United States Patent 7,745,391 (HUMAN THROMBOSPONDIN POLYPEPTIDE) - sequence listing, part 75

SEQ ID NO: 270831 - DNA, 1111 bp, Homo sapiens
tctttgctttaaaaggttggaatttgtgtctgttttatgtgctgcctgggtcatagtatatgctcagtgaagcaattacacattaacccatttagcagtagaaagcaagggtatcagacaaagtctaatgacctttatcttcccagccaagtgtctgcaacagagtgagtgctcagttttgaattacagaattaataaaagcacagaggaatgagaagaaagtttaatttacagatgttcacaaactctgtcctcattagaataaatgtttttgatatattcagacctcatttagaaacaaagccatcaaatgtgattctttctaaatcagtacaaatttttccttatattcactctggcataatcttcaaactctattaaggttttagaatgacaggttctgaaaattaataccaaatgactatctcagcagtgttttcccattatacaaataccttccctcatctctgatgtcagtttcctgttgtcattttcataatggcagtaagttagaaatataaccattttgtattactacatatgaccaattttaatatttttttgccataggaaaaacatcatagttattggaaatttgttttataactggaaacagaaagccttactttatatagttgaattcagctttcaggttgagggaagtgctactggtactctttttcaagtcatggatagcattctgccattcctgcacagcagcgcaatcggcaattgagatgtagcactcacacatgctttatttcctaaataatttataacctcaggggaagagcatccctgtcctgtgccagttttcaaagggaatgcttccagttttttcccattcagtatgatattggctgtgggtttgtcatagatagctcttattattttgagatatgtcccatcaatacctaatttactgagagtttttagcatgaagtattgttgaattttgtcaaaggccttttctgcatctattgagataatcatgtggtttttgtcattggttctgtttatatgctggattacatttattgatttgcatatactgaaccagccttgcatcccagggatgaagcccttgatcatggtggataacacgtcgcga

SEQ ID NO: 270832 - DNA, 433 bp, Homo sapiens
tatcaaactacttttatcagacgcagaaagagagagaactgggaaggaacaaaggagaaaggctcaggtttaacatgtctgagataagaacctgtttccaagtgctttctaaaaaccccacaagaaacccttttgcatccttcacacatctcctttgattaggtttattactagatattctttaggactgcaataattcagatgaaatatttgaagaacacttgcgtctccactgataaactgacaactctggctctgaacctctggaaccaatgacctctgtttctaagcagcttatgtacgtctttttgctaataagtgcttctctaccctttccctcactaaattcactagtggcttgccattccatgccttccagattgtaatatccttgtttctcattctcaaataaacacattctctagtgtttaga

SEQ ID NO: 270833 - DNA, 432 bp, Homo sapiens
ccaactaaccacttcagtcaacccttgtgaggcgcatgattttacctagttggttggatgggcgtgaggccaggcatttggtagctgcttagtatggttttaactgccttgtttctgaactaccaccatggtgattccaaggcgagtccaacagaagttgagcctgtgggagtggttcacagcatatgccacagtgcttttccagatgtccaggggaatccggagaggtctctgtctacattcacttctcctctggagacaaaaccagtgtgcaaaaggagggaggaaagcaagcagaaagcctacttaattactctctgtatgcctccaaactccctgtctttggatcctcatctgtagagtgaggagtacagagttggctactttgcaagaatagagtgctgttttgcaagttacagcttttcaagtccc

SEQ ID NO: 270834 - DNA, 366 bp, Homo sapiens
gtatcttcaccagcccctgagttgctgcactgtgaactgggtatacagactgctaatgctttgttaggagttctttcaacatggaaactacttgatacatcagctttgaagcaatgcggcatacgcatgctctagaaaggtaaaatgctaaggtctgtcctgctgaagagtccagtggccacaccagtttcacattacacagaacacagcttcttcacaacctctgaccatctccatcctctgaagtggtccactggatctaatgtcccaacatgctgtgctatttgtaacatgctgagcgtctgccccacttacattctttacctcttctatatgatgcattaaaatattttgtgatccataaaa

SEQ ID NO: 270835 - DNA, 409 bp, Homo sapiens
acaaatttggagatggagttctcactgaaataatccaccctcaaatgacctagcttcagaaagtgatcatccccaccacgtaaatgatgtgtatcccaatcactgaagatttaagactgtgtgtgtaccccagtgactaaagtataggttccttcctttcacatagtaacaacccattgctaactggatgctaaacatcacccctaaatacttaatttgctcctgttatctgggcctacaaaaagatacttgaaagtcggtatacagaaaatttctggaagaactgcttaagaaagtgataacaatagttacctctggggaatgggactagatgacttgaggatgacacactatttttgtaccatcggcatttatttttataataaaaaaatacactgggctcctatca

SEQ ID NO: 270836 - DNA, 312 bp, Homo sapiens
aacctggattggttggttttatatcaaaagcccacccactggagaattgtttgctattcagtatctaggaattagctagaccctccaggatcaagatccaaaatgccagggcatccagaatatagaaaacaagaaaatacagtcaatacacagtttattgcatatcaattattccttaataataaagctgtttaaaaatacattagagagcccttttcagcaaaatcctatgatgctccaatttaaaataaagcaacttgttacaactactaactaaatcaaatagcccataactatttaggcaaactaaaa

SEQ ID NO: 270837 - DNA, 566 bp, Homo sapiens
aaacaagttagctcagactctgtccttcctgtggcatgttcttaaagttctccccaaaacatccaggctttgggtggggttgggaaagatagctggccttttagagacaaagggatttaggagggcagggagtgagtctctcccaggcacatggctggttccctgattcaggggcatccccagcatttctataccaggtttgcatcacctgggcagacaggtttctactctgggcaatggtttcttggtgagaaaggagggggatgggaaggcatctacagaagcctgacctgtttccagcaaggacccaccctcagtcagtcagtcagtcagtcagtcagtcagtcaagcagttggcccaagatttaggccacccagaatttgcacagggtgttgccctgttacccagaacaacctactgacagggagaacagatctcagatcaaacatgcacacccacacacacagcattcacactcacacacaaacatgcagtctcactcatagtcatagaatcacacacacacacacacacacgtgcacacatacataactgaccagagctt

SEQ ID NO: 270838 - DNA, 373 bp, Homo sapiens
ctggagtgagtcagccagccctgaggatggtggtgagtcagaaacagctgggattatccagaactgcctgggtctgggccactgaccttgtgagtaaatgagagagggagtgagagagagagatagaaagagagagagagagaagaagagagagagagagagaaaataagagaataagaatgtgtgtgtctcagagggccatggcaatggaatctttttcagtagtatttttctttagattattttctccctggccctggatgtttgagatgcatcagaggcacaatctgcaggttctggatttttttttttttttttttgaggtggagtctcactctgtcacccaggctggagtgcagtggcgtgatctcgg

SEQ ID NO: 270839 - DNA, 387 bp, Homo sapiens
gttaccaatattcttttctgtggtctagcttaggggttggaaaactgacccccaaggccaaatctggcccaacagctgtttttttaaataaagttgtagtaaaatgcagccacacacattcactcgcatatcatctagaaccactttggctctacaaagccagagctaagtacctgcgacaaagacctgtggcctgcaaagcctaaaatatttactatctggccctttacagaaaaggtttactaactgctgttctagattgatcatcgtttgcttaatttgaggtggtttttttgtttttctctttccattttgaaactaaggctggagatcgcatcactgcactccagcctaggtgacagagcaacactccatctcaaaaaatta

SEQ ID NO: 270840 - DNA, 385 bp, Homo sapiens
cttcatgtaacttgctggttctcctccaagggcgcagatgggaaagtggaatctttcagctacttatcaaaatctgatagactctgggggctggatgttccttacccctggtacatttcacccattttcagtgccaggcccaagcctctgacctctgggcaagtggctaggacttcagggaaagcctgcagcctcctcgcagatcagtgttctagggcagtgctccctagaactgtaatgtgcacacaaatccccagagatcttgttaaaatgtaattctgatttcttaggtcttggtgggggtgggggcaaagatctgtgttgttaataagcttcaggtgacactgaagctgctggtccaggggccacaccttgagtcacaagg

SEQ ID NO: 270841 - DNA, 476 bp, Homo sapiens
caccacggacgggcttacgggtgaaggcgaccacagctgagccagtggggctggttccaaccaggctacgcaccatgaaatttcaattcttaaattatcacatcataaaatacgctgcttttgattttttccaactatttaaaaatgtaaagaaacattcttagctcatgggatcctcctgcctcggcctcccacagtgctagggttacaggcatgagacactgtgtccggcccccacgtttctaaagcaagaggtgacaggcatgttcaggatccatggaaagaggactggtgagtgcgtgagccccacagccctcaccaggaacggacaggagcctggcacaccaaagaccatgacacgcccaccgagtgaaagagcccagagtgggctgagactgagaatggacactttgataaatgttttaaacatgttgcctctacgaagacaggtttctaaaataatttataaaaacaaa

SEQ ID NO: 270842 - DNA, 231 bp, Homo sapiens
tctcaaaaaaaaaaaattttttttcagataatctggaacggtaaaaagaagagagtaaaattacctaaataaattaccaaattcccatcatctggaggtaactattgatagcacagatttttaaaaaatgggttatcatataatgctttctattttttatcctgcttttttaaacttaatttttctacttacattgttttatgctaataaatatatatcttcatttaaata

SEQ ID NO: 270843 - DNA, 417 bp, Homo sapiens
ggtgttgccgggttttttctttaataaaaaccgtaattgagggggctcttgagcagccgcttgctcaagcccaatcccactctgaattttcttcaataaatctgtgcccacactggcattttgttcagttccttgcccaatacaccaagaacagcaggtgcagcatacaggccacatcctggctggacaactcacatttaggacactctctccggcaacaggtgacatcatcctcttagcctgtcaaaatgttggtattacaggcatgagctgccctgcctggcctataactttttttgctgaaaaatattcccttgtatgcaggtattacatttagccattcatcagctggtggacatttgaactgtttccacttttgtttactatgaataaagctgctatgaacacctgtgtaaa

SEQ ID NO: 270844 - DNA, 784 bp, Homo sapiens
ctgctattcctctggtgttatccttcaggattgttccaagtttatttttcaaaatatttacttcacattattctatataagtgattacttgtcagtattcacatgtatcttagctaaaactagagaatgccctaatttagatggtttttgaagcctgtatatttggtattgtttgacccttaggtgtttttacatctcttagcacggaagatgaagaaagctgtacattgttgtttgtttaagagtctgtacatttagaccagatttgtatctgcactgtcagtatggcaaatgagtgaaaaacgtttaatacagtattggatttctttctttttttttttttcagcttataccagggcttaaaacctcaatttatgttcatgacagtggggatttttcttgatgtccacattctttctaataaactgttggaagacttcttggctgtccttttaagtgtctggcttactgtaatttttatgtatttaccacttactggaatggagtttttatttttaattgaggaaaaatttgggattatttctctgtttgaaaaaagaggcttgctgtaatgtcataggaaacctttttaaagtggatctgtaatagaatattgtagatgcactttgcagcaattggaaaagaaagtgttgtgatttgattgaaataaaactaaatgtgttgtcctcctctaaaatatatatagcaataattagtagttatgctgaaattaataatttgaaactatgtttatgtactgaaaggatacatttataatgctgtt

SEQ ID NO: 270845 - DNA, 306 bp, Homo sapiens
ttttgctatatagtgactgttagccagtaaaaacagggaagattgattaatttagaagaaattgaaagaaaatatatttattaatgttgcttttaaatgcaaattatcagattgaggagaattttgagaccattgacatttttctaattatgactaaaatttaatcactatacttaataaacatactctattcaaggtcttgtaataaaattatagggaggaataaaacataattgaccccagcgacatcagcaaaaatgggtggactaggaagctgcaagcttttgtttgcctatcaaaacatta

SEQ ID NO: 270846 - DNA, 728 bp, Homo sapiens
gagccaccgagcccggccggtccttattttatacaagtgattaagccaaaaattttcttgaatttctgataccaaagagctttaggtaaataacttcacactctaatgcaatgtaattctttctttgtgctttcagatttccttacacttcctgtccagttctctcttctaaatccaatattactcactagataatttcagccacttaaataaaaatatctatttttaagtcctggttcaagggttccaaactcacataatttctcaactttttgccagaaagttgagcatttattcatacttattttcaatcctaagtgttctcccatgggcagcagcacttcttgagctgtttagtactgccacacctttttatgtctttactatgtcagcctctgatcattttcactttgaacttcctaaagatcacaatttcctatcccttcaatctgcgatccctcttcttcctttcttactagattatggtgtagtttgtactagactgactcattaagaccttgtacgcttcctgagtctgcttgttactggctttgtaatcaagggtgagtctttttacttctctaggctagattttctcatttatgaaatgaggacatttttctagatgctgtaaagccctttccagctgtaacattctatgaatctgtaattccctcgaggagctaaggaggattatgctactttaataaaaagctgctttggtgaca

SEQ ID NO: 270847 - DNA, 488 bp, Homo sapiens
ctcttctctttgtttcagtgatcatcaaataccagatgcctcaatttagactaattgaatagaattttcatgatggagtctggatatatactttttactttaaataaataaatatgtatatattttgtgcatatatgtattttaaaaagctctgttgcccttttgggttaatttacaaatatttcctcctaagaaatatgtaatctcagccaggtgccgtggctcacgcctgaatcccagcattttgggaggccaagcctggcagatcacttgaggccaggaggttaagaccatcctggccaacatggcgaaaccccacctctactaaaaatacaaaaattagccaggcatggtggcatacatccgtaatctcagctattcgggaggctgaggcacaagaatcacttgcatctgggatgtggaggttgcagtgagccaagatagtgctactgcactccagcctgggcaacagagcaagactctgtctc

SEQ ID NO: 270848 - DNA, 463 bp, Homo sapiens
cagccagtgggaggggccacaggctgccctggggtgtggagaagcaccccctagctccccatcccatgcactctggtctatttcttcctacatcccagatggactcacccgattcaagaggcccccatcacatcagcttcagccttcatcttgggagtccttaaatgcaggactcaagagtctgcatttgttcttaaggacaggagatttgctttaactcagacaatttctccttatagactcctttcttcatagtagaaagagaaggagcccccaaaggcacatcctcctagcaggtggttctggcccctgttctgccagtcatctgcatgcagcccaggcgtgccactcagccacactgattctcaagggcctcaccaggaacgtttttatctttgccctatcctccaggatgatgagaataagagaaaaataaagcaagtatcgaaatttctcctagaaa

SEQ ID NO: 270849 - DNA, 411 bp, Homo sapiens
gaggggttgaaagtttccatattgaaaatgcctaccacttgccaggaggaagagctgtcctaggctgcccatattcaaacagcttgctagtaatggtataccaaatgtgtaaaaacattaaaaggtagaattaagtccaatttcccttaaagcccttggctcccttttattctttgctagttggaaataagcattcatttgccagaagctgattcttggatctcagggattttattgttgacaaacaaaaacttacttgtttatctcagggactgggagggtggtagatgtcagggaatggaatctgcatgtgcccagaacctaatccaaacccataaagaagcaagaaaaataatagagtggtacgttgactcagtaaaaatatattttgtgggtcaaattggggtcaaa

SEQ ID NO: 270850 - DNA, 459 bp, Homo sapiens
atttcctgcctgctgcctgccctgtagataacagacattccagtcctcacaattgcatcagtcaattacttaaaataaatcacaagtatctttcaaaatagatagactagataggtaggtaggtaggtaggtaagtaggtaggtcagtcgatcccagatcttattagtctgttttttgggaagatcctgaagagatttacttccagaactaaatgtaaagagaaatgttaatagaaaaaatagagcttctacgatttaaacggtaatttcaaaatgtaaaaagtatgcatttttaaggtaccagaaatagatgaaagggagaatggacaaaaagaaatatttgaagcaataatggctgaaaactttccagaagtggtggcagacaacacagcacagatccttgaagtgcaaagaataccatgccaattaaacaccaaaataacaacgataataactaaa

SEQ ID NO: 270851 - DNA, 324 bp, Homo sapiens
tcttgggatgctcacccctggaaccttaccatcgtgccaagagcaaactgaagtagcctgtggaatggaactgagggccctggttgagctttcagctgagccagcactgtcttgccagccagtgagccatcttgaaggtggatcctcccacacccagtggagcagccccaaatgataccacatggaacagatgagctgatctcactgagtcctgcctgaggtgtagtgtgagcaaaacagatgactgttactttaagccactacattttttaatggtttgttacacaacagcagataaaatgatacagtcaccccactgcattc

SEQ ID NO: 270852 - DNA, 493 bp, Homo sapiens
atagaatccattaagcatggtggggtattggtgtgaaaggagatgtaaattatccatgatcatgcttgaaatgcaaaacctgatcatgtttggcatcaggccagctcccattaaagtaattatttttaatcatcagcacttggtgacatgaatactcatatttgttgatttactgagaaaagcactttatattgtaaataaaaaggatggaaaatatacatttggattttagaacaaatgataatgattattctcgctttctgagggtctttccttggataaagccagaaaaaagtctgtttccatgtggctcatatgtggcccccatataaatgtcaatggcggcatgtgtgagcttatttttatgtcccattttcaaatgggatagttggttctattcttaaatgaagatcggggaataggggatttctgatgatttctttcatggcaaccaaaggagacatagaaaatggctattaaaatgtatcctaac

SEQ ID NO: 270853 - DNA, 532 bp, Homo sapiens
atgttactattataacttgtggttttataataggctatgaattaatgatctcattttatcttaactcatactaccccaagaggcattatcattatcactaggttacacaagaaaatgggcctagaaatgccaaaagtatgtgcccaagatcattacacaggttccagttctaaattgacacacacttgtttaccaaaatgtttccttttataaagcattttgattgcatgatggtagtcacttctttttcttttgatatactttggtataatcatgattgtccttattgtatagaaaggaactcgtctgaagcaaagagagttcaagaaagtggccatactcagacaggttaataaatgcatccaaacttttaacttacgacactgtattttgctttttcctaccttataggaaagaaattaaaagtgtggtattgaaagatgtacaactgactttggaaaaaggattcctctctaattggtgtttgtaagtgatcgaaataaacatttttaaactatcatttgtggaatca

SEQ ID NO: 270854 - DNA, 570 bp, Homo sapiens
ccctcctttgtaacggagagaagcgcggccccctcccggccgcccccgcgctcctcccccgccccgcccgcgcgcgggaggatcacgaagggaccggggtgggagcgggcagcgtctggggacagcgtgttgggctgtggggaggttaccgaaaggaaacgggccgagtccagttgtttgagcggttttctccttccacgagcgtgtgtgaaaaagcgcggagttgggtggagggcagctgccaggactgcctcctggactgggtaattgtacattttttcatcctacatctcaagagaccaagggacctaagtaaattgatctacttgccaatgactgtaagaaagacaaagaagttgtaaaaacatccaaatgatgttaaacataaattagctcagaatagtttgcagaagataaactaccagcgtcaaagcatgcattaaaaactggaaagaaattaaaagtgtggtattgaaagatgtacaactgactttggaaaaaggattcctctctaattggtgtttgtaagtgatcgaaataaacatttttaaactatcatttgtggaatca

SEQ ID NO: 270855 - DNA, 363 bp, Homo sapiens
ccctcctttgtaacggagagaagcgcggccccctcccggccgcccccgcgctcctcccccgccccgcccgcgcgcgggaggatcacgaagggaccggggtgggagcgggcagcgtctggggacagcgtgttgggctgtggggaggttaccgaaaggaaacgggccgagtccagttgtttgagcggttttctccttccacgagcgtgtgtgaaaaagcgcggagttgggtggagggcagctgccaggactgcctcctggactgggtgcggtaaggccttagggatgcattcagatgtagggtgccttattttgggccgagaaagctgtcaagtgaaagatccaaggggaaaggtgggcctggat

SEQ ID NO: 270856 - DNA, 398 bp, Homo sapiens
ggaaaaaagaattgatatttaaagccatttctaattataattttgctataacttgaaagggtgatactttcctatcttgtgtacctgggaaatttggtggtcgatttaaacacccatactaacaatagggaaaatgtatctttccagtgattttaaggactgaagagaagacttctctgagtcaaacattcttttccatttagaagtaaattgttctatacaaaatccaaagatacttctttgctatttttatttttattttaaaagaccttaaatctaatgtattaggcaaaggaagcaagcacaaagtaacttgggaaagtgtttatagaaatgaggaatataaagctgttaagaacataaagtgggaaacactgctttatttggaaaagaaagaa

SEQ ID NO: 270857 - DNA, 423 bp, Homo sapiens
ccttacctgtactctttccgtctcattcaccacactcttgaaaaccaataatttataaaattctgttaaataaacagatgaatgttaaaagaaatgaaggtaactgaattatttgaacattcaatacaaaggctagaaagcaggaccacgaaatggaattctagttatgtgaatgctgatgctgtgtgccagcatttgaattggtagatctcttcatattaaatcttttttacaatattccatcagagaacattctacttcagttcaggttagattaagcacaccacctttgctttggctttttttggtattcttatcactttaagaaattattttattatttacctatttcttaaaacattaataattttctactacatttcatattttaatttattccttaaaaagttaagtgtttctaaa

SEQ ID NO: 270858 - DNA, 441 bp, Homo sapiens
cattccaaagtgctggggttacaggcatgaggcaccacacccagccttacaatagaatatctaaaacatttaagggatttttttctctttggataattaatgatagtttctatttatgttacaagatagtttctacttatgttacaataattattctatggatagaattctgttacaataagtatctctatggataaagctacattgatatgttgttgctggcccatgtgagagaggcatttcctaggtaatgcttgctgccactcacaatctcaaagcatgtgcttcagttgaaacaaacaaattacatatcatggatctttaaataagtcttgactgttcaaaacagtgaaggtgaaattcttagttgctaaggtctattatgtttctacttatttgtttacaatacttatttaaataaaaagagtacaagtgttttag

SEQ ID NO: 270859 - DNA, 457 bp, Homo sapiens
tatcatcataagagtcattttctttctggtgctagcagcattcttctgttaaggtaggtcccctgtgtctgtcttcttgaaagtgggagttcaaactttctctcttttctttcttctcatcatgactagagtatacctgagcagatatttgtgtttgtacattctagttcagtgatattcatgttttaatcattggaaagctttaaagaaatatcagtgcatgtatcatttttttaaaagccccccacatgattctaatatatagccaaggttgacactgttcaagagcagtgtttatcaaactttaatgtgaaaatgaatcatctggggatctcgttaaaagatggtttctgctttcagtagatccaggatagagcctaaaattctgcattttcaacatgcagaacactttgagcagcaaattccagaacaatggctctcaaactggtatacaaaa

SEQ ID NO: 270860 - DNA, 438 bp, Homo sapiens
aaattgtaatatcctcccacccttgatatctgaaaatttcctgattttgatactttcactgtggttttgtaagacagtgcccttagaaaaagtaccctgtagtatttagggttaagagaggcaatttactttcaaatggttcagaaaagaatacagatataggccgggcgtggtggctcacacctgtaatcccagcactttgggacaccgaggtgggcggatcacaaggtcaagagatggagaccatcctggccaacatggtgaaactctgtctccaccaaaaatacaaaaattagctggacgtggtgactcatgcctgtagtcacagctactcgggagattgagtcaggaggatcacttgaatccgggaggcagaggttacaatgagccgagatggtgctactgcactacagcctggcgacagagcaagacttcatc

SEQ ID NO: 270861 - DNA, 453 bp, Homo sapiens
accacaatctgaagtgttattcttgcttatgcatgtacatctgcatctatgtatttgattgttgctatgatgcctctcactagatgtgagcatcaggaaggtgtccactgctatgttctagaatagctgctagcacataataggtgttcaataaatatttgttgaataaatgaatgcatgaatatatgtaagaggttaacattcgtatatgcattataataaaattatctagtgatattccattagaaaatctcttcagatacagtgtctttaaaagagtaatttaaaagataaacctcaaatgactccaacattctgtgtaaatttctgaagttgtgggcaaatgagagtgttataaaatgaagcccattttgaaagaatttaaaggaaatttacttgaagatgtgaaaaacctttactgatcaagtgaattatcacactcattattctgtt

SEQ ID NO: 270862 - DNA, 402 bp, Homo sapiens
cagtttacctctggggaaggaggctgcttttggggctgcgggcgatggctgggcggatgatatggaggctcagggtgcacaggtgcccagacgccctgagcagattaaacactcccccggcaatctggttttttgctgtcctgagccctggactttgagccctgagcgccgtctccaagcaaatctttgctccttcccccacctcactttgttttggggcacgtgacttttttcctgggagctgtatcttggagggtgggggtgccccagggccctgcaatatcttggaaagggactagcacttccttttcccagtttctgttctcctgcttcccctcaccttctccaggccctggaccttaccctgaacaatgaccatttctcttttatttgagatggagt

SEQ ID NO: 270863 - DNA, 507 bp, Homo sapiens
attcaccattgcactccagcctgggcaacaagagcgagactctgtctcaaaaacaaacaaacaaacaaacaaaaaaagtcctataacaaatcataacctggctctgcttgttaaagagaagtcttatactctctttagttacagaaaggttcaaagggaaaagtggaggcttaaaattagattgtgctgcatatcattatgcctctattatttgttacagagtaatttaatttcttagtcactgcagcaataagaaatatattctaaactgtagttgtccctcctgcctcagtaaacagagaataatagagaaaaattaagctttctttaaaaatccaagctgtatcagtgtcttagagtagtcataaatggcactaggatttttgagtactcgacttgttggaggtgtaggaacttgagctgaatatgaattgaccgagactatattttgaaatattagatttgagtcaatatcagattttttcttgtgatttaccattttattca

SEQ ID NO: 270864 - DNA, 333 bp, Homo sapiens
tccgagagagctgcctgggctgtcaccccagtgcttgggacacagtggaacattcctgactacctactttttgtgattaaatagggacattgttaccagagggctaaaacttccagcctctcagattcgccagtggacagatgaggtagtcagagaaagcacaggaatgaggctggccttgactgggaataactaagcagcatttgcataaggcaagaaggccctttttcaaactatggctcatcacccgggatgatgctgtcgtgaacaatttagtgggttgtacataacatcttgttaatgacagaaactacttgttttgtggattgcaaa

SEQ ID NO: 270865 - DNA, 448 bp, Homo sapiens
gttgcaatggtgcgatttccgctcactgcacttccaccttccgggattcaagccattctcctgcctcagtctctggagtagctgggactacaggcatgtgccaccatgcccggctaatttttgtatttttagtagaggcagggattcaccacattggtcaggctggtctcgaactcctgacctcaagtgacctgcccgcctctgcctctgaaagtgctgggaatacaggcatgagcaaccgcacccggcctggattaattgaaaattttcttctgtagattgtaatatattactattgttatctattttattgccccaattttctcaaatttggctatggaagtttattcaaagtggatctgtttccctttcacattttccccattttgtgagcatttccttacttcctaacatgacaaaatatttcaaactaatcttgtattttccc

SEQ ID NO: 270866 - DNA, 417 bp, Homo sapiens
gacaggagaagacagatccatgatcttaaccatctcagccccagacaggggaccgcgtcatttccacccaccttccatcagcaagaaccagtcacatgagcacatctaacagcaatgaaggctgggaaatacgtgcccaggaagggaggaatcagtttctttgcagaggagagagggaacagaagagagggaaagggggaaaatagagagacggagggagagaaagagagaagaactaatgagcacagaactaagaaagcccaggcacagtggctcacatcagtaattctagggccttgggaggcaagacaagagaatcacttgaggccatgagttcaagggcagcctaggcaacatagtgggaccctatctccacaaaaataataatattattattattaaataaaataaaaggaa

SEQ ID NO: 270867 - DNA, 317 bp, Homo sapiens
aacttggacttaatccctttggcttcagtcccttttccctgctcatacttcactctgaccagtgcccctgttccagagcttctcatacctaataattcaactagaggttaagacattggtatcctgcagagtgaaaagtcagaagaaaacagggaagaaatcagttagcttagggttgtgagacaggaaacaaaatctgggcacctagccactttcaaccattctccttgttttcagcaaacttcactaccaacatcccaacaccttgtgcctccatgtcttaaacctttctgggtgtctggagggcaaataagact

SEQ ID NO: 270868 - DNA, 475 bp, Homo sapiens
aaaacttggaaaggttgtaggtctcaaatgcttggggtttaatggctttctaaggccttaggttcagtggaaatgaaattgaaatgccaatgcatagagacctacaaaggcagcaacagtagtgaacagggagaactagaaaatgactacttttggctggacactgacctgaagaaaagtgtttcttaaggaatgaatgctaatactatactagtactgtagtataactatagtactagtctcacatggttttgaggttcatatttgtattgtccacatgctctaataacatccaaaccaagaaattaccatatatgtaaatatttggacatctggtagtagcatacgcaaaatctctctggaaggacttacccttaacccaggcccaacaaaacatccacagaattaattgctaggaatttcagatattgggattattcaagtctttaaaatagttatgttcaaaatgaataaa

SEQ ID NO: 270869 - DNA, 248 bp, Homo sapiens
ctcgcccggttcccgccgcagcacctcccggctcgacagcctctccaggacactcagcccttccctgagccgggcctctggcctaggccgggagagccctgattctcgcctgtccctgggccggagctgcctagaggagtgggatgatggagccagtatggccctgagcgaggcctgctcgcagtacagccacccgtcgctggcccgcagtctgtcggtgccaccccggccacgcagctctgcctcgg

SEQ ID NO: 270870 - DNA, 238 bp, Homo sapiens
taaggttcacaacatttctaactcttcaaatcaagtattattttggaagttgccaacttaacaagcaactttgactccatgcaaactaaaaatggcatttgaaagttgaaatttcattaaatctgctgttttctgagacttcatccaactgggacatctgtttgtaacaccaaaggggtatgtaatcccaaaattatgattggattatattcaagtcattaaaaaagatgaattcatg

SEQ ID NO: 270871 - DNA, 382 bp, Homo sapiens
cttttgtcgaaaaaatatttccaaggtagttcttgtgttgtgctcaggcacgtgggtaaggaagcaatagtgagtgcttccttcttgcctgccagggaccttgtgcatatctgttggctcattgcatcttagaaactcctgaagaaactgaggcttggggaggttgcctgcccccacgcacccctcagggactaagtgacagagctgagatccccagtcggccagacacaaagccctcctactttctgaagccccaccctgctggggagggagaactggacgccatctgggaagaattaaggaggtttttagaaaaggcctctgcaggaatgagaaaaccttcattagggctttttaatcaataaagcaggaacaaaacctc

SEQ ID NO: 270872 - DNA, 300 bp, Homo sapiens
gaagtggggagaagtgaaagcaaaatacatcttggtggggaagatatagttgagtgtctttttttaaatatgtaatagcgtatagtgtctttgattataaggccagtataaccttgatagcaaaacctgacaaggatactacaacaaatgaaaattatagctcaatatctttcatgaacatactgcaaaaattctaaaaacagtagcaaatcaaaatcagtgacacataaaaaggatcatgtcttattaccaaatgaggtttattccaggaatgcaaagatggtttaacatttagaaatt

SEQ ID NO: 270873 - DNA, 389 bp, Homo sapiens
gtcctcattaagactgaggttctgcgggaaatgctgaatctgaaaacattcttcccctccatgatgcacccttaaagtagcttcatccagactgaaactcaaggctgggcatggtggctcatccctgtaatcccagcactttgggaggccgaggtgggtggatcacctgaggtcaggagttcaagaccagcctggccaacatggcaaaatcccatctctagtaaaaatacaaaaattagctgggtgtggtggtgagcacctgtagtcccagctactcgggaggctgaggcaggagaattgcttgaacctgggaggtggaggctgcagtgagccaagattatgccactgtactccaacctgggtgacagggcgagactccatctcaaaag

SEQ ID NO: 270874 - DNA, 387 bp, Homo sapiens
ctgccaggattgctagcatataccatatggaaaataaaaatcattctttgtagggggaagggatgctctcttagatattctatctgggaaagaacatgaaaatacatagaacatgaaaatagaaagtagggcatgcaatctgagctacatataataatctttgggagttcaataccacaaaaaaattctttttaaaaattgtgatttctggctttttcctcctctttcccagatccttagcttccaatgctgataaaatatctgaattgctgctgcagaagcatacctctatattctcaggcttctgaaattgtgagtgtggaaaaaggaagtgtcaaaaattgtgtttgactttctaatatccaaggtaaagaaatccccaaagat

SEQ ID NO: 270875 - DNA, 338 bp, Homo sapiens
tctgtcacccaggctggagtgcagtggcgcgatctcagctcactgcaacctccacctccagggttcaagtgattctcctgcctcagcctcctgagtagctgggattacaggcacatgccaccacgcctggctaatttttgtatttttagtagagaagggatttcgccatgttggccaggctggtctcaaactcctgacctcaagtgatccgcccacctcaacctctcaaaatgttgggattacaggcgtgagccaccgcgcctggccatgtttgtagtttttctaccatcagcttcattgcctcctgctcacagacaccagcagtagccattggtgcc

SEQ ID NO: 270876 - DNA, 396 bp, Homo sapiens
aaccatggcagtatgggcttctttgatagactcaggaaacaggtggatgcaatacttcatttagaaaagatgtaaatatatcttcccaggtgtacttaatttgtgtatgtcctggaatcataaaaccttggaaactagaaaggaaagagtctcactactgtagcctacttaattaatctgccctgtagttcatttgtttgtacaattgcatttctagtgttaagtgcatggagagcctggctactggtttcctgatgccttcagcaggcataaatcacctacagaggcagtggcaacatggtcctcgtttttcctccgaaaaagctttcctcattttctcaacattttggattccaagacaaagtggttaataaaaccagtagttctgtttcagtt

SEQ ID NO: 270877 - DNA, 358 bp, Homo sapiens
agatacaaaatcatttttatggtcatgttattggtcagaagataagtgaatgggtaaagaactttcagaagagaaaataaaacaaagcacaagaaatagtgggattagaaaaatctctacgcctacaaaggttactcttcctggaagtgagaaaagaagatacaaaagattccaacaagaagcttccagtaaatgaaacaagaacatatttcccagaaaactggataaaactgcattaccgaataccctggactagagaaagcttagatgttcctcgtggcatctctcacttgttctggaagtattatctttagttaggggtatttccttaactaataaagcctagcattgctgttgt

SEQ ID NO: 270878 - DNA, 331 bp, Homo sapiens
aataaatggaatttaaaattaaaaataccatttacattagcacagcacccctaaaaatgaaatacttagatataaaatataacaaaatatgcacaagatctatatgaggaaaactacaaaattctaatgaaagaaatcaaagaactaaataaaaaaaaaaaaaaaaaactgaaaaccactaacaatcattgacacattgtaactatgtaaatattattgatagaaaaattagatactaggattttattctcctctccacagggagtctacaggtactctaaaagactattcaagtttaagattacagagttttaaatttacaagaaaaaaa

SEQ ID NO: 270879 - DNA, 315 bp, Homo sapiens
tgcatgccaccatctacctcagatattcaaaacactacaaggaactcattcttctgcagtatattttgtgataggccctgttttgttgttgttgttcctttgctctttctataataagcagaaatacatgctagagttgcaatacatctaacaaaggtcctaagtgaatctatcaaaaaccaatgccacgtaagtgatcattctctcatgtagattccagtgaggggcctggcaacatcatccacaaattcccaagtaagcaacagtcttttatgtgacagatgttaaataaatgtttgccatactgtattgaaa

SEQ ID NO: 270880 - DNA, 437 bp, Homo sapiens
tggtaccactccatcattgaagagaaaccactaccacaccactagcaccatacagaaccttttctctgtatctttgtacaatactacaaaggggtaccagggaggagagagtggctgaccactttagtgacaaaacagcactccactgctggtgaatcccatctaattatggtccttccacccttttcaaccaccaacaactgttcgtactgttaattcctatcctgaaggtttaaccagtggttgtctagtatcttctgtctttagaacagtggttctcaaactttagtacacatcagcatcacctggagggcctttttttaaaataagacacagattgctgggctcatggtcagagttcccagttaagtaaatcaggaaatttgtatttctaacaagtttataggtgaggccaatactgctgttttgggaactat

SEQ ID NO: 270881 - DNA, 206 bp, Homo sapiens
caaccaaggccttgggaacatttgaacagaggaagaaaaataaattggaggtgtggtggcttatgcctgtaatcccagcactttgggaggccgaggtgggaggatcacccaaggtcaggagttcgagaccagcctgaccaacatggagaaaccccgtctctactaaaaatacaaaattagccagccatggtagcacatgcgtgtaa

SEQ ID NO: 270882 - DNA, 157 bp, Homo sapiens
gttgcttatttcagggtatacctaaggagacactagttacttgaaatatttgaacagttcctaaagacaagaggcactattttatgaattaggatatcagaaaaagttttaaaacacggaaattactaggagacagttttgtatatgtatcataaag

SEQ ID NO: 270883 - DNA, 433 bp, Homo sapiens
aaataaaccggcagttaaagcagggttgcgagagcgagaaaaccacaggcctgcgcgccgctgataacgcgcgggcaggcagcttttgcagaagttccgtcgctgcggcgcgctgcgcaccagagctgcgccaccgcctcccttcctgtctgggccgctcgcgtccccgccgtttctggctgttgctttctgcgtcgctctttcagttacttcgcccattgctttttctaaaggatccccttgctgctccgccatgagggatggatccaccaacaagtccccgggcggatgcgcgcagatcctggacccataggaggccaaaatttacgagctgtcatgaaaatgacaccgtttaagagaagctgaagttgctttctcttctgcagtatgtaatgctttgacctggttaaaataaataaataaataacaattt

SEQ ID NO: 270884 - DNA, 790 bp, Homo sapiens
acacagtctagatcttcaaggaatcagagtccagtggacaaataaatacaatacagtgaaagggcacaacaaaaaaaagtatgcataggaagcagaaacggcataaaggagagagttcttcataacctgggatgaagtgagatctgggttggaaaagtcctcctgtagcatgttcatttcaaaggataaacaggaatatgccgtaagtcaaggtggacacatagttatgcagatgatctcaaacagaaattatttcttcaaatgattcgatttagctttggaatggaacgcatcatatctactcttttgtagcaaaagacttgttttcagagttttactatgccagcattagcttggagaaaacttgtaaaggaggtaaggtaccttcccaaggtgcctctcttctccctacatctctagtaagtagagggggtagcatgtcctacccactcataagggcttctattccagtatttctgtgttattcctcccattcaaaaccctcccatcctatatcttatggccacatagtgttaataggagaaagaggtggccagcctgtatcacgtgcttgcactttaccaagaaactcaacatttaacccaaatgaaagatgtgaaagttgtactatctagtgggaaatacattttggagcaggtggaaaatttcaacatccccctataaaagcagctgtgtaaaagtcagcttgattggtagtttacttttaaaaatattgatattcatttgcatccctagaagtcacagaaactgtcagtggcataagccaccc

SEQ ID NO: 270885 - DNA, 362 bp, Homo sapiens
tttttttgagacagagtcttgctctgttgcccaggctggagcgcagtggcgtgatctcagctcactgcaacatctcctgggttcaagtgattctcctgcctcagcctcccaagtagctgggattacaggcatgcgccaccatgcacggctaatttttgtatttttagtagagacaggatttcgccatgttggccaggctggtctcaaactcctgaccttaagtgatccatccgcctcgtcctcccaaagtgctaggattacaggcatgagtcaccatgcccagccccttctaagagctttatgtgcagcacttcatttaatcctcatatatataatatatccccttgaagtgagtagtatca

SEQ ID NO: 270886 - DNA, 2250 bp, Homo sapiens
aattctcgcccaaggacagacctgaatctctagctgcctagaggctgactcaactgaaatcatggcgtttgacagcacttggaaggtagaccggagtgaaaactatgacaagttcatggaaaaaatgggtgttaatatagtgaaaaggaagcttgcagctcatgacaatttgaagctgacaattacacaagaaggaaataaattcacagtcaaagaatcaagcgcttttcgaaacattgaagttgtttttgaacttggtgtcacctttaattacaacctagcagacggaactgaactcagggggacctggagccttgagggaaataaacttattggaaaattcaaacggacagacaatggaaacgaactgaatactgtccgagaaattataggtgatgaactagtccagacttatgtatatgaaggagtagaagccaaaaggatctttaaaaaggattgagcattattcttggcgcacagtccaaaatacaaattggacagaagatctatattgtaccagaactatttatttcaccccatcaagtataaggttactgattgattggtccttttataaacattggtatatttccattcatgccaaagcaaaagaagtaaaagctaattaggatttaatttgttttatattctctaagatatatatttactaaaagaatttgtgacattttaaaaaacaaaaataaatattgcgtccatgttgctttatatgtagccttgccttttaaaagaaaaagtatgtgaatatgaattgacagactgttttcgtagagagagggtcttactctttcactcaggctggaatgtagtggagagatcatagctcactgtaacctcaaactcctggactcatgcaatcttcctgcctcaggcttctgagtagctaggactatgggtacattccacagtgcccagctaatttttgttttgttttctttttattttttttagagatggggtcttgctatattgcccaggctggtcttgaacccctggcctcaagcaatcctcctgcctcagcctctcaagttgttttttttctttacatttgataaactaaaagcataggctgcatatgagtctttaacatcttgaactggttgtgaataattttctggcactggttgtaagtaatatctattattataaaaataatatatgctcagccagaaaacttagaaataagaaacacaaatgtaaaataagtatttccataactcataatccagagataattgccattctgattttgatagatatcctctcagctctcttccctgggggcagatatttcccaatacataccactttgaataggatgataggaaataaatgatgtactacattaaattaaattattgtattacatttttgtacacatcagtcattcccacgcttggctgaaaatcaggatcatctgagaaacttaaacaatttctgcattcttaatctccactgttattctattatatcagaatcgctaatagaaccaagaattctagaaaatttcctggtgattctgatgcagcctgtccactaacttgtctttgagaacaatggagatatcagttatcaatgttatttttaaccacccccttcttttttgttgttgtgggttttttcacataaacacatacattgccaattttccagggctcaaaaagtttccttttattcatattttcacatgacgtaaaattttatgtgcttcacataattgtattttagcagggtacatattaggggatggagagggggtacaatttttaagcatttgcagctgcaactctatagacttttgacaaattctttttcacactgatgtagataacagcttaacatttacatagttcttactacttgccacacactgttctaagtggtatatacatatgacatatatattaaaatgtaggaagaaaaatgtttgagtacctgatgaaaatgaatagagagtatgtaatctttgaaagctgaatactgcgtgttctcacttataagtgggagctaaataatgtatacacatggacacaccagagtgtagaataatagacactggagacttggaagagttggagggttggcagggggcgatgataatttacttaatgggtacaatgtacattattcagggggtgatggttacagcccagactttaccactatgcaatatatcaatgtaacaaaactatacttgtactccttaaatttatataaaaataccttaaatct

SEQ ID NO: 270887 - DNA, 483 bp, Homo sapiens
ggaatgaagaatgcaatttgatatacatagaaatacgcagttttttccgtcctggaactagaaacataaaatctgccattccttcgtggactgtggaatggaactaacgtttgttgaacagttgctgggttccagacattagggcaggcatttaattcttagaccagtcccatacaacaggtggtatttatggattatgacagcatttaggtttaaatcagactgtcagttccctgagggtgaggatctcatgtggctggtttgctgctgtttctctagtgcttggaaaaatgccagcatctagcactggattatttatcagacagaccaaagaagcacatgcttacagcatcagtaatcaggggagcccagtgtggtggctcacgcctataatcccagtgactcggggagatcaaggcaggaggatcgtctgaggccaggagttggaggtcagtgtggagaacgtagtaagacgttgtctca

SEQ ID NO: 270888 - DNA, 439 bp, Homo sapiens
catcttctgagggttcccaaatcccccagcctccaggagcccgtgcaggccagcccccagcagggcacactttttcccagcagcccaggaggggtgtctgctgcccaccccacagggcagggcatgacctcctggaggtgctggcccagctagcaggtggtgaggttggaggccaaccaggggccgcaggccttgaccacaggcacctccctgacccctgggcctggctcaggccggagcattaccccaactctcccaccccctttcagccctcttctccaaacccaaagccagcgggcccccaggtggaggcagggcagaggcctggaggccagccactgcccagccctgtcactcctctcccatctggccatgggcggagccaccgacagccatcacccagggatgtgtgtgtgtgtgtgtgagagagaaagagaga

SEQ ID NO: 270889 - DNA, 426 bp, Homo sapiens
tgggattataggaataagccaccgtgcccagcctggacactaatattctacatgattttatactctcaaatttggattatcatcattattttgtctttgtggattatgtagtttttggatctgttccttgattgcctatccagtaataatttcttcctccacagcatcttagccacccactcttatgttttatgctatatcttactattgttcataggctctaacatctcactttaaaacgtcccactctctgaccaccacttaccacttcctcttattgacccagttcatttctatagttcccatatcaatcattgatcccacaactactactaaatcattggctctacacattttcatgcctgttagctaccgtaagtcttcatgtcctacctcaccaaacttagaatacatggttcattactg

SEQ ID NO: 270890 - DNA, 450 bp, Homo sapiens
cattggtgttttgacagggattacattgaatctgtggatcaccttgagtagtacaaaatgggtttttatttagatgtgttcagtattctttaacttgttttttcttccatctctgtaatttccttttcattagaaagaagagctatgtactccttgagggaaaaaatcctgataggaattattagtgggtagaacaattatttgctttgccctttctagcccatcatttataatctttagaacaagagacccagggtggccattagtcctagtggcacagtccttgctgatcacagaagatgatcgtgatagcatcaagacgatcacttgaggaaagtggtcagcagctggagtgggggttggttgtttttgtttgtttgtttgtttgtttggtccttttctctgggataattagcctcccagccataataaccaaggaatgtaaggttt

SEQ ID NO: 270891 - DNA, 459 bp, Homo sapiens
ttattaaagatgtataataaatgatattaaacaactgttacttgtttaaacagtcataaaagtgagttccttgaaagagttggaataatttagtagaaatgatgttttgagtacttcagataccttaaagagcaggtgaaatgcccaggtacgttattacaaacttactacactggaacctattctgtaagacccatactacaagtttcactcattttgtttattatttataactagttttgagttgtccttggctattatattattttgatacctacccagaattgacataatcttcgtggcaccagaaacaaaagaataccctttcaaacctgccatgattacagatctgggtttcggatggatcacttgtgagtcagaacatggcgcaactttgggttcttctcccatggcgagtcagaccctggccacaggcatcaggctaaactttctttgttt

SEQ ID NO: 270892 - DNA, 605 bp, Homo sapiens
tgtgtatgtagccctaaataatatagtgcttagttttacctgtttttgaataatataaaaaggatatcctactatatgtagtcttttgagacttgatatcttaatattctagaagtaaaatctacccatattgttatgtgtagctgtagaacattcatataatgactatataatattttacgtgaaatataccatgatttatccattttctttttgggacttttactactaacaacattttagtgtgtatcttctagttattttcccgaaggtatttagttttccttctatgaaacatgaatattatacgtattttttgtgacctatttctctcactgatgataccttatgaacatattcccattttggtaaatattcttccatgatataaatttaaatgaccacacagtattccattagatagttacaatataattttctaaccaccccaactgttagacacatgattgcttgtaatttttttgctgtgatgaacattatgatgcacatggtcttgtttggctcagcaactctccttttagaaatttatcctaagtaatacccaaacacatctgcacacaaatatgtacaggaacaccacgtag

SEQ ID NO: 270893 - DNA, 494 bp, Homo sapiens
cacatctccaatttccagcaatatatttgtctgccatgatttggcctggaagcttaagcaggaagaccacttggagccagacttcagagtgatctgtctctaaggaataactttcatattgcagcgttcggttttgcaattcttcctaagctactctaaattcgcagcataaatctgcagaaagacttcaccctccacatcaaacccttataaggatccatttctgctctcattttagaatatcttttctaatagctaaaggcagacagaggcaaaccaagaaatccagactttgcatcaacgggttaaatcatatgtcaaaggtgcaaccataacgtattacaagcttctcatcacataatacatcactcaagaaaaaatatttgggcagcttttctaattcatcttcctggtgttaaaggagcacatctccagtgttcgtgtcttctgtttcaattaaagcaatcatgcctactcttttaggaaactactaa

SEQ ID NO: 270894 - DNA, 517 bp, Homo sapiens
agcaaaggtggtgctaagaggaaatttcatagccctaaacgcctacattaaaaagtctgaaacagcacagactatctaaggtcaaacctcaaggaagtagagcaacaagaacaagccaaacccaaacccagcaaaagaaagcaaataactaagatcagaacagaactaaatgaaattgaagcagagcacagaggatttttaggggttggagaactgtgttaaaggcaagaaaggaaacaaagatcagggcttcagccatgtggacagatggaggcactcattcctctctcctttgttgctgttatactggacagttgtttttaattcctcaaagaactcggttgcagcctgaatgatatcaaagggtggacccacccatccagttatattaccttgagtttgcttctttatatcagggagaagagttccaactaagatgaaaatgtaaagattcccgtgttagagacttagaactttgtgcctttgaactgtttcaataaatcattccacaaagact

SEQ ID NO: 270895 - DNA, 380 bp, Homo sapiens
agcaaaggtggtgctaagaggaaatttcatagccctaaacgcctacattaaaaagtctgaaacagcacagactatctaaggtcaaacctcaaggaagtagagcaacaagaacaagccaaacccaaacccagcaaaagaaagcaaataactaagatcagaacagaactaaatgaaattgaagcagagcacagaggatttttaggccagtgaaattattcttatgatactgtaagagtggctccatgccattatacatttgtcccaacccatagaatagacaacaccaagagtaaaccctaatgtaaactatggactttgggtaataatgatgtgtcaatgtaggcttattgattgtaataaatgtaccatggtggtagaga

SEQ ID NO: 270896 - DNA, 755 bp, Homo sapiens
atggcgctgcgctggggcatcgtgtctgtcggcctcatctccagcgacttcacagccgtgctgcagacgctgcctcgctctgagcaccaggtggtggcggtggcggcccgcgatctgagccgtgcgaaggagtttgcacagaaacacgacatccccaaggcctacggctcctatgaggagctggccaaggacccgagcgtgggccatctggacccgcttctttcctgcctccgaggctctgaggtctgttttggcccagggaactctaggagacctccgggtggctcgggcagaatttgggaagaatctcatccacgttccccgggccgtagaccgggcccaggctgggggggccctgctggacatcggcatctactgtgtccagttcacctccatggtctttggagggcagaagccagagaagatttctgtcgtgggaaggcgtcatgaaacagctcctcaacccctgctggtgcccgaccgagctggtggtgaagggggagcataaggagttcccgctgcccccagtcccaaaggactgcaattttgacaacggggcaggcatgagttatgaggccaagcacgtctgggagtgcctacgcaagggtatgaaggaaagtcctgtgattcccctgtcggaaagtgagctcctggctgacatccttgaagaggtgaggaaggccattggagtcaccttcccccaagacaaacgctgatgtatccccgaataaataaagacatcttacatcttcaaa

SEQ ID NO: 270897 - DNA, 1044 bp, Homo sapiens
atggcgctgcgctggggcatcgtgtctgtcggcctcatctccagcgacttcacagccgtgctgcagacgctgcctcgctctgagcaccaggtggtggcggtggcggcccgcgatctgagccgtgcgaaggagtttgcacagaaacacgacatccccaaggcctacggctcctatgaggagctggccaaggacccgagcgtggaggtggcctacattggcacccagcacccccagcacaaggcggcggtgatgctgtgcttggcggcgggcaaggccgttctgtgcgagaagcccacgggcgtgaacgcggcggaagttcgcgagatggtcgcggaggcccgatcccgagccctcttccttatggaggccatctggacccgcttctttcctgcctccgaggctctgaggtctgttttggcccagggaactctaggagacctccgggtggctcgggcagaatttgggaagaatctcatccacgttccccgggccgtagaccgggcccaggctgggggggccctgctggacatcggcatctactgtgtccagttcacctccatggtctttggagggcagaagccagagaagatttctgtcgtgggaaggcgtcatgaaacaggtgtggatgacactgtcacggtgctcctgcagtacccaggggaggtccatggcagcttcacctgcagcatcaccgtgcagctctccaacacggcctccgtgagcggcaccaagggcatggtacagctcctcaacccctgctggtgcccgaccgagctggtggtgaagggggagcataaggagttcccgctgcccccagtcccaaaggactgcaattttgacaacggggcaggcatgagttatgaggccaagcacgtctgggagtgcctacgcaagggtatgaaggaaagtcctgtgattcccctgtcggaaagtgagctcctggctgacatccttgaagaggtgaggaaggccattggagtcaccttcccccaagacaaacgctgatgtatccccgaataaataaagacatcttacatcttcaaa

SEQ ID NO: 270898 - DNA, 943 bp, Homo sapiens
atggcgctgcgctggggcatcgtgtctgtcggcctcatctccagcgacttcacagccgtgctgcagacgctgcctcgctctgagcaccaggtggtggcggtggcggcccgcgatctgagccgtgcgaaggagtttgcacagaaacacgacatccccaaggcctacggctcctatgaggagctggccaaggacccgagcgtggaggtggcctacattggcacccagcacccccagcacaaggcggcggtgatgctgtgcttggcggcgggcaaggccgttctgtgcgagaagcccacgggcgtgaacgcggcggaagttcgcgagatggtcgcggaggcccgatcccgagccctcttccttatggaggccatctggacccgcttctttcctgcctccgaggctctgaggtctgttttggcccagggaactctaggagacctccgggtggctcgggcagaatttgggaagaatctcatccacgttccccgggccgtagaccgggcccaggctgggggggccctgctggacatcggcatctactgtgtccagttcacctccatggtctttggagggcagaagccagagaagatttctgtcgtgggaaggcgtcatgaaacaggtaccatctatcctggaatatttcatggtgatgggaatgattctgtctctctgggagcactgaactgaggacaagtctccaagtcaatgagaattagatcagacacctagaggaacaactttccatgaagccagagaggatcagagtcaagactgcaggtgggcactctcctgggactttgctgtgtgatcttagccagcagacttaacatctctgaatcttaattactttactggtaaagtgtcactaatagggttgtcatgggagttaatgaagtaactgctgaggcaaatggcagttaataaatataaaattattattttt

SEQ ID NO: 270899 - DNA, 434 bp, Homo sapiens
agagggtgcattttgtttggaacatgtggttctctgggggaggctggcttggcttggatagggtgctggagtaggggctgtggctgagggcagcatgggggccttgtgtatctgagggcagaggagaggcaaagggaaatggagctggagtgcaaagggaggggaaggcctgtcaaaggcaacacatagtagagtgactgtctttgaacagcttcgtgtcagaccttagccctttcgcctaatagctctgcgagcaaattatttcatttcccagtgataggaatttttctattctgggtcctaaacaaatagctgcctgatgtggtggctcactcctgtaatcctagcattttgaaaggccaaagtggggagagctcttgaacccaggagtttgagactaacctgagcaacataatgagaccttgagtctacaa

SEQ ID NO: 270900 - DNA, 110 bp, Homo sapiens
tgtccttcccaaaagatcctttggcctcccccatatggacccgtattactcccctatgccacctcatcggtgacctaccccaaaggcccaggcctagtctttgtcccgcc

SEQ ID NO: 270901 - DNA, 373 bp, Homo sapiens
cccatgccttcaactccccagcagagtctgcagaaactggcctggggtgtggcctgggcactgggactttcagtttctctctgggtgattagaaagtgcagccaaggctcacgcctgtaattccagcactttgggaggccaaggtggatgaatcacttgaggtcatgagttccggagcagcctggccaacatggtgaaaccctgtgtctactaaaaatatgaaaatgtagccaggcgtggtggcaggcacctgtaatcccagctactcaggaggctgaagcaggaaaatcacttgaacccgggaagcggaagttgtagtgagttacattgctccagtgtgctccagcctgggtgacagagtgagactccgtct

SEQ ID NO: 270902 - DNA, 231 bp, Homo sapiens
atgggcccatggttctaaaccctttctgtacatccacagtagctgggagtgctcagataagtctggtaagcaggccgcactccggagcagtgacatctgaatctggtggaggtggggcccaggcacctgcattttcagggtcccaggtggtgtccagtgtcatccagggctgaagcagctggtgggggcttagagaggatggtgggtagggcctggggtgacccttccaaa

SEQ ID NO: 270903 - DNA, 1774 bp, Homo sapiens
tagaaccagactagagaatatgatgcaggttcactggctttatggtctttctaatgctccctgccctgcatccacgccatggaagaaccagacaaggggaactgggagcctggaaaccagacacacttacccagggccaaggccactgccgccctctgataggggcagacagaacagaaagagaaatcccatctgtgatgtttgcaggagagtaactgagttgagaaatggtccgtgagtggctgtcacctgccaatcaggcctttagtccactttcaggggggaagagaaggaaggtgggatggtaataggtccagagcgtttatgtaaagaccctttctcgtggaaagaaaatgtgtgagaggtaagaatccccctttcacatttaagaaagttgccaagaatttaataagcactcactttgtgtatcagtgctcttcatgcattcattcaataaatcaccaactatctattgatcacctgttttgtacccggttctcttctcaggctcttgggttcaaaacagaaagagattccttctctcatggaacttacatttttggactgaggagagacagacagtaagcaataatcatgataagtaaggaaatcatagactatgctagaaagcggtcattgttatagaaaaacaatagtaaccttagactcgagggaagtggaggagtgagccatggggctttctggggaaagagcattccaggcagagcgacagctggtgcaaagaccctaaggcaggagcgtgcctgaggggtgtgagaaaagcgaggagtccgatgtgtgcagcagaaaaggccatgcattctggagatgtgggagccagatggaaaagagccttatgggccacggtcaagacctcatgcctttcagagtgatgtgttatgtggttcacaccccgtagcaactctgtgatagttgttgttcttattatccctttctttacgtgaatgcactgagatacattgccaaaagccccctttattttacagctgagaaaattcatacccagagtagggaagcaacttgcccaaggccacagagtgggaaaaatggcacggagctagggttcgggttccctgattcttggtccagaaccctttctctcatgtctctgctccagaaatgaacttcttttgaaggaggtgactctgggcctctcttgaagattcagattagatcctggagctcttaacactgtgctttgctgcccagatcttctatgttaactacagtatttccttcctaggaagaggtttaacatggaaaacctgagaaaggctaacacattaaacatgtatgttagtaaatcctggaggagggaaggaaggccattgactggtgacatggcggtggcatcagtcatagtaaatactgataccaactgattgcttcccatgtgcctggccctgttgtaagctggtgaagtgtgatagtttaagtattctttaccactactctaagaagtaggtactgggccaggcgcagtggctcccgcctgtaatcccagcactttgggaggccaaggcaggcggttcacctgaggtcaagagttcatgaccagcctgaccaacatggagaaaccccatctctactaaaaatacaaaagttagccggacgtggcggcacatgcctgtaattccagctactcgggaggctgaggcaggagaatcacttgaacctgggaggcggaggttgtggtgagccgagatcacgccactgtactccagcctgggcaacaagagtgaaactctgtctc

SEQ ID NO: 270904 - DNA, 555 bp, Homo sapiens
agaaaatagatcaatggttgccagggctgggaatcagggagcaggtgactataaagggacacaaaaaaagtttcttgttgttatggaaatgttccgtaactcaactgtggttttggttgcacaactatatgtatttttacaaattcgtagaaccgtacactacaaatggtgaattttactgtatgtgaattacacgtcaattaaccagactttaaaaaatgtttgtagagattcccagtaagctgttagtaatagttaccccttggagaatgggagtgggagtataagaaaaaaagcagctttcatattttacacttctatataatatgtattacttttagtaagtatatactgctttttggcaatttttaaaaaggttttaataagtgtgacatactcaatgcatgcaacactaaatagccctagaagacagtagatttacatgtactgatacataaaggcattcacaatcactgttaagtagaaaaagacaacttgtacaaaaatatacaatcactgttatggaaaaatacaataaaattatgtgtacacata

SEQ ID NO: 270905 - DNA, 448 bp, Homo sapiens
aaaaaaaaaaaaaaaaaaaaatgagccgggcatggtggcaggcgcctgtagtcccagctattcaggaggctgaggcaggaggcggagcttggcagtgagccgagatcgcgccactgcactctagcctgggcaacagagcaagactccatctcaaaaaaaaaaaacaataatggcaactattagtaaaatttaaaaccagtcgtgtatcttctgcaacattggagaagatggagcaagtaaaacagttcatagagcaaaagaaggaaaacaaagcaactgtcaaggaagcttaaatcagagagtacatgtataaagtgatgtaagtaatagcaaattcattataataggaaatgtaatttgattaaactacccatttaaagacaagaatactaagattggtcagaaatcaaagtccaaacaaaagatctaaccaaattaatgacattag

SEQ ID NO: 270906 - DNA, 459 bp, Homo sapiens
ctgaaatttagttatttgtgttatatggaacaaatgtctgttggccattttttaagaataaaagcaatgtgtgcacactgaaaactttcagacagtgcaggaaggcataaaatgaaaagtaaagtttcctttccttctgccttccaaagtgcttcccccacaggtgatccttgttaatggtttctttcatatcattccaaaaaatgtattcatatactaaaacttatagcattccacaaaaaatattatgcatttatgtttgcctgcctagccatttgtctatccacttctcctttttgatttatgcaaatgagattgtttgcccaatgtctttttaaaatacttaattatatatcctaggcatctgtccatatcattacaagtagctttccatcagtttttgtacataacaataccagccatttagaggtctgtctttcaaatatcattttaggtaaa

SEQ ID NO: 270907 - DNA, 401 bp, Homo sapiens
tatcttcataaacgtggatattttctaccttgtagaactgttgtgagaattaaatgaaaaaaaatatatataccattggatgaaatctttgacatattctaagcacctattgcctattagctgttcttatttatcagcagctaaacttgattgcagttttctttagtgtatttttaaatagttttttattacggaaaatttcagatacatatataaatagattcaataatgtaccatcaccagctttagtagttaataacagaacatgcaaatcatcttgttttatttctgcttcaactgaattattttgaagcaaataccagatgaatcacttttattgtactggagagtagtggctcctaaacaaggctgttaagtgattaacaaagagaaatagagat

SEQ ID NO: 270908 - DNA, 132 bp, Homo sapiens
ccggggctacgtgtgctggaggctgtgcaggcctctggcagtcccgactctcggtgcctcaggaagatgataacacctgccaggttttgagagtccggtgaattgaaccacaaagatagctaagctcagttc

SEQ ID NO: 270909 - DNA, 1266 bp, Homo sapiens
aaaattattttagagtcctgctctttagggaaaactttgctatggtaatgtttctttgaaaacaaatttaccagcaactgcgttacttggtgttttccaaagtacaacatccaaggcttgaaccttacccgtttctaggccagactaggccagcctctagttttgataataattcatacctttattggaatatattttggatagcagtgaagaattgaaagcagctcctaaagattggtttgtttgctttgaaaatgtttacacttattcactctaagcagtggaccattttgatatcaggccctatacataagaccaaaaccagaaatatttctaaatctcaaagatttataagtacagtacctctggctgaaaactcgttaaacatctttggatattttttctttatatctttatgtaattatttctgtaattaagtgtacattagggttatttgctacttaacaagcctaaaggtatagctgtatatagaatgtgctctgtgtttttctgtttcctgcttggtttgtttctggtatgactatgtctactttttatttaaggaatttgtgtagataatactctcactaacttgtaaataggataagttatgagatttttggtattagaatttgtaataataatgacttttagattttatttgaaaaagctacttggaaagcagtaaatagaactatagtgatatatatagatacatagatatatacttttttctgagaatgtataatatataattgtcaaagatttttggaagtctttcaaaatatacttaataccattttgagaacataccttctaatttatttccataaggctgaagaacttttatttacaaaatgtaagactagataatgtatgaatcagtgttactaggacttatcagtacttaaaatagcaacttggcattctttattttgtttcctggttgttttatttggagggataataaatgtctaagttatttccattaaaattttgaaatgtttgtatactttatgtgtgccattttaaagtatatgcaagttctaagcaataatctgcatgttatacaaggttgacatattttgtcctgaaatttttagttaacatttcaagaatgataaaatgaacaccctgtaaattacccttctccccctcccctccatgaaaaccttgggattttcttgtgctagaacactaccacaatgtggtgcaaagctttgtattttgtggaaaaaaacaataaaatcacaattatttagtgca

SEQ ID NO: 270910 - DNA, 415 bp, Homo sapiens
cgcccgggggtcttggggcgggactccacctgccgccaccactcgcttcgctgatgacatcccattagcagtaatggagttagtgagtgcatggcggagactggacccaggccgcctacaagggccagaatcccaccccagccatagcctcgaggcaggaagtgcagtgggcaagctccctgccaaagcccaggaacgtgtgattttgtatccagtacagcttcatctcggtggattttccttcctaaccacctcctcctccacaggttttgtgaccgtgctgacccctacgcagacctcatgagagtcacaagccatcgcaactgacagtttaaacgtctgcctcttatctctaagggagggaactatctcttatgcaatgtgatatccatggctgctagcacagtgtaattaa

SEQ ID NO: 270911 - DNA, 440 bp, Homo sapiens
catcctgggttcaagcgattctcctgtctcagcctcctgagtagctgggactacaggcagcaccaccatgcccagccactttttgtacatttagttgagacagggttttaccaagttggtcaggatggtcttgaactcctgacctaggtgatccacccacctcagattcccaaagtgctgggattataggcgtgagccactaagtctggccagtgctgcacagtattaatgttcttattttacagattacatcattaagtctcaggggtaagtacaaaagctaggattttaccatagatttaaatcataccctttcccctgtatgtgtcccttttgattttgtcaatgaccttgtgaggtaggaggggcagctattatacccacttcaaaaagaaagaacatgaggaaagcttattactgaaaaaaagttttaaaaagaa

SEQ ID NO: 270912 - DNA, 513 bp, Homo sapiens
gcttttgaagtcctcagtcactgagtctgtcgcctctgccgtttccggttctgtttctgtttgacactttgctgcacttggagctgtgggccattgtgcacgtgcctggtggacagtcctgaccctcgctgtctgataaaaaagcactggccacatggccgctgggaaatttgaatgtggccagtctgaatttagatgtgatgtgtgagctacaaactagatcttaaaaaactaatgcaaaaaacgtaaaaatatgagtaacgatttcttatggcccacatgttggaataaaaacatcttcaataaatttgtctaagtaaaatgcattagttaattgaatgttaagagtaattttaatgtggcagctagaattttaagagctgggtatggtggcatgcacctgtcatcagctccacgggaggctaaggtgggaggatcacttgaggccgggaggtcgaggctgcagtgcgattgcaccaccgcactctaggcaatagagcaagaccctgtctc

SEQ ID NO: 270913 - DNA, 481 bp, Homo sapiens
aagctgttctattaaagggataatatagtgaataaatatttgttgtctgtttaacttaccttatgtagagctattggctctaaggattttgaaaggacaacaataattctctaaaaataattcaggcacctttggccatttgtgtaaccaggtacaaattaccacgtttcccagtttcccccttgagtccaactgtaatgtattgttctgtaaagtatagtccagttgtcagctctgtttgccttggtcaattgaatgatcctcctccttaagcttagcctatagtgcatttggcttaataaatgaaactgtaacatgccagccacacaatagaggattttatagaactgtttctgcttggaatactataattggaatttgagttaactataattaaaaaagctttcatagcccatggtatatgaactctgaaaccccaaataccaaaatcctactatataaaaatgatccacatactaaa

SEQ ID NO: 270914 - DNA, 557 bp, Homo sapiens
ctgtccttgtgttgacagctcttctgattatagcagttgtcaaactccatccttaagcaggttgtaaatcctggctccttccgattaaaactaggtcagagccaatcgcaggttaactagaggccggtattctactactgtacgtccttactagttcattctaaataggctttgtgtggcagcatactaaaacccttatgtgcctatattttacctgggtttttttttaatcttcagatattggtcctcctgttacttcatgattaaacatggtccttgctgaagagtatattggtataagtatggtcttacttataaatggcctgttagccttcccctcctcttcctccactgggaatactaatatcattgcatctgtgtctcccaggggaaatcaaggcttttccttgcacgtgcagtcatgtgatttcagagtgggcaggctttgtatcctcatgagccctcagtcttccacgcaaagcaccatctgttctgttacctccacactgttacagggcagtgggaggaggcattagagtgaaaataaataaaataaa

SEQ ID NO: 270915 - DNA, 473 bp, Homo sapiens
gcaactcaacacttaatacgtcccaaatcaactcgctatttcccctcaataaatgtggtcctttttgctttttctctatttaagtgaacactatcaccatcctttcagacgcatagtcagaaatctaggactcaccctttatacctcaattctctcccctatctagtccatcatcaactactgtcaattttgcctcataaatatccctcaaatctaaccacttttctccacatctgccaccaccataatatgcaaagtttttgcaacagctcatttgaatcactttaataactttcgaaactcatttacccacatccactttagttctccctccaatcttttctccacatggcacctgaagtaattctttctcatgtaaatctgatcaagtcattcctgccctcatctccctagcctcttccttacctttcttcctccccaagtccaccctccaccctccaccaaaaaaacaa

SEQ ID NO: 270916 - DNA, 283 bp, Homo sapiens
cttgagacttgcagcaggagaaggatctctgtataatctttgtttgcctaataataggtctttaagggtttttaaaaattggtttcctttggggatcatttaaatttcccatttccttgtaaatatttttggtaaaaacatcctcttggatttcagaggaagttaaaatagaaaaagcttgaaagcattcacaaagcaatgtgctctcaaaacacagccattcatttgaagttgtcttttagtctgaatccaaatcctccagtcaatacaaaccataatatgc

SEQ ID NO: 270917 - DNA, 254 bp, Homo sapiens
gttttggaatggcctgttgaagactgggctaaattgcgattaagatgtaatgccttgcaaagttgggagcagttcttcagaatatggtatatgcgctgaaatgcattgggccaaaatggatatatagtattgtgtctccagtaggactatgtgcatacaggagtagcctctattactatcacacccagccactcacctgtagaatttgtgcctcctcgctccgaaatctggagccagctgggttatgatcctca

SEQ ID NO: 270918 - DNA, 800 bp, Homo sapiens
tcttagttgttctttttgatttaaaaatatagcagtaccttacttacatagtgtcactcaggagtataagtcaaatttccagttcacaaatgctagcttttaaaagaactactttaagcattttggtacactctaaaactgttgaagaatatgcttaaatttggtcaacctcttagtccctcagatcttgggtcatagtagaaaaatactgaatttggattcataagttctattttcctatcttggtatgcctgcttaacttcactgagccttactttcattactcttaaaagagaataagaatgtccctcttacagggtattaaaagatactgagataatggaggttggatgagctttgtaagctgcagaagatattctttatattgcccaagtgatttgggagttgtaggaggcctagagtaagagagaattttgaagctttccaacactcgaatgatgtcatatgttaagatggtaaggtctacatcactgaagcattctaggaaagatgagttgatgttagagaccatatagagagaggaatgctgtgcttagtgacaggatgaactagaattctcaggctctttcctactctgagggtttctgactttatacaaagttgaattgtcaaatcattggttcagaaaaatcagagggggacagtctctttggactgatttaggaaagctgtatgggttttaaaaatcaggcatttcttctgattctaaagaatgagtgagaatagccaaaggtatcttgaaaaataacaaagttggaggactaacaattcctggcttc

SEQ ID NO: 270919 - DNA, 436 bp, Homo sapiens
cattatataatgtccctctttgtctttttaaaactgctgttgtcttaaagtccgttttgtctgatataagaacagctactcctgctcgcttttgatgtgtccatttagacgaagtgtctttttccaaccctttgccttaagtttatgtgagtccgtatgtgttaggtgagtctcctgaagacagcagcaacttggttggttaattcttacccattctgccattctatatcttttaagtggagcatttaggccatttacgttcaacattagcattgagatgtgaggtactattctattcctaacgctatttgttgcctgagtacctgaaaacctggaagcattcccttgaaaactgacacaagacaaagatgccctctctcaccactcctattcaacacagtattagaaattctcaccaaggcaatcaggcaagaga

SEQ ID NO: 270920 - DNA, 726 bp, Homo sapiens
cctgtctactttatccttccttggtccacagagactgctgcttaggagtccataaaacgagcttgatcagtgcgcaggcctgaggtaacgagtacacagggcctgaatgcagctctgctcagggttgagcaggaggttaatcacttgatttaaattaaagcatgggggattaagcatcttccccttaggtgccggcatgccccccacccctggcagccagagcccaatcagaaccagtgccagaggcgactgtctcctggaccaatttgctcaacttcaattttggtccttgagatttcgttttgacattgaaaaaattgcctcaccattctatgggttctgatttgtgtgatggttctgaatgaattctaacaaattagcatatctttctggatctttatagagatgtaggaagatgaattgcatctgtcttccaagagagttacaaatgcagcagaatatcaggctgggaggcagaaagcgagcgttcctgacagtggctccacggaatagccggcacatgctgaaccacagcctctctgcggaggcagatggagcacaggtgagaaatataaatgaatccacaatctggactcctgggaaactgtttcacacctatggaggactccatcatttgggccaaaaaaaaatctcgcttatctgaaaatcatttagatggcaatctcaaaatctagaaaggcagttaaaatgttctctgaggagtta

SEQ ID NO: 270921 - DNA, 561 bp, Homo sapiens
caatgaagtgcaagagaaatctgaaaactaatacaaagaaatcagaaaattaatccaggatataaatgagaaatttatcaaggagatagacatcttaaataaaaacaagcagaaattctggaactaaaaaattcattgaaggaaatacaccatatgctcaaaaacttcaacagtagactacaccaagcagaagaaagaatctcagaactcgaagacaggacttttgaaataatccagtcagacaaaaatgaggaaaaaaggataaaaaagaatgaataaagcctttgagatgtctgggactgcaagaagcaactgaacttatgaattattggtatttctgagggggaagagagattagaaagtttagaaaacatatttaaagaaatagacatccagatacaggaggcccagtgatccccaggaaaatacattgcaaaaggacctcaccatggcatattcaaaatgtctgaagtcaagtgaaagaaagaattttaaaattagcaaaagtgactagtcacctataaaggaaatcccaaatctcatcagaccaattgaggactt

SEQ ID NO: 270922 - DNA, 849 bp, Homo sapiens
tgtcagctgtttgatattccattttatcaatatgttattatttacctaagcagtccatcattgatgaatgagttgtaatgttccctgatgtagaaaattcctaattattatgctgaaatgaacatctttgttcatttgggcacttacgtaaatactcttaaaaagtaaagttctaagacaaaatatatcaataaggtttttttaaatttttttattattattattttttatgagacagggtcttgctctgtcacccaggctggagtgcagtggtgcagtcatggctcatggcagcctcaacctcctgggctcaagccatcctcttacctcagcctcttgagtagctgggaccacaggcacaagccaccatatccagccaagattatgtttttattttcatttctttttttatgtttactagatgtttataattcctttgttaattgcctattaatgtattttctccatttatttcagttttatttttcccattggatcattagccttgtttgtgtacatattgctttgttatttgtttatagattttgatttttttttctctttggcttcacatttggagtcattctgaaaagaatctttgcttttcaaaattaaaaatatatgtatacattttctctgatacttctattttttcttttttcttttctttcttttttttttgttttttttttattgagacggagtcttgactccagcctgaatgacagagcaacactccgtctcagaaaaataaagagaacaaaaaaagaaatatgttccacatctgctactccctgtccctcctgtgccaccacctggccatgccgccttggcccctccctggagtgt

SEQ ID NO: 270923 - DNA, 253 bp, Homo sapiens
aggtaataaaggggaaaaatgaataataaaggaataaaagagtgaagctgaaatctgggagagaaagaaaaatatatttattcaaaaatatattttattcatggggaggagctgatatttgcaaaatgtagaaatcttaaaacttaaatctcaaaatcaaaattaaaatgcaatgacagtttagaaatatgcctgataaaaggtaagttttgaatgattttccattaaaagctaattttgactttagaatgtt

SEQ ID NO: 270924 - DNA, 256 bp, Homo sapiens
ctggaaatggtaaatatgtggatactatgaaagactgagtacacacatacacaaaagtaaacacatgcttaatgttttttaaacaccagcaagactgtctaaggcaaaaattataacactgtatcatttgatttattaaatacagtagacggcttctacttctggaagatggagtagatactttttctattcacgcttgctaagtacagctaaatgccttggacgttatatataaaacaaacataagaaatacaaa

SEQ ID NO: 270925 - DNA, 412 bp, Homo sapiens
tcttttaggagttgattctctccgggtaatatctggagctctctaaagtttcagagagaaatacgttccttataaaccttgtggttgtcatgctggtgactccttgagcctgtcctgtgctggaccgtgaggaaggacacaaggccatccagactcctggactcacagtgatttcttgtcctccccaaagatgcctttgcctggtgcactctttaatagcccatcacttcttgctggctgtgtccccagctgagttcctccaggatatggcatcaactctgaacacatctctgtatattccctcttaggaccataagattcatgttaaacttagtgccagaaataaccttgggtagccatgttccttatggttccttagattacattcctagattacacattttacattaaa

SEQ ID NO: 270926 - DNA, 325 bp, Homo sapiens
tagtacaattatatcaataattcaaagatctagatagaatgctgactaattctgttttggtgtatgtgacaatgtaaaattagttcattttatctttttttgattcctaggttttgaaaaatgtcctgggcagtaaataaatttagcaggaaagtacgcctactccatttatccaaatgttaatgaactttctcttagtgaacatggcactgttgacaccacctaagtcataaaaacgggtctcaagggaggaaatgactcagtgtgtttaatacaggtttccctgctaagcctcaatctggggaagtcctgttggttttgggaa

SEQ ID NO: 270927 - DNA, 368 bp, Homo sapiens
cgttagggctttttcatgctgacttcctagaactaaattgaaaggaaaaccctaactttccacacctaagtaacaaaggaccagaggctgctccctttgcaaacccccccttttttttgaggcagatgggaaattgaaagtacctctgattgcaagtagagtcttggtttgcaaagaaacgcaactttgtaacttcactttagcctctgattggttgcagaagtgaagttacaaaggttgctttccacaaccaatcagactgatggcaggccaccacttcatttacaccaggcgagcaccaagtggccaatgggaaacctcctgggggtatctggacctgagaagattctgtcactaggccttgagac

SEQ ID NO: 270928 - DNA, 416 bp, Homo sapiens
gctggcacaagtttgttctagcaaattccagtctgtcgtgtgtttcaaacctacttgcttctgtaaatgtcagatttactatgttgcataacttaatccttagcgtctggggacgatgttatacagaccggaatctaaggtcatttgacaaccgtgagaaacaggtttttcgcttatttattcatttattttatttgtgtaactcatctcttgactcaaacatttgttctttgcttacatatttataaaaggtgctatacttttatgtcaattaaggcaggcttaacatgttttcctagaagataaatacttaggattttaatgatggcacacttaagtttgtaaaactaaaaggcatccagaaattagtctgaattgtatttaaaacaacaagttttcagaatttgaacttgtag

SEQ ID NO: 270929 - DNA, 441 bp, Homo sapiens
ttgtcccattcatgagggtgctgccctcatgacctgatgatgtcccaaagcctccacctattaatatgattgcattaggaattaggttttaacatataaatctgggaggacacaaacattcataccaaagcaccctgcagtgtccttgtgcactcgcatctctagcatcacactaaagcattcatgaacaggacactggcaaaagagaaaccaagacagttcacaaaaattacccacacatctaaggaaactgtatgggcagtcttcttgtctacataaaaaacttctgtcataaaaaaactgccttgctataaagtatctgaaaataatggataaaatatgacagaaatcttttaaatatatagctgagcttgcaataaaaaaaatagcaacaacaacaaaatgatgaggtctccagaagccaaaacaaagccaaagcca

SEQ ID NO: 270930 - DNA, 465 bp, Homo sapiens
gaaagccgaaaaagggtgaacccaccacacaagtgaagaaggccccacctctggcaaagtcatggaccatcactccaggaccaacagcctcaaaactaacattcaaacgggtttgtctttttcttctccccttagctactcaaggatatcttactgttaatgtaactatgcttgtctagtcttaccttgtggagatctccaaagtcaaagacagttagcttgtacagaaaagtacttctgcccctctgtggaaagagttaatactcctgtgtcttgcatatggggggaatcctcagaggaagagttaggcaattgggggttatggtctcagtgggcagttttagggcactgccctaaaaccatacctacacttcaccaaaggggccaccccttctgactgtcaatctaatcattgcaatccagtacttatccattgtaaaaattaaagatctaaagcaaaccata

SEQ ID NO: 270931 - DNA, 416 bp, Homo sapiens
aggtatgattgttcaagtagctaaaaaaaaagccattaatctaattaattgtttaatcctgcttacaagattatcttgaaaaaatgtgctggggagtatggtataatgaattacaggtccaagaatttgggttcagataccaccttcagtctttactaagctgcgtgactttagcaaagtgcttagtctctctaagcttcggtttcctaatctatgaggagggcctaagatatcaccacccatcatattcccccctctgtaccgcttattttagattctactatcattgtatatcacagaggacatttatcttgttcatctttacaatcaacacttagcaagacagatggtacttagaaggccccccaggttatctgttaaactagacaacctcagttcttgtgttaaaagtaaaa

SEQ ID NO: 270932 - DNA, 526 bp, Homo sapiens
ccgtgggcttcggcctggcagcagggcccctggaggagcctggcacccaacaggcgctctgtaaatatttgggaagtgagtggacgagtgactgtccctggtttgggctggtgccatttagagggcaaccagagtgcagggaagggaggagcttgggcaagagggacattgctgtcgctggttgatggtgagatggcacttaatgagaacctggtcattgggaaagccccaagcctgcgtcttgctgtgatgccttccccattatgaagggtccattggcatgggagtggggagacctggactcagagaagctacaagggcaagggtggaaaggcatagcttctgcaagttgatgctgaaaaagatccaagactcatattcagcagacagcccataaccaagagccaaggaaaactttgcctctgcttcttctactggactctcttgggctatcctttcatgtctttatttttctcaaaatagctctatgttcctttctttaaaaattaaaatatagcaaaattga

SEQ ID NO: 270933 - DNA, 546 bp, Homo sapiens
aagttgagagactcttccacaatgcagaaagtaatatgagcaaaaaatgatgaaagagagatgatgaaaaataaggagtacagagtctgaagatccaacatacagataataggcatctctgaggaagcatttatttactgtgaatcagaagccataatagattaaagaaaatttcataaactaaaaaaatgtgattctatagaatgagaatattccctgtatttcaggcaaaaataataatgagaagagacccacatggaggcagattggtgaagtttttgaatttcacaagggacagaaatcaaatagtttcaagaagtctaaagaactttgtgggaaatgtttatgagccagcaatttatgtgataagagaatagatatagtctcacttaaatacggcctctgaaaatgaattatttatgcacatttcattgaaagttattcaaagacataattattttggcaagaaatgaaccaaatattaaatcaagaatgaggagatacagagttgaaaaaactgaacttgaacactgatagttaaattat

SEQ ID NO: 270934 - DNA, 443 bp, Homo sapiens
tcaccaacttctggagatccttcaacttgtaggacaatatccaatatttactgttaaatccatgtccctttaaaacttgccctctagccaatcttcataagctcttcttgggagctgctttctctgcctcagccacaatttctgtgcccatctccctggaacttaagccagtgaactcaccaggactgtatcacaccatattctttcaaaacaggctcacctctgtgcctggaaaacagcccatctttttttctatgtgtattagtagaaaaaaaggtgaaatgactgtgatcatgaataatccccacctctcagtggcttaaaataacaaaggctcctttctcactcacagttgggcacgtctgtccatttgcaggtgggttgggaagctccattctgtatcaccctcgctcaaggacctggactgaaggatttctgctttc

SEQ ID NO: 270935 - DNA, 335 bp, Homo sapiens
tattatactctaagttttagggtacatgtgcacattgtgcaggttagttacatatgtatacacgtgccatgctggtgcgctgcaccctcatggtgagttttaagggctctgggtttgggctatctgggttaaaccctgtctctgctatgtaccagctgtgtggctttgggcaagtggttcaagagtgttggtctccattttctcatctatggcatggagatagtaatagcctaaacatcatagggtggttgagagatttcccccccacatcttccctccctccctccatccctctcttttcaaataagtgagcacattcaatgtaccaggcattg

SEQ ID NO: 270936 - DNA, 386 bp, Homo sapiens
atgaaatttatccaaagcgtaagtggcaatgtcagtttacctgaattaatgccacatactaaggcattttagttctctcaaatcttaatttagataaatgaaaatgttatttaaaccaatctcaagggcactgaatgtaaaaacattaaatggacagttcaatgagaaagtgaacaagaaatgaacaagaaatctctcaagaacaatgaacataaacggggtacagaatagggagcttcagacaactgggctgacagaaaagaagggtgttgataattcctttttcccatcaaaagggaatcaagggtgtagcaataatcctcagctatagaatcccacctagagaagtctttcatcaaattaaaaatactgtataaataatataa

SEQ ID NO: 270937 - DNA, 383 bp, Homo sapiens
tacttcatacctactattatgactataatttttcaaatggaaaataaaaggtgttgctgaggatatggagaaataatagcccttgtacattgctggtaagaatgtaatatgttacaggcaatgtggaaaataattggtgaccgatcaaaaagttaatcctagaattaccatgtgatccagcaattctacttgtacatatataccaaaaagaaatgaacacttacacccacaaaatatggcatacaaatatttattcataatagctaaaagttggaaaccaaatgtccatcaacagatgagtggataaacaaattgcattatgtacacacaatggaatattattcaggcataaaaaggaataaagtacttatacttgctgtagc

SEQ ID NO: 270938 - DNA, 451 bp, Homo sapiens
gtaggtgggagatgtaacatttgccctgtggactgaatgatgcagtctgtcccttggtcagcccagggcagatcatacatggaatacatgttactatcacggtagctctgccaccaacttactgacgttcagggagcttgggtgacttggtcatgtgatgaggcaccgataaagggggagaactggaacctggagcttcctccctcatatctggatgtttcactatagggagctccaaagtttaaaaaaaaaaatcagcatcaaagagccatgatgtatgaatcagctcagggccccgggcgggaggacagggtagggctgcatgccctgctggcttcagcaaaattcatcagctgagttaacagggtccctcagaatccagaacccttaagggtagagcttctatatcctccttctatctgtccttctccccacttcaaatcaatttttt

SEQ ID NO: 270939 - DNA, 331 bp, Homo sapiens
gaggattggggagcggcgacgccgcccagccgtcgtttttgatctgctgcagccgccggcggggcgacccagcccgaccccctcccctccccctcagccaggagcggtggcggcggcggcggccggagggagttggcggcggcgggcgagcggagggggctgagcggggagggagggagggctgaggtgtcccccctgccgggtggaaccggaggcggcggcggcgctggcggcggccgtggtggcggaggcgacggtggagacggctgccctagtgggagaggcggcggcggcggcggccgaggaggaggagggggaagcggcggcggca

SEQ ID NO: 270940 - DNA, 492 bp, Homo sapiens
actgattgaaaggtgaattctgattccaaggtactttgtattctcaaattgtgtctgcttcccctgaccccctcaaaatgggagtgatgactacttgtcttcttagcactgtggggacacaaagccttagatggaagtgtgtcaaaaacaacattccataaaaggccatcacttccaattttcaagaaaggttggaaaccaaccatgatgtatgaagcactgtcagccaaattgagcaattagtaatacaaaatgaatggtataaactattctacatgtgtgtggccatgatggcaatttacacatcgaaaaaacatggccaaattcaggaagaggaatctgtaaactcacggctgttgggaagcttaatgtctgtgtaccggaacctatcaaagttacttctccatgccagtctgtccaaacaaaccttgagttgtttatttctatggaattcctgtagaatcctaatgagcatgaccttctggacccatc

SEQ ID NO: 270941 - DNA, 482 bp, Homo sapiens
cagagtcacactctatcattcaggctttagtgcagtggtgtgatcatagctcacggtgacctggagcttctaggcttaagcgatcctcccctgcccagccttctgagtagctaggactgtaggcatgatccatcatgctcagctaattttttttttgtttttgtagagatagggtcttgctgtgttgccttggctggtctcgaactcctggcctcaagtgatcctcacatctcaacctcccaaagtgctggatcatctttgttcttggcaattacagtgccattaaaacgtggctgggcatagtgactcacacctgtaatcccaatactttgggaggctgaggtgggaggattgcttgaagccacaagttcaaaaccagcctgggcaataaaccaagaccctgtctctacaaaaaaataagacaaatacaaataaaacttaacatgtttctttgattcttgaactggggctgataggtgctg

SEQ ID NO: 270942 - DNA, 569 bp, Homo sapiens
cagctgcagccactgcatgaccctaggacccagatcccccacaggctttgagaagatgaccccaagtcaagctgagcgcatatgagagcagtggagaaagagctctgtttctgtcttcaagagggcatactgcatatttcccagagacaaaagggagcatcgaacccaatgccagtttgctaacagagccttccatatgcaagcaccagagttctatgcttcaccaggttggtcatttctggaatgggaacattgaattgcaagatgttgttgattatgaccaggagtctgattcatatgctaatcagtgaaaacagtaacaaatactccaaattgatgtaccatacaatttatcatggctttgggatgtattttggcacacagtgtactacagtgattctaagatgaacattttaattttaaagtctttgcagtcattgatggcatgttgtaatttaatggcacataaaacaatggtgcatttttaatcaatgacagattcgatgaaatatggttcatgtagattttaatgtaactgacagcctggaaattcaaatcattttgaacca

SEQ ID NO: 270943 - DNA, 569 bp, Homo sapiens
cagctgcagccactgcatgaccctaggacccagatcccccacaggctttgagaagatgaccccaagtcaagctgagcgcatatgagagcagtggagaaagagctctgtttctgtcttcaagagggcatactgcatatttcccagagacaaaagggagcatcgaacccaatgccagtttgctaacagagccttccatatgcaagcaccagagttctatgcttcaccaggggtttaggtcaaggagagcaggtgcggatgaggttccaggaggaagaatcaagttggagctgtaaagcaaatcttttatttacgcagtgtgcactgaaagccttatgagagtcgactttggaaagctggactattttctccctcaatttatttcagcttcctttggaaaaaaaaaatagctcatggctgaggtaatagagcacaagccttaaaacataggctgaagcagatgggaggagggccagagtcgagatgcagccttgcttttctggctgttctggtttttacactgtgagaaaaatatcttttctaaacatgaatttgtccttcctctactatgc

SEQ ID NO: 270944 - DNA, 678 bp, Homo sapiens
taagacagggtctcactctgtcgtccaaactagagtgcagtggcgccatcacagctcactgcagctttgacctcctgggctcaaacaatcctcccacctcagcctcccaagtagctgagactataggcacgtaccaccacacttggctaatttgtatatttttagtacagatggggtttcgtcatgatgctcaggctggtctcaaaatcctgggctcgagttatctgcccacctcagccttccaaagtgctggggttacaggcatgagccgctgtgcctggcccaggatgagacttgattagatatttaacatctcttttaatatttaataaaatatccctttaacaaaatgaagaaagatatttttagcatacaagttatataaaaggatgttatttaaatctagagcatctgaactgaattttttcacaaatttcttttggccctactctatacttaactgtccacagatgaaaagcttaatatttgcaagtaatcccctccaattcctcattaatgtttgtaaggtatttgctttctacagaaattacacctttacaacccagaaatccaacctatttgtagtctgtattgctgttattagatgtgcttagatttgatacttattttaactccttttttgtaaaaattaaacagaaataaaacagtcaaacacta

SEQ ID NO: 270945 - DNA, 454 bp, Homo sapiens
ttaattatagggggaagtattctcatcatatgcaaggtaattttagtattcttgacagttattactgtaatatttgccaagtggcgagtttctgtttccatcattctgaagttaagttttaatctgaatattcaactgcataattacttcctaaagatatttgactaatactttctctacttcacactaggggaaaaaaagacatttggaggctgtgtatatgtatgctgtggaattaatggctataatggaatttataaatgtatttttacagataattgcattctaaatgaatgattcactattcttagtacttgtaagaaattggattctaaaaatcccaatttacatggatttatgagcttattagttgaattgcttttattctgtgtttatacaaaatggttaaatgtaaactatatttaaaaatagaacaaagataatatgtccttca

SEQ ID NO: 270946 - DNA, 586 bp, Homo sapiens
aaaaaatttgaaaggtgcttgtataccaaaaaattggaaaaggtgggcttacgtgttcttctgaaaggtacaactaagaacaatgaagggtgattatcacaggaaactaattttgttatcattttaaagaaacacttcctatcaataaatctgtctcatgacagaatgggaagcagaaagagcagaggcaccgagtatgaaaaagaagggacttgacagagactctgccacttctttttactgatttcctcattctacttcagtattctccccgtgattccacagttctacagttggcatttctcactggtaaaatacaagggatttctgaactgacaaatgagatatcagtgacttgggcccatctagttctaactatttatgatcctgaatatcactttgtggcacttctgccttaataactatggtaacctacttcagaaatccctctgacaatatacattgttacttgtcatttaaaaggcaacctgtaccagtacctgggataaaatacctagtatttaggagatttatagtttagaaattttttaaatcattgcttcaaacttcaccaccccataaaatc

SEQ ID NO: 270947 - DNA, 429 bp, Homo sapiens
  misc_feature (10)..(10): n is a, c, g, or t
  misc_feature (22)..(22): n is a, c, g, or t
  misc_feature (43)..(43): n is a, c, g, or t
  misc_feature (134)..(134): n is a, c, g, or t
  misc_feature (410)..(410): n is a, c, g, or t
ctggttgtgnttcccatggtgnttcccacagtcaaggaattcnaaaccagagctcagaaaaaaggtaccatcccagcagtggtcattcgacaacgaaagtcataccgtagaaaagatggcgtgtttctttattntgaagataatgcaggagtcatagtgaacaataaaggcgagatgaaaggttctgccattacaggaccagtagcaaaggagtgtgcagacttgtggccccggattgcatccaatgctggcagcattgcatgattctccagtatatttgtaaaaaaaggaataaccactgctggatgtaccttttttctgagctctggtttgcctttcttgactgtggccccggattgcatccaatgctggcagcattgcatgattctccagtatatttgtaaaaaatnaaaaaaaactaaacccatt

SEQ ID NO: 270948 - DNA, 185 bp, Homo sapiens
taaagtttttttttttttattttttacaaatatactggagaatcatgcaatgctgccagcactggacgcaatccgaataaccactgctggatgtaccttttttctgagctctggtttgcctttcttgactgtggccatcaccgtgtcacccacaccagcagtgggaagtctgttcagccatccct

SEQ ID NO: 270949 - DNA, 172 bp, Homo sapiens
taaagtttttttttttttattttttacaaatatactggagaatcatgcaatgctgccagcactggacgcaatccagggccacaagtctgcacactcctttgctactggtcctgtaatggcagaacctttcatctcgcctttattgttcactgtgacccctgcattatcttca

SEQ ID NO: 270950 - DNA, 160 bp, Homo sapiens
atacctatttttgagtgggtaacagcaagtgttgtcgctcaagcttagagtaagaaaagtctcttgaatgttccatttcatgttgttcgaactttttaaaatcattctgttccctttttattcattatatctttaattagaaaaatgataggctgggcgt

SEQ ID NO: 270951 - DNA, 282 bp, Homo sapiens
caaactagttactaataaaattccaagaccttagcttataatgacttaacatggttaccttttctaatattgcttatatttgagtaagaggaatggatgtttttcagatggaaaaaattattttggtagatgtattcttctgttatttcttaaatcttaccaataagtagcagtttactctattcatgggtgatcttgacctggttgatttttttctatcaaattcattaaataagagaatttttgtacacttggtttaataaatgaggcgagtttttatgg

SEQ ID NO: 270952 - DNA, 296 bp, Homo sapiens
gtgggctgctttaaaggtggtaccatgaagaagcttctctggaaacccctctggggtcctggcttggtcactaagctggctctactgattgtcattatcgatgggggtattttttcctttagccagacggctggggctgtggagacatgccctgctttgtgtgatcaattcatttctaataaaacagccaaaatcagagcttcagttaacctactggtgaaactggacaccagttctttttgcttcatgtaaaactggctcctgaatcttctctggaagtttggactttttaatac

SEQ ID NO: 270953 - DNA, 536 bp, Homo sapiens
ttttagcacttagtgtgccaggagagcctagaatttcatgcttaagaatttgggctttatctgtaggaaatgggagtcattgaaggcttttagtagaagacaatagggttacatttatgatttagaaagatcattgctggaggaattagaatgctgagtggaaagggtggtaggaactatgttttaccagaattatttggataattaatttagtaagcagtttttctttgactatggagaactgatatttaaaagggcttctgtatccttacagattttaaagggttcactttgaagagaacttgttaactccaaatttggcaactccagagacatttctgttaatctgactcattttagcttctctaaattgggagaagaacaaagtgacatgtgcaagagtcttgataatccccaaaccctgtatctggatatttcagggcatatttggacatattccagagaatgccttatacctacaatacttggcactttcctgttgattttatgctgacaataacgtaagaactatttgg

SEQ ID NO: 270954 - DNA, 549 bp, Homo sapiens
cgtaattggtgaaatcaggatttctcaattcagtgtaaactcacaccctaaaagaaggcacactataaagcagatttccataaacccagcgcatcatttactcttaacgatattattttaaaagcatgctcttcaggcaaaatcgctgaaagacctactcaagcaacaaaaaccagtgctgcttcaatgtcaaatctccctatgagatattaatcattagctggaagaaataggcaaaagcagttttttactgcagaaccaactaattatctttcataactcttttgaaaaccaaatgtaaaagctcaagtgaaaaacatgttaaatgcatttgtgtctagactttgccaagaaaataagggagtttaagtgcacaaaatcaaaagatcttactaaactagaatttcaaataaaggtaaaaaaaatcagccacatattgttatatatcttgtcttcagcacttaaatgtatacaatcagctgagggtgaatgttgctgtatattcaagatgtacatgcatcctatttggtgagtagcaccaacatagta

SEQ ID NO: 270955 - DNA, 357 bp, Homo sapiens
gagtcgacgaactgagtaaaaaccatgagctaggagcatgtggcattctgaaagccaagtgaagtgtttttagaacagaatggtcacctactgacagcataaaatgctgctgacgaggcaaacaacatgaagacttgaagattagatttatccaggtacagctgtgatgaatgctttcagtagagttgtagaatctactagattcaaggagaaaaaaagccatattggagtatattcaggattgggtgatgaggaagtagaaagagagtatctataaaactcattcaaggaattttgagggataaggaaattgagctgcaactagaagaggggtatgaggtcaatgagattttttaa

SEQ ID NO: 270956 - DNA, 407 bp, Homo sapiens
gaaacaaacttctttctccacgttctttctgacttccccagcctccagccttccttgctcttctcatgggtgccaccgtttgcccagccagtggagcttcaagccctcaagtcctttttgaataatccttcttcaagctttgtgactagttaatcaccaaggcctattgatttggtctattgatttccttccaaaatttctcgcacactcctctatcctcatttctaatacctctgcactgggccaggagtcaaaatactatattgacttagacaagtcacttagcctctctggtatcaacattattcataaaatggtgatttgccatgctcccctagaagtttgtgggccttttttttttttttcctttttttcttttcttttggtggcggggggacagaatctcg

SEQ ID NO: 270957 - DNA, 432 bp, Homo sapiens
gcgctgtccctgccagaaagatccttggcgcacagagcacagaatgactcgagcgggggctcgtgggttccttggcgctgtgccctccttccaggcgacagcggtgctgctggacggggttcgagccttgggctgccggtcagactttcaggtactcctctctacctctctacttataaaccaactgcaggaaagtgcatgtcaggttgtcagccataagcaggggactctcactgttatttggttaaaacatctatcctcagttacagatgcttctcctgccagttcgctgataaaaggtcagtaactatctgtttgttctcttaaaattacataagaagggaaagtgacaccgtgggaagtggaaacttctctggtcctagaatcataagacctgatttgagtcgcgtctgtgccatttacaagctgtgt

SEQ ID NO: 270958 - DNA, 628 bp, Homo sapiens
gtagataccagttagcgtgctagcttgagggagcagaatctcagcagatctccttaaagaaaagccaatgctttaaaggagatgttatctggaaaacatgcagacactgaaaatctagtttatgcagtatgatccctggtatttggcaagggctattccagaagtcaagatgggaaagggagaaggaagcagtgaggaaggaagaaatcactgaacttgagtctcatacttaatttgaccttaaagactatgaccttaaaaacaatgtccagttagattgtccttccactttagacaagtttatcaagttcaattcttctggataaaaaatatgtatcactggaaatgaggttttatacttgaattcatttcatttttaagcatatggcacttaaatattactataatataggttactaggtgcctaatagttattattagcagagttcccttgctagcagtttctatgacaaacaactcacacagagttgcttcaaaagatgcctctgcaagggctcgcttctgcaagtggaaatggctccctctagacaatggaaagaaggcaagaagaaggaggcacccaccagcagccatgactagctgaaatcagactgattccaaacacaaa

SEQ ID NO: 270959 - DNA, 664 bp, Homo sapiens
aaagcactgagattacaggcatgagccgctgtgcttgcccaatgaacacactaatgtcttgtgaaagtggtacacctgagagagggcatggtccctgccatacctcactctgtatatctctcccacttgtctgtttcttagttgtatcctttataatcaagtggtaaatataaatatctttttctaatactaaatttctaatatgaggtaagttctgggtaacaaatagcctggaagattaaatcacagctcgttcatgcctaatttcagtttcagcaatttatcttatccttaatctgaaactagggtaactgtgtcttattcaaaccagaatgtttttgagagtgaaaaggattgaatcaaaaatatgcataaactggagctatctagaaccaactgatttgtatggttacttatatatatgtgtatgtatgaattacctgtatgcaaaaggttggaaactatctaaatgaccattagtatggggactcgttgaattagcggtaccacagccactcatcagaacatagtacagctgttaaaaagtacgagataaggagatctacaagcacacgaaaagatgctaacatcaccaattattaaggaaatgcatattaaagccaccataagatactattgcatgcccattattattgctattaaa

SEQ ID NO: 270960 - DNA, 806 bp, Homo sapiens
gagtaaatgcaatgacacattctcccaaatgccagcgagctggcctgggagcaagtgatggtgtttttcctgctgccctttgtctgggctgaccgccccccctgcctattgtcccgccgcttgtcccatttccaaaagctagagctaagcgaggcgctggggctggggcaggtgactaaccagctcacaatgccccctgcgggggaggaagagggcactgcaggcccactgcccggcccagaggcgagaagaggccacttggcgggactttttccctcaagttcacaaggttcttcattcttcctccagtgaccagggagaatgtacatgggtgggggatttgtaattcattaatcagcacgaggcaacggaccagtttcaacaccacaggcttcttgggtgactcagcgggaatgctccgattcaaggcgatggaccgcccgagcgtccccatttgtgaaatgtttccccatgaagaccctggcattctccttcctttggggtttcgggttgttggtttttccggtggtgaggtgggggtggcttagcggtgagggctccccctccttcccgcaggcctgggttgggatttgctgggcaggatacctgggggtatgcctggaccctcccagagggggtcccctcctccctctccaagggctgccggggagaacacgctcagaggaggcagctctaacccagggctggggactgccctgcttcatgattttcctgggggagagtcatgtggtccccaaggcttgggtgccctatagccacaccaccaattaaatcactgggtaata

SEQ ID NO: 270961 - DNA, 681 bp, Homo sapiens
  misc_feature (80)..(80): n is a, c, g, or t
  misc_feature (83)..(83): n is a, c, g, or t
acgagaccgaagtagcacaggtgcaaacaaagagcaaaccaaccccagaatcccatccaaggagtacacgttcgtcatgncgnctggccctgaacctgggtagggggtccgggttcagtggtaatagcggcgaagatgggaaagcgcccgcttaacacttccctcgtgccgaattcggcacgagctcaccaatgcaaagtaagcatgactgctctctttctgatgtccatgctttttggccttgcatgtgggcaagcgatgtctttttgtattccaactgagtatacaatgcacatcgaaaggagagagtgtgcttattgcctaaccatcaacaccaccatctgtgctggatattgtatgacacgggatatcaatggcaaactgtttcttcccaaatatgctctgtcccaggatgtttgcacatatagagacttcatctacaggactgtagaaataccaggatgcccactccatgttgctccctatttttcctatcctgttgctttaagctgtaagtgtggcaagtgcaatactgactatagtgactgcatacatgaagccatcaagacaaactactgtaccaaacctcagaagtcttatctggtaggattttctgtctaatagtgatataatttgcaatttggttaaatgtgcttgcctgaaataaagctaataaaaata

SEQ ID NO: 270962 - DNA, 638 bp, Homo sapiens
  misc_feature (80)..(80): n is a, c, g, or t
  misc_feature (83)..(83): n is a, c, g, or t
acgagaccgaagtagcacaggtgcaaacaaagagcaaaccaaccccagaatcccatccaaggagtacacgttcgtcatgncgnctggccctgaacctgggtagggggtccgggttcagtggtaatagcggcgaagatgggaaagcgcccgcttaacacttccctcgtgccgaattcggcacgagctcaccaatgcaaagtaagcatgactgctctctttctgatgtccatgctttttggccttgcatgtgggcaagcgatgtctttttgtattccaactgagtatacaatgcacatcgaaaggagagagtgtgcttattgcctaaccatcaacaccaccatctgtgctggatattgtatgacacgggatatcaatggcaaactgtttcttcccaaatatgctctgtcccaggatgtttgcacatattccatgttgctccctatttttcctatcctgttgctttaagctgtaagtgtggcaagtgcaatactgactatagtgactgcatacatgaagccatcaagacaaactactgtaccaaacctcagaagtcttatctggtaggattttctgtctaatagtgatataatttgcaatttggttaaatgtgcttgcctgaaataaagctaataaaaata

SEQ ID NO: 270963 - DNA, 411 bp, Homo sapiens
cacaataaatagaataaatggagtgggctaattgtgtcatttcagtccaagttagaactatatgcgagataggttgaggtcaggatcgattttgccacaaaataaattctgaaaaaatcttttggtttccagatattttgggattttggaagtgtgggtaaggagttgggaagttgtattgtgttaatactaaattactgaactagatttattctttaatcacctttttaactcaaaaaggaactgtaacagtgtatttttggcttccttttcttcttatatgttaactgccacaaaagtatgtattggaattatttggttttatgatgctataagagtaaaaaaatcaaataattcttgtataactagcaggaaaacaaaacctatgccattaaaatattcaggtacctg

SEQ ID NO: 270964 - DNA, 316 bp, Homo sapiens
gatactataaaagatcaagaagaaaatatagttgaagaactgatctcagagtggggatggcctttcacgttgtacctaaaaaaattgaattgactattaatattaaaagcacatggcaaaaatatcataaaatatatttgcaatgtatgatagaaaaaggtttaatgttattaatacataaagaattcatacaaatatgtaagaaaaagctcagcttttcataaaaatgagcaaaggacatgatcaggcaagatacacaagaaggaaacacaatgggctaataaacatataaaaatgattaactttcttagcagtc

SEQ ID NO: 270965 - DNA, 517 bp, Homo sapiens
caggataagatgtttcaaaggtcagcagagtctgctttagagagccggactcttccactttgtcagattcattgatccaggtgcaccacgaggtgttgacagtggcacagactctccttggctggccagctggaagtccagggctatgcagctgctcaaatactcaaaccaaagagctgaggctgatctgttgtgtctccaaaactaaggtagtgttgttaatgacctcagtgatggtaagagacaggtgcacaaccttttctcactgagggacctgagcagtgggaaaaaccacccagagcatacacatgagcaaagagggtcagcagtgcttctcacccggtaagccctccaagtaaccagggtaggcttggttctggagctcatgccttactcagcctggtgcaacatgctccttgggagaggttgcttggaatatttgaaaaactcttattaatgccccattcgtgcagattacaaggctatcaaaaaggaaggtaaaggcctggtgtttaga

SEQ ID NO: 270966 - DNA, 448 bp, Homo sapiens
tttagcctgttacctgtttccttattcattcaatacatgcttacaaaaaaatatgtattagacactgctttagacacaagggatacaccaattagcaagacagacacagtctccaccctcagcaaccctatattctagtgggtggagaccaaaaaaaagtatgtaaacaaatgaaataatttaagacaccaatgaattctatgaaaaaaattaaacagagtagtgtgatgggaaatcactggtgtgatgggaaaaactcccttgagattagcttcaaattacctccttatagaggagctatttgagttgacacttcaatgtcaaagatccactcacctgaagatcaagtggaagaacagtcaaggaagaaaaaaagcaagtttaaagtccccaagatgggaaaaagcttgtaatattcaagggacaggaaaaaaacaaacaaacaaac

SEQ ID NO: 270967 - DNA, 559 bp, Homo sapiens
aggctgaggtaggagaatcactgaacccaggaggtggaggtttcagtgggccaagattgtgccattgcactccagcctgggtgagactctgtctctaaaaaaacaaaaataataatattgaagtaaaatgagtatttataaagtgcctattaaatgcctgattgatcactggcctgctcacttcaagggctgttcttattctaggattagaccaataaagcagccacaactggtaaattgtcactcatgaaggccgagggaaagacagcctttgagggtcttttgctgggaattaaacgttctgcctcaaaaactatacatgtcatttccattcactagtctttgagacgtcacatggccacccaggagtgtgatagcagacatgtaatcctaccataattctgggatgggaagagctggcgatattttggaataacattaaagactgccacaaacattgtaaagatagtgttatcatcacgcttcaaaagaaactgcaacacgggggtgaggtgacctgtccgtaatcattcagtgagtaaataaagcaacaaggatt

SEQ ID NO: 270968 - DNA, 394 bp, Homo sapiens
gaaaaggcaaaactgtggggacagtaaaaaccatcagtggttacgggggtggagggtgggggaggaacgggcagagccaagggttttcaggtcaatgaaaccattttgcattctctgtaaatggcggacccgtgtcctacatttgtccgaatctacggaatggctaacaccaagagtgggctctaacggatgccgtggactcggggtgatggcgcatccgtgtgggttggctgccttaataaatgtgtgctctggcgggcgggggtgtgcgggggtgatggtgagggaggccgtgcatgcgtgggggcagggagtgtgtgggactctctgtaccttctgctccattttgccatgaagctaagactgcactagaaaataaagtctatttaaaaca

SEQ ID NO: 270969 - DNA, 928 bp, Homo sapiens
gctcttatcatgcaaaccggtccaagaagcagacacatccaccttgagccagatttatttgcaaggaatgggttcaaagtcatgaaaagaggagagttcacatagactcaatttcaacaaaaagtagctctcataggggtgaatgggtttaggttgctcaagaagagagagattccaaagatggagcttgagttgaagcccccaggagctccccctgcagaaagagcagaggctcaggctgaggacagctccctgaatggccacctgaaacctgaaacccgtgatgggaacgcagaggggaccatggagcaaaaacgccagggaactctatatggtggaaaggagatagccagatgtggtggcacacccctgtagtcccagctactggggaggctgagataggaggatcacttgagcccaggagtttgagactagaatgagccatgattgtgccactgcactccagcctggtgaaagagtgataccctgttttcataagaaaaaaataacaaaaacaaaaacaagaaaggagagagttggctaagctttatcacctttgtgggtttggaacccttacttgatccttcactaaagtacttcttgggcatccagtgaggttcagtgtgtattgagaggatggtgaggatggcagccaggcgtgggacctgtattcaagaagaagctgccccactcgctggccttctatggatttccagccaacaagcatttccaaccacctatggatttccaacaactgagaactcatgagactggctgcccagtctttcctctctgccagagcatgaagaggcctccatcatttcaggttgatgctctggttcgagtagagcacactcttcagtggcttcctgagaaaatgtgcaagacaagtccattttctggctctccatagaagacccacttcacc

SEQ ID NO: 270970 - DNA, 356 bp, Homo sapiens
cacaccccaatattcagcccagctgctcagaggcaaagagctggcacagcagaaaccgagcctgcgcagggccactctgcatgggcaggtgtgacaagcttgtctctcccccagttcaccacaccttgtcccccactggtttctctcctgtaagacattgccgagctgttggtagaatttcagacaatggaggaaggtgacgaagccaagggaagggaagtctcagtttgttgcctgtggaagcccagccgcctctgtttataagagctccccattctgcccccttctcactcaaacgtctgggtgtctctgatacaaagagcctggcatagtccctgataaacagcaagtgccta

SEQ ID NO: 270971 - DNA, 535 bp, Homo sapiens
cttgtctacacagaagtgggcaatgacatgtgccatctatggcacacggtgtgcacttaatcatcatgttttagcattttgatcttctgcttatggcgctcaatttctttctgcagacgctcaatctccttcttatgatgaacgatttcttcttcatggtgttttttcaaagctgccagtataaacaagagtaatacaaagatgtataaggcaaagttgattactatgaccaattattcatttttctttacttttcttttagaatctcccctcaggcaaaattttccttctgcttcttaacatctgttccttgtacttttgagagataatcttatcttcccagttttctgcaaattctgcatattgtaggaattcaaaagaggtgaaatatagtaaaaactgaaagtgttttttattatgtcagcatggtgtctttgtggaacgttgagaagcttgaaccaatttttgagtggatcagattagaaggaatataaaatcttgtagttacatctaggaccttgacagacaagaaagt

SEQ ID NO: 270972 - DNA, 626 bp, Homo sapiens
tagaattctcgctgcactgtagtagttcttagacattttccatccccagccttaatctgagctttagctatcccaattccacacgtggcttgcttctgggctgtggactagtattagcagcccttagtccttgtcaaattaaaaccacctgttaaccttaagaaaaaaatcattcagtctctgccctcaatttactgaatcagtttctacaagaaaaacctggacttatatatattttaaaccattatagttggttctggtgttcaatcagggtggaagaccaatacactggttcctggcttccactctttctcatgactatggctgtatcttctctctcagtagtttaatctctgtgatgtccctctgctttcacaatttttctacatgaattattcggtttaaaacattcattttaccatttgttaacttcattctttatatatttcatttattttccttggaagttatttttaccttgtcggcagtgttcagttcaaccctgccttgttcacttcattgaacaaattggtcaacattttatagcaccaggcattctaaaacatccagcctccatcaaagatcactaattttaatctttctactctgtccttcctttgtaaagg

SEQ ID NO: 270973 - DNA, 443 bp, Homo sapiens
ggcgaggtgcggaaggcgtcgcgctggctactctggtacccccaggacggggtctcagtgacgaggcagggtctccacgcactggaatagtgtcaaaccacacacaagggcacagaacccagggacacagggcggctgagacacgcagctggtgatggccctcaggacggtgtcaaccagtatgtaatcacattccacacggcaccaattggacagcggcctccggtcagcctcactctgactgcaaccccctctcactggacagcatcacctggacacagagcctcacctagtctgtgtcccgtggacacaactttgctttggacagtgacaccaagaatactcacccctttacttagccagaccacaggcagccaccgggacacaaacatctctccagagtcaccctccacacagactccacagcagaactcccagggagg

SEQ ID NO: 270974 - DNA, 708 bp, Homo sapiens
tatgcttgaactgaggtcttctaacccctaatcctttacacttttcactctgccacaactaatctgagaagacttcttagaagaggtgggatttcaggattaaacacaatggcccaacaggacaggagtggatgggtaagggttacactgggatgggctgaatgtcacaaggttgacttcgtaggtgttcaggagccaggtcactgggcggaattccctgatatccgcccatctctccatcctcctctgcttagtcactgccctattcaaccacctttcattccatccccaccccaagttagttagaaaaacataaactgcccctgggtgaagctgctttatttccaagcatcccattctcagcatatactcagatggatggactgtgttttaaaagttggatagctggaagttccctaaatccatggaaaatatccccatcctatacccgttatggtgaggggagaaaaagagaaaagagaaagagaaatagcttcataaatctccggatgcaaattgtttgcatggaaaaggcctccaagtgcagctcttttttccttcatgcctgactctaggagctaatccctccattctgttaattaatttaagatgtttattgagcactggctttgtgtcagatgctgtggcacggcaccagatgcagcactgggaatccagtggtgaacaagacaggtaaaggctttccat

SEQ ID NO: 270975 - DNA, 364 bp, Homo sapiens
gtgatccgacgaacttaagagggaggggtgattttctgggttttcaacgtcttggtcctcgtctcaaaagtgtatcttcggccgggcgcggtgtctcacgtctatcatcccagcactttgggaggccaagttgggtggatcatttgaggtcaggagttcgagaccagcctggccaacatagtgaaatctttactaaaaatacaaaaattagccaggtgtggtggtgcgcacctgtaatcccagctactcgggaggctgaggcaggagaatcgcttgaacccgggaggcggaggttgcagtgagccgaggtcacaccattgcactccagcctgggagacaagagcaagactctgtctcgaaaaaa

SEQ ID NO: 270976 - DNA, 1539 bp, Homo sapiens
aaagaggttaaagtcacttgtcgaagttcacagaggtaggagttattggggttaggattcaggtccagggcagttttccccccagagcccatagaggtagaacaagaagcagcttttgggctacagagcagcttcactgtgatttacctcctcctcctactttctgcacgaccagtttcctctctccagtgacaaaacagctgaagccaccagatctacagaaggaagggggctgaaggcccaggctgagggcagttaggaggactacgtgacagggtgtggacgtgcactgtgtgtgcgtgcgtgcgtttgtgtgcatgtgtgtttgtgtgtgtgcacgtgtgtgtgtgtgtgtgctgggagaaggacaaagcttcctccagtgctaaagccttcagcaattgtatgaaaagcatgtgttgcaaaacaatccagcatcaggcgtttgcagggctttaagtaaaagctgcccaagcacgggtgtgtttgttttttccctagctctgatacccttttgatctggtttccttttttctttgggctttatctggagacgtgtgaagaattggaggccgcgctggctgtgtgttttggcggtgctactctggttagccatgtgtgccggagctctggggacttctggggggtgagccacgtggcagctccttagggctccttcttagcgagtctcccagcagatctgccagagcagcaggtcggcagcaggagcccaggtccagcgttgcaggggtggggaaaaccatttcctggctggagaaggctgctgctgggctgggtgggcaagtcctgacacattagcgatcagccaactgttttattaccaggtctcccatggagaaaacacttcgtaaatcgaggagctgttacaaaagtcgaatggcagcatcattagtgcccagctttctggaaatgtggatttcctgacagttttctcaccttctcatcttatagatttcctgtcagcctggatcatagccatgacagcctccccgttccctgtcctctctgtgcatgcacctgtgcatgtgtgtataaagacagaattatttagacaaatggctttcagaagttccgtcacagatataccccatgttcgtttacagtgagtttcacccaacatttgagtctatttactgagaaatggttgggaaggagctgaagagccactgcaaatgattgtagatggatgtggtaactttttggggtgaaagatttagcagctcagatgataaggttagattaagatagcatttaaaatgacatctgcaaagagaggcagttttaattaagagaatctacttccaaactccctactcatggggaaactaaggctcatgtacagcggcagaatgagggtgatcagtcttctttctatttattgacagaagactctatttaataaagagtgtatgggctgcctataattccagcactttgggaggccgaggcagaaggatcacttgagcccaagaattcaagactagcctgggcaacaaagcaagaccccgtgtctaccaa

SEQ ID NO: 270977 - DNA, 453 bp, Homo sapiens
gccacgaaacatccaatatttgaaagtgttctatggacctcaaagggcaagagacaccttaaaatgtttgctggatggctgtaggagggtagagccctggtgggcacacctggtggtgagcttggaggcgaggctctgctgctcatgttcatggagtcccacgtccaccaggccctttgaatctcgagtttctggcttcagatgcccccaggtttccagaagtcaagatttctaacaaatggacccaaaccccaagccagcacctggaagtggcagcaacacggctgtgtggaccccggtgctgggaaccttctggaggcagctggacacaggggctgccagtgtggagagggacgctgctcattttgacatttcatctgaataacgttccaagtgttctaatgaaagcctctgcgctccctttgaaatactagcaattacaaagatgaataa

SEQ ID NO: 270978 - DNA, 486 bp, Homo sapiens
acccactacacattcaggatgaataaaaatgtccccaaacagccccaaacaaaagcctttgggaaacagattcttgcatacatcttttgtctatgcttaaaaagtgggcattatactaactttcaaaatttttttttttttaaattctacatgcaaagatgaagcatcactaagaatgcaactttattttaaaaattatttcattttttcacgcctgtaatcccagcactttgggaggccgaggcgggcggatcacgaggtcaggagatcgagaccatcccggctaaaacggtgaaaccccgtctctactaaaaatacaaaaaaattagccgggcgtagtggcgggcgcctgtagtcccagctacttgggaggctgaggcaggagaatggcgtgaacccgggaggcagagcttgcagtgagccgagatcccgccactgcactccagcctgggcgacagagcgagactccgtctcaaaaaaaaaaaa

SEQ ID NO: 270979 - DNA, 322 bp, Homo sapiens
gaaagatgaagtccattatgtgctggttcatgctacccaccatgtcaggatcatccaggaggacaaagaactaggcaagtgtttgctggtgtttgattcagttaatagtattaacagcagccacttttactatgctcttgattctgtgtcaagctttcttgttatttatttttgagacagagtctcactcagtgcccaggctagagtgcagttttattgtgctcttgattctgtgtgtgtgcccggcctgttcctgctgctcgtggcgctggaccgcatggagtacgtgcgcaccttaccaagcgcgaggacctcgcggccc

SEQ ID NO: 270980 - DNA, 217 bp, Homo sapiens
gctttttccaaagctagtgcttcatagtattggcttctgtgcccatggggcagcaaaaccatttgcttgataaaaatgcggtggctctcgccagtaatcccagcactttgggaggccgaggcgggcagatcacctgaggtcgggagttcgagaccagcctgaccaacatggagaaaccccgtctctactaaaaatacaaaattagccgggtgtggtg

SEQ ID NO: 270981 - DNA, 807 bp, Homo sapiens
  misc_feature (220)..(220): n is a, c, g, or t
  misc_feature (307)..(307): n is a, c, g, or t
  misc_feature (784)..(784): n is a, c, g, or t
gaggagcgtggctctctcctctccaccatggcatgtgctcgcctactaatatcggtgtactctgaaagtggggagtcatctggcaaaaatgtcactttgcctgctgtattcaaggctcctattcgaccagatattgtgaactttgttcacaccaacttgcgcaaaaacaacagacagccctatgctgtcagtgaattagcagcgacagttgcctgctgtnagtaagctggtacagaaggttgacgaaaattcttactgagcaagaaataaccttgttgtaattactaaaatttgagaaatgtgattnttgactggaaaaatagatgtgtcgtggaggccgaatgtttgcaccaaccaaaacctgacgccgttggcatcgtagagtgaacacaacccaaaaacgatacgccatctgttctgccctggctgcctcagccttaccagcactggtcatgtctaaaggtcatcgtattgaggaagttcctgaacttcctttggtagttgaagataaagttgaagggtacaagaagaccaaggaagctgttttgcttcttaagaaacttaaagcctggaatgatatcaaaaaggactatgcctctcagcgaatgagagctggcaagggcaaaatgagaaaccgtcattgtatccagtgcacaggcccctacatcatctataatgaggataatggtatcatcaaggccttcagaaacatccctggaattactctgcttaatgtaagcaagctgaacattttgaagcttgctcctggttgggcatgttggangtttctgcatttggactgaaagt

SEQ ID NO: 270982 - DNA, 475 bp, Homo sapiens
caacactattaataggatctaatcgatattcataaagcactgaattcaactatagcagaatatatatatattttttcaagtgcccacagaacatataccaagatagaccatatcccgggtcataaaacaaactttagcaaatataaaataattgaagccatgtagaatgttttacctaacctcaatgaaacaaactataaatcagtcacagaaagataatagaaaaatctccaaacacttggaaacttaacaacacacttcttaataatctatgggtcaaagaggaatctcaagggaatttaaaaatacattaaactaaatggaaagataaatatataaaaatttgtgggacacagctaaagcagtgctgaaagggaaatgaatataaaagggggaaaagtctcaaataaatagtttaacgttttatctcaagaaaagataaagaagagagaaataggcccaaagcaagcagaag

SEQ ID NO: 270983 - DNA, 433 bp, Homo sapiens
gtttggaagagaaaaaggtaaaaaggttgcaagagtgcaagatttcaagattcatctttgaaagctaggttaatggattagtctgccaaaaatatgaaaatataaaaatattataaattagtcagatgtccatggctgtaatctgtttgcctgatgccagatgtacttatgataggaaaaacaggcggcttaaaaatagctagaaaatgttaagtacttatataacacatttttttgttttaagtatcaaatgggttgttatcttattagggtttccagtaaaagaagtgcctatgatttaacttggaccaatggtaagttttcccattttaggatttcagtgttcatttagggaactataatactatgtagtacaaatcctttattaaatcaatgcattcattatctgaaataaaagttttattcaatcact

SEQ ID NO: 270984 - DNA, 424 bp, Homo sapiens
gacacagtctcactctatcacccagactggagtgcagtggcacaatcttggctcactgcaacctccgcctcccgggttcaagcgattctcctgcctcagccttccaagtagccgggattacaggcatgcaccaccacgcctggctaatttttgtatttttggtagagacagagtttcaccatttagccaggctggtcttgaactcctgacctcaggtgatctgcctgcctcagcctcccaaagtgctgagattacaggtgtgagccactgtgcctggccaggttcttacgtttcaatatctcagaaagctaattaaagatcttaatctcatttaaatctcttgattttacacagtaataacagcaaacacatggtgaaatctggccaacttaactcagaaacttcattttaggatgatatttca

SEQ ID NO: 270985 - DNA, 524 bp, Homo sapiens
cacaccagcaggcgatagaagtggcattcagggactgctgtcattgctgctgagatccaagactcctcttggtgcactgtgatttgcagggaaagctgtgtctctctgacttgcaggccagaggttctgaagattgcttgaggttgcaagtacctccaagcttgagcagcagttttgaagtgtggagatgggaggtgagttattcacatctctaacaaaggagctgctgcttctggcttcaggaggggctgagaggcccctgattcactatctcatcactgggctggaagctccacagggatcagttaggcctgtgggccatgctttcagcacttggaggagaagatcccttagactcagcctttggctccatgccactcttgacaatgtacagggaagccacttggacctgatgctggagtttaatcaacagacaaggaagaggccccagtgtgtactgggcaaaagaacgggacgggtgtgctgaaaagcgtctcataaacagactttgttttcctgtgttt

SEQ ID NO: 270986 - DNA, 169 bp, Homo sapiens
tgaggtcaggaaaccgaagacatagcaaaggccatgatagtcttatgttcaagaggaaaatcaagataataaataatcctgtgtttttgtgtagcctgctctatagttcacgaagtaccagcaccttgtctcatatctatccttttctctccattcccccatcaaccag

SEQ ID NO: 270987 - DNA, 779 bp, Homo sapiens
ggcatgaggaggctggccggcaaaacagttttcaggtgtagccgagtgactgctgaaccccgtgttgcgattgcaggttgtcacaaccagtggccacaaaaattgggagctaggtttcacttagttttcactccttattccatgctggagttggtgatggttaataccttaaccagcctttgtatctcaagtagagagtgacccagggcttggctgcacagtggtcagtggttttcaggaggtaggggtgaggggagatgtcggtcaacatgggacacccaggcttgcactgatgtttctttctgggtcttctcattgctttggtaagcggtgtgtgagacacttttcctgccactgcatccccttttcctggctgacactttgatctgagactttaattagtaattagacccagatccatcttttggttaatcaccacgtagtaaaagaaaaagcacattggaggctggtgctggaaagtgcctttggaccttttactcagattaacgtaatatattctttttcaggtgatagtaatctagatgttccatgagtctggttttgtgtaaagatataatagtatttggggcatgaccaaagattgcagaatggaacagataacttaaccagaggagaattgtataatttgaaaggacatagaattttagggcttagagatgatctcacctatcatagcattgttgtttaagagcctgggttctttctgatttactttctctaaaatggggataagaacagtatctacttcaagggtacaa

SEQ ID NO: 270988 - DNA, 433 bp, Homo sapiens
cacagggccagaatacataaggactataaacatcatcggtatttggagtccagaatcatcacaaattgttaatcctggtaatagataaaggggaggacatgggcaggccaacaggcacttaagttactgtctactaaaataacacactctgtttactgaatcacaactgctctggggaaaccagggctgaccagtgaaagcttacagacccctcttcagccacaaactggaattatgaagtggcctccagatatgacatattttgatgttcagttcagtgcttcactttcctcagaactacttggctacagaatactttgatcctggcccttctgtgactgctccctgatggaatatttggacaaaatcccaacactgaattaagatgaaggtatgctgtaatgtcttatatgaaaaataacatcagatcaaa

SEQ ID NO: 270989 - DNA, 1518 bp, Homo sapiens
  misc_feature (1080)..(1080): n is a, c, g, or t
  misc_feature (1133)..(1133): n is a, c, g, or t
tgtttctgaaaaagtgctaataaacatacattctgtgggcattttctcacttccctataggtgacatgcttcgttatattcaggagagtaaggaacgagctgcagaaatggtaaaagcagaggtactgcgagaacgtcaagaaaccgcccgaaagatgcgcaaatattatttgatttgcctccaacagattttgcaggatgatggaaaagaagggtgagttcagtctgaacaatgtgtcctgagattaccaggacaacatgttatcatttttaaagcattttccttaaccactaaattaactatttctacatgatcagccatagggggttaagagaggtttatggctgtgctaccctaaatgttggcagagccaataggaaaacagaaaccatggggctaaggcaactcattttttcctttaaactatatttttaatattctggaattccccacagggctgagaaaaagattatgaatgctgctagcaaacttgctacaatggcaaaattactggaaacacctatttctagtaagtcccaaagcaaaactacacagtcaggtatgtcaaagtgagtcgccaaatggtttttctatcttttcttctttagctatttaatattttcagtatgaagaaggcagggaaggtaaggagtgagagttaatttgtgaagttttgtatgttttacttaaactagaagtttacgcaaaaagagtacacagtttccaatttaagtaggcagactgagcatgcccatcagtttcctattgctgcttccatccctcgaaatgatagaaaagattttaaacagcaaataaagaatgagaaaaagaagaaattataagtgggttttaaaaagttgcagtgggccaggcatcatggctcacacctgtaatcccagcactttgggaggctgaggtgggaggatcccttgatcccaggaatttgaggttgcagtaagctatgattgtgccactgtactccagcctgggtgacagagtgaggccctgtctcaaaaaaaaaaaaaaaaagtttgcagtggatagaccagaagctacaagaaatccctgagagaaagaanacagtataggatggaagatggaaacctcagttcaaaaccaccgggagatgacnattgcaattaggagcaatatcaaaactgttccacatatgagggtgatatgttccaggagaaatagagggcctaggggatatgaatggggtaattagttggtgttctaaaccaacagcaaccaggtggggttaatcctctctttatttcttcttctcccctcctttccccaacctcaatattgagctgggcaacaacaacaggaacaaagaatctgggagcagggcagtgctccaggtggctagccatatcaagcaggaactgggagccgacttgccttgggaggctgagatgggaggatcacttgagtccgggaggtcaaggctgcagtgagctgtgatcgcaccactgcactccagcctgggaaacagagcagaccctgtctca

SEQ ID NO: 270990 - DNA, 577 bp, Homo sapiens
acagtatgaagagcctcgaacaaccattttactccgtgccagtacacatgggaaagggttgaaaggatatgtgaacctgccgccaccaattccttgattattcactggaaccctttcagccagagaagatagacacagtactgggctttactgaggactgggtggcgctgtctttaggggcaggttaataatatacacctaagtgacaagaacactcacacccgaggaaattagagtagtaaatagacacgtggaaaaatgtgccatcttatcagtaattaaagaagcaaaaatgtaaacaaagcggcacctagtaaggtagaagacaaagcaaaatatctaaggctgttaaataatggggaagcaggcgccttagaaaacaagggcaaatgtaaaaaacctctaaggcaagagttcggtggggaatctgcgggattctgtgtgctgaagcgcaggaggcacgagtcacctttgcagtctccggtaccaaacgggcaaggggtccccgtaagactgctgcaccctggccgaaggtagcgggtgaagcgcctcggcgtctctaggcaaccgatcagcc

SEQ ID NO: 270991 - DNA, 617 bp, Homo sapiens
atgacattaaatatttttataaaatataattttttgttttgttttgtttgagacagggtctcactctgtcactcaggctggagtacagtggtgtgatctcacctcactggagcctccccctttttaatggcttaattgtatacagacattatattatttgacctgaatgaaaagatagaaataaataaacctcttatttgacatataaattgttttcagcctttcacataaatgtttacataaaaagaggtcatagaacaagaattaaaaattagaaggggatcagacttctcacttgcaacaaataaaattagaaaacagtggaacagtgcttttacacttctgatggaaaaagaccttcaattcataatccagtactcagcctgccaatttaataataatgcaatgcctttaaaaatttactatttccaggtacaatagctcacacctgtaatcccagcactttgggaggctaacgtgggcaaatcacttgagcccaggagttcccgaccaacctgggcaacatggtgaaaccccatttctacaaaaaaaatacaaaaattaggtgggcgtgatggcatgcacctgcagtcccagctacttgggaggctgaggca

SEQ ID NO: 270992 - DNA, 4572 bp, Homo sapiens
tcggcgattgaaggatgcgagtgctccttaagggcctccgccccgtgagttcggttgtgactaggaaggagctagtggactagagccagggtaaggggatctgctagaagttggtcttccgccaggactagagtttcctcgcggtaacagcctccgtggcctccggaggaccatgtcattagactttggcagtgtggcactaccagtgcaaaatgaagatgaagagtatgacgaagaggactatgaaagagagaaagagttgcagcagttactcacagaccttccccatgacatgctggatgacgacctctcctctccagagctccagtattcggactgcagcgaggatggcacagacggacaaccacatcatcctgagcaattggagatgagctggaatgagcaaatgctgcccaaatctcaaagtgtaaatggctataatgaaattcagagtttatatgctggagaaaaatgtggtaatgtctgggaagaaaatagaagtaaaactgaagaccgacatcctgtgtaccatcctgaagaaggtggagatgaaggtggaagtggttatagtcctccaagtaaatgtgaacagactgatttatatcaccttcctgaaaactttaggccatataccaatggtcagaagcaggaatttaataaccaagcaaccaatgtaattaaattttcagatcctcaatggaaccattttcagggtcccagttgtcaaggtttggaaccgtataataaagtgacatataaaccttatcagtcttctgcccagaataatggctcaccagcccaggagataacaggaagtgacacattcgaaggcctgcaacaacaatttttaggagctaatgagaactctgcagaaaatatgcagattattcaacttcaggttcttaacaaagcaaaagagagacaactggagaacttaattgaaaagttaaatgaaagtgaacgtcaaattcgatatctgaatcaccagcttgtaataataaaagatgaaaaggatggtttgactctcagccttcgagaatcacagaaactctttcagaatggaaaagaaagagagatacagcttgaagctcaaataaaagcactggagactcagatacaagcattaaaagtcaatgaagaacagatgatcaagaagtccagaacaactgaaatggctctggaaagcttgaagcagcagctggtggaccttcatcattctgaatcacttcaacgagctagagaacagcatgagagcattgttatgggcctcacaaagaagtacgaagagcaagtattgtccttacaaaagaatttggatgccacagtcaccgcacttaaagaacaggaagacatttgctctcgtctgaaagatcacgtgaaacaactggaaaggaatcaagaagcaatcaagttagaaaagactgagatcattaataagttgacaagaagtctagaggagagtcaaaagcagtgtgcccacttgttgcagtccgggtcagtacaagaggtggctcagctacagttccagctgcagcaagcacagaaggcacatgctatgagtgcaaacatgaacaaggctttgcaagaagaattaacagaactaaaagatgaaatttctctctatgaatctgctgcaaaactaggaatacatccaagtgactcagaaggagaattaaatatagaactcactgaatcgtatgtggatttgggtattaaaaaggtcaactggaaaaaatccaaagttaccagcattgtacaagaagaagacccaaatgaagagctttcaaaagatgagttcattctgaagttaaaggcagaagtacagcgtttgctgggtagcaactcaatgaagcgtcatctggtgtctcagttacaaaatgacctcaaagactgtcataagaaaattgaagatctccaccaagtgaagaaggatgaaaaaagcattgaggttgagactaaaacagatacctcagaaaaaccaaagaatcaattatggcctgagtcttctacttctgatgttgtcagagatgatattctgctgcttaaaaatgaaattcaagttttacaacaacaaaatcaggaacttaaagaaactgaaggaaaactgagaaatacaaatcaagacttatgtaatcaaatgagacaaatggtacaagattttgaccatgacaaacaagaagctgtggataggtgtgaaaggacttatcagcagcaccatgaagccatgaaaactcaaatacgtgaaagcctattagcaaagcatgctttggagaagcagcagctctttgaggcttatgagagaactcatttgcaactgaggtctgagttggataagttgaataaggaggtgactgctgtgcaggaatgttacctagaagtgtgcagagagaaggataatctagaattgactctcaggaagaccactgaaaaggagcaacagactcaggagaagatcaaagaaaaactcattcaacagcttgaaaaggagtggcagtctaagctggatcaaactataaaggcaatgaaaaagaagaccttagattgtggcagccaaactgaccaagtaaccaccagtgatgttatttccaagaaagagatggcaattatgatagaagagcagaagtgcacaatccagcaaaacttagaacaagagaaggacatagccatcaagggggctatgaagaaactcgaaattgaattggaactcaaacattgtgaaaatattaccaaacaggtagaaatagctgtgcaaaatgctcatcagcgatggctgggagaactaccagagctggcagagtatcaagcacttgtgaaggcagaacagaaaaagtgggaagaacagcatgaggtctctgtgaacaaaaggatatcatttgctgtttctgaagctaaagagaaatggaagagtgagcttgaaaatatgaggaaaaatatacttcctggaaaggaattggaagagaagattcattctcttcagaaggaacttgagttaaagaacgaagaagtccctgtggtcatcagggctgagttagctaaggctcggagtgaatggaacaaagaaaagcaagaagaaatccacagaatccaagaacaaaatgagcaagattaccggcaatttttagatgatcaccgaaataaaattaatgaggtgcttgcggcagctaaagaagactttatgaaacaaaaaactgaactacttcttcagaaggagacagaattacaaacttgtctagaccagagtcgtagagaatggactatgcaggaagccaagcggatccaactggaaatctatcagtatgaggaagacatcctgactgtacttggggttcttttaagtgatacccaaaaggagcacatcagtgattctgaggacaagcagcttttggaaatcatgtcgacttgttcttcaaaatggatgtctgtgcaatattttgaaaaactaaagggctgcatacagaaagcatttcaagatacacttcctctgcttgtagaaaacgctgacccagaatggaaaaagagaaatatggccgagctctctaaggattctgccagccagggcactggccaaggagaccctggacctgctgctggacaccatgctcagcccttggccttacaagcaacagaagcagaagctgataagaaaaaggtccttgaaattaaggatttatgctgtggacactgcttccaagaacttgaaaaggcaaagcaggaatgtcaagatctgaaaggaaaactggagaaatgctgtaggcatcttcagcatttagaaaggaagcacaaagctgtagtggaaaaaattggagaagagaataataaagttgttgaagaattaatagaagaaaacaacgacatgaagaataaattggaagaattgcaaacactttgtaaaacaccaccaaggtcattgtcagcaggggccattgaaaatgcttgcctgccatgcagtgggggagccttggaagaacttcgtgggcagtacattaaagctgtaaaaaaaattaaatgtgacatgcttcgttatattcaggagagtaaggaacgagctgcagaaatggtaaaagcagaggtactgcgagaacgtcaagaaaccgcccgaaagatgcgcaaatattatttgatttgcctccaacagattttgcaggatgatggaaaagaaggggctgagaaaaagattatgaatgctgctagcaaacttgctacaatggcaaaattactggaaacacctatttctagtgaagaagctaagtctcagaaagataactcacccaagaggacacaaggataaacctgatacccatggcagtagaaagcctacacttacccactcagatgctcatcaatggaggagagacttatgcctggaggaacttggaaatcaaactcagtacaatagctcacacctgtaatcccagcactttgggaggctaacgtgggcaaatcacttgagcccaggagttcccgaccaacctgggcaacatggtgaaaccccatttctacaaaaaaaatacaaaaattaggtgggcgtgatggcatgcacctgcagtcccagctacttgggaggctgaggca

SEQ ID NO: 270993 - DNA, 768 bp, Homo sapiens
tgtgctgaagcgcaggaggcacgagtcacctttgcagtctccggtaccaaacgggcaaggggtccccgtaagactgctgcaccctggccgaaggtagcgggtgaagcgcctcggcgtctctaggcaaccgatcagcccgcccactccggggtgacttcctcgtaattggctctcgaatccaccaatgggcgcacagggggagcttcccgccacctctggcgcccgctttcaaacagccgtactttgcaactgcaggtggacttctcaaccaagcttgaggaaggcggagacttctgcctcctcgctctgccctgagctggcacggctccgcccaccgggcgagcttctagtcggcgattgaaggatgcgagtgctccttaagggcctccgccccgtgagttcggttgtgactaggaaggagctagtggactagagccagggtaaggggatctgctagaagttggtcttccgccaggactagagtttcctcgcggtaacagcctccgtggcctccggtaagttctgattcacgggtgagcttggacctggggttagaggagttgcggggtcctcgggatgctggctgagggttcctgggggggctgacctgccccctccccaaatcccgcggtggtggactgcccgcatgttgcgggctcagcttttaccttaacgtgtcatttagacctcttcattcctccaatatcctacttagaagtgacatatgggaagcccgcctcgtttccaggctgctggggtcgccctgag

SEQ ID NO: 270994 - DNA, 405 bp, Homo sapiens
agaagaagatgggatacagattttaagtgctgagaaaacagagcaagggaatggtctgagtagggtttctaaggggatgaacgttacagaaaagcgactggaaattgcacagtctcttctataaacatttgtattgggaacttaagggaaaagaaggcttaaaaaatttttaactgtctaatatactataaactttctgttatagaagagaataataaagttgttgaagaattaatagaagaaaacaacgacatgaagaataaattggaagaattgcaaacactttgtaaaacaccaccaaggtatacttttactattttaaagtgctattttaaagaaatctaagtacaagtatctttaaatttttttaagtatcaattttttttgttatacagcaaaaagtat

SEQ ID NO: 270995 - DNA, 4944 bp, Homo sapiens
  misc_feature (4506)..(4506): n is a, c, g, or t
  misc_feature (4559)..(4559): n is a, c, g, or t
tcggcgattgaaggatgcgagtgctccttaagggcctccgccccgtgagttcggttgtgactaggaaggagctagtggactagagccagggtaaggggatctgctagaagttggtcttccgccaggactagagtttcctcgcggtaacagcctccgtggcctccggaggaccatgtcattagactttggcagtgtggcactaccagtgcaaaatgaagatgaagagtatgacgaagaggactatgaaagagagaaagagttgcagcagttactcacagaccttccccatgacatgctggatgacgacctctcctctccagagctccagtattcggactgcagcgaggatggcacagacggacaaccacatcatcctgagcaattggagatgagctggaatgagcaaatgctgcccaaatctcaaagtgtaaatggtcccagttgtcaaggtttggaaccgtataataaagtgacatataaaccttatcagtcttctgcccagaataatggctcaccagcccaggagataacaggaagtgacacattcgaaggcctgcaacaacaatttttaggagctaatgagaactctgcagaaaatatgcagattattcaacttcaggttcttaacaaagcaaaagagagacaactggagaacttaattgaaaagttaaatgaaagtgaacgtcaaattcgatatctgaatcaccagcttgtaataataaaagatgaaaaggatggtttgactctcagccttcgagaatcacagaaactctttcagaatggaaaagaaagagagatacagcttgaagctcaaataaaagcactggagactcagatacaagcattaaaagtcaatgaagaacagatgatcaagaagtccagaacaactgaaatggctctggaaagcttgaagcagcagctggtggaccttcatcattctgaatcacttcaacgagctagagaacagcatgagagcattgttatgggcctcacaaagaagtacgaagagcaagtattgtccttacaaaagaatttggatgccacagtcaccgcacttaaagaacaggaagacatttgctctcgtctgaaagatcacgtgaaacaactggaaaggaatcaagaagcaatcaagttagaaaagactgagatcattaataagttgacaagaagtctagaggagagtcaaaagcagtgtgcccacttgttgcagtccgggtcagtacaagaggtggctcagctacagttccagctgcagcaagcacagaaggcacatgctatgagtgcaaacatgaacaaggctttgcaagaagaattaacagaactaaaagatgaaatttctctctatgaatctgctgcaaaactaggaatacatccaagtgactcagaaggagaattaaatatagaactcactgaatcgtatgtggatttgggtattaaaaaggtcaactggaaaaaatccaaagttaccagcattgtacaagaagaagacccaaatgaagagctttcaaaagatgagttcattctgaagttaaaggcagaagtacagcgtttgctgggtagcaactcaatgaagcgtcatctggtgtctcagttacaaaatgacctcaaagactgtcataagaaaattgaagatctccaccaagtgaagaaggatgaaaaaagcattgaggttgagactaaaacagatacctcagaaaaaccaaagaatcaattatggcctgagtcttctacttctgatgttgtcagagatgatattctgctgcttaaaaatgaaattcaagttttacaacaacaaaatcaggaacttaaagaaactgaaggaaaactgagaaatacaaatcaagacttatgtaatcaaatgagacaaatggtacaagattttgaccatgacaaacaagaagctgtggataggtgtgaaaggacttatcagcagcaccatgaagccatgaaaactcaaatacgtgaaagcctattagcaaagcatgctttggagaagcagcagctctttgaggcttatgagagaactcatttgcaactgaggtctgagttggataagttgaataaggaggtgactgctgtgcaggaatgttacctagaagtgtgcagagagaaggataatctagaattgactctcaggaagaccactgaaaaggagcaacagactcaggagaagatcaaagaaaaactcattcaacagcttgaaaaggagtggcagtctaagctggatcaaactataaaggcaatgaaaaagaagaccttagattgtggcagccaaactgaccaagtaaccaccagtgatgttatttccaagaaagagatggcaattatgatagaagagcagaagtgcacaatccagcaaaacttagaacaagagaaggacatagccatcaagggggctatgaagaaactcgaaattgaattggaactcaaacattgtgaaaatattaccaaacaggtagaaatagctgtgcaaaatgctcatcagcgatggctgggagaactaccagagctggcagagtatcaagcacttgtgaaggcagaacagaaaaagtgggaagaacagcatgaggtctctgtgaacaaaaggatatcatttgctgtttctgaagctaaagagaaatggaagagtgagcttgaaaatatgaggaaaaatatacttcctggaaaggaattggaagagaagattcattctcttcagaaggaacttgagttaaagaacgaagaagtccctgtggtcatcagggctgagttagctaaggctcggagtgaatggaacaaagaaaagcaagaagaaatccacagaatccaagaacaaaatgagcaagattaccggcaatttttagatgatcaccgaaataaaattaatgaggtgcttgcggcagctaaagaagactttatgaaacaaaaaactgaactacttcttcagaaggagacagaattacaaacttgtctagaccagagtcgtagagaatggactatgcaggaagccaagcggatccaactggaaatctatcagtatgaggaagacatcctgactgtacttggggttcttttaagtgatacccaaaaggagcacatcagtgattctgaggacaagcagcttttggaaatcatgtcgacttgttcttcaaaatggatgtctgtgcaatattttgaaaaactaaagggctgcatacagaaagcatttcaagatacacttcctctgcttgtagaaaacgctgacccagaatggaaaaagagaaatatggccgagctctctaaggattctgccagccagggcactggccaaggagaccctggacctgctgctggacaccatgctcagcccttggccttacaagcaacagaagcagaagctgataagaaaaaggtccttgaaattaaggatttatgctgtggacactgcttccaagaacttgaaaaggcaaagcaggaatgtcaagatctgaaaggaaaactggagaaatgctgtaggcatcttcagcatttagaaaggaagcacaaagctgtagtggaaaaaattggagaagagaataataaagttgttgaagaattaatagaagaaaacaacgacatgaagaataaattggaagaattgcaaacactttgtaaaacaccaccaaggtcattgtcagcaggggccattgaaaatgcttgcctgccatgcagtgggggagccttggaagaacttcgtgggcagtacattaaagctgtaaaaaaaattaaatgtgacatgcttcgttatattcaggagagtaaggaacgagctgcagaaatggtaaaagcagaggtactgcgagaacgtcaagaaaccgcccgaaagatgcgcaaatattatttgatttgcctccaacagattttgcaggatgatggaaaagaaggggctgagaaaaagattatgaatgctgctagcaaacttgctacaatggcaaaattactggaaacacctatttctagtaagtcccaaagcaaaactacacagtcaggtatgtcaaagtgagtcgccaaatggtttttctatcttttcttctttagctatttaatattttcagtatgaagaaggcagggaaggtaaggagtgagagttaatttgtgaagttttgtatgttttacttaaactagaagtttacgcaaaaagagtacacagtttccaatttaagtaggcagactgagcatgcccatcagtttcctattgctgcttccatccctcgaaatgatagaaaagattttaaacagcaaataaagaatgagaaaaagaagaaattataagtgggttttaaaaagttgcagtgggccaggcatcatggctcacacctgtaatcccagcactttgggaggctgaggtgggaggatcccttgatcccaggaatttgaggttgcagtaagctatgattgtgccactgtactccagcctgggtgacagagtgaggccctgtctcaaaaaaaaaaaaaaaaagtttgcagtggatagaccagaagctacaagaaatccctgagagaaagaanacagtataggatggaagatggaaacctcagttcaaaaccaccgggagatgacnattgcaattaggagcaatatcaaaactgttccacatatgagggtgatatgttccaggagaaatagagggcctaggggatatgaatggggtaattagttggtgttctaaaccaacagcaaccaggtggggttaatcctctctttatttcttcttctcccctcctttccccaacctcaatattgagctgggcaacaacaacaggaacaaagaatctgggagcagggcagtgctccaggtggctagccatatcaagcaggaactgggagccgacttgccttgggaggctgagatgggaggatcacttgagtccgggaggtcaaggctgcagtgagctgtgatcgcaccactgcactccagcctgggaaacagagcagaccctgtctca

SEQ ID NO: 270996 - DNA, 5223 bp, Homo sapiens
  misc_feature (4785)..(4785): n is a, c, g, or t
  misc_feature (4838)..(4838): n is a, c, g, or t
tcggcgattgaaggatgcgagtgctccttaagggcctccgccccgtgagttcggttgtgactaggaaggagctagtggactagagccagggtaaggggatctgctagaagttggtcttccgccaggactagagtttcctcgcggtaacagcctccgtggcctccggaggaccatgtcattagactttggcagtgtggcactaccagtgcaaaatgaagatgaagagtatgacgaagaggactatgaaagagagaaagagttgcagcagttactcacagaccttccccatgacatgctggatgacgacctctcctctccagagctccagtattcggactgcagcgaggatggcacagacggacaaccacatcatcctgagcaattggagatgagctggaatgagcaaatgctgcccaaatctcaaagtgtaaatggctataatgaaattcagagtttatatgctggagaaaaatgtggtaatgtctgggaagaaaatagaagtaaaactgaagaccgacatcctgtgtaccatcctgaagaaggtggagatgaaggtggaagtggttatagtcctccaagtaaatgtgaacagactgatttatatcaccttcctgaaaactttaggccatataccaatggtcagaagcaggaatttaataaccaagcaaccaatgtaattaaattttcagatcctcaatggaaccattttcagggtcccagttgtcaaggtttggaaccgtataataaagtgacatataaaccttatcagtcttctgcccagaataatggctcaccagcccaggagataacaggaagtgacacattcgaaggcctgcaacaacaatttttaggagctaatgagaactctgcagaaaatatgcagattattcaacttcaggttcttaacaaagcaaaagagagacaactggagaacttaattgaaaagttaaatgaaagtgaacgtcaaattcgatatctgaatcaccagcttgtaataataaaagatgaaaaggatggtttgactctcagccttcgagaatcacagaaactctttcagaatggaaaagaaagagagatacagcttgaagctcaaataaaagcactggagactcagatacaagcattaaaagtcaatgaagaacagatgatcaagaagtccagaacaactgaaatggctctggaaagcttgaagcagcagctggtggaccttcatcattctgaatcacttcaacgagctagagaacagcatgagagcattgttatgggcctcacaaagaagtacgaagagcaagtattgtccttacaaaagaatttggatgccacagtcaccgcacttaaagaacaggaagacatttgctctcgtctgaaagatcacgtgaaacaactggaaaggaatcaagaagcaatcaagttagaaaagactgagatcattaataagttgacaagaagtctagaggagagtcaaaagcagtgtgcccacttgttgcagtccgggtcagtacaagaggtggctcagctacagttccagctgcagcaagcacagaaggcacatgctatgagtgcaaacatgaacaaggctttgcaagaagaattaacagaactaaaagatgaaatttctctctatgaatctgctgcaaaactaggaatacatccaagtgactcagaaggagaattaaatatagaactcactgaatcgtatgtggatttgggtattaaaaaggtcaactggaaaaaatccaaagttaccagcattgtacaagaagaagacccaaatgaagagctttcaaaagatgagttcattctgaagttaaaggcagaagtacagcgtttgctgggtagcaactcaatgaagcgtcatctggtgtctcagttacaaaatgacctcaaagactgtcataagaaaattgaagatctccaccaagtgaagaaggatgaaaaaagcattgaggttgagactaaaacagatacctcagaaaaaccaaagaatcaattatggcctgagtcttctacttctgatgttgtcagagatgatattctgctgcttaaaaatgaaattcaagttttacaacaacaaaatcaggaacttaaagaaactgaaggaaaactgagaaatacaaatcaagacttatgtaatcaaatgagacaaatggtacaagattttgaccatgacaaacaagaagctgtggataggtgtgaaaggacttatcagcagcaccatgaagccatgaaaactcaaatacgtgaaagcctattagcaaagcatgctttggagaagcagcagctctttgaggcttatgagagaactcatttgcaactgaggtctgagttggataagttgaataaggaggtgactgctgtgcaggaatgttacctagaagtgtgcagagagaaggataatctagaattgactctcaggaagaccactgaaaaggagcaacagactcaggagaagatcaaagaaaaactcattcaacagcttgaaaaggagtggcagtctaagctggatcaaactataaaggcaatgaaaaagaagaccttagattgtggcagccaaactgaccaagtaaccaccagtgatgttatttccaagaaagagatggcaattatgatagaagagcagaagtgcacaatccagcaaaacttagaacaagagaaggacatagccatcaagggggctatgaagaaactcgaaattgaattggaactcaaacattgtgaaaatattaccaaacaggtagaaatagctgtgcaaaatgctcatcagcgatggctgggagaactaccagagctggcagagtatcaagcacttgtgaaggcagaacagaaaaagtgggaagaacagcatgaggtctctgtgaacaaaaggatatcatttgctgtttctgaagctaaagagaaatggaagagtgagcttgaaaatatgaggaaaaatatacttcctggaaaggaattggaagagaagattcattctcttcagaaggaacttgagttaaagaacgaagaagtccctgtggtcatcagggctgagttagctaaggctcggagtgaatggaacaaagaaaagcaagaagaaatccacagaatccaagaacaaaatgagcaagattaccggcaatttttagatgatcaccgaaataaaattaatgaggtgcttgcggcagctaaagaagactttatgaaacaaaaaactgaactacttcttcagaaggagacagaattacaaacttgtctagaccagagtcgtagagaatggactatgcaggaagccaagcggatccaactggaaatctatcagtatgaggaagacatcctgactgtacttggggttcttttaagtgatacccaaaaggagcacatcagtgattctgaggacaagcagcttttggaaatcatgtcgacttgttcttcaaaatggatgtctgtgcaatattttgaaaaactaaagggctgcatacagaaagcatttcaagatacacttcctctgcttgtagaaaacgctgacccagaatggaaaaagagaaatatggccgagctctctaaggattctgccagccagggcactggccaaggagaccctggacctgctgctggacaccatgctcagcccttggccttacaagcaacagaagcagaagctgataagaaaaaggtccttgaaattaaggatttatgctgtggacactgcttccaagaacttgaaaaggcaaagcaggaatgtcaagatctgaaaggaaaactggagaaatgctgtaggcatcttcagcatttagaaaggaagcacaaagctgtagtggaaaaaattggagaagagaataataaagttgttgaagaattaatagaagaaaacaacgacatgaagaataaattggaagaattgcaaacactttgtaaaacaccaccaaggtcattgtcagcaggggccattgaaaatgcttgcctgccatgcagtgggggagccttggaagaacttcgtgggcagtacattaaagctgtaaaaaaaattaaatgtgacatgcttcgttatattcaggagagtaaggaacgagctgcagaaatggtaaaagcagaggtactgcgagaacgtcaagaaaccgcccgaaagatgcgcaaatattatttgatttgcctccaacagattttgcaggatgatggaaaagaaggggctgagaaaaagattatgaatgctgctagcaaacttgctacaatggcaaaattactggaaacacctatttctagtaagtcccaaagcaaaactacacagtcaggtatgtcaaagtgagtcgccaaatggtttttctatcttttcttctttagctatttaatattttcagtatgaagaaggcagggaaggtaaggagtgagagttaatttgtgaagttttgtatgttttacttaaactagaagtttacgcaaaaagagtacacagtttccaatttaagtaggcagactgagcatgcccatcagtttcctattgctgcttccatccctcgaaatgatagaaaagattttaaacagcaaataaagaatgagaaaaagaagaaattataagtgggttttaaaaagttgcagtgggccaggcatcatggctcacacctgtaatcccagcactttgggaggctgaggtgggaggatcccttgatcccaggaatttgaggttgcagtaagctatgattgtgccactgtactccagcctgggtgacagagtgaggccctgtctcaaaaaaaaaaaaaaaaagtttgcagtggatagaccagaagctacaagaaatccctgagagaaagaanacagtataggatggaagatggaaacctcagttcaaaaccaccgggagatgacnattgcaattaggagcaatatcaaaactgttccacatatgagggtgatatgttccaggagaaatagagggcctaggggatatgaatggggtaattagttggtgttctaaaccaacagcaaccaggtggggttaatcctctctttatttcttcttctcccctcctttccccaacctcaatattgagctgggcaacaacaacaggaacaaagaatctgggagcagggcagtgctccaggtggctagccatatcaagcaggaactgggagccgacttgccttgggaggctgagatgggaggatcacttgagtccgggaggtcaaggctgcagtgagctgtgatcgcaccactgcactccagcctgggaaacagagcagaccctgtctca

SEQ ID NO: 270997 - DNA, 712 bp, Homo sapiens
gcaagctgcagaacagtatgcagaatagtatgactgcatttccttaaaaacttacatgcaatgtttgtgagcaatgtgtttgtatgctggggaataggattttcaccttgggcttcacatgtgtgtattaaggaattttcacaacagatacacataaattcgaaatttaagaaagccacaattaaaacaatttttaacattttaagttttaaacacacatatcccctcagaagctgcctgccaggaaggaatggaagacagtcttctgtctaggttttctctgcaaagtggagaatgaatccacatccaagaacatccctctgctccacggttatttccacctctaggaataaggggtatcacatcagtaccaggcatttcaagaacagcaagttactgacaatccttgaagttaaatgctgggtgcatggattcattaaaacattctctctacttttgtgtacgtttcacaattttctttttgttttcgcccaagctagagtgcagtggcgcgatctcagctcaccacaacctctgcctcccaggttcaagcaattctcctgcatcagcctcccaagtagccaggattacaggagcctgccaccacaactggctaatttttgttttttttgtttgtttgttttttgtgttttgagacggagcccaggctggagtgcaatggcacgatcctggctcactgcaacctctgcct

SEQ ID NO: 270998 - DNA, 633 bp, Homo sapiens
tagaagagggtgcttgagggattaaacatttagccttgtgtatgcatgcatgcaagtggttgccttcatacgtgcccagatttataccagctgtgcacttgttcatcttttgtggaggggggtggggttgagggttttcctctgatgcagagacattccagatggacaagaatgtaaatgccaggttgcatttttaggggcttactaatggagccacagcagattaagagggtaaaaaaaattatgaccgcatgtatttgtagggaagtgtggactggacactattagatttgctatctgtgagatcctcttgtattgacattttataaagtaattgggtattttcaactctctctgaggagtaagaatgagattcttgatgccggcttttgtcaaaataatattttaaggaacattttagtaaagccacttattgaattgtagttttaaaattaatttttaatcttgcaataagacaaaaaaagaaaaaaatttaatttgtgcacataaatgactcatttggatggtagacttattctatatgcattattattattattttttttctgagacagggtctcactttgatacccagcctggagtgcagtagcacaatcacagtttactgcagct

SEQ ID NO: 270999 - DNA, 461 bp, Homo sapiens
ccctgccgctccctctacaccaacttgccagccagccggcagctcagccctttggagcccaagctctacatgtctgcctgcaccggcatgggttccagtccccccaagtccaaggacatggacaatgagggccgtgataaagccgagattgaagatgaagatgaggatgagttcaaggatgaagaccaggatgaggacaaggatgaggatggagtctagagcctcccagagcctggagaggaggcctcggtcagccactccgtggacgtgggccacggtgacccaccatgaagtccccactagccactcgattccctgctctgtcagagttgctgcacatcacaccagcccctgccaagagcaggagtcaccacaggctgaatgcccacgaggagctctgctgagactctcaagggagccagtgaaagaaatagaaataaagcctgtgttgctgggacaca

SEQ ID NO: 271000 - DNA, 384 bp, Homo sapiens
tcctttcctgtctcattggtctgaaatgaaccccatactcatgtcttagcccgtccattctcgaggcactcctggggctgcgttacaccaggaaaggatgggtaagcacattggggattttgttagataacttggtagttaacaaaccctgaccactacaggttttcttaataataggtaaaatatattgagcacttactatttgccaggctaagtgttctaagtattttatgtgcattatgccatttaatccttttaacagtgtgctaaggtaggtgcagaaactgaggcaggagaatggcgtgaacctgggaggtagagcttgcagtgagccgagatcgcgccactgcactccagcctggcaacagagcgagactccatctc

SEQ ID NO: 271001 - DNA, 494 bp, Homo sapiens
taaaccaataaatacagtaacaaaatactacaaagaaaattaagggtaaagggcaatgacttataccataaccctgttttacatatagttttttggggatcaatatgggcttagttgtttgggctaatcattacaaagcagaaatgggacaaatctcagatcactcattcaaaacaagcactccaggccaggcatgcaaatctactcattggccgggcacagtggctcacgcctgtaatcccaacactttgggaggccaaggcgggtggatcacgaggtcaggacatcgagaccatcctggctaacatggtgaaaccacatctctactaaaaatacaaaacattagccaggtgtggtggcgggtgcctgtagtcccagctactcgggaggctgtggcaggagaatggtgtgaacccgggaggtggagcttgcagggagccgagatcgtgccactgcactccagcgtgggcgacagagcaagactccgcctcaaa

SEQ ID NO: 271002 - DNA, 553 bp, Homo sapiens
taaaccaataaatacagtaacaaaatactacaaagaaaattaagggtaaagggcaatgacttataccataaccctgttttacatatagttttttggggaaaaaaaaacagataaaaatcagtcaatctactttgggaatagtaaccaagatccagacatcaatatgggcttagttgtttgggctaatcattacaaagcagaaatgggacaaatctcagatcactcattcaaaacaagcactccaggccaggcatgcaaatctactcattggccgggcacagtggctcacgcctgtaatcccaacactttgggaggccaaggcgggtggatcacgaggtcaggacatcgagaccatcctggctaacatggtgaaaccacatctctactaaaaatacaaaacattagccaggtgtggtggcgggtgcctgtagtcccagctactcgggaggctgtggcaggagaatggtgtgaacccgggaggtggagcttgcagggagccgagatcgtgccactgcactccagcgtgggcgacagagcaagactccgcctcaaa

SEQ ID NO: 271003 - DNA, 515 bp, Homo sapiens
gagattggactacaatgctggaaactctgattttcatagctgggacagtaggaatcactcctccttaaaaattccgaagtctttgtacaaattacccttaatttaagatgaattggtgtagcataattcaggggtcaccacgtactcccctctgaataagaaggctgaatctcagtggtcagcaatgagggagattcattttggtatttttttctttttttttttttacaggcaatctttcttctcatccttctagattaacaggattctttcagtcagctttcaaaactcattcagcgtagatctggtttgttttcttccttgaaaaaaattattaatataataccacagtctctgcgctgaacatcatgatgcatgcctataatcgcagctactcaggaggctgaggtgggagaatcacttgacaccaagagtttgagcattttttagagatgggaccccatttcttaaaataaataaataaataaataaataaataaataaataaataaata

SEQ ID NO: 271004 - DNA, 461 bp, Homo sapiens
aactcttttctattctgtataaccactttttcaccaaaatgatactaaataaatatgctataggaagctatattttgacatgactgttttaggcaaagatacactcaccaacttactccacaagagtttctaatcagagaatatcatatggatctatttgaattgctcccatgcttggctgagcccaaaataatttactgtgcatatgtacaccaagtgagaaggttgaggaggtgtcacttgtacatctctttattcttttttttttgtatgtgtgtgttattttcatgtgttttgaaaggctctcttgcttagcttttattttgccattaaagatttttttctgtgctataactgtatttttaagtctggtttgagttcaagaaatccacaaattcacaaaagattaggaataatttgtgaacaaaatgatgcagaaataaaaaatgcattttccaaat

SEQ ID NO: 271005 - DNA, 486 bp, Homo sapiens
tttacctgtaactgttaaactgccacttatatacatgtgacatttgatacttgtaaaatacatttttattatattttctactattgaatatattttatttttcagagtgggacaatttttagttttagttgcctttttttgttttgtttttgtttttgtttttgtttttgtttttgttatgttacccaggctggtgttgaactcctgggctcaagcttggactatgggagttgctgtattcttttaattgaagtaagggaattgttcactttaatgttgtgtgatttaaaggaaatacatttataaactaccttttcctaaataacttgcatactaaagtctggcacatttttcttggtgttggggcaacggtggtgaagaagacaaagtccttgtggtcaaggagtttttcccttgtaatgggtagtaataggcaatattcatttaagcaaatacatgagataatttcagattgtggcaagtata

SEQ ID NO: 271006 - DNA, 373 bp, Homo sapiens
cctgggtggtgagcccaccaccatgaccagaggggcagggttctatcactgagagctccttcagaactgcatggaatgcgagggtggttcctcaagatgtagtgggcagacaaaagcaggtgagccatcccagacacccaaaacgaaagctatgtgtgcctaggacacacttcccttacattttttctccattcaaggtcttttcaggagctcctcaaactacagatgagagtttttgtaaatataaattcacaagattacacaatttacatgtaaaatgggaccagttttctcacgagattcataaaccagctctgaagcaattctaaaggaattgttgcaaaattgtttttagcattagcaatattactac

SEQ ID NO: 271007 - DNA, 347 bp, Homo sapiens
actggctgggaagactgagagttcactttctggggtgacataatagtgtagatcttggctgggcacggtggttcacgcctgtaatcccaacgctttgggaggccgaggcgggcggatcacctgaggtcaggagttcaaaaccagcctgaccaacatggagaaaccctatctctactaaaaatacaaaattagctgggagtggtggcacatgtctgtaatcccagccacccgggaggctgaggcaggagaatcgctcaaacctgggaagcagaggttgcggtgagctgatattgccccattgcactccagcctgggcaacaagggagaaactgtctcaaaaaaataaa

SEQ ID NO: 271008 - DNA, 318 bp, Homo sapiens
cttacactttacaaactgtgaagcctgtcttcctacccaatctctctctctacttacattacaaaattctccatggctgatgatctctctttcttcatccatgtgccactggcaccaccttcctagtttcacttcttcctgtttccttctttcctttccatctctgtcctgaactttttacccgcttagtggagtcacaatatggaaacgaaaggtttttaaaacagtctcattttttaatatatttggataaattttggtagcctgtttttaaaatcaggtaagtaaaactttacatgtatctttgtatttatcaaa

SEQ ID NO: 271009 - DNA, 471 bp, Homo sapiens
ctatgtgagagttatctttatttagagacagaaaaattgcagcttttgtcccagcaagtgaacaagagtttccgccctcttgggatggaaaagaaaatgaaaaagcaatagaagcaagaaaaaagcacacataaataccttgatcagttatcctttcatcttaatgctcctacaattattgcaaaacaatcatttatgaactcaaactggggacggtaacaaatttgttatgggctgggcacttgccatgctgtgtaaaacctgggtagattcatgtctcaagataatttttaaaaatgtaaacttcctactaaaaggacagcataaggcagtggttaagagcacagagtcaggtgggcacagtggctcatgcctgtaatcccaacagtttgggaggttgaggcaggaggattgcttgagcccaggagtgagagacctgcctggacaacatagctagactcagtctctata

SEQ ID NO: 271010 - DNA, 400 bp, Homo sapiens
ctcacacattgtaattgggattaaatgaatcaggtctagagtgtttaggagattgtctggtacatagtaagcatctaagacgtgttagcaataatattgacagtaatgataagagatgacatgatggtgattatgatggtattaacacatcattggctgtgactgattggacaagtaacgcttttatccaaaggctaccaatccagaagctgcatgttgtcttacagttcctctggctggttgcaaaagatgagctaggccagagtcctctcaaaaaaccaaccaactgtggccaaaaaagtcataggctgggatggacattgtgtggcattgtgaaggttaaaattgggaggcaaaaaagtatttaaaagaagagtgagtaaaaaagaagagacattgt

SEQ ID NO: 271011 - DNA, 396 bp, Homo sapiens
gaggacacacgagggagattataagcatgtgtgtgtgttcgtgtgcatgtgtacacgtatacgttggagattggacattgcgctttttagaaaggtgaagaagttggaaaggtaagaaagggcctggacttgaagggctttgttaggctagctaaaccatttgaaattaattctgagaacaatgaagaactgtttaaaagttttaagtagtactctgcccgccttggcctcccaggagttcgagaccagcctggccaacatggtgaaacccagtctctactaaaaatacaaaaattagccggacgtggtggcgggctcctgtaatcccagctacttggaaggctgaggcaggcgaattgcttgaacctgggaggcagaggttgcagtgagctgaga

SEQ ID NO: 271012 - DNA, 455 bp, Homo sapiens
aaaaagggctgcttttcggtgggggcagatgaaggctcacaggagccctttctcttagagggggcaagtacccttcccttatatctttaatttgaggaatgtatgagataacagttgcagttactgaaatgccactggaatttgaaaacttgacttttttttctttccttttttttttttttttttttttaaaaaaagaaacaaaaaacccacaaaaactacttgcccctcctagggaagctgtgtgccaaagaaccagtgtcataacccctccctcctgctgagctgacgttgcattgttgcatatcccagctactctgtgggttttgtgaagctgtgtgtgaagtctctacctcattgtagtatatgcaggcaagactgcactctcctacagatgtgtggagtaagctgtggtgtagtttttttggcacataataaacacgttgcagcagagt

SEQ ID NO: 271013 - DNA, 359 bp, Homo sapiens
cacccgactccaaaggcttgtttctatgttagactgccttttggatgggcaagaggtctgttcagatatagccagaactggcacagtgacagaatatctccagggacagtaaactgtcagtcagggtagcattgagggattgttgcagatgcaaaactccccacctccctctgccacaactcaacaatggacatctctgtgcccttcataaaattaagtcatcacagaatcttttctcccaattatgcattccttatcatgactggatattcatgtttggtgaatttttgtttttttgtaagctaagaatgtatgcttaggggaggtgctgtttgtggaataaataggtttaaattatt

SEQ ID NO: 271014 - DNA, 162 bp, Homo sapiens
cttgttttcttaaaaattaagccccagattattaaattttaatatgggagtacttttaattttggtgtttaagatggttggcaattatttaaaaaactaaagaacaaagataaattattttccatcttgagactgtagtgaatttttttaagaagcgggggg

SEQ ID NO: 271015 - DNA, 529 bp, Homo sapiens
gttgatggagaaaacttaatgtttgtattagtaaccctggggacagggatgagctgagggtctggccaacagcaaaaaaggcttgctggggagttggttgttctgaccagatctaatgcagctgagctgtgacttcattctgaaacacccattcctaccaccatctgggattcattcacatctaggtgtgccaggcactgttctgggcactagggacacaggtgtgaacaaaacagataaaagagagaaaacagataaaactccttggggagtttacattctggtaggagtattggctcaggccggcacatggcagagccttgtttttaaggtcttgtctacaggtgggcttctcagagtaggggagccccttgagattgtagatgtgtttgtgtgtgtatgaggagaatgtccctgtattttagcaatcccattatcccttaccttagaaaacaggtttatgtactcttaacctattgtaaaaaattattttaaaataacataaactgaaaattccactaaaaaacca

SEQ ID NO: 271016 - DNA, 535 bp, Homo sapiens
atgtgtggggacagggggcatacggaaaatctctataactttcctctcagttttgctctgaatctaaaactaccctttaagaagtcttcttttaaaacaatttacaaagcatgaggtgatacagatgtgggagtttggctcctgtctctgcccaactctgtgacattcgataaattacttaacatgtctctgtttcagtttcctcatctataactgggaaaaataacacctgtcttatagagttgccatggggatgacatgaggcatgtgtctcgttcatatcccatgctcagtgaattagtagcagcagccactgtgtgtttgtgtgtctttatccctcctgggttaatgagctccttgtgggcagggactcacccattctgtaaccaccccatctaacacactgcctggcacttgggctccgcagaagtttgccgagtgaatacttagtaagccctaacctaggcttttctctctggtggacatttgggttgtttctagggtttttgctatgaataaaacacatttcaaagcc

SEQ ID NO: 271017 - DNA, 329 bp, Homo sapiens
aaagaaactaaaatatcttaacagtatttaatttatcacaagtgtcagatgctaagtagaaaaggttgtacttctaagtacagtatcatcccttggcctgttgtcttggaccctctgtgaaaatctaggtaacacaactctccaggaaataatttcttggacaggctagcagcccatctttgcttgtgtgccttatcatcttgatagctttcactgtttttgatttttaacttgtctacagtcttttatcctcactatatagatgataaccaaccacccagtttgccccagacaattcctattctatccttgacagtgctacgtcttta

SEQ ID NO: 271018 - DNA, 346 bp, Homo sapiens
tttttaaacgagaataaataagcattaacatttaaattctgagacattggtactgaagtggagatttctattgctgtggttagagatgaaatagaaataaatgtctttggccgggtttggtggctcatgcttgtaatcccaacactttgggaggccgaggagggcggatcatgaggtccggggttcgagaccagcctgatcaacatggtgaagccctgtctctactaaaaataaaaaaattagcaggcatggtggtgtgcacctgtaatctcagctactcaggaggctgaggcaggagaatcgcttgaacccagggggcggaggttgcagtgagccgagatcgtac

SEQ ID NO: 271019 - DNA, 462 bp, Homo sapiens
tattcttaatgtgcccactgtctcctggagaatgccagcctcccttccataagaatagagggaagagcgaacgttgcagagaattagaactcagtttgtagaaagttaggagcacagcgcagagagtttttgtttttgtttttgttttgagacagtttctctgtttgcctctgcactccagcctggcaacagtgcgagactccatcttaaaaaaaaaaaaaaaaattgacaggcataaatgtatttatggtacattgctcagacaactttaatataaacaacttacagagaaaattgagtcttttgggtaggtgacttgcctgagctgactttgtgataggttttttctgttttttttgtttttgaaatggagtctcactctgtcatgcaggctggagtgcagtggccccatcttggcccactgcactccagcctggcaacagtgcgagactccatctaaaa

SEQ ID NO: 271020 - DNA, 496 bp, Homo sapiens
gtgtgtgtgtgtgtgtgtgtgtgtgtgttccctgtgatggactggagtcctgtctaggatgggttcccgccttgccttctgagctgctaaaataggctgcagcgatccactactgtaaactggaataagcatgtaaataattatcttgttcttattgttcttaattctatgcatagcttatatttatttcagtgtttaatattagaagtattttagtctttagaagtttggtgatgctgtaaccagaaatatttggtaggaacttaactcttatctatttcaattagcctgttggtaaaattggtttccttatgtgtcgcttaacttaaaattacagtttctaaaaatctgtcaacgatgttaagtgaggacttactgtactttatttcttctaatgcctgaataatattctgttaatataccacattatgtttgttgatgggcatttgggttttctccatgttttttcaattataaacaataatgctgtgaacat

SEQ ID NO: 271021 - DNA, 553 bp, Homo sapiens
tagagcagctgtatgtggccagtccctgattttgctttagcctggaaggcttggctgaaataccactgcttcccctccttggcttgcgcagctcttagctattcccccaaggcttcccaacacttacttgacctctgttgatgaaaggtgggactgaattgcgtggatcttattggccactggtagctgaaagagtgaccgtatcagaaactgaagtctcaactaacagacagtggtagatgagaggtgctgtagtacgtgaattcagggaattaggttggttactctaccagcatcttccatccttggtcactggagtgcctggaatcaggctggctctaattctgcccatcctcacacccaactgctctgcacacggagtagactccattcctggaaccagcctaagccaacagaagagaaaaaggaagcatgctgattttagtgtggggtggaactgaacctttgccaaagaaaaaaggtagaatccaagaggaatgggtatttagcaaaagcctagaagcaagtcagttctgctgcatagaaaaaaaaa

SEQ ID NO: 271022 - DNA, 497 bp, Homo sapiens
gtcaatgccaaggggaattgtaaggttggcacactgatatggtttggctgtgtccccacacaaatctcaccttgatttgtaacaatctccacgtgtcaaaggtggggccaggtggagataattaaatcgtggcagtggtttccctcatactattctagtggtagtgaataagttccctgagatctgatggttttataaatgggagttgcactgcacaagctctcttgtctgctgccatataagatttgactttgcccctcatttgccttctgccatggttgtgagccccaccccacggtggaactgtgagtcaattaaacccctttcctttataaattacccagtctcgggtatgtctttattagcagtgtgagaacagattaatacacattccccacacagagttcccaatggggcacactgcctagtggagctgtgagaagagggccaccatcctccagatccaagaatggtagatccaacagcagcttgcaccc

SEQ ID NO: 271023 - DNA, 445 bp, Homo sapiens
ggtagaggtggggtttcaccatgtttcccaggctggtcttgaactcctagactcaagtgatctgcccaccttgacctcccaaagtgctgggattacaagcatgagccaccgcacctggctgtgttattctttatagccaaagatgaattgctttgctagaaggagtaagaatttttaaagccagtttccctttctttccaagactgtctatgtcttacagtgtgcatttgtgacactgctggccagaataagggctccagcaaacagaactctctccggggtaaaaggggctgctgtgtctgtgagtaaccagccgacacttgcatgcacctcagcccttgccctttccaagtgaccagtcagccctgacagtttaacaccaaacacagcctgtcagcctgtaaaaaatgcacagttctttgaaaggtctttttttaaaaacaac

SEQ ID NO: 271024 - DNA, 542 bp, Homo sapiens
acatttttaagggggatttatttgagaaacataaaaacataacagaacacttcataggctactttacatgataaaataggcaaaaacaacatacatattttgcaagcataaacacttgggtatactaatgacagtcatacaggtataagttatgagcagacaaggtgtattcataaaaaaatagcttatataactgcagtcatctgaaataccacgacaaacaacctaagtcttaagatcaatcaaaaaccatgatgggctttttgctgtaggcccgagtggttgctgccgaaatgggcaagttcatgaaacctgggaaggtggtgcttgtcctggctggacgctactctggatgcaaagccgtcatcgtgaagaacattgatgatagcacctcagattgcccctacagccatgctctggtgtctggaattgaccactacccctgcaaagtgacagctgccatgggcaagaagaagatcaccaaggggtcaaagatcaagtcttttgcgaaagtttgtaactacaatcacctaatgcccaaa

SEQ ID NO: 271025 - DNA, 437 bp, Homo sapiens
tatgtaaagtatttgaagaaaagattattttacggccccgtcaaaagtagcttcaagcaagagctattgttcaggaccttttatagacatagatgaaattccttttgccatttgaacagtgtttacattcgggaaagttcacagttaagtctttgacatactgtgaaaggatcttttgttctctacaaaaacatacttcctcatcctttgagtcaccttgtttttattcccttgtttacttttctggggaaataatgcccacctcccaagtaatgtcaagggaagaactatttcagaaatctaagttgttctgtatgaggaaagagggcttggattttggcagaaaaaaatcagaaatatttttaaaacctgaaccagataaataatgtaatctcaagcttccaaaaattatttgggtagggttttttccaatgcta

SEQ ID NO: 271026 - DNA, 390 bp, Homo sapiens
caaggactgtgccaggagaggtgattaagcaattagaatattttgaagtctaaaataactgtagtatcaggagaacaactgaacgagaaaataaattactgagagtaaagcagtctgtagattttgggaagattcgtaggtgtgtgagaaacaagacattttggaatcttaatgtaatctgagaagtaaaatagacctgtattcctgtcattctctttctcattttcttcctcctcaccaaatcatgatgttgaaggtcagtgagaagagtcaattcgggctgtttctcacgaaggtgtacaccagtcatccggaatgtcagtatcccttattcagagtgattttgataaatgtgcttaaataaataaacactctcatttcaactaaata

SEQ ID NO: 271027 - DNA, 308 bp, Homo sapiens
cccaacctccagaactgtgagaaataaatttccgatgtttataagctacccagtttatggtgttttgttatagcagcctgaacagactaaaacaatatttaaataaataatgctcagaaacttctcaaatttgaggaaaaacattaaccacatttaagaagctcaagaaactccaagtaggataaactacaccaagacacacgataatcaaactgtcaaaaggtaaagagagaatgttgaaagcatcaagagaagtaactcatcacatgcaaggatccttgctaagattaatagctgatttctcatca

SEQ ID NO: 271028 - DNA, 502 bp, Homo sapiens
agtactaggaatgataactgaaacccctactgaataattccaagtactgactaccttctaaaatagggaaagacactagcattcatttacaaatctattttatgccaaaatctgtgaacagttcctatacatagctaaatatattataaaataatcatgtttataattatagtatagcagaaatacattaagaatatgcgggtaaatgaattttttatatctgaattagtagatagaagatacaatttgagtgggtactccttttccccaatataacagtttcttcaagcctcttctggggctgtttggcacattaaaagactattttggggacagggaagctggttaattaataccgattgactagaccatgcatgctagaagtagtcctcaatgtaattacccaaccgtctcatttagaaaagaaatgcagcataggttcagttcacaaatgcagagtaggttttttttgtttgtttgcattgctacttaaaaggttgcc

SEQ ID NO: 271029 - DNA, 365 bp, Homo sapiens
ttcaagtgaagctgggcttcagggaggctttgtggaatggtgagaagaacagtgtgactaaggcacagaaggctgagtgatgccctgcagtactattgtagggttggaggccagctgggaaagaaagaaccattgcattagagaatgggaacatgccttcggatatagaaatggcaaatccatgagatagtttaaagtgagaatactagaagcattcccaccaaacatggtgtgtcttggtgcctgctgtatcccaggctccacgagatgctggagtcagcactgaacaaacagagtttcctctgctcgtggaaatgcgttccgttggggaagggatttttctgctgagtctggctattcatagt

SEQ ID NO: 271030 - DNA, 342 bp, Homo sapiens
caggcagaatagcctgaaggccttgccattcaggagctcacagctgaacagtgcaggaagacacatgcaaccataacatgatatactagagctataacagcagttgattcttccctgtaattatttaagcaattactctcttggtaattactctaattgttattaaattcaaaaaattataaaaatagtatgtagatttaaaaaacacagaggtgcataaaatttaaaagtttcctgttaccaggtatgtatattcctcagacctttctatatacatattcaaactatatatacctatttgtacagtcatttaagaaaaactgaatcaaaatagaaatattg

SEQ ID NO: 271031 - DNA, 307 bp, Homo sapiens
taccccaacaaacacagtccacagcctacatcccagcagtgagtgacccccaaccttccctccacccctgatctgagcttggtctccacacatcaagcttatttctgtgccaaagagtacagcccagatgaacctgcttttctgatgtagcccccagaattctgctcaaacacaaattcctcatacatgtatggaaaggaatgcagacttttgacatgttaatatgtatatagtcatggatatgtaggacttgattaaggtatattttatgatacatgtaataaacagaaaaaaaagtaggtgatta

SEQ ID NO: 271032 - DNA, 471 bp, Homo sapiens
actcgagatgggttaggatgcacatgacaaactgttggaatgtggggctcttccaaaaggagagcaggagtgcaagacttttccagaaaggctggtggctttggcagagaaatggcacctaagcatatttgtaaagctttctcctcctctatgttagagtcagaagctgcatgccacccgtgtgcagagccaagtccagctcagctttcccacaggtttgcttacacttgctgggtgaccccagcctggctggaggtgcaagggagcacgtttgtaccttgtaatgatttctctctagagtagtgcagatgttcgcagggataatgtcaactgccacagcaactggaattctatctgcaaacttttatttgctgtgttggaatcattagttaattaggacttttttttttttttttggaaatggaatttcactccagcctgggtgacagagcaagactctgtctcaaaaaa

SEQ ID NO: 271033 - DNA, 471 bp, Homo sapiens
caggagttcaggaccagctggggcaacatagcaagactctgtctcttgaaaaaaaaaacttaaaaaattagcaggttgtggtagtgcacactgatattcccagctacttgggaggcccaggtgggagggctgcttgagcctaggagtttgaggctgcagagacctatggtcataccagcgcactccagcctggttgacagagcagattccaactctttaggaaagaaccaaaacactcatccctcaactacataaaatagttataagttattattttccctgaagtctctagcagtcacttcgtccatgatggatatttctggcagggaactgtgctacatgaaggaagtgaatgaaagtcctgaaaatcaggataatggtgattacccttgattcaatcaaactgtactcaattctaagtcttcttatactgtctttatattttcttgagacacacttatgacattcctc

SEQ ID NO: 271034 - DNA, 285 bp, Homo sapiens
ctcaccacctaacacattttatagcgagtctgcactttctaggaaaatgagtcaaatatacagtaagtcagtcatcctgtctctttcttgagggacctggaggagggacttgaaccagtgcctggaatgtgagtgcagaatgctgtctcgcctgcacttcattattgtctgattgggcccaagaaggtctgtgggagagctcaatggataagattatttgtttatattaatcgagttgtatgtggttaatgtatctgccttcacaaaactgacattttccctgtg

SEQ ID NO: 271035 - DNA, 3597 bp, Homo sapiens
ggcacgaggagccctgagagtccgccgccaacgcgcaggtgctagcggccccttcgccctgcagcccctttgcttttactctgtccaaagttaacatgtcactgaaaaacgagccacgggtaaatacctctgcactgcagaaaattgctgctgacatgagtaatatcatagaaaatctggacacgcgggaactccactttgagggagaggaggtagactacgacgtgtctcccagcgatcccaagatacaagaagtgtatatccctttctctgctatttataacactcaaggatttaaggagcctaatatacagacgtatctctccggctgtccaataaaagcacaagttctggaagtggaacgcttcacatctacaacaagggtaccaagtattaatctttacactattgaattaacacatggggaatttaaatggcaagttaagaggaaattcaagcattttcaagaatttcacagagagctgctcaagtacaaagcctttatccgcatccccattcccactagaagacacacgtttaggaggcaaaacgtcagagaggagcctcgagagatgcccagtttgccccgttcatctgaaaacatgataagagaagaacaattccttggtagaagaaaacaactggaagattacttgacaaagatactaaaaatgcccatgtatagaaactatcatgccacaacagagtttcttgatataagccagctgtctttcatccatgatttgggaccaaagggcatagaaggtatgataatgaaaagatctggaggacacagaataccaggcttgaattgctgtggtcagggaagagcctgctacagatggtcaaaaagatggttaatagtgaaagattcctttttattgtatatgaaaccagacagcggtgccattgccttcgtcctgctggtagacaaagaattcaaaattaaggtggggaagaaggagacagaaacgaaatatggaatccgaattgataatctttcaaggacacttattttaaaatgcaacagctatagacatgctcggtggtggggaggggctatagaagaattcatccagaaacatggcaccaactttctcaaagatcatcgatttgggtcatatgctgctatccaagagaatgctttagctaaatggtatgttaatgccaaaggatattttgaagatgtggcaaatgcaatggaagaggcaaatgaagagatttttatcacagactggtggctgagtccagaaatcttcctgaaacgcccagtggttgagggaaatcgttggaggttggactgcattcttaaacgaaaagcacaacaaggagtgaggatcttcataatgctctacaaagaggtggaactcgctcttggcatcaatagtgaatacaccaagaggactttgatgcgtctacatcccaacataaaggtgatgagacacccggatcatgtgtcatccaccgtctatttgtgggctcaccatgagaagcttgtcatcattgaccaatcggtggcctttgtgggagggattgacctggcctatggaaggtgggacgacaatgagcacagactcacagacgtgggcagtgtgaagcgggtcacttcaggaccgtctctgggttccctcccacctgccgcaatggagtctatggaatccttaagactcaaagataaaaatgagcctgttcaaaacctacccatccagaagagtattgatgatgtggattcaaaactgaaaggaataggaaagccaagaaagttctccaaatttagtctctacaagcagctccacaggcaccacctgcacgacgcagatagcatcagcagcattgacagcacctccagttattttaatcactatagaagtcatcacaatttaatccatggtttaaaaccccacttcaaactctttcacccgtccagtgagtctgagcaaggactcactagacctcatgctgataccgggtccatccgtagtttacagacaggtgtgggagagctgcatggggaaaccagattctggcatggaaaggactactgcaatttcgtcttcaaagactgggttcaacttgataaaccttttgctgatttcattgacaggtactccacgccccggatgccctggcatgacattgcctctgcagtccacgggaaggcggctcgtgatgtggcacgtcacttcatccagcgctggaacttcacaaaaattatgaaatcaaaatatcggtccctttcttatccttttctgcttccaaagtctcaaacaacagcccatgagttgagatatcaagtgcctgggtctgtccatgctaacgtacagttgctccgctctgctgctgattggtctgctggtataaagtaccatgaagagtccatccacgccgcttacgtccatgtgatagagaacagcaggcactatatctatatcgaaaaccagtttttcataagctgtgctgatgacaaagttgtgttcaacaagataggcgatgccattgcccagaggatcctgaaagctcacagggaaaaccagaaataccgggtatatgtcgtgataccacttctgccagggttcgaaggagacatttcaaccggcggaggaaatgctctacaggcaatcatgcacttcaactacagaaccatgtgcagaggagaaaattccatccttggacagttaaaagcagagcttggtaatcagtggataaattacatatcattctgtggtcttagaacacatgcagagctcgaaggaaacctagtaactgagcttatctatgtccacagcaagttgttaattgctgatgataacactgttattattggctctgccaacataaatgaccgcagcatgctgggaaagcgtgacagtgaaatggctgtcattgtgcaagatacagagactgttccttcagtaatggatggaaaagagtaccaagctggccggtttgcccgaggacttcggctacagtgctttagggttgtccttggctatcttgatgacccaagtgaggacattcaggatccagtgagtgacaaattcttcaaggaggtgtgggtttcaacagcagctcgaaatgctacaatttatgacaaggttttccggtgccttcccaatgatgaagtacacaatttaattcagctgagagactttataaacaagcccgtattagctaaggaagatcccattcgagctgaggaggaactgaagaagatccgtggatttttggtgcaattccccttttatttcttgtctgaagaaagcctactgccttctgttgggaccaaagaggccatagtgcccatggaggtttggacttaagagatattcattggcagctcaaagacttccaccctggagaccacactgcacacagtgacttcctggggatgtcatagccaaagccaggcctgacgcattctcgtatccaacccaaggaccttttggaatgactggggagggctgcagtcacattgatgtaaggactgtaaacatcagcaagactttataattccttctgcctaacttgtaaaaagggggctgcattcttgttggtagcatgtactctgttgagtaaaacacatattcaaattccgta

SEQ ID NO: 271036 - DNA, 495 bp, Homo sapiens
ttctcatagaagcacttgttctgtttttacttgtgttaggattaaacctacagatactgcatgggattggttgttttgaaacctctgtaattattttctcctttacatattttcagaaccatgtgcagaggagaaaattccatccttggacagttaaaagcagagcgtaagtaactgctttttttctcatatcattgttttttattatgaaggtgaggtatcagtaatcattaatgttttcacagtgtgattatagaactctgtttataaaaggtaccccacaaaatgttcacctgtaataaagtatttattctcattaagttgcccaaaccattattcaaatgaagacaccaagactaaataggtaataaaaaccgagcatctttgtaatttctatttatttttatttatatatagttgttttaataataacaatcatctttatgaggtattatagttgtttgttcttctttatctactggatacaatttttta

SEQ ID NO: 271037 - DNA, 1054 bp, Homo sapiens
ggcacgaggagccctgagagtccgccgccaacgcgcaggtgctagcggccccttcgccctgcagcccctttgcttttactctgtccaaagttaacatgtcactgaaaaacgagccacgggtaaatacctctgcactgcagaaaattgctgctgacatgagtaatatcatagaaaatctggacacgcgggaactccactttgagggagaggaggtagactacgacgtgtctcccagcgatcccaagatacaagaagtgtatatccctttctctgctatttataacactcaaggatttaaggagcctaatatacagacgtatctctccggctgtccaataaaagcacaagttctggaagtggaacgcttcacatctacaacaagggtaccaagtattaatctttacactattgaattaacacatggggaatttaaatggcaagttaagaggaaattcaagcattttcaagaatttcacagagagctgctcaagtacaaagcctttatccgcatccccattcccactagaagacacacgtttaggaggcaaaacgtcagagaggagcctcgagagatgcccagtttgccccgttcatctgaaaacatgataagagaagaacaattccttggtagaagaaaacaactggaagattacttgacaaagatactaaaaatgcccatgtatagaaactatcatgccacaacagagtttcttgatataagccagctgtctttcatccatgatttgggaccaaagggcatagaaggtatgataatgaaaagatctggaggacacagaataccaggcttgaattgctgtggtcagggaagagcctgctacagatggtcaaaaaggctgtcagaacccacctgtctgtgtgcacagcagtctgggaagtgtcaacagctcccaggagcagccatcagccaagaactgatcggagtccagccccatcctcctcagttggggtgactctgcagcagtctctacactgtctcccagaactccttagctggcttacagcacagctgcccacaataaaaagcgatcggcag

SEQ ID NO: 271038 - DNA, 3306 bp, Homo sapiens
cctttgtgttctgccatgattgtgaggcctccccagccatgtggaactttgctccgctctgctgctgattggtctgctggtataaagtaccatgaagagtccatccacgccgcttacgtccatgtgatagagaacagcaggcactatatctatatcgaaaaccagtttttcataagctgtgctgatgacaaagttgtgttcaacaagataggcgatgccattgcccagaggatcctgaaagctcacagggaaaaccagaaataccgggtatatgtcgtgataccacttctgccagggttcgaaggagacatttcaaccggcggaggaaatgctctacaggcaatcatgcacttcaactacagaaccatgtgcagaggagaaaattccatccttggacagttaaaagcagagcttggtaatcagtggataaattacatatcattctgtggtcttagaacacatgcagagctcgaaggaaacctagtaactgagcttatctatgtccacagcaagttgttaattgctgatgataacactgttattattggctctgccaacataaatgaccgcagcatgctgggaaagcgtgacagtgaaatggctgtcattgtgcaagatacagagactgttccttcagtaatggatggaaaagagtaccaagctggccggtttgcccgaggacttcggctacagtgctttagggttgtccttggctatcttgatgacccaagtgaggacattcaggatccagtgagtgacaaattcttcaaggaggtgtgggtttcaacagcagctcgaaatgctacaatttatgacaaggttttccggtgccttcccaatgatgaagtacacaatttaattcagctgagagactttataaacaagcccgtattagctaaggaagatcccattcgagctgaggaggaactgaagaagatccgtggatttttggtgcaattccccttttatttcttgtctgaagaaagcctactgccttctgttgggaccaaagaggccatagtgcccatggaggtttggacttaagagatattcattggcagctcaaagacttccaccctggagaccacactgcacacagtgacttcctggggatgtcatagccaaagccaggcctgacgcattctcgtatccaacccaaggaccttttggaatgactggggagggctgcagtcacattgatgtaaggactgtaaacatcagcaagactttataattccttctgcctaacttgtaaaaagggggctgcattcttgttggtagcatgtactctgttgagtaaaacacatattcaaattccgtataccaaaatccatttcctttgtaacaagaatttaccagtaactgtgatctaggttgccaaaagttgtctgaatctccttattcttctctgatcttcatttatgcagccaatgtctagctggacctgccctcatcttgcagttcatacaggcactgtttgagagattgtttattattagatgttgtaatgctgcttcaagattcttcatggttacatgggatgcccctgctcatctggtcctgaagtagtaacattcacccaaatgaggatatagtcattattccttttcagtcactgtacgaacacggcagactttagcctacacagtagactgtgttaggcacttctggtaacattgacactgtatcttgacaccactaagccaacaggaaggaataaattcccaatattgagacagagatttatttcattttgctcccaaaggcactgacaacatgagtccttgtgattaggcccacctgatcaaatgtaaaaacatgcatgggatatttgattacgtaacaaccagctaaaactgagagcacacagccttcggaaacccccaaggtgtcgaggaggatcagatccagataagagaagatgattccttctagtcctgtaaaatttcctgtcatccttagctgctgggttgattgaaatttgatctctacatttcaaaatcaaactagtgaatacagtttgtctttcaagagaatcagaggcatcgtaactcctaccaagttagtaagtatgagtctaaccttgtttgacattcaggtcttctgctacattatcttctttgagaaaaattaattgattataaaatatgtgctacttcacttacattattaaatatgtattaacgcctctcaccagggcttccagtgaagttacaatgccctagtctgtgaattagtctggaaacgtgtttttccttttcggatgttagagtaccctttgataaactaaattttactaagctgaacaactctgacagtctaaagagctaatgtgggttaccaaaaggcctgtacctgtaaaacaaaatgcaggtgtaatgattatacatgtctatggattacctggacatactctcatttgggttgttcttcaaagaagcaagcagccgatccctgttttcataaagctaatacttcagttggaaaaattaaacaggagcacaaagtcagggataggggttagcagaagagagaaatagtgtcacatcaagggcaggatctcatagctagggaacatttcacaaataaggtgagattttgtaaccaataataaaaatgaatgtttttataagtaaataacttatttttcatatggctaaagatggtaaaatgacttcattctatagccattgtaaataagaatttgctattgatgaaagaagttcagattggcatttgaagtattgagtgtatgggatctctaaggatttcttagattttatatttaaatattttttaaaccttagaggagtcaacaaactggctcttgattttcagcaccctactctcatgaaaaaagcctgaaaggaccctttcccttataagtaatttaatccaatttctccccattttatagatgaggaaactgaggctcagatcagatgagaactcacttaaatccactcaatgtgtagatggtagagctgggactagcaacattgctgcagcccattgttggcctctctcttcactttatcattgcccaagaatgaggatatgcagtaaacagaattcaggcaagatacctctaagctgttttgaaccctctgatattttgtatttatgtgtttgtctgtctccccctactagaatgtaagctccatggggcagggacttcactgtattttgttcatagtgtatccccagagcctggaccagtgcttggcacataggagatggcaataaatgcttgtagaattaataaacaaggtgaaggagagagctaatgaaatgaaaatcttagtc

SEQ ID NO: 271039 - DNA, 3206 bp, Homo sapiens
gagctcggtccctgttaaagcacacccgatagagaacagcaggcactatatctatcgaaaaccagtttttcataagctgtgctgatgacaaagttgtgttcaacaagataggcgatgccattgcccagaggatcctgaaagctcacagggaaaaccagaaataccgggtatatgtcgtgataccacttctgccagggttcgaaggagacatttcaaccggcggaggaaatgctctacaggcaatcatgcacttcaactacagaaccatgtgcagaggagaaaattccatccttggacagttaaaagcagagcttggtaatcagtggataaattacatatcattctgtggtcttagaacacatgcagagctcgaaggaaacctagtaactgagcttatctatgtccacagcaagttgttaattgctgatgataacactgttattattggctctgccaacataaatgaccgcagcatgctgggaaagcgtgacagtgaaatggctgtcattgtgcaagatacagagactgttccttcagtaatggatggaaaagagtaccaagctggccggtttgcccgaggacttcggctacagtgctttagggttgtccttggctatcttgatgacccaagtgaggacattcaggatccagtgagtgacaaattcttcaaggaggtgtgggtttcaacagcagctcgaaatgctacaatttatgacaaggttttccggtgccttcccaatgatgaagtacacaatttaattcagctgagagactttataaacaagcccgtattagctaaggaagatcccattcgagctgaggaggaactgaagaagatccgtggatttttggtgcaattccccttttatttcttgtctgaagaaagcctactgccttctgttgggaccaaagaggccatagtgcccatggaggtttggacttaagagatattcattggcagctcaaagacttccaccctggagaccacactgcacacagtgacttcctggggatgtcatagccaaagccaggcctgacgcattctcgtatccaacccaaggaccttttggaatgactggggagggctgcagtcacattgatgtaaggactgtaaacatcagcaagactttataattccttctgcctaacttgtaaaaagggggctgcattcttgttggtagcatgtactctgttgagtaaaacacatattcaaattccgtataccaaaatccatttcctttgtaacaagaatttaccagtaactgtgatctaggttgccaaaagttgtctgaatctccttattcttctctgatcttcatttatgcagccaatgtctagctggacctgccctcatcttgcagttcatacaggcactgtttgagagattgtttattattagatgttgtaatgctgcttcaagattcttcatggttacatgggatgcccctgctcatctggtcctgaagtagtaacattcacccaaatgaggatatagtcattattccttttcagtcactgtacgaacacggcagactttagcctacacagtagactgtgttaggcacttctggtaacattgacactgtatcttgacaccactaagccaacaggaaggaataaattcccaatattgagacagagatttatttcattttgctcccaaaggcactgacaacatgagtccttgtgattaggcccacctgatcaaatgtaaaaacatgcatgggatatttgattacgtaacaaccagctaaaactgagagcacacagccttcggaaacccccaaggtgtcgaggaggatcagatccagataagagaagatgattccttctagtcctgtaaaatttcctgtcatccttagctgctgggttgattgaaatttgatctctacatttcaaaatcaaactagtgaatacagtttgtctttcaagagaatcagaggcatcgtaactcctaccaagttagtaagtatgagtctaaccttgtttgacattcaggtcttctgctacattatcttctttgagaaaaattaattgattataaaatatgtgctacttcacttacattattaaatatgtattaacgcctctcaccagggcttccagtgaagttacaatgccctagtctgtgaattagtctggaaacgtgtttttccttttcggatgttagagtaccctttgataaactaaattttactaagctgaacaactctgacagtctaaagagctaatgtgggttaccaaaaggcctgtacctgtaaaacaaaatgcaggtgtaatgattatacatgtctatggattacctggacatactctcatttgggttgttcttcaaagaagcaagcagccgatccctgttttcataaagctaatacttcagttggaaaaattaaacaggagcacaaagtcagggataggggttagcagaagagagaaatagtgtcacatcaagggcaggatctcatagctagggaacatttcacaaataaggtgagattttgtaaccaataataaaaatgaatgtttttataagtaaataacttatttttcatatggctaaagatggtaaaatgacttcattctatagccattgtaaataagaatttgctattgatgaaagaagttcagattggcatttgaagtattgagtgtatgggatctctaaggatttcttagattttatatttaaatattttttaaaccttagaggagtcaacaaactggctcttgattttcagcaccctactctcatgaaaaaagcctgaaaggaccctttcccttataagtaatttaatccaatttctccccattttatagatgaggaaactgaggctcagatcagatgagaactcacttaaatccactcaatgtgtagatggtagagctgggactagcaacattgctgcagcccattgttggcctctctcttcactttatcattgcccaagaatgaggatatgcagtaaacagaattcaggcaagatacctctaagctgttttgaaccctctgatattttgtatttatgtgtttgtctgtctccccctactagaatgtaagctccatggggcagggacttcactgtattttgttcatagtgtatccccagagcctggaccagtgcttggcacataggagatggcaataaatgcttgtagaattaataaacaaggtgaaggagagagctaatgaaatgaaaatcttagtc

SEQ ID NO: 271040 - DNA, 3144 bp, Homo sapiens
  misc_feature (3064)..(3064): n is a, c, g, or t
ggcacgaggagccctgagagtccgccgccaacgcgcaggtgctagcggccccttcgccctgcagcccctttgcttttactctgtccaaagttaacatgtcactgaaaaacgagccacgggtaaatacctctgcactgcagaaaattgctgctgacatgagtaatatcatagaaaatctggacacgcgggaactccactttgagggagaggaggtagactacgacgtgtctcccagcgatcccaagatacaagaagtgtatatccctttctctgctatttataacactcaaggatttaaggagcctaatatacagacgtatctctccggctgtccaataaaagcacaagttctggaagtggaacgcttcacatctacaacaagggtaccaagtattaatctttacactattgaattaacacatggggaatttaaatggcaagttaagaggaaattcaagcattttcaagaatttcacagagagctgctcaagtacaaagcctttatccgcatccccattcccactagaagacacacgtttaggaggcaaaacgtcagagaggagcctcgagagatgcccagtttgccccgttcatctgaaaacatgataagagaagaacaattccttggtagaagaaaacaactggaagattacttgacaaagatactaaaaatgcccatgtatagaaactatcatgccacaacagagtttcttgatataagccagctgtctttcatccatgatttgggaccaaagggcatagaaggtatgataatgaaaagatctggaggacacagaataccaggcttgaattgctgtggtcagggaagagcctgctacagatggtcaaaaagatggttaatagtgaaagattcctttttattgtatatgaaaccagacagcggtgccattgccttcgtcctgctggtagacaaagaattcaaaattaaggtggggaagaaggagacagaaacgaaatatggaatccgaattgataatctttcaaggacacttattttaaaatgcaacagctatagacatgctcggtggtggggaggggctatagaagaattcatccagaaacatggcaccaactttctcaaagatcatcgatttgggtcatatgctgctatccaagagaatgctttagctaaatggtatgttaatgccaaaggatattttgaagatgtggcaaatgcaatggaagaggcaaatgaagagatttttatcacagactggtggctgagtccagaaatcttcctgaaacgcccagtggttgagggaaatcgttggaggttggactgcattcttaaacgaaaagcacaacaaggagtgaggatcttcataatgctctacaaagaggtggaactcgctcttggcatcaatagtgaatacaccaagaggactttgatgcgtctacatcccaacataaaggtgatgagacacccggatcatgtgtcatccaccgtctatttgtgggctcaccatgagaagcttgtcatcattgaccaatcggtggcctttgtgggagggattgacctggcctatggaaggtgggacgacaatgagcacagactcacagacgtgggcagtgtgaagcgggtcacttcaggaccgtctctgggttccctcccacctgccgcaatggagtctatggaatccttaagactcaaagataaaaatgagcctgttcaaaacctacccatccagaagagtattgatgatgtggattcaaaactgaaaggaataggaaagccaagaaagttctccaaatttagtctctacaagcagctccacaggcaccacctgcacgacgcagatagcatcagcagcattgacagcacctccagttattttaatcactatagaagtcatcacaatttaatccatggtttaaaaccccacttcaaactctttcacccgtccagtgagtctgagcaaggactcactagacctcatgctgataccgggtccatccgtagtttacagacaggtgtgggagagctgcatggggaaaccagattctggcatggaaaggactactgcaatttcgtcttcaaagactgggttcaacttgataaaccttttgctgatttcattgacaggtactccacgccccggatgccctggcatgacattgcctctgcagtccacgggaaggcggctcgtgatgtggcacgtcacttcatccagcgctggaacttcacaaaaattatgaaatcaaaatatcggtccctttcttatccttttctgcttccaaagtctcaaacaacagcccatgagttgagatatcaagtgcctgggtctgtccatgctaacgtacagttgctccgctctgctgctgattggtctgctggtataaagtaccatgaagagtccatccacgccgcttacgtccatgtgatagagaacagcaggcactatatctatatcgaaaaccagtttttcataagctgtgctgatgacaaagttgtgttcaacaagataggcgatgccattgcccagaggatcctgaaagctcacagggaaaaccagaaataccgggtatatgtcgtgataccacttctgccagggttcgaaggagacatttcaaccggcggaggaaatgctctacaggcaatcatgcacttcaactacagaaccatgtgcagaggagaaaattccatccttggacagttaaaagcagagcttggtaatcagtggataaattacatatcattctgtggtcttagaacacatgcagagctcgaaggaaacctagtaactgagcttatctatgtccacagcaagttgttaattgctgatgataacactgttattattggctctgccaacataaatgaccgcagcatgctgggaaagcgtgacagtgaaatggctgtcattgtgcaagatacagagactgttccttcagtaatggatggaaaagagtaccaagctggccggtttgcccgaggacttcggctacagtgctttaggtctaaaatgactccaggtgtcgaagatccctgatctttggcaagaagatgcaaattttaaactaatctgtggtgaagcagagagantactgggctaggaagctgggctcgtttcagctgtgcgatcctaaataagtccattcaataaagtgttatttagaactttc

SEQ ID NO: 271041 - DNA, 364 bp, Homo sapiens
ggtttgcccgaggacttcggctacagtgctttaggtcagtccgccaaagtgtgtctctctgatgcatttccactgcagcagtcgctgggacccagccccgctagccctgagcacatgggtcatcctaggttcttcttcatctaaaacagtgtgtcccagaatataggatatgtaccaccagtagtatgcgaaatgactttaggtggtacatgaatattttttattttaatagctttttattactgtcacgtgcagtagaaaaaactgcagtggtgcagttacagctcattgcatccttgaattcctaggctcaagcaatcctcctggctcagcattccgagtagctgggactacaggcccgtgt

SEQ ID NO: 271042 - DNA, 5582 bp, Homo sapiens
ggcacgaggagccctgagagtccgccgccaacgcgcaggtgctagcggccccttcgccctgcagcccctttgcttttactctgtccaaagttaacatgtcactgaaaaacgagccacgggtaaatacctctgcactgcagaaaattgctgctgacatgagtaatatcatagaaaatctggacacgcgggaactccactttgagggagaggaggtagactacgacgtgtctcccagcgatcccaagatacaagaagtgtatatccctttctctgctatttataacactcaaggatttaaggagcctaatatacagacgtatctctccggctgtccaataaaagcacaagttctggaagtggaacgcttcacatctacaacaagggtaccaagtattaatctttacactattgaattaacacatggggaatttaaatggcaagttaagaggaaattcaagcattttcaagaatttcacagagagctgctcaagtacaaagcctttatccgcatccccattcccactagaagacacacgtttaggaggcaaaacgtcagagaggagcctcgagagatgcccagtttgccccgttcatctgaaaacatgataagagaagaacaattccttggtagaagaaaacaactggaagattacttgacaaagatactaaaaatgcccatgtatagaaactatcatgccacaacagagtttcttgatataagccagctgtctttcatccatgatttgggaccaaagggcatagaaggtatgataatgaaaagatctggaggacacagaataccaggcttgaattgctgtggtcagggaagagcctgctacagatggtcaaaaagatggttaatagtgaaagattcctttttattgtatatgaaaccagacagcggtgccattgccttcgtcctgctggtagacaaagaattcaaaattaaggtggggaagaaggagacagaaacgaaatatggaatccgaattgataatctttcaaggacacttattttaaaatgcaacagctatagacatgctcggtggtggggaggggctatagaagaattcatccagaaacatggcaccaactttctcaaagatcatcgatttgggtcatatgctgctatccaagagaatgctttagctaaatggtatgttaatgccaaaggatattttgaagatgtggcaaatgcaatggaagaggcaaatgaagagatttttatcacagactggtggctgagtccagaaatcttcctgaaacgcccagtggttgagggaaatcgttggaggttggactgcattcttaaacgaaaagcacaacaaggagtgaggatcttcataatgctctacaaagaggtggaactcgctcttggcatcaatagtgaatacaccaagaggactttgatgcgtctacatcccaacataaaggtgatgagacacccggatcatgtgtcatccaccgtctatttgtgggctcaccatgagaagcttgtcatcattgaccaatcggtggcctttgtgggagggattgacctggcctatggaaggtgggacgacaatgagcacagactcacagacgtgggcagtgtgaagcgggtcacttcaggaccgtctctgggttccctcccacctgccgcaatggagtctatggaatccttaagactcaaagataaaaatgagcctgttcaaaacctacccatccagaagagtattgatgatgtggattcaaaactgaaaggaataggaaagccaagaaagttctccaaatttagtctctacaagcagctccacaggcaccacctgcacgacgcagatagcatcagcagcattgacagcacctccagttattttaatcactatagaagtcatcacaatttaatccatggtttaaaaccccacttcaaactctttcacccgtccagtgagtctgagcaaggactcactagacctcatgctgataccgggtccatccgtagtttacagacaggtgtgggagagctgcatggggaaaccagattctggcatggaaaggactactgcaatttcgtcttcaaagactgggttcaacttgataaaccttttgctgatttcattgacaggtactccacgccccggatgccctggcatgacattgcctctgcagtccacgggaaggcggctcgtgatgtggcacgtcacttcatccagcgctggaacttcacaaaaattatgaaatcaaaatatcggtccctttcttatccttttctgcttccaaagtctcaaacaacagcccatgagttgagatatcaagtgcctgggtctgtccatgctaacgtacagttgctccgctctgctgctgattggtctgctggtataaagtaccatgaagagtccatccacgccgcttacgtccatgtgatagagaacagcaggcactatatctatatcgaaaaccagtttttcataagctgtgctgatgacaaagttgtgttcaacaagataggcgatgccattgcccagaggatcctgaaagctcacagggaaaaccagaaataccgggtatatgtcgtgataccacttctgccagggttcgaaggagacatttcaaccggcggaggaaatgctctacaggcaatcatgcacttcaactacagaaccatgtgcagaggagaaaattccatccttggacagttaaaagcagagcttggtaatcagtggataaattacatatcattctgtggtcttagaacacatgcagagctcgaaggaaacctagtaactgagcttatctatgtccacagcaagttgttaattgctgatgataacactgttattattggctctgccaacataaatgaccgcagcatgctgggaaagcgtgacagtgaaatggctgtcattgtgcaagatacagagactgttccttcagtaatggatggaaaagagtaccaagctggccggtttgcccgaggacttcggctacagtgctttagggttgtccttggctatcttgatgacccaagtgaggacattcaggatccagtgagtgacaaattcttcaaggaggtgtgggtttcaacagcagctcgaaatgctacaatttatgacaaggttttccggtgccttcccaatgatgaagtacacaatttaattcagctgagagactttataaacaagcccgtattagctaaggaagatcccattcgagctgaggaggaactgaagaagatccgtggatttttggtgcaattccccttttatttcttgtctgaagaaagcctactgccttctgttgggaccaaagaggccatagtgcccatggaggtttggacttaagagatattcattggcagctcaaagacttccaccctggagaccacactgcacacagtgacttcctggggatgtcatagccaaagccaggcctgacgcattctcgtatccaacccaaggaccttttggaatgactggggagggctgcagtcacattgatgtaaggactgtaaacatcagcaagactttataattccttctgcctaacttgtaaaaagggggctgcattcttgttggtagcatgtactctgttgagtaaaacacatattcaaattccgtataccaaaatccatttcctttgtaacaagaatttaccagtaactgtgatctaggttgccaaaagttgtctgaatctccttattcttctctgatcttcatttatgcagccaatgtctagctggacctgccctcatcttgcagttcatacaggcactgtttgagagattgtttattattagatgttgtaatgctgcttcaagattcttcatggttacatgggatgcccctgctcatctggtcctgaagtagtaacattcacccaaatgaggatatagtcattattccttttcagtcactgtacgaacacggcagactttagcctacacagtagactgtgttaggcacttctggtaacattgacactgtatcttgacaccactaagccaacaggaaggaataaattcccaatattgagacagagatttatttcattttgctcccaaaggcactgacaacatgagtccttgtgattaggcccacctgatcaaatgtaaaaacatgcatgggatatttgattacgtaacaaccagctaaaactgagagcacacagccttcggaaacccccaaggtgtcgaggaggatcagatccagataagagaagatgattccttctagtcctgtaaaatttcctgtcatccttagctgctgggttgattgaaatttgatctctacatttcaaaatcaaactagtgaatacagtttgtctttcaagagaatcagaggcatcgtaactcctaccaagttagtaagtatgagtctaaccttgtttgacattcaggtcttctgctacattatcttctttgagaaaaattaattgattataaaatatgtgctacttcacttacattattaaatatgtattaacgcctctcaccagggcttccagtgaagttacaatgccctagtctgtgaattagtctggaaacgtgtttttccttttcggatgttagagtaccctttgataaactaaattttactaagctgaacaactctgacagtctaaagagctaatgtgggttaccaaaaggcctgtacctgtaaaacaaaatgcaggtgtaatgattatacatgtctatggattacctggacatactctcatttgggttgttcttcaaagaagcaagcagccgatccctgttttcataaagctaatacttcagttggaaaaattaaacaggagcacaaagtcagggataggggttagcagaagagagaaatagtgtcacatcaagggcaggatctcatagctagggaacatttcacaaataaggtgagattttgtaaccaataataaaaatgaatgtttttataagtaaataacttatttttcatatggctaaagatggtaaaatgacttcattctatagccattgtaaataagaatttgctattgatgaaagaagttcagattggcatttgaagtattgagtgtatgggatctctaaggatttcttagattttatatttaaatattttttaaaccttagaggagtcaacaaactggctcttgattttcagcaccctactctcatgaaaaaagcctgaaaggaccctttcccttataagtaatttaatccaatttctccccattttatagatgaggaaactgaggctcagatcagatgagaactcacttaaatccactcaatgtgtagatggtagagctgggactagcaacattgctgcagcccattgttggcctctctcttcactttatcattgcccaagaatgaggatatgcagtaaacagaattcaggcaagatacctctaagctgttttgaaccctctgatattttgtatttatgtgtttgtctgtctccccctactagaatgtaagctccatggggcagggacttcactgtattttgttcatagtgtatccccagagcctggaccagtgcttggcacataggagatggcaataaatgcttgtagaattaataaacaaggtgaaggagagagctaatgaaatgaaaatcttagtc

SEQ ID NO: 271043 - DNA, 3800 bp, Homo sapiens
aacttgtaaggactgtaaaaccttgttagcccacagcctgtaatagaatggacagatgccaccctagttgtgtcttaagaaattaagaagcttttaggtgtttaataaatgagagttgagcctccctttctgggactcacctgaaccacagtctctgagggggtcttgctgcattcacagataccgggtccatccgtagtttacagacaggtgtgggagagctgcatggggaaaccagattctggcatggaaaggactactgcaatttcgtcttcaaagactgggttcaacttgataaaccttttgctgatttcattgacaggtactccacgccccggatgccctggcatgacattgcctctgcagtccacgggaaggcggctcgtgatgtggcacgtcacttcatccagcgctggaacttcacaaaaattatgaaatcaaaatatcggtccctttcttatccttttctgcttccaaagtctcaaacaacagcccatgagttgagatatcaagtgcctgggtctgtccatgctaacgtacagttgctccgctctgctgctgattggtctgctggtataaagtaccatgaagagtccatccacgccgcttacgtccatgtgatagagaacagcaggcactatatctatatcgaaaaccagtttttcataagctgtgctgatgacaaagttgtgttcaacaagataggcgatgccattgcccagaggatcctgaaagctcacagggaaaaccagaaataccgggtatatgtcgtgataccacttctgccagggttcgaaggagacatttcaaccggcggaggaaatgctctacaggcaatcatgcacttcaactacagaaccatgtgcagaggagaaaattccatccttggacagttaaaagcagagcttggtaatcagtggataaattacatatcattctgtggtcttagaacacatgcagagctcgaaggaaacctagtaactgagcttatctatgtccacagcaagttgttaattgctgatgataacactgttattattggctctgccaacataaatgaccgcagcatgctgggaaagcgtgacagtgaaatggctgtcattgtgcaagatacagagactgttccttcagtaatggatggaaaagagtaccaagctggccggtttgcccgaggacttcggctacagtgctttagggttgtccttggctatcttgatgacccaagtgaggacattcaggatccagtgagtgacaaattcttcaaggaggtgtgggtttcaacagcagctcgaaatgctacaatttatgacaaggttttccggtgccttcccaatgatgaagtacacaatttaattcagctgagagactttataaacaagcccgtattagctaaggaagatcccattcgagctgaggaggaactgaagaagatccgtggatttttggtgcaattccccttttatttcttgtctgaagaaagcctactgccttctgttgggaccaaagaggccatagtgcccatggaggtttggacttaagagatattcattggcagctcaaagacttccaccctggagaccacactgcacacagtgacttcctggggatgtcatagccaaagccaggcctgacgcattctcgtatccaacccaaggaccttttggaatgactggggagggctgcagtcacattgatgtaaggactgtaaacatcagcaagactttataattccttctgcctaacttgtaaaaagggggctgcattcttgttggtagcatgtactctgttgagtaaaacacatattcaaattccgtataccaaaatccatttcctttgtaacaagaatttaccagtaactgtgatctaggttgccaaaagttgtctgaatctccttattcttctctgatcttcatttatgcagccaatgtctagctggacctgccctcatcttgcagttcatacaggcactgtttgagagattgtttattattagatgttgtaatgctgcttcaagattcttcatggttacatgggatgcccctgctcatctggtcctgaagtagtaacattcacccaaatgaggatatagtcattattccttttcagtcactgtacgaacacggcagactttagcctacacagtagactgtgttaggcacttctggtaacattgacactgtatcttgacaccactaagccaacaggaaggaataaattcccaatattgagacagagatttatttcattttgctcccaaaggcactgacaacatgagtccttgtgattaggcccacctgatcaaatgtaaaaacatgcatgggatatttgattacgtaacaaccagctaaaactgagagcacacagccttcggaaacccccaaggtgtcgaggaggatcagatccagataagagaagatgattccttctagtcctgtaaaatttcctgtcatccttagctgctgggttgattgaaatttgatctctacatttcaaaatcaaactagtgaatacagtttgtctttcaagagaatcagaggcatcgtaactcctaccaagttagtaagtatgagtctaaccttgtttgacattcaggtcttctgctacattatcttctttgagaaaaattaattgattataaaatatgtgctacttcacttacattattaaatatgtattaacgcctctcaccagggcttccagtgaagttacaatgccctagtctgtgaattagtctggaaacgtgtttttccttttcggatgttagagtaccctttgataaactaaattttactaagctgaacaactctgacagtctaaagagctaatgtgggttaccaaaaggcctgtacctgtaaaacaaaatgcaggtgtaatgattatacatgtctatggattacctggacatactctcatttgggttgttcttcaaagaagcaagcagccgatccctgttttcataaagctaatacttcagttggaaaaattaaacaggagcacaaagtcagggataggggttagcagaagagagaaatagtgtcacatcaagggcaggatctcatagctagggaacatttcacaaataaggtgagattttgtaaccaataataaaaatgaatgtttttataagtaaataacttatttttcatatggctaaagatggtaaaatgacttcattctatagccattgtaaataagaatttgctattgatgaaagaagttcagattggcatttgaagtattgagtgtatgggatctctaaggatttcttagattttatatttaaatattttttaaaccttagaggagtcaacaaactggctcttgattttcagcaccctactctcatgaaaaaagcctgaaaggaccctttcccttataagtaatttaatccaatttctccccattttatagatgaggaaactgaggctcagatcagatgagaactcacttaaatccactcaatgtgtagatggtagagctgggactagcaacattgctgcagcccattgttggcctctctcttcactttatcattgcccaagaatgaggatatgcagtaaacagaattcaggcaagatacctctaagctgttttgaaccctctgatattttgtatttatgtgtttgtctgtctccccctactagaatgtaagctccatggggcagggacttcactgtattttgttcatagtgtatccccagagcctggaccagtgcttggcacataggagatggcaataaatgcttgtagaattaataaacaaggtgaaggagagagctaatgaaatgaaaatcttagtc

SEQ ID NO: 271044 - DNA, 4730 bp, Homo sapiens
ggcacgaggagccctgagagtccgccgccaacgcgcaggtgctagcggccccttcgccctgcagcccctttgcttttactctgtccaaagttaacatgtcactgaaaaacgagccacgggtaaatacctctgcactgcagaaaattgctgctgacatgagtaatatcatagaaaatctggacacgcgggaactccactttgagggagaggaggtagactacgacgtgtctcccagcgatcccaagatacaagaagtgtatatccctttctctgctatttataacactcaaggatttaaggagcctaatatacagacgtatctctccggctgtccaataaaagcacaagttctggaagtggaacgcttcacatctacaacaagggtaccaagtattaatctttacactattgaattaacacatggggaatttaaatggcaagttaagaggaaattcaagcattttcaagaatttcacagagagctgctcaagtacaaagcctttatccgcatccccattcccactagaagacacacgtttaggaggcaaaacgtcagagaggagcctcgagagatgcccagtttgccccgttcatctgaaaacatgataagagaagaacaattccttggtagaagaaaacaactggaagattacttgacaaagatactaaaaatgcccatgtatagaaactatcatgccacaacagagtttcttgatataagccagctgtctttcatccatgatttgggaccaaagggcatagaaggtatgataatgaaaagatctggaggacacagaataccaggcttgaattgctgtggtcagggaagagcctgctacagatggtcaaaaagatggttaatagtgaaagattcctttttattgtatatgaaaccagacagcggtgccattgccttcgtcctgctggtagacaaagaattcaaaattaaggtggggaagaaggagacagaaacgaaatatggaatccgaattgataatctttcaaggacacttattttaaaatgcaacagctatagacatgctcggtggtggggaggggctatagaagaattcatccagaaacatggcaccaactttctcaaagatcatcgatttgggtcatatgctgctatccaagagaatgctttagctaaatggtatgttaatgccaaaggatattttgaagatgtggcaaatgcaatggaagaggcaaatgaagagatttttatcacagactggtggctgagtccagaaatcttcctgaaacgcccagtggttgagggaaatcgttggaggttggactgcattcttaaacgaaaagcacaacaaggagtgaggatcttcataatgctctacaaagaggtggaactcgctcttggcatcaatagtgaatacaccaagaggactttgatgcgtctacatcccaacataaaggtgatgagacacccggatcatgtgtcatccaccgtctatttgtgggctcaccatgagaagcttgtcatcattgaccaatcggtggcctttgtgggagggattgacctggcctatggaaggtgggacgacaatgagcacagactcacagacgtgggcagtgtgaagcgggtcacttcaggaccgtctctgggttccctcccacctgccgcaatggagtctatggaatccttaagactcaaagataaaaatgagcctgttcaaaacctacccatccagaagagtattgatgatgtggattcaaaactgaaaggaataggaaagccaagaaagttctccaaatttagtctctacaagcagctccacaggcaccacctgcacgacgcagatagcatcagcagcattgacagcacctccagttattttaatcactatagaagtcatcacaatttaatccatggtttaaaaccccacttcaaactctttcacccgtccagtgagtctgagcaaggactcactagacctcatgctgataccgggtccatccgtagtttacagacaggtgtgggagagctgcatggggaaaccagattctggcatggaaaggactactgcaatttcgtcttcaaagactgggttcaacttgataaaccttttgctgatttcattgacaggtactccacgccccggatgccctggcatgacattgcctctgcagtccacgggaaggcggctcgtgatgtggcacgtcacttcatccagcgctggaacttcacaaaaattatgaaatcaaaatatcggtccctttcttatccttttctgcttccaaagtctcaaacaacagcccatgagttgagatatcaagtgcctgggtctgtccatgctaacgtacagttgctccgctctgctgctgattggtctgctggtataaagtaccatgaagagtccatccacgccgcttacgtccatgtgatagagaacagcaggcactatatctatatcgaaaaccagtttttcataagctgtgctgatgacaaagttgtgttcaacaagataggcgatgccattgcccagaggatcctgaaagctcacagggaaaaccagaaataccgggtatatgtcgtgataccacttctgccagggttcgaaggagacatttcaaccggcggaggaaatgctctacaggcaatcatgcacttcaactacagaaccatgtgcagaggagaaaattccatccttggacagttaaaagcagagcttggtaatcagtggataaattacatatcattctgtggtcttagaacacatgcagagctcgaaggaaacctagtaactgagcttatctatgtccacagcaagttgttaattgctgatgataacactgttattattggctctgccaacataaatgaccgcagcatgctgggaaagcgtgacagtgaaatggctgtcattgtgcaagatacagagactgttccttcagtaatggatggaaaagagtaccaagctggccggtttgcccgaggacttcggctacagtgctttagggttgtccttggctatcttgatgacccaagtgaggacattcaggatccagtgagtgacaaattcttcaaggaggtgtgggtttcaacagcagctcgaaatgctacaatttatgacaaggttttccggtgccttcccaatgatgaagtacacaatttaattcagctgagagactttataaacaagcccgtattagctaaggaagatcccattcgagctgaggaggaactgaagaagatccgtggatttttggtgcaattccccttttatttcttgtctgaagaaagcctactgccttctgttgggaccaaagaggccatagtgcccatggaggtttggacttaagagatattcattggcagctcaaagacttccaccctggagaccacactgcacacagtgacttcctggggatgtcatagccaaagccaggcctgacgcattctcgtatccaacccaaggaccttttggaatgactggggagggctgcagtcacattgatgtaaggactgtaaacatcagcaagactttataattccttctgcctaacttgtaaaaagggggctgcattcttgttggtagcatgtactctgttgagtaaaacacatattcaaattccgtataccaaaatccatttcctttgtaacaagaatttaccagtaactgtgatctaggttgccaaaagttgtctgaatctccttattcttctctgatcttcatttatgcagccaatgtctagctggacctgccctcatcttgcagttcatacaggcactgtttgagagattgtttattattagatgttgtaatgctgcttcaagattcttcatggttacatgggatgcccctgctcatctggtcctgaagtagtaacattcacccaaatgaggatatagtcattattccttttcagtcactgtacgaacacggcagactttagcctacacagtagactgtgttaggcacttctggtaacattgacactgtatcttgacaccactaagccaacaggaaggaataaattcccaatattgagacagagatttatttcattttgctcccaaaggcactgacaacatgagtccttgtgattaggcccacctgatcaaatgtaaaaacatgcatgggatatttgattacgtaacaaccagctaaaactgagagcacacagccttcggaaacccccaaggtgtcgaggaggatcagatccagataagagaagatgattccttctagtcctgtaaaatttcctgtcatccttagctgctgggttgattgaaatttgatctctacatttcaaaatcaaactagtgaatacagtttgtctttcaagagaatcagaggcatcgtaactcctaccaagttaatgaggaaactgaggctcagatcagatgagaactcacttaaatccactcaatgtgtagatggtagagctgggactagcaacattgctgcagcccattgttggcctctctcttcactttatcattgcccaagaatgaggatatgcagtaaacagaattcaggcaagatacctctaagctgttttgaaccctctgatattttgtatttatgtgtttgtctgtctccccctactagaatgtaagctccatggggcagggacttcactgtattttgttcatagtgtatccccagagcctggaccagtgcttggcacataggagatggcaataaatgcttgtagaattaataaacaaggtgaaggagagagctaatgaaatgaaaatcttagtc

SEQ ID NO: 271045 - DNA, 431 bp, Homo sapiens
tggcgagctcctgccctccaccctcttgccgctgtatggggcgcctcgtccccgcggctccagcctccctcgtcggcagcacactggccctccctctcctgcgccctgaggttgacttcgtcgtctttcggggttgccttgcctttcggcctttctggggttcggggattatgacgtttgacctgaaagacagcagggatttcggccgggacccctgggccccgggctcgtccagcactgggctctcacccggatcctcatggctttgcccctggggagccacggggcggaacagcccaggccatccttgggaccagagagggttgacctcagatgtacggtacccagccttttctcagggacctcctttttatttttctgaagccctaccagggcgatcccagaaataaaacgtgtacaaggcttaaaaa

SEQ ID NO: 271046 - DNA, 367 bp, Homo sapiens
aaccctcctacctgtaccctcagaagtgatacttacatagcccaggaagtgcttcattatgactctcctggcttctcgtctataatactggccaacatcaagggctgccaggagagttcacagagctgaagactgtctccttcacacaagggagttgtgccagaaactgcaggtgagccattaggagccacagcagttcttttgtgaccgtgagggaaacctgaagccagaagccaagtcaaagtatagcagaacctcaagaccaaaggggccatgaacattggtgatgttgtggagccaccagaataaccctgttctttgtgaacttctttcagatgaaggaaaataaatcctgatattgtttaag

SEQ ID NO: 271047 - DNA, 1007 bp, Homo sapiens
gcccggagctcgcgggacgcgcagggtccccaggagggcgtccgggccgccgccgccgccgtaggtgtgggcccggggccggggcgcgggcgggcccccgagcggagcgactccttgcggcgcgtgtgcgggctctcgagcagcgcgcagaagccgtaggcggtgcgcacacggggcaggtgcggcagtgacagcgcggcctgcgagcgcgggtcccagtctgtgcggccggcgccctcgtccatccctgcttcttcgacccaagaattccggagcgcagccaaggccaggcggggcatgagccgtggcgggatgcagaactcagggatgcggtccggagtgagcacatttgcgcacgcggcggtggtgcgagacttggctccgcgggcccgacccgggagaagccagtctccgctccgccgaaggcactcaggacccaagcggagtcgctccaggcaccacatctggccactctctgctggagcttgtctacctggagtcctgcgtcagatgggtctctgcacctttctgcctgggacaccgaccaggagaggcgcttagcggctgggaaattcaaagcgcgcgcggcggggttcagcaccagtgttcaaggactgccagcctgagcttttatacctgccgctgggagcgcttgccagtgggccgagcagaggggcgctgcctggtaacctgacgccaggctcttccctgtccctctgccacgtggctggatttgctgagcaaggtttggagacccagttctttctctctccggcttcaggtggaggtgttttcctcggaaaccccgaacaagtttctgtttcctcacatgcaaaatggtattaagtctctactataccgcagagtcattgtgaggatcgacgggcgtaatgaatgtgagcacgtagaagtactctacattcaccattaaaatgaagacaagtccggtttgtcttattcttgcctaatacccttccccaaatccagcttcccagttgcccagcttt

SEQ ID NO: 271048 - DNA, 1703 bp, Homo sapiens
caccaattttaaaatgaggtgattggagcaaacagatcgccaagacactttctagttctaacacttcatgtgattcattatttcctaggcgtgtgtggtacatatggtatgcaaatggctgtctatattgggaaacactgtagaaccattccatttgctgaaaaaaattctggaggtatctatggaaaatatcatatcttttactgggatagttaatctagaatcatctctgccagtgttgtactgaaacgggactgataagaacaacaaatacacgtttattttgtaccacgcggctgtcagtgtccggagtctccagggcagagcgccccggggagggctgggccctcagagcagcaggagggcgcccagggacagctcaccctggcccagcaggcggccccgatcccggccgcgaccctcatcccgggccttgacgcgaacggccaggcggcgcacctcgtcttccgagaggccgtcgaagcaaaagtcctggtcaaaggaggccttgcggctgcgccccaccacagcgctgcattgccgaacgcgcagtgcccggcggccgcaggacgaggctgaggcgacagctgacggctcggggcccgggggcgcctccggccgggctctcggcgcggagcagccggaggcggagccgcccggttcccggacagtactcggcggccaggcgcagggcgtcgccggcgcggcccagagccacggtgccctcggcctccaggcgctcgggaaacgggacccgggacgacggcgggctcgtggagggggcccgggccggggactcggagcgactccttgcggcgcgtgtgcgggctctcgagcagcgcgcagaagccgtaggcggtgcgcacacggggcaggtgcggcagtgacagcgcggcctgcgagcgcgggtcccagtctgtgcggccggcgccctcgtccatccctgcttcttcgacccaagaattccggagcgcagccaaggccaggcggggcatgagccgtggcgggatgcagaactcagggatgcggtccggagtgagcacatttgcgcacgcggcggtggtgcgagacttggctccgcgggcccgacccgggagaagccagtctccgctccgccgaaggcactcaggacccaagcggagtcgctccaggcaccacatctggccactctctgctggagcttgtctacctggagtcctgcgtcagatgggtctctgcacctttctgcctgggacaccgaccaggagaggcgcttagcggctgggaaattcaaagcgcgcgcggcggggttcagcaccagtgttcaaggactgccagcctgagcttttatacctgccgctgggagcgcttgccagtgggccgagcagaggggcgctgcctggtaacctgacgccaggctcttccctgtccctctgccacgtggctggatttgctgagcaaggtttggagacccagttctttctctctccggcttcaggtggaggtgttttcctcggaaaccccgaacaagtttctgtttcctcacatgcaaaatggtattaagtctctactataccgcagagtcattgtgaggatcgacgggcgtaatgaatgtgagcacgtagaagtactctacattcaccattaaaatgaagacaagtccggtttgtcttattcttgcctaatacccttccccaaatccagcttcccagttgcccagcttt

SEQ ID NO: 271049 - DNA, 1708 bp, Homo sapiens
  misc_feature (134)..(134): n is a, c, g, or t
  misc_feature (146)..(146): n is a, c, g, or t
  misc_feature (206)..(206): n is a, c, g, or t
gaatgaataacttgctttattaaaaaaaaactgtaacattgatagaaaaccggaaggaattaaaaacaatgcagatgggtgtacttcctttctctcccagtcccaagccaacccatttttccttggaatgcaanaatggtctgganagagatatgggggtcctgtgaacagaacagggagtcattatctttttcttctttaccaanagacgatgacaaatgtggatggtgaggaagtaaaacgtcaataaagcagtatcataaataaaaaaataaatacacgtttattttgtaccacgcggctgtcagtgtccggagtctccagggcagagcgccccggggagggctgggccctcagagcagcaggagggcgcccagggacagctcaccctggcccagcaggcggccccgatcccggccgcgaccctcatcccgggccttgacgcgaacggccaggcggcgcacctcgtcttccgagaggccgtcgaagcaaaagtcctggtcaaaggaggccttgcggctgcgccccaccacagcgctgcattgccgaacgcgcagtgcccggcggccgcaggacgaggctgaggcgacagctgacggctcggggcccgggggcgcctccggccgggctctcggcgcggagcagccggaggcggagccgcccggttcccggacagtactcggcggccaggcgcagggcgtcgccggcgcggcccagagccacggtgccctcggcctccaggcgctcgggaaacgggacccgggacgacggcgggctcgtggagggggcccgggccggggactcggagcgactccttgcggcgcgtgtgcgggctctcgagcagcgcgcagaagccgtaggcggtgcgcacacggggcaggtgcggcagtgacagcgcggcctgcgagcgcgggtcccagtctgtgcggccggcgccctcgtccatccctgcttcttcgacccaagaattccggagcgcagccaaggccaggcggggcatgagccgtggcgggatgcagaactcagggatgcggtccggagtgagcacatttgcgcacgcggcggtggtgcgagacttggctccgcgggcccgacccgggagaagccagtctccgctccgccgaaggcactcaggacccaagcggagtcgctccaggcaccacatctggccactctctgctggagcttgtctacctggagtcctgcgtcagatgggtctctgcacctttctgcctgggacaccgaccaggagaggcgcttagcggctgggaaattcaaagcgcgcgcggcggggttcagcaccagtgttcaaggactgccagcctgagcttttatacctgccgctgggagcgcttgccagtgggccgagcagaggggcgctgcctggtaacctgacgccaggctcttccctgtccctctgccacgtggctggatttgctgagcaaggtttggagacccagttctttctctctccggcttcaggtggaggtgttttcctcggaaaccccgaacaagtttctgtttcctcacatgcaaaatggtattaagtctctactataccgcagagtcattgtgaggatcgacgggcgtaatgaatgtgagcacgtagaagtactctacattcaccattaaaatgaagacaagtccggtttgtcttattcttgcctaatacccttccccaaatccagcttcccagttgcccagcttt

SEQ ID NO: 271050 - DNA, 876 bp, Homo sapiens
gtaattatataatactaatcttattaatattttttatgaaaaataataataatgtcaagccatcttgtacaaagctgtcatatcaaaatgtcatatcaaaatatccaagagtactttggaaatatggattcccaagttgtttttgtgggtgccaaaaggactgctggtcatgttcaaagcaatgtatggaaagagtccgccatctcagaggaaccaaagagtggagtgattatcatcatggaggatgaaagtgtattccagtgtctacctcattcatttcctaaagtgaatcacccaggccttggctgttctaatatctggaattctctttctactacaagtacatctgtcacacagaatgttacccacttactccctatgttttctgatcacatagaatctgagaggggaaataaaacttataaattgttgagtccaagattgacaaactccgttgtcttaaagggctaagctgtggtgacaggtgcagcaggccaggcataagtaatagggagcaggggagactgtgggaaactgaagggcagctgtctcataagaggatgaaattctaatcttttacaatatatttcaaggcaaacaaagcaacactctgggctgggagtccatccatgaactaccaacttttagccccaaattatgaataccttccttatttatagatgaggaaattgagactgagagtagggatatgacataaggcagaaattggcttctggcttaattgaagcatttagatgggttgggagtgataatattaaaaagatgattgcaaaagctttatttcatgctggaatgtcaatataacattgaatgggctgaagactgatattttcaatgacttaacctataagcaag

SEQ ID NO: 271051 - DNA, 872 bp, Homo sapiens
tgtattgttaatcattcacgcctccacttatatttataaacgacccgcctattagccatcttgtacaaagctgtcatatcaaaatgtcatatcaaaatatccaagagtactttggaaatatggattcccaagttgtttttgtgggtgccaaaaggactgctggtcatgttcaaagcaatgtatggaaagagtccgccatctcagaggaaccaaagagtggagtgattatcatcatggaggatgaaagtgtattccagtgtctacctcattcatttcctaaagtgaatcacccaggccttggctgttctaatatctggaattctctttctactacaagtacatctgtcacacagaatgttacccacttactccctatgttttctgatcacatagaatctgagaggggaaataaaacttataaattgttgagtccaagattgacaaactccgttgtcttaaagggctaagctgtggtgacaggtgcagcaggccaggcataagtaatagggagcaggggagactgtgggaaactgaagggcagctgtctcataagaggatgaaattctaatcttttacaatatatttcaaggcaaacaaagcaacactctgggctgggagtccatccatgaactaccaacttttagccccaaattatgaataccttccttatttatagatgaggaaattgagactgagagtagggatatgacataaggcagaaattggcttctggcttaattgaagcatttagatgggttgggagtgataatattaaaaagatgattgcaaaagctttatttcatgctggaatgtcaatataacattgaatgggctgaagactgatattttcaatgacttaacctataagcaag

SEQ ID NO: 271052 - DNA, 875 bp, Homo sapiens
  misc_feature (54)..(54): n is a, c, g, or t
tttccttcactaccttcctgttataaaaacagaagcacccttattagctactgnacagccatcttgtacaaagctgtcatatcaaaatgtcatatcaaaatatccaagagtactttggaaatatggattcccaagttgtttttgtgggtgccaaaaggactgctggtcatgttcaaagcaatgtatggaaagagtccgccatctcagaggaaccaaagagtggagtgattatcatcatggaggatgaaagtgtattccagtgtctacctcattcatttcctaaagtgaatcacccaggccttggctgttctaatatctggaattctctttctactacaagtacatctgtcacacagaatgttacccacttactccctatgttttctgatcacatagaatctgagaggggaaataaaacttataaattgttgagtccaagattgacaaactccgttgtcttaaagggctaagctgtggtgacaggtgcagcaggccaggcataagtaatagggagcaggggagactgtgggaaactgaagggcagctgtctcataagaggatgaaattctaatcttttacaatatatttcaaggcaaacaaagcaacactctgggctgggagtccatccatgaactaccaacttttagccccaaattatgaataccttccttatttatagatgaggaaattgagactgagagtagggatatgacataaggcagaaattggcttctggcttaattgaagcatttagatgggttgggagtgataatattaaaaagatgattgcaaaagctttatttcatgctggaatgtcaatataacattgaatgggctgaagactgatattttcaatgacttaacctataagcaag

SEQ ID NO: 271053 - DNA, 880 bp, Homo sapiens
ctctctcgtccccccctatcttccatcataattattataacgccacccaccacccttatgtagccatcttgtacaaagctgtcatatcaaaatgtcatatcaaaatatccaagagtactttggaaatatggattcccaagttgtttttgtgggtgccaaaaggactgctggtcatgttcaaagcaatgtatggaaagagtccgccatctcagaggaaccaaagagtggagtgattatcatcatggaggatgaaagtgtattccagtgtctacctcattcatttcctaaagtgaatcacccaggccttggctgttctaatatctggaattctctttctactacaagtacatctgtcacacagaatgttacccacttactccctatgttttctgatcacatagaatctgagaggggaaataaaacttataaattgttgagtccaagattgacaaactccgttgtcttaaagggctaagctgtggtgacaggtgcagcaggccaggcataagtaatagggagcaggggagactgtgggaaactgaagggcagctgtctcataagaggatgaaattctaatcttttacaatatatttcaaggcaaacaaagcaacactctgggctgggagtccatccatgaactaccaacttttagccccaaattatgaataccttccttatttatagatgaggaaattgagactgagagtagggatatgacataaggcagaaattggcttctggcttaattgaagcatttagatgggttgggagtgataatattaaaaagatgattgcaaaagctttatttcatgctggaatgtcaatataacattgaatgggctgaagactgatattttcaatgacttaacctataagcaag

SEQ ID NO: 271054 - DNA, 871 bp, Homo sapiens
ataatataatttatatattatataatatgttttaacacaaaataaacctcgaagccatcttgtacaaagctgtcatatcaaaatgtcatatcaaaatatccaagagtactttggaaatatggattcccaagttgtttttgtgggtgccaaaaggactgctggtcatgttcaaagcaatgtatggaaagagtccgccatctcagaggaaccaaagagtggagtgattatcatcatggaggatgaaagtgtattccagtgtctacctcattcatttcctaaagtgaatcacccaggccttggctgttctaatatctggaattctctttctactacaagtacatctgtcacacagaatgttacccacttactccctatgttttctgatcacatagaatctgagaggggaaataaaacttataaattgttgagtccaagattgacaaactccgttgtcttaaagggctaagctgtggtgacaggtgcagcaggccaggcataagtaatagggagcaggggagactgtgggaaactgaagggcagctgtctcataagaggatgaaattctaatcttttacaatatatttcaaggcaaacaaagcaacactctgggctgggagtccatccatgaactaccaacttttagccccaaattatgaataccttccttatttatagatgaggaaattgagactgagagtagggatatgacataaggcagaaattggcttctggcttaattgaagcatttagatgggttgggagtgataatattaaaaagatgattgcaaaagctttatttcatgctggaatgtcaatataacattgaatgggctgaagactgatattttcaatgacttaacctataagcaag

SEQ ID NO: 271055 - DNA, 378 bp, Homo sapiens
gcacccatagccatgagacctaggtttgtcagataatttctttgagcctcacatgcctcctctgtaaaatgggaataatgactattccttctcttcaggactgctggtcatgttcaaagcaatgtatggaaagagtccgccatctcagaggaaccaaagagtggagtgattatcatcatggaggatgaaagtgtattccagtgtctacctcattcatttcctaaagtgaatcacccaggccttggctgttctaatatctggaattctctttctactacaagtacatctgtcacacagaatgttacccacttactccctatgttttctgatcacatagaatctgagaggggaaataaaacttataaattgttgagtcca

SEQ ID NO: 271056 - DNA, 875 bp, Homo sapiens
tttttgttaaattacaagttcttctattttattataataagagagcaaccgtgattagccatcttgtacaaagctgtcatatcaaaatgtcatatcaaaatatccaagagtactttggaaatatggattcccaagttgtttttgtgggtgccaaaaggactgctggtcatgttcaaagcaatgtatggaaagagtccgccatctcagaggaaccaaagagtggagtgattatcatcatggaggatgaaagtgtattccagtgtctacctcattcatttcctaaagtgaatcacccaggccttggctgttctaatatctggaattctctttctactacaagtacatctgtcacacagaatgttacccacttactccctatgttttctgatcacatagaatctgagaggggaaataaaacttataaattgttgagtccaagattgacaaactccgttgtcttaaagggctaagctgtggtgacaggtgcagcaggccaggcataagtaatagggagcaggggagactgtgggaaactgaagggcagctgtctcataagaggatgaaattctaatcttttacaatatatttcaaggcaaacaaagcaacactctgggctgggagtccatccatgaactaccaacttttagccccaaattatgaataccttccttatttatagatgaggaaattgagactgagagtagggatatgacataaggcagaaattggcttctggcttaattgaagcatttagatgggttgggagtgataatattaaaaagatgattgcaaaagctttatttcatgctggaatgtcaatataacattgaatgggctgaagactgatattttcaatgacttaacctataagcaag

SEQ ID NO: 271057 - DNA, 873 bp, Homo sapiens
tattcttgatatttattatcttttcaaaagtaatttttattacagccacctgacagccatcttgtacaaagctgtcatatcaaaatgtcatatcaaaatatccaagagtactttggaaatatggattcccaagttgtttttgtgggtgccaaaaggactgctggtcatgttcaaagcaatgtatggaaagagtccgccatctcagaggaaccaaagagtggagtgattatcatcatggaggatgaaagtgtattccagtgtctacctcattcatttcctaaagtgaatcacccaggccttggctgttctaatatctggaattctctttctactacaagtacatctgtcacacagaatgttacccacttactccctatgttttctgatcacatagaatctgagaggggaaataaaacttataaattgttgagtccaagattgacaaactccgttgtcttaaagggctaagctgtggtgacaggtgcagcaggccaggcataagtaatagggagcaggggagactgtgggaaactgaagggcagctgtctcataagaggatgaaattctaatcttttacaatatatttcaaggcaaacaaagcaacactctgggctgggagtccatccatgaactaccaacttttagccccaaattatgaataccttccttatttatagatgaggaaattgagactgagagtagggatatgacataaggcagaaattggcttctggcttaattgaagcatttagatgggttgggagtgataatattaaaaagatgattgcaaaagctttatttcatgctggaatgtcaatataacattgaatgggctgaagactgatattttcaatgacttaacctataagcaag

SEQ ID NO: 271058 - DNA, 394 bp, Homo sapiens
tccgggaacgtggcaacacccaacacatcctgtggccctctctgagactcagcatttcccattcaacagcaaaatccagaagtaatttatatttgggtttaaaagtctagatcaggcagtggctcatgcttgtaatcccagcactttggaaggctgaggtgggcagatcacttgagcccaggagttcgagaccagcttgtgcaatataacaagaccctgtctctacaaaaatacaaaaaaagccgagcatggtggtgcacgcctgtattcccagttactcaggaggctgaggtgggaggatcacttgaacctgggaggtcaaggctgcagtgagtgatgactgtgccactgcactccagcctgggcaacagaatgagaccctgtctcaaaaaaa

SEQ ID NO: 271059 - DNA, 349 bp, Homo sapiens
gacaaatgaaatacagaaagtcataatatctacaaccctgtggtctacaaaggagtttggttatactacatgaacctgaaatagatgatggattaaagtctccattattccatgtaatgataaaacaatttcaagtgatcataagaccattttataatgaattccttctttccactgtaaaggccatagtgttagattgcttactcttgttaagatttactggatgctaacagtccagcactggctaggcatcgagaacataaaaataaatgagaagtgttcctgcttttaagatgttcctactgtggcaaacagagagctacaaaatataataatatagaagtatgta

SEQ ID NO: 271060 - DNA, 590 bp, Homo sapiens
cagcctccacacggacgcgccttgggcttggtcttgggggagctacctgcactgtggggtcacatgacagaattagtggtcagccctagctggaggtccagggcaaacacaggcgggggcaggggggtggggggtcgtgagcctgctgattcaagtgtccctgtgggtcccgcaccttctgagacacaagcgccaggcttcagagacgaggctccgggatttacccctgggggcctcctgctcccacagccgatgagagccggcagtttggctgtatcgtaagctggcgctttagctggagagggacgagccctcggccagctcgccagcgggagggcctcagtcgtcccatccgggctgtaggctccgcaaagctcttgatgcactgtcaggctgggaggtccggccgctcccattcccccacagccgcatctagattggggtgggtaggacattttaacgtgcttctgagacagccaccaccgaaaggcacctttagcggttaggaaacccgcgcggagttcaaccacccggcctctgcggagcagaaggcccggtcgggcttttccctgcgcggggcgggcggccgc

SEQ ID NO: 271061 - DNA, 427 bp, Homo sapiens
tgaagtttcttcatgccatgctaaagccctcctcccctagaggagctatagctttattatcataacctgtgacccatcatggcatgtagagggggggtctgggccactgggacccccccccccatacacatgccatgatgcacctctcccttctctatcactccatcaaaccctcctgtcactttcccttgggaagatacggctttggagaacacttcccgtgtgtgtcttacttgtgccaagtaacacaatgcctattgatcaaaatctgagttctcctggagagtcgtttgttactcaccaggcaaataagccccagtttttgggaggtaacattatgaaatattctgaagtagtcccatgaaagatttctactttccttttcaaattattgataaataaatgagcttgctttgggctatggaga

SEQ ID NO: 271062 - DNA, 933 bp, Homo sapiens
ttaaatttccagttcaaagatggaaatcgtcagaggcttccaagatggctgaataggaacagctccagtccgcagctcccagcaagattgatgcagaaggcggatgatttctgcatttccaactaagtgccatgacttaaggagtgaagagagggcatagagaacaagcagagtatgcagggcatatgctgagataagaaactggatctgaaacaagttgaatacttgcagagaatcatgggaaccattataacaaagaagtcaagagtgttggtgtggagtggaccttggtttgaatactcagctctgccacttactagctgtaggctcatatgcaagttactatcctcatctgttaaaaaggaataatatctaatgttatataaaatgtaaaagttatttcacacaatgccattcacatagtaaatgttcaataaaagcaaaaacctcaggacatatataagtggcaatgtgaaattaatacagcagaagctcagttcacacagatgttaatccttaaacaagccttgcattgtatgagtatcccacaaaaggagtaagggaagaagatcttacatcactggagtgagtgactaccatggaccagccaccgttactcactttacttcatttaacccgcacaatagcctcatgaggtagatatcatcaccattttgcagatgagaaagctgaagctaagcaaagttgacctgaccaaaatcacatagcaattaagataggagtccagcttcgtctcattccaatatgagtgcgttttcctcttttccattggctctcaaagtttggtcttaaaggagctgtatcagcatcacctgggaacttattagaactgcaccttctcagccctaccccaaacccactgggtcagaaactctggggttggggcctagccatctgtgtttcacactcaga

SEQ ID NO: 271063 - DNA, 472 bp, Homo sapiens
  misc_feature (444)..(444): n is a, c, g, or t
atctgaaaagagaatggtaggctgtgattttgataaattattcctttaaagtcaccgttttcttgcttgtttattctgattttatccatggagaatttcaaatcagtgacaacagtataaaccttactctaaataagttttaaagactttaaatacaaacaaattctatgacttaaataaaaaaaaaaaaacagttcagtcaactgtatcagcaccacaagaccccctctacttaaccctttatagctgtcaaaaaaattgcaccaaatttagtacaaaaaattcaacaagtggcttttatttgcaatttgagagtcgagaaacactcaataaaatagaatgagtattctgatgagccaagcagaagaggttggctttataggcagaaaaaagggctgcagaaagcagaaacagagaacacaaatcagtctgggtgacaaaagnggatccgtctcgaaaaaaaaagagaaaa

SEQ ID NO: 271064 - DNA, 306 bp, Homo sapiens
gctgtggagcctcatccataattgatcctgaactgcacttaccctaacagaccgcgcagatgccggctgcacgtagagctctgggagggttgtctactgatgagcctactccaagtagtgaaggcactcacagccatggcacgtggtaacttcaatgggcctgacacttttccttccatcaaaaacaacaaggaagaggaaaggaatgactccccagatgctctgagtggttgttctgaggtcatttctatgtacaagtcagcttgaggggaattaaaaacaattggcataagccaaactcatacc

SEQ ID NO: 271065 - DNA, 699 bp, Homo sapiens
aaaattatccaatgtagcatggatggtttcactttcttgtccactcagacacatgctcatacttattaaatggatttattggatgcttcaaaagtcctgatgtgtagtagcacaaaagttccttgtaaaaaaagaagttgcaaaattataaaaatttctgcagcagttctggctctggatgacaaagctcattctgattagtagtttttttgacatgcacagcagcttcccctataagtcctacgttcggagggttccgtttagacaacaggaagttggaatccaagtttaaaaggctctctgctgacaaaatgtggtacatccatcaacagaattctactcagcaataaaaggaacaaactaccaagacgttatctgtcatggacaaacctcaaaaacattagctaagtaaaaaagccagacacggctgggcgcagtggtttacgtctgtaatcctagcacttttggaagccgaagcgggcagatcacctgaggtcaggtgttcaagaccaccctggcgaacatggtgaaagcccatctctactaaaatacaaaaattagctgggcatgatggcgggtgcctgtaatcccagctactcgggaggctgagccaggagaatcgcttgaaccacggagatggtggatgcagtgagccgaggtcacaccactgcactgggcagctgagcgagattctgtcta

SEQ ID NO: 271066 - DNA, 778 bp, Homo sapiens
  misc_feature (1)..(1): n is a, c, g, or t
  misc_feature (3)..(4): n is a, c, g, or t
ncnnggcttcattccattttctgttgagtaataaactcaacgttgaaaatgtcctttgtgggggagaactcaggagtgaaaatgggctctgaggactgggaaaaagatgaaccccagtgctgcttagaagacccggctggaagccccctggaaccaggcccaagcctccccaccatgaattttgttcacacaagtccaaaggtgaagaacttaaacccgaagaaattcagcattcatgaccaggatcacaaagtactggtcctggactctgggaatctcatagcagttccagataaaaactacatacgcccagagatcttctttgcattagcctcatccttgagctcagcctctgcggagaaaggaagtccgattctcctgggggtctctaaaggggagttttgtctctactgtgacaaggataaaggacaaagtcatccatcccttcagctgaagaaggagaaactgatgaagctggctgcccaaaaggaatcagcacgccggcccttcatcttttatagggctcaggtgggctcctggaacatgctggagtcggcggctcaccccggatggttcatctgcacctcctgcaattgtaatgagcctgttggggtgacagataaatttgagaacaggaaacacattgaattttcatttcaaccagtttgcaaagctgaaatgagccccagtgaggtcagcgattaggaaactgccccattgaacgccttcctcgctaatttgaactaattgtataaaaacaccaaacctgctcactaaa

SEQ ID NO: 271067 - DNA, 806 bp, Homo sapiens
  misc_feature (1)..(1): n is a, c, g, or t
  misc_feature (3)..(4): n is a, c, g, or t
ncnnggcttcattccattttctgttgagtaataaactcaacgttgaaaatgtcctttgtgggggagaactcaggagtgaaaatgggctctgaggactgggaaaaagatgaaccccagtgctgcttagaagacccggctggaagccccctggaaccaggcccaagcctccccaccatgaattttgttcacacaagtccaaaggtgaagaacttaaacccgaagaaattcagcattcatgaccaggatcacaaagtactggtcctggactctgggaatctcatagcagttccagataaaaactacatacgcccagagatcttctttgcattagcctcatccttgagctcagcctctgcggagaaaggaagtccgattctcctgggggtctctaaaggggagttttgtctctactgtgacaaggataaaggacaaagtcatccatcccttcagctgaagaaggagaaactgatgaagctggctgcccaaaaggaatcagcacgccggcccttcatcttttatagggctcaggtgggctcctggaacatgctggagtcggcggctcaccccggatggttcatctgcacctcctgcaattgtaatgagcctgttggggtgacagataaatttgagaacaggaaacacattgaattttcatttcaaccagtttgcaaagctgaaatgagccccagtgaggtcagcgattaggaaactgccccattgaacgccttcctcgctaatttgaactaattgtataaaaacaccaaacctgctcactaaaaacacagacactcggctacacaaacaaa

SEQ ID NO: 271068 - DNA, 652 bp, Homo sapiens
atgtcaggctgtgataggagggaaacagaaaccaaaggaaagaacagctttaagaagcgcttaagaggtccaaaggtgaagaacttaaacccgaagaaattcagcattcatgaccaggatcacaaagtactggtcctggactctgggaatctcatagcagttccagataaaaactacatacgcccagagatcttctttgcattagcctcatccttgagctcagcctctgcggagaaaggaagtccgattctcctgggggtctctaaaggggagttttgtctctactgtgacaaggataaaggacaaagtcatccatcccttcagctgaagaaggagaaactgatgaagctggctgcccaaaaggaatcagcacgccggcccttcatcttttatagggctcaggtgggctcctggaacatgctggagtcggcggctcaccccggatggttcatctgcacctcctgcaattgtaatgagcctgttggggtgacagataaatttgagaacaggaaacacattgaattttcatttcaaccagtttgcaaagctgaaatgagccccagtgaggtcagcgattaggaaactgccccattgaacgccttcctcgctaatttgaactaattgtataaaaacaccaaacctgctcactaaa

SEQ ID NO: 271069 - DNA, 680 bp, Homo sapiens
atgtcaggctgtgataggagggaaacagaaaccaaaggaaagaacagctttaagaagcgcttaagaggtccaaaggtgaagaacttaaacccgaagaaattcagcattcatgaccaggatcacaaagtactggtcctggactctgggaatctcatagcagttccagataaaaactacatacgcccagagatcttctttgcattagcctcatccttgagctcagcctctgcggagaaaggaagtccgattctcctgggggtctctaaaggggagttttgtctctactgtgacaaggataaaggacaaagtcatccatcccttcagctgaagaaggagaaactgatgaagctggctgcccaaaaggaatcagcacgccggcccttcatcttttatagggctcaggtgggctcctggaacatgctggagtcggcggctcaccccggatggttcatctgcacctcctgcaattgtaatgagcctgttggggtgacagataaatttgagaacaggaaacacattgaattttcatttcaaccagtttgcaaagctgaaatgagccccagtgaggtcagcgattaggaaactgccccattgaacgccttcctcgctaatttgaactaattgtataaaaacaccaaacctgctcactaaaaacacagacactcggctacacaaacaaa

SEQ ID NO: 271070 - DNA, 686 bp, Homo sapiens
  misc_feature (1)..(1): n is a, c, g, or t
  misc_feature (3)..(4): n is a, c, g, or t
ncnnggcttcattccattttctgttgagtaataaactcaacgttgaaaatgtcctttgtgggggagaactcaggagtgaaaatgggctctgaggactgggaaaaagatgaaccccagtgctgcttagaagacccggctggaagccccctggaaccaggcccaagcctccccaccatgaattttgttcacacaaagatcttctttgcattagcctcatccttgagctcagcctctgcggagaaaggaagtccgattctcctgggggtctctaaaggggagttttgtctctactgtgacaaggataaaggacaaagtcatccatcccttcagctgaagaaggagaaactgatgaagctggctgcccaaaaggaatcagcacgccggcccttcatcttttatagggctcaggtgggctcctggaacatgctggagtcggcggctcaccccggatggttcatctgcacctcctgcaattgtaatgagcctgttggggtgacagataaatttgagaacaggaaacacattgaattttcatttcaaccagtttgcaaagctgaaatgagccccagtgaggtcagcgattaggaaactgccccattgaacgccttcctcgctaatttgaactaattgtataaaaacaccaaacctgctcactaaaaacacagacactcggctacacaaacaaa

SEQ ID NO: 271071 - DNA, 168 bp, Homo sapiens
ctagcagacaagtgttctatcagggttatagacataagcaaaatgaggctcccattgaagaaattaatcatttagaggggaagagacatgttgacaaagaaaacctggtacaatctgataagtgatatcaatagcaagtgaagaaattcagttgtcatttgaaaatga

SEQ ID NO: 271072 - DNA, 686 bp, Homo sapiens
ttttccagtttaggaaactgatattacaccttttctacagatggggaaacttgcccagggtgcccaggcagtccgcagaaccatgctttgaatcagggcagtgtggttccagggtcctgtacagatcaaacaccctgactctgccattccatcagatacatgattcatattttggtgtatttgcctccaatcttgagcaaagtgggttgtccctgtacatactttgtgtaatcttttagcttaacaggtgtcatgaacacttccgtatcataaatctttcccagcatgatttttattatctatttaatatttctcatattcaatgtagaacaatgcacttaaccaatttctcatttttgtaataattttcttcccattttcccctgtaataacactgctgagatatatatttttttcttcttttttttactgttctgaagatactctggcagaaatgtatgttcctcaggctaaatcttttcacacatccacaatcattttatcataaattctagagctggaaacgctgagtctaatgttttatatatatatatatatatgttatatatctgtcacccaggctggagtgcagtgtggtgtgatctcagctcactgcactccagcctgtggaacagagtgggactccctctctaacaaacaaacaaacaaacaaacaaaaaactggg

SEQ ID NO: 271073 - DNA, 519 bp, Homo sapiens
gaggggcttggggctgagaagagacaagcttaaaaggactgctttggctgctgtactgagactagattgcaggagggcagggaataaagcaggttgatgaagtaggaggcggttggaataatccaggcaaaagataaagaggcttggaccacaatgatagtggaagtggtgagaagtggccaaattctggctagaatgtgaaggtagagccaataggacttgctgatgtttgggggagtcagaaaaagaggcataaaggaaaatctgaggtttgggacctgagattctggaaagataggaaaacttctgcagtggatttcagagggaaagtaggagttcattttgggacatgtcaagtttgatagtattatagaaatgttgagaagggccagacccgtggctcacgcctgcaatcccagcactttgggaggccaaggtgggaggactgcttgagcccgggagtgtaagacaagactgggcaacagtgagacttcatctctatttaaaaaaataagaata

SEQ ID NO: 271074 - DNA, 451 bp, Homo sapiens
agtgacttataggtgggtagtgtatgcagtgtggatacactggacaaagggatgattcacatcctgggcgggatggagcaggacagcacaagatttcattacataacggcatactatttaaaacttataaattgtttatttccggaactttccatttaatattttcagactgcagttgaccatgggtaactgaaactatggcaagttaaaaccatgaataagagggagagtactgtataaaggaacgagataaatgacaccatgaggaaaaagacaaatccaaaacaattgactggcactcttcaaaaactcgatgtagttaattttttaaaaaagatggaagacttccagttatggacccagttagagtagacacacttctccctattcctcacactaagtacagctaaaactctggacattatatataagacaaacataagaagactat

SEQ ID NO: 271075 - DNA, 179 bp, Homo sapiens
gctttggggtttgttcctccccaagcaaaattaaccagaggcactgctgacctttgggcttcctgggtgtagcgttacgaagcatctccacatgtttgtcacagctagaatttgacaataaaaatttggacagggagaccctgccagagccactgacctctttccaatgtgacaagggg

SEQ ID NO: 271076 - DNA, 403 bp, Homo sapiens
aaggtgaagaacagagttggagaatagaaactctgttggctccttggggaggaaaaacaagcatggaaaaagaggcttttcttcataagtgtgccacatcagtcacccatcaccacttctgcctttcatctattccctggcagccatcctaagaagaataactgtcttgacatgagacagattatttcaaggccttctccttgaggccaatctacccatgaagatggggaacagcatttcacagtgttgcccttcaatcctctcatgagtgactcattctgagaccaaactgaggacactctccaagaagccatgccaggtctccagctggtttcagactaacagccacaaagcaatcaacagaccattgttttttatataaaccgtatgccctggaacttcg

SEQ ID NO: 271077 - DNA, 369 bp, Homo sapiens
taaaggaaaaggcactcatccatacatactattctgtaaacaggtgtgtaactgtcaaggtgagtggcacacaagaatttgataaaagtcaaagtactgaaggcgctgctaaagtagatctgaggctattctgacttcctcgttactcacctgtgctatgatttgctttgcagtgggaaaggatggagatgcagcctgggaggggtttgggtgttgattcctgggcctttcatgggagtgattattcacaggaaaatcatccctatcacaggaaaaaggcagagaactgctgtctttggcactaaagactatgatctcagaaccaaagtaattatcttggagaaactgtggcaatagaagaaaaaagcc

SEQ ID NO: 271078 - DNA, 440 bp, Homo sapiens
taccgcttcaagcggtgatcgcaccacgcctccgcgcctccacccgggccttcctcccccgtggaccccggtggatgacctgcccctctccccgccgcgcccctgcccctcctcctcgctccctgggttgggggctcccttagccgggcccccaagcgcgacggccccggaccggccgcggccccttcccgaacgccggcacccccttccgcttgggctgcccagccctgtcctcgccgggccccttcctcctggaaaaccaggcaggcgggtgccccccccctcgagtgggggactgtacagaccccgtctccgccctggccccgcggaggagctgcccacctgattcccggacagacctccccaactccgcgtgagacagagaattattcagataatttaaattaaaaaacgacgtgaaaatttggaataaaaaaaaa

SEQ ID NO: 271079 - DNA, 261 bp, Homo sapiens
agcaagctgctgctgcccatcacccccttccgcttgggctgcccagccctgtcctcgccgggccccttcctcctggaaaaccaggcaggcgggtgccccccccctcgagtgggggactgtacagaccccgtctccgccctggccccgcggaggagctgcccacctgattcccggacagacctccccaactccgcgtgagacagagaattattcagataatttaaattaaaaaacgacgtgaaaatttggaataaaaaaaaa

SEQ ID NO: 271080 - DNA, 347 bp, Homo sapiens
taccgcttcaagcggtgatcgcaccacgcctccgcgcctccacccgggccttcctcccccgtggaccccggtggatgacctgcccctctccccgccgcgcccctgcccctcctcctcgctccctgggttgggggctcccttagccgggccccttcctcctggaaaaccaggcaggcgggtgccccccccctcgagtgggggactgtacagaccccgtctccgccctggccccgcggaggagctgcccacctgattcccggacagacctccccaactccgcgtgagacagagaattattcagataatttaaattaaaaaacgacgtgaaaatttggaataaaaaaaaa

SEQ ID NO: 271081 - DNA, 418 bp, Homo sapiens
cactgcactccagcctgggcgacagagctagacaccatctcaaaaaaaaaaagaaaaatgaacagagtttcagagacctgtgggacactatcaagtgtatcaacatacacataataagaatcccaaaagttaaacagatgagtgcataaaaatatttgaagaaataataaccaaaagtttctcaaatttgatttaaatacattaatctgcacctataagaagctccacaaactccaaagaggataaattcaaagatatccacacttacacacatcataatcaaattgttcaaagccaaagagaaaatcttaaaagaagtataattaataatataataaattaattaataattttacttctattaagatctctcaccagaaactatgaaggcccgaaggaagtagggtgacatattcaa

SEQ ID NO: 271082 - DNA, 402 bp, Homo sapiens
  misc_feature (216)..(216): n is a, c, g, or t
  misc_feature (368)..(368): n is a, c, g, or t
  misc_feature (399)..(399): n is a, c, g, or t
gttactgggcctctcaggacaccagggaggctgggctggggaggactggtgggcgagctgtcccctccacattctgccaatgcctgggacgtgaaactcattcctgtttccatgagactcgtatccttaatgtcccttttgacttcagctaattctgagtaagtttttgaccctctcgctccgcccagacccctggatgcccagctgccgcacctnccgtggccccacgctgtggctacgtgttgtctgaagacgcctggggaaaccttcagggcctctgtactggcctgtcatgtggtcaaccagtgtgaacatcaaggtgtctgggttcatggaagctggtgaagccacctacaattataccatgncctgtccctatttcacatgggcctcgagggntct

SEQ ID NO: 271083 - DNA, 417 bp, Homo sapiens
tcaccatgttggtcaggctggtctcgaactcctgacctgatgatccacccacccaccttggcctcccaaagtgctgggattacaggcgtgagccaccatacccggcctattagctagtaatttcaaggactcacttacacggcctttttgtacattcagggccttttcaactcctatttccctttccagaatcatttttgcaaggctgcttccttaccattcaattctgagttctaatgtcacctcctcaaaaaagacttcctgaccatcctatttaaatttgcagctatctccacccatcactgcttctttcatagcacttaccaccctctaaagtcattttttatacttacttgtctattgcttgtctctccctaccagaatgtaaggtttaagacacatgttttctctacctca

SEQ ID NO: 271084 - DNA, 581 bp, Homo sapiens
taaattttctgtacttagttttatatggacattgtagtaagtactgtattttaggatcatatttgttttgaaatattttgttattcaaaattttaataagccttttttgtttttcccccattagttttttcccactggttttaagaaattataaaagtaacatataccaaatacaaatgttcaagcaatatacacatatatggtgcaaatagtttttccctgcttgcagttcccgtcccctaccctgtcatcctctgcataggtaatgactcacatccttttagatcttgaagagtcaacatcattattatgcacaccacacacacacacacacacacacacacacacctgtctatatagctgtatttcctttttacaaaaatggactcacttcattctgcaacttgctttttaacatttaacaatacctaatgtaaatggtactgtgcatgtaattttatatatatttcattctttttaacagctccgtggtatttctggtattgatgtagcctgttatttagccattcccctattaatggaaatttaggttatttccagtcatgtacagatatacttcc

SEQ ID NO: 271085 - DNA, 502 bp, Homo sapiens
catcacatttcatcattgtaatagccttactgtatggatagtgcccataattttaaaataatttttaaataattattgcttaatcagataattgctaaagtaaaatttcccaaattttgctttcacatcgacatttatttgctatcactgagtttgtacccctaatccattaaaaagtagaaaacagtgaaatagggcatttgttctaagtaatgggagaagatgtaactggagaagatggaaaaaagttgtaagaaccactgctctgtataggttgtaaaagcagtattaaatatggtgcctgcccttgctaaaggtaacatgaagtaataggtagggtaaatgcactcagctgtgtgggttgcttgaaagatcttgtgagcctgttcactcttgcagttgaaagactggatcacttctttctggcgttgtttatttttatgcagactccagcctggacagcagagcaggaccctgtctcaaaaaaaacaaaaacaaaaca

SEQ ID NO: 271086 - DNA, 474 bp, Homo sapiens
acagagtctcactctgtcgcccaggctggagtgcagtggcgcaatctcagctcactgcaaactccgcctcctgggttcacgccatgctcctgcctcagcctccccagtagatcagactacaggcgcctgccaccttgcctggctaattttttgtatttttagtagagacagggtttcactgtgttagccaggatggtctcaatctcctgacccagcagtgacttctaatccatacctcgctccacgaagaagcgacccactgtagccggctgttcttggggcatcgtccaagcacacagccctcctgcagctcaggtctggggagactggtacactggctctcggggagggtttctgcggcagagcccttgcagaggagttcacgcttcctcacccctcgtccacaggtcttggaacacttgagaagacaaaaaagttctatttgcattcccattaggtttcagtagccacatt

SEQ ID NO: 271087 - DNA, 481 bp, Homo sapiens
ggtttattagctgctagactcactccagtggtgggcagctgggcgaaaggccctgaaagttgctcttttctcaaaattcagcctcatgtaaatttaccctgtgacctgccatgggggattaggatgggctggccaggccaggctaggtggcctgattttcccattcagcttctgacctggtcttctgaaagtcagactctggccctcttcattagccagcccaagtccttgcccctgggaatgcagggtggctggctgtgtaggtgttgatcatcattagcgataattagagggcagagctcagggaacaagttatgacacctgcaaactaggggcctctggaaatgggacagaaaagtttctcactttggggacaaaccagggaagcctgatttgttgctgatacacagggtggtctctgtcaacgttcagaagttctggacccagccaatgtggtgaaaatgccacagtaacgtatgac

SEQ ID NO: 271088 - DNA, 618 bp, Homo sapiens
ggtttattagctgctagactcactccagtggtgggcagctgggcgaaaggccctgaaagttgctcttttctcaaaattcagcctcatgtaaatttaccctgtgacctgccatgggggattaggatgggctggccaggccaggctaggtggcctgattttcccattcagcttctgacctggtcttctgaaagtcagactctggccctcttcattagccagcccaagtccttgcccctgggaatgcagggtggctggctgtgtaggtgttgatcatcattagcgataattagagggcagagctcagggaacaagttatgacacctgcaaactaggggcctctggaaatgggacagaaaagtttctcactttggggacaaaccagggaagcctgatttgttgctgatacacagggtggtctctgtcaacgttcagaagttctggacccagccaatggtaggaaactttggctgtgccttaaacattttcataggtcaaataaagaattggttaaactaaatatccctggcacacctttgtgggggcaatgctgagaacatgaagaaggaatgtgtgtggagaaaaggggaggcttccctggcttgccttaagggatgaagg

SEQ ID NO: 271089 - DNA, 629 bp, Homo sapiens
tagatagaaatgtaatatgtttacagagtttctaatttatttttctgttaatgaaaacaggcatttccagataaattaggccgtgttctagagttgcttttatatacagagggaagtaattttgcttagaattttaaatgtaacttttgtcttttgttaagaattatggatggtagtggggggatggaaaaaggactgaaaccaagcacagaggcaaaaatgtattgcctttttttttcaattctggaaaagagttatgtgtgcaattaggatttctgtgtttaaggaggctgtttaaaaagtcaacacattatttagttgaggaatgtagtttaagaattatgcttacggctgggtgcagtggctcatgcctgtaatcccagcactttgggaggctaaggagggcagatcacgaggtcaggagttcgagaccagcctgaccaacatggtgaaaccccatctctactgaaaatacaaaaattagctgggcgtggtggcatgcctctgtaatcccagctactcaggaggctgaggcaggataatctcttgaacccgcgaggtggaggttgcagtgagccgagatggtgccattgcactccaggctaggtgagagagtgagactccatttc

SEQ ID NO: 271090 - DNA, 462 bp, Homo sapiens
agaaacctgaacagagctgcagcatcattactgtaggagtgaaagctccccagcacatctggagacctgtctgggtaagtgtccacatagtcttacctggagatttatgaatctgctacaaagaggtaggatttccaggaaaaattctacttttcagaaccagggtttccaggccagagcagcccctcatactagatgtagggcctcttctcattgtggatttaaaagcacagagatccacaagacaatgtacaactgtaaattaaatacaactgcaattaaggccattataccaaatactggaaataccagcaggactcccttcttctacctcccaagattaaaatctaggatattcagaaccattatcagggctcaagctgattttaatataaaggcatggagcaatacaatctattacttttcaataacctccttgtgatggccttacttcacaatgac

SEQ ID NO: 271091 - DNA, 573 bp, Homo sapiens
aatatctgacaattttcctccactgaggtatcagacatctttactatacttgatgcttttcacgctcttgtaaatcttttaaaatttcattttacaactgtgttgctagtgtgtgtgtgtatgcgtatatacatacatacatatatatgtgtattctgcatgttgaatttctatgtgatgtttctcaactctcatattatttgttataacttattatttatcttattatttatctatcttttggattttctgaattgatactcatataatctgtgaatcccacttacgtttttctccaagtgttataccttttcttttcttttcctcctttctctgctgtacagtgctgaatggaagttgggatggttggcttctacgtgctgattcctatctcaaaggcagagctttcaaggttctctttaaatatgcagttacctggtgttttctgcagtaccactgaccagattaaagaacgatactttataatttgttaagaatttcatggcatgaattgatgctgaattttatcaaatattacctctgaactttaatattaaatttaatcaaacattg

SEQ ID NO: 271092 - DNA, 742 bp, Homo sapiens
tatgtgagaacctaactcctttctcagctccaactgtaaccctctccccacctccaacacacacataaacactcacatacacatgctaccacactgcctgctgtgccatcagcctgcctgaagttcacatcattttagaattggacgggccttcataatttaaattttattatgaaaaagtgatagtctaaggaactcatttgatttttttgtctaaatgtcaaatatagagtagaacgcacaagtgtctgttatagaaatacttgagagtcctatatgcactgttatccacaaccatttaagcacttatccactaatccctaataagtacccctaataagtacatttctaaaccagttattcaagctacatcctcccaagattggactttgtttctactttggtagggacataaataaacggaaacaactgacctaactttttactaaagagataataaagggaataaaattaagattacatttggattttaacttgtgttcttattcctactgccagcaaaaatatgtgaagtgtttttatcattataaatgaatatactattcattgtgcagattttgacatgttcataaataagttagtacccaatgtttgcttgataaagaatgtgataaaatgttaacatttgggaaatctgggtgaagaatgtataggaattatttgtatgtaatatttgtcaatctgaaattatttaaaagaaaaagttaaactgtctcattcc

SEQ ID NO: 271093 - DNA, 662 bp, Homo sapiens
  misc_feature (604)..(604): n is a, c, g, or t
ctgacactgtagaaagcccaactctcagaaagataagctttgattgagaggggactgctgtagttattcccttccccaggtattgactgagggttctttgttgaaaatgctcaactttgtcgtactttgttgagttagtaagtgtcatgagtggagaaaattaagtgaaactatgaaaatctaaagtaatataacattttaaaagggcatgctgtcacctttgatttaaaagaaaaattctggaagatataagtgggggcaagaagaggaggtatgaccaagacagtgaaatgaaccgcagttgaaagacgcagcgtctttcaactgcggtgggaattctctaatggtatcatgtgggccttttgaaagtaacaaacagaaggccagtctgtggcaagtttgctgctgaacatcacattccaccctaagaaaacacaaggtggatcgcgtcgagggtggataccttaccttagcacagaaggaaaacgtatgtcagtgcaaagtatggactaaactgctttcaggacaaacgtcgtacccctcgatacaggtcgccaaagggaatttcccttcccggcttggagtcctcccaatttaaggcagncccatccactcaatttctgcagttacaacttatctactaattagtttccctctggtca

SEQ ID NO: 271094 - DNA, 482 bp, Homo sapiens
cacgagggaaattgacaaatattgatagtgtctatctcacagccacttttcgcttatccttatgcttttcagaattttcaaaatttttatcattgggtatgcatttttaataaaattgttttaaaatacaaactattaagaaatttaatatgactgaaatatggaatatagaaaaagaagactggaaaaaaatgaagctaaatggtagttattgagcctagtctaaattgccaaacaaagcaatttggttttcattctatatgcaacagggaatcctaatggccttgaaaaaaaaatggacgtggactgattataccatggaatttagtaatagctgttttttttgactgaagaagtaatataacctcattatagaaaaaaaaatggacccacaggaaattagagatccactgttaacattttttagtatttccttccaacactatttttgtgcctattttgtacaggttagctcaattttt

SEQ ID NO: 271095 - DNA, 427 bp, Homo sapiens
ctgcatgccgccctccatcttccacctgtccacggctgacacacggtgggaaagggttttgctgacattggtgatctgagctgaaaatgtgaagccaccttttggcatataattcatattggtttttcaatcatttgtgtctgtgtgttttctttttgttgcattttttttcccttcttaagaaactcgtcatgtggtattgaaggtgacctgactatggcaaagagcatgttctgtgtggtttgcctttccacccacgcacaacacactttgcagacttgacagggatggatcagccccacagaagagaaaacagaaaaccaaaaaatacccctcctctgaaaaatacccccggtgtgaaactctttctgagaaagactggcccttttctttaatgtaaaaaaatatatataacaaaaatagattt

SEQ ID NO: 271096 - DNA, 852 bp, Homo sapiens
ggcaacaagagagaaactctgtttcaaaaaagaaaacaaaacaagtcattgatagtataacgaagagatatctgcatcccatgtctactgcagcactattctcaatagccaagatatggagtcaacctaggtgtccaacaacagatgaatgaatgaagaaaatgtgatatatacacactatggagtattattcagccataaaaaagagtgaaatcccatcgttgatggaatatagatgaaactggaggacattattttaagtgaaaaaagccaggaacagaaagttaaacagtgcatgttctcactcatatgcgaaagctaaaaatagttgatctcatagaagtaaaaagtaggacagaggatactagaggctgggatgagagtgacagagagatttgttaaaagatacaaaattatagcgagataagagaaataagttctagtgttcgacagcactgtagaatgactacagttaataataatacaatatatagtttcaaatagctggaaggatattgcacattctcaacataaagaaatgataaacatatgagatggtggatgtgctaattaccctgatctgataactataaattatatgtatggaaatataattatgtgctctcaagaatatgtacaattggtatttgtcaatttaaaaaataaatttaaaaactgtatcattgaatccttaagatgctaaagttcatttacttatataacaaattaaaaaattatttcttatgctgtttttcaaaaatcatagcttttatgactttacataaatatatctaaaataataattgtatgatatgtttttgtagtctaataaaatttgcactgaattccaat

SEQ ID NO: 271097 - DNA, 331 bp, Homo sapiens
aatgaacaataattatatgagttgttgagaattcagggacaaatacaggatcttcataaactgtgtcataccaaatatcaaatattctttggactctggctcagtgtaactgtataaataatttttgctactatcacaacttaagtagtgggaatgtttgcagtttcagcacattgtccatatggtccatatgtaacggagtcaaatttgtctcatttttcaagattcaaaataagactcagtaaagttctgctgagcatcctcaattttttttaaattgagaaaccactggggcctagaggggggaaaatgttcccatttcatgccattg

SEQ ID NO: 271098 - DNA, 575 bp, Homo sapiens
gccttttaaatcaggtagatcctgcattgatgcagacttaccataacctgcagttgatgaaaatgaacctcagatatttctgttcttttcctggaattgcaaacgatctctctttgcactcatcgtttctcctcctcactgaatttcggcagccttctagcttttaacattttcagcattaagttgaaaaccagtttcctaattgttacatataccaggcattacattatgcactagcgcataagatgcaatgcatgggagcatctccccaccttcaaattgcatgcagttcatctgagaaaacaaacaagaggaggatgatcacaataccatctttaagtgctctgtgattccagagagcaggctgtaagccagattgagtagttaaagaagctgctcagagagctgatgggccacctatgcttcacctggagcaatgactgtgatcagccggaacctggtgggggatggggtagggagagggggtcacttccggcacatgaaaagcagttttcacagtattccaaaggaatatttttatttctctaataaaattctcaattatgccttttaaa

SEQ ID NO: 271099 - DNA, 462 bp, Homo sapiens
acaggaaaactgttttagaaagcattctggctatacttaggtccagtctggagattggaaatctgcataagcatattgagttgtgacaaactatgtagccaactggaaaagttgagatgtggagtgctctgattgtttgacttctgaactcccacagtgcatacaagtgtattggttaatctctctactatatgttttgaatttgtatgctttactaagcattgatgttagatactgaacttatttaagcacagtgatagtatttgaaagaaatataaaaatttagtggtattgttgactctgtcttttccttttttctgagttaatctcttgggaagtataaattaatttttctaaacaactcacaggcacagaagccgaaaagttgagaaggccacagatatgggagttattttaagaataatatttaattagaaatgtaggatactaaattggaaagtt

SEQ ID NO: 271100 - DNA, 211 bp, Homo sapiens
agctggtggtggggggtaaagattgccccgggaggaatgggctctttccatgccatgataaactcttccgtgcatgtcataatgtacctgtactaccgattatctgcctttggccctgtggcacaaccctacctttggtggaaaaagcacatgacagccattcagctgatccagtttgtcctggtctcactgcacatctcccagtactact

SEQ ID NO: 271101 - DNA, 123 bp, Homo sapiens
gcaacatctgcctaattctcagatgcttgatgcttacaggaaaggcatatgaataaactcaagtttaaatttgtttattctctttattggtgatgggaccttgaacaaattacagaaataaaa

SEQ ID NO: 271102 - DNA, 400 bp, Homo sapiens
ccctcatccttggaaacaagtcaaaggaaggtatatgcagtatcttctgtcatgagtgtgcactgatatctttggataggtgttactatttgtattttgttatgtttacttgggattagagtcttaattagttataatgttactaggtaatccattatatgcatttgattaaaagtgatagaaacaaacatcttcaagttgtacgttggtaggtaatagtttcaacatataaaacttttgtgttctttgagcccagcggttcacaagcactggtttttttggtttgttttgttttttaaatgagaactgaccacagtatagtagaaccagataactaatgttctcatttgggaactatgctgttttcatttctgataaaataaactttggtcacattagt

SEQ ID NO: 271103 - DNA, 428 bp, Homo sapiens
aactcttcacctctgctgcttcctggatgaggagatggggagatggttcagaggacagcactgacaaagatctagagctcagagtgcaggccatatcagggaacttgaaacactaaattagtttggtggtgctttgagggcagtggtgagagattctcttcagtctgcctctgtatagtagggatagtcctttcttatcccctgtcacagctgaagcagagatgtcagtctcaaaacaattcaaatcttagctttccaagtgaactacaatatctttactgttttaaatttgagtttaaataagctttgaaacttcacatgaagtggggcattttaaaacatatatctaccgatgaagttttgtcaactttggaggaggactcaaattatagccaaatgacttaaaaatcaagctagttaaaaaaaaa

SEQ ID NO: 271104 - DNA, 608 bp, Homo sapiens
acatttcaaactgtcttttcaactaacttgatcaatattgaggcttttttcccatattagccagaaagcagatactagttttggtaaatgacttctctaaagaaaacactatgatttgaaaagactagcacacaaggacaaatatggaattaaataattcttctgagtagacctgtgttctctgtttcaagtatggaactgcataatggttcagtttgtatataagataataacttttttattgaaaaacttgtgaaggggaaagtcttgctatatccttgagccaggaatcaaggtctccattgttatcctagccccatagatgtttttacttagccctaagtttctaaagttttatgtagggttaatatgcagtacagtaatgaggcaggaatttgaatattttcttcattattggaaatgagtcttgtaatttaaagacaaaagcttgttttgagaagtaatattcatatacctgctgtaactgtgaatgtcactgctcttttctggttgtgctttgccacaaattttattgtgaattgtaaagatttgaaactcttaaaattagccatttatattttgaaaaaaaggggtgtgattattttaaa

SEQ ID NO: 271105 - DNA, 185 bp, Homo sapiens
tatatagagaggaacaaataaaaatcttgttaggaaagttattttaagcatttatttttctttgttttcaataattcctgtttctacctattttatatataaccattaaaattagtacattggaatgataaatgcacaagtctttgggaattaaaatataatctttagagaaataagctaagctg

SEQ ID NO: 271106 - DNA, 611 bp, Homo sapiens
ggcgctgggaggtgcgcgggccgtctgggcctgccggcttcctccgcggggtgcggcttgccaccctcacccctacccctatccctatctccaccccaaggcctaccctgggctagcgaggcgatctcctgagataagaagtgggcccgcgtctgggatttgctttccgttgacctctcccgctgaacattttggacttacaaacagctgaatgattctttttgtattcaacaggaagtaattttatgccaagagactaagactgtagtttttgttgacttcttgtaggtgaaatcccagttgatgtgactttgagatatcttgtgtaaattatttagtggccagttgtatttttgggattggatctcagataaagctgggcagattggctgatttagatagaacaaattttgtaaacagttttgttaaatttaggaaatataaaatctaagaaaaacatttattctactaatgtcggttagattcaaaacgttatcaaaaatttaattaggttcctctaggtaaattaaaaaaaaaaatactttgtctctactcaggggaaattctttggttttagaaaaaatatttctttttaaagttcgcagttgcct

SEQ ID NO: 271107 - DNA, 539 bp, Homo sapiens
atgttacttcctgcctgcctgcctacctcccaaggaaaatggaaaggtcaaatgttgacaagtatcaagaattgtggtccgggtctacagcagcctagctgtagatagctccacacacgacttggaaagtagaaataggactaccaggagctctcctctcgaagggcggcttattttatagcgggagacaaatcgggttgggacgccagtgtcaacgaagactcccgggcgggcgggcggcgctgagctctgagcgctgagagatgcctaagctgaagcatgaaggggagtcgttgtccgcggtgctgaagcgcgcgccaggcttcgcctccccttccctgcagttgggattcctgggatcggatttagggtagtctgcagctcccgtcttcccggcccatcaggcttgcagggaagcagctggaaagttacacctcagggcatcctgggtacctccgaacattttacttccccactcccaccccaagctcaaaagggagctgggagagactctttaggaaaacaaaacaaaacaaaaa

SEQ ID NO: 271108 - DNA, 377 bp, Homo sapiens
tcaattttttgtgtcatatgttttaaggctattttattttattagattcttaaccaaatataaatatgtgatatctttctgctaaattgaaacttttagcgttatgtattatttacctctatttctgctagtgataaactattatagtttttgtttgcctgaaatgtcattcttgatagatatttttacatgggtgtaaaattcaagattggcatttatttcattttggtacattaaagttacctcctcaatatcttctgggttccactgttgtctcattgtgctgcttcatcagtaatttattatctttcttccaattttactaattttgtcttcttgtgtgtccaacatgctattaaaagtattccttgagttgt

SEQ ID NO: 271109 - DNA, 288 bp, Homo sapiens
gaattttattttacaagtgaagaatgaagtccagagaagttaagcaaattgttcaagatcataccagttagtggcaagtggagaagtaagactcctatgttctgtctccaggcaatgttcttgccaccacaggacactgtctattgcccagaaactactagcccattatctttaggcaaaaacaaacaaataaataaataaactgaaaaaccttacccttgaaatgtaaactcttcaattctacttccttttgcctttctgtccagtattaaagtatttatgtcttta

SEQ ID NO: 271110 - DNA, 439 bp, Homo sapiens
agggcttcagaccgcaggcccacaaggaggaggtccatgagcccctgaagctgtttgcacaattgttcctgtacatgtatttttctgcgcaagactctgtggtttcatcagattcttcaagtagtctggggccattaagaatccctggtccagctgggtacggtgactcatgcctataatctcagcactttgggaggccaaggcaggaggatcacctgagcccagaagtttgagaccagcctggacaacatggtgaaacctcatctctagaaaaaaaattttaaaattagctgggcctggtggcatgcacctgtggtcccagctacctgggaggctgaagtgggaggatcgcttgagcccaggaatccaaggctgcagtgagctatgttcacttcactgcactccagccttggagacagagtgggagaccctgtctcaa

SEQ ID NO: 271111 - DNA, 372 bp, Homo sapiens
atgatgtgggggtctccgtcacagggtcctgaaatcacacattcaaaacaggatcccacttccaagactgtaatttgtccaccagttgaggagctcagacattctacaagtgaacccacttgtctcttcctgtgagttgcagtttgctcttctgggtagtgaaatcaggctcaggcaccatggcccagccctgtaggcttctagggtgttgcggtgtcaagtagagaagtgacctgctatctggagcctcatcctcttcctcttcccactccctcccacagactctgaggctccccacccgggctcccagtacgtggacaggccagctaggcctgtggggcacagcagggacatggggccagtctggggacc

SEQ ID NO: 271112 - DNA, 413 bp, Homo sapiens
ctgttgttccatgtattttctgtatgttacaaatatttactattaattataacaacataagatgtactctaactccttcatgctgctaattatagaatatctactttgttgactaaaccctttagcatatatatatatatatatatatatatatatatatagcctatttctgttaatggttctttggataaataacagttgactttgttcctctgcttggtattttaaaaaacctattagtttacaaatctcttactaattttagttttaatatttgtattgttaagtattttaaacacacagaaaggcaaataaacccccattacccaaacacccagctttattaaatcttagtattttgtcctatttgtttcaatggtttttttaataaatcagtgactacaataaaattg

SEQ ID NO: 271113 - DNA, 431 bp, Homo sapiens
caggacccagtacaccctctgcagccgctggcccgggtgctaagtccctcattgccccgggccagcagggctggccggctgctccgagtgcggggcccgccaagcccacgcccacccggaactccagctggcccgcaagcgctgcaggcagccccagttcccgctcgcgcctctccctccacacctccctgcaagctgagggagtgggctccagccttggccacccaggcagaggaggtgctgagagcaagcgagggctctgaggactgccagcatgctgtcacctctcattttgtttaatgttttctattttaatgttttgtattatcaggtgtctgtcaagtcaggatcactttacatgctactgcagtgtataatcttgtcacaatgtattggctcataataataaaaaccaccaaatattacatata

SEQ ID NO: 271114 - DNA, 803 bp, Homo sapiens
agcgggaagacggcgagtggaggctcgggaggggctgcgtgtgcgcggaggcgggctgtggcccgtggccgccgccggagcctttcgcttgcggtgattttgggctccctcggttggcagtgttgatgtgtgcctgtgagttgtgagcgaggcagatttcctcgcgtggccggcacgaccttcacctttgcagaaggcaaccgggaccctcagtgagacaccttccatttccaccgtagtcttaccatggtctgggttttacattcgcgcgctttggtaaactattaaaggtagtaaagtcgatgggcgattaccacccaaatactttgtctcttttggaatctcctctgcatttaaaggatttgacaagccgacattttaaactgttaggattgtggagtaaaggaaaataggatcgaaaagcgaggtactgtagccaatttgagattagtaagaaatatagagtacatttgtaaagccaatatattttttcattgattcacgatatccttctgcctcccattcctgttcatatgccctaaagtaaacagttggtttggtaagggtggggacttgtgtcaacaccaggacagttctgacacatagtaaatgctgaactctattttggtgaatgaatgaacacctgtagtattcctgttttgccctttgcctgggtaaaatgagtcatgtgattatgatttatttatctaacaatttattgaacacctaccttgtgtcaggtaccattccaggctttgggatacatcaatgaacagacggaagttcccaacccttgtcgactt

SEQ ID NO: 271115 - DNA, 534 bp, Homo sapiens
agcgggaagacggcgagtggaggctcgggaggggctgcgtgtgcgcggaggcgggctgtggcccgtggccgccgccggagcctttcgcttgcggtgattttgggctccctcggttggcagtgttgatgtgtgcctgtgagttgtgagcgaggcagatttcctcgcgtggccggcacgaccttcacctttgcagaaggcaaccgggaccctcagttgattccagttcaaaagttgctgtggtcctggaaatgaggattctgggcaaaacaagaaattgggtgattatgcattcaagatctaaagatgctttcctttcatcatctagaatgaatttgttcatttatcctgatgaaaggttaaagaagatattgccaagtgtgaacaataaccttcgatggaaatgatatcatcaattcctgaaagtgcagaacaatctatttttaggaagggatgtgctccattgagctcctgattttgagaccacttttatttatttatttttaaacttaatttagtttgatatttaaaattatt

SEQ ID NO: 271116 - DNA, 478 bp, Homo sapiens
aattttacttgttttttctgtccattcaaggaatgaaaaaagaaaatgagtgcatagaagccggaagtaggacggtagtttcccggggtctgcagggaatggggagatgtaggtcaaagggtatgaagttgcagttatacaggttgaataagttctagagacctaatgtacagcatgataattatagttaatcatactgttttgtatacttgaaattttctgtgaggatagatcttaagtattctcaccacacacacacaaattggtaactctgtgagatgatggatatttaattagcttgatggatttatgatgtatacacgtatacaaaaaatgaatatcaaaacttcacattgttcacttgaagtataaaatggacagtctttatcaattataactgaaaaaagctgaaaaataaaacacaatatttatcattttaaaaagtacagaaaagaaaaatgaaaaactgtcttcaaaa

SEQ ID NO: 271117 - DNA, 109 bp, Homo sapiens
ccagtgtgagattgaagaactaggtgtcatcatcaacaaggtggtgtgatggctcctgcacaggccctgcacataggatgagggcatctgctcccactcagcctagccc

SEQ ID NO: 271118 - DNA, 416 bp, Homo sapiens
tgcttcttcagagcaaaacaagaactaggaatcatcttttcacctgggaaggaatcaagtaaaaagcaaaattgaactaaaggttgtttacctttcaaacttggtggccatgttgtgaggaagcccaagtgacatgaggagttcccgtggaggtgtgctgctgacagccccaggtgagagctcagccaagaatcagcacaacactgtgagtgcaaacatgtgagtgagtgagcttgcagaggatgtgatcccacctaggatgtcagcattcaagacaccctagctgacactgagtgagtataggtgaagaacatttacaacagtgataatagaaaacttgtcataagtttttaatttgtgctgtaattacactctgatattcccaaatcttcaataaaaatccattgtacagtaaa

SEQ ID NO: 271119 - DNA, 223 bp, Homo sapiens
catattttcccaaattagatttggtaagataaactcctccattgacatatttcttaacattatggggtttcctgagcttaatttttgcttccggtcatctgtaggattgcttagggcattcactgggagtctgggagtacttagctttgtacatggagggattgtgaggacagagagtcactggcctccctccagcctgcatgtactattccatcccaccatg

SEQ ID NO: 271120 - DNA, 340 bp, Homo sapiens
gagtctttggcaagagttcagtttcccagggttggttcacacacccacccttggttatatggcaccataagaggcaaggagcttctagaaaccttatcgcctggtttcatagacttaccctccctcttagactggacataattgggggagaagtaatagcttcttctgtccccaaagtggggtgttatcatgaagggagaaaggatgttgagttatcaaaatatacaaatatctcaactggaagtcaaaatgtgtcttagaaattcagcaatgtctaagtaaagacactcagaattgtctgcacataaaactgtaagctccagctctccagatttgaaaa

SEQ ID NO: 271121 - DNA, 468 bp, Homo sapiens
aagctaagagtgtgtcagcagctgactatcactagagaaaattctaaagaatttacttcaggcagaggaaaatgatcccaggtgggaaggtctatgatgcaacaaaaataaagagcagtagtaataggtggagaatgacacattgtagaagatgtacagtaaatgaacactgcatacaacagcaaaaaaaaaaaaatgtgaaagtagttttaaaaataatattgaactaaaatcccaaataacaataatataagttggggggggcagagcagggtatatagaataaagtgttccaaggatctcatataacccaggaggagaataaagcttaaagtaacttttgatgttgataaattaggtacacatgttacaacttctaaggtaaccactaaaagaataggaacagtagatgaaatttccaaactagagaaagtgaaatgtaaaaaaaaagtttaacccaaaacaagg

SEQ ID NO: 271122 - DNA, 507 bp, Homo sapiens
agacaacaggtccagtgcttggcaggaccatgactggtgcactgtcttcttggtcatgctctgattggaggattatccttggccggtggttctcaccaggaaaagtgtgctctcctgggtcccctgcaaaccaacaaggtgcccgaagatggtgtaaaaacacagatttgtcccacctggtttcaccccactttcctctctggtcccaggcctcagggtctggacatttctgccagggaacatctgttctgcagagcagccaggactccccctgccaccccccaccaaggagtggttctaagttagctttctcataaacggttctcacatggaagaaaagcagctgtcgctgaagccacgtcaatctgagcggtaaaaggtttgggcaaaaacatattttattgttcttgctgtcagaaacataaagattgaaggggcatgtgactcggtaattgctgtggactttttttcccccttgacaataaacataaaacttaaaactgaaaa

SEQ ID NO: 271123 - DNA, 872 bp, Homo sapiens
tctagtccaattctctaattctgtaagtgaaggtctacagctctagaaaggtgacaagacttgctcatgatggcgtatctcaaacattgtcagaataattttagagaaaatcttcctgcaaagtccaaccagctaaaaaatacaacttttctagtttctccgctttaactacatcagtgtcttgtggctacatcatgcctgacaatctcagatgcttatcttacttatgaaatagaaacttccatttctggcatacattcaaatcaagtgaaagcatcatcaagtgaaagcaaacagctttggggaagggagtcgaagaaactctttaacccaacttcatggtgatgaaacagcagctttgtattgggtgtctaaaatactagtttcacttaaacctcattccaagttgatattgttggaaaagtagaaataatatctcaagggtcaagttgaccttttcagtgggaacgttgtccttcaggctacttaggattctttgtatctgcttcctggcaatctttgagatgctgtaatggaatggctgccctgagtgttaacagtaaaactgtatattcagtttttaattaattaggggaaatttaattaattggggaaagtgtctcaagcattctctttagaaaatattcctaaagagctgtatttagaagcaaaagaagaggataatatgtgttttatttacttgatgtaacattaaattgcaatggcagatgagctgctttttgtcataaatttatgggctgggctaaacttgcaactggccttggtgactgtatttcctttcatttgtatcttcaagagctaaaatgtaaggctttatcaatttatgaataaagtgatgataaattcttgta

SEQ ID NO: 271124 - DNA, 303 bp, Homo sapiens
ccttaaagttatatttgttattagcatacttctgatataaactggttttcctttcagagaagcgtaatcattggaggaaatgtttgtctttgggaaaaaaaagaaaaaaacgggaagttgtacttcaggaaaaaattagtcctcagaaaaagggaacaatatgtctgcatttttggctattgtttcagcttatgtacatgtttctgcttaccttcttgaaagagaaacaagttattcaatgttacgtatgaatcaaagatcagattactcagaatcctgaaaaataaattgtgactgtacata

SEQ ID NO: 271125 - DNA, 391 bp, Homo sapiens
atacttttccaattttttaacaggaagcttgaattagttttaaatcagaaaaataaagaaaaaatcagtatattcattaaaatttacctcttcaaaactgcatcaagataataaaaatggctgggcatggtagatgacacctgtaatcctggcatttggggaggctgagacaggtggatcacttgagcctaggagttcgagaccaccccgggcaatgtagagaccctatctctacaaaaaattaaaaaaactagctgggtacatgcctgtggtcctagctacttggaatggcaaggcaggaggatcactggaacccatgaggtcaaggctgcagtgagccatgattgtgccactgtattccagcctggataacagagtgagaacttgtctc

SEQ ID NO: 271126 - DNA, 438 bp, Homo sapiens
  misc_feature (335)..(335): n is a, c, g, or t
  misc_feature (352)..(352): n is a, c, g, or t
  misc_feature (382)..(382): n is a, c, g, or t
  misc_feature (403)..(403): n is a, c, g, or t
tgattgatgagttctctgggtggaacgttggcttgacagctgagaacgaagatggacctaagtaagataagatgtgagggattcatctaggaagttgtgccttctacctaaaggaatctgggcagaacctttactgtattttattggtctcttttgagctttgctttatgtagtgcggacagtgagctgtccgctggtttgagtaacttcgttgggatattgggatttttgtgtgacatagattaaatgtaaacatgaattaaattgcctacacttagggggtaaatgtccctgtttttatttcacgatttaattccagaaatatcaatgtccanagtaccaatgtcttttncaaggcttgcaatggcttccaatatcctgngcttacaatggttccaatgtnccaggggtttccgatggcacctgtgtcaagggctt

SEQ ID NO: 271127 - DNA, 345 bp, Homo sapiens
gccaaaagaggcacttgaagattcttgagagtcttgaaggaaccatcttactttttaaaataaaaaaatcttatttctaaaactgaagttagttggcaaggaagcattgaagttttatatattttataaaacagtatcaaattattatactctagttaggaaaatagcacacaactttaataatttaatgaaggtactgtttaaatatgctatacttgcatgagtctaaagaatggtttttgttcccaattaaatacaagaatagcaaaatgtggaaacgtaaatttagcaattgttcactgttgttttcccaccacctgaaataatgctggaaatacagttggc

SEQ ID NO: 271128 - DNA, 451 bp, Homo sapiens
agttgtttttgtacctctgtcttacacagctagtcttcacttaacgtcatcgataggttcttgtagtacttttaagcacaacgatgtataacaaaaccaatttttttctaacaatgttataatgaaacgacttcaaagtaaacagtgttgttcaaggacctgctacacacagttctgcttaaatcgtaggacttactgtacctataatgctcaactaagaaataggcatctacaaccaaattctcgatttttcccacaaacataacacagcatgaatatgtctgtgttttcatcaccaaacagcaggcagagtttatttgctttctccagtatgccaatgcctacagagaggtagccttaaaatcacaaactggtgggtatatattcaatttgtatcactgtcttggaaaagtaacacctaattctcagacactgttagaattaaagcatt

SEQ ID NO: 271129 - DNA, 619 bp, Homo sapiens
ccaaagtgctaggattacaggtgtgagccactgtgcccagccaaaaaaatttttatagataattgaattttcttagcttgaacgcttttgcattttggactttattttacatagtttcatatttgagattctgatattttcttattatataaaagggattcaatttcattctaccattatataagaattatctaggtagtaatatatacatttattatcaaataattatattttaactcttgaaataacctttaaaaggttaccatgaaataactattccctttaataattgtaatgttacttaattaaatatagtaatttgttctaatttgctttccatttttaattttttttaacttgaagatgaaacacttctttttgttagaccttaaaagtaagaaattaattaatttgggactagaaacagctaattaattaagttagatcctaaaaatctttaataatctgctacaatatttgtagccctaaatattttctgctatctttattattttaattgttttgtaaactttaacatattttacaacttcgaagtttcacatagatttaaggatcatcttttgtgttggttagaaaccaggatcccacaaattgctat

SEQ ID NO: 271130 - DNA, 486 bp, Homo sapiens
catctctgcactgtggcttgcaaatgaagccatctgtcaaaccaggggccaggcgcccagccctcactcacctgggctgtgcctctggccaatggctgaggtgacctcccaggcatccatagtggagtatgtttctactttattgaacagccttgaaaatcagagaagctgaggaaaccatgtcaaaatttcctgagaaatttctctcctgcacttggtaaaggtgaactagaatttgccatgtgagtgaggaggacattttttaatgaggcaagagctccacaattcccacagctgctcagaaagttctcttgcgtgtcttgagagagactgaaataaagggaagtcgaggacagcctggctttgttctttgaaactacttatcaaagtaagatcatcctaacccaatatgagaagtatatgtgcaactgtgtgagtgtgtgtttgtgtgtgggggtacacactgaaagaaaataaataaggatg

SEQ ID NO: 271131 - DNA, 493 bp, Homo sapiens
tcagccttccaagtagctgtgactacatgtgtgcacccccacgcttgactaatttttttaatttttttgtggagatgaggtttcgccctgtcgcccagactggtcttgagctcctgggctcaagtgactggcccgcctcccaaagtactgggattacagatgtgagccaccacacctggccacacacttgtcatttctgacccccgagcccaccacattccactactcatgagaaagaggttcctgaacgctgcaggctaatttcagggacagcaggcaacttggccgcatgacaaagccaagtggtgaaataaacacattcttaattatgacctgtctcctcacccacatttttcattttccagaatggggacttgaaaactcaaaaggaagcagccagttacacatcagacctgttatctttcacctgttacctttcagctagaccgtagggtcagatgatttttgtttttttttctggtgaggggcagag

SEQ ID NO: 271132 - DNA, 801 bp, Homo sapiens
aggaaccttagcttgtgagaaggaagttgtacctggaaggatttgccatctatcaataagaagtaactttgtaaattcagtcaaggatctaataatctattatatctgaaatctgggagctaaattggactgattatggaggttagttggatatttttccacttttgactagtcagtagaaattccactttgaattaacttcttgggactgagtacaagttgagttgcccacagtgttttgttcggaaaataaaattatgttgttatttatttatttttgacagggtcttacccagccttgacctagtgggttcacctcagccttccaagtagctgggactacaaaagtgtgccaccatgcttggttaatttttgtaattttttttgtagagatgatggtttgccatgttgctcaggctagtcttgagctcctaggctcaagccatcctcctgcttcagcctcccaaagtggtgggattacaggtttgagccactgcacccagccaattacgttatttttaatgctgaaaatgcacgttgatgacatttgccgaagtatgacgaacaagggggtatctctgaaataccctcctaaaagagacgagaaatgaaaagctggttggtaagtgtttcaggaactttcagattgagagtaatgttaggaagtatttgctttcaagcagttttttttttctttttgagatgaagtcgctctgttgcccaggctggagtgcgttggcgtgattgagattgcccccctgtactctagcctgggtgacagagcaaaattgtgtctttaaa

SEQ ID NO: 271133 - DNA, 409 bp, Homo sapiens
tacatgtgatatggctccttgggagggttctttgtatttcctcggatgtatcaaacctgcttgctcttaatttcttaccgcttcatctgaaagtatttttctttcagaaaaacctgggatgtggaagtgatcgttttgtatattttaatttagtggttgtcatcaacctagtgatttggattatatattacattagtatcatctaggattttttttttctgaaaggatacacaaaggatgtgtcctgatagcttagctcccacttcgaagtgagagcataaccatatttggttttccattcctgagttacttcacttagaacaatggcctctacctccatccaagtagctgtgaaagacatgtctcaccctggtaatccagaatgtggtgaaaccccatctaccataaa

SEQ ID NO: 271134 - DNA, 210 bp, Homo sapiens
atagcttgttcattataatcagtctgtatacacattatacatgtgatatatatacacagacacacacacatacagagaatgagagagagagacagagaaagagacagggtcttaatctcttgcccaggctggagtgcagtggtgcgaccacagctcactgccgcctcaacctcctgggcctcaccaatcctcccacctcagcctcccaag

SEQ ID NO: 271135 - DNA, 299 bp, Homo sapiens
gtcatgggctgttcagacaatggaggacttgagctaccgatatacacaacatccatgtatgaatcccacacacattgtgccacatgaaagaagagacactaaacgctgtaagcccatatgacattgaaatgaaattcaaaaccaggcagaattaatttacagtggtgaaaaatcagatcagtggttgcccctgggatgggagtgagggctgactagaaaggggtcaaagggagctttctggttgatggaaatgttctgtaacttgtttgggcagtgggcacataaaactctaaaaactc

SEQ ID NO: 271136 - DNA, 382 bp, Homo sapiens
ttttttaatgttgtgttgtttgagttccttgtatactctgggtattagtcccatattggatgagtagattgcaaatattttgtcccatttaagaggttgtcttcttcatgctgttgattgtttcttttgctatgcagaagctttttagcctataatctcagcattaagggaagccatggcaggaggatcacttgagccgagcagtttgagaccagcctgagaaacatagcaagatccgtttctacaaaaaaatataaattagccagacatggtggaacatgcctgtagtcccatcttcttgggatgctgagataggaagatcacttgatcccaggaggttgaggctgctgtgagccataatcacacttactgcactccagcc

SEQ ID NO: 271137 - DNA, 155 bp, Homo sapiens
cctgctagccacttacctggtggtgggcactaatgaaccaatggccaggaatccttaccttttgggaactgtaatgttatcattgtttgagctcctcttttgaaaatgccatgttgtttttcttttacaaaattaaataccattttcactaattg

SEQ ID NO: 271138 - DNA, 1637 bp, Homo sapiens
agcggccccacgcgaagctggcgtgggggttgccatagcccgcatcccagggggcgaggccgaggcttctccccggcccatccagcggctgctgcccggctcctctcccacctgtccgcttcggcgcctcgcccggccccgcggcctccaggcaggcggcgggaccccaggcgagtgcccgttagcgggtctcccggcggcccggccccgcgtcgccctgtgtcttccaggtgctgggcctagggaggcgcgcggcagccctcactcctccgctcctggtgacgccagcccatcccctgctgcccttggctttctgggcctagcggatctttgacgccctggtgagaccgttacccacccgcccgccatagctcctcgggggagtcagtgccaggctgcagcacacgctgccttttcaggaacccgaatttgggaagtttactcatgtctaagtccagctggagaaaacaaggatattaagataactattttctggagggctgaaggaaattcaaaatgatttagaccttctcaagtgttaggaataatccctgcggcatgcaccctgtgtacccttcgactttgagcaatcatgatgctgctgcacctttcaattaattgtgcaaactaaagttttcctctttaagtggcattattttggcatgagttttaaagacaaagatgagagaatttcttgtttggaagcctacgtaactttgacatctaagagctcaagatttactgatgaaacagagattttgaagatgtcgcaaaggcactcaggtcaagctggcactgaagcaggaaatggggcggactctcctccaattgtcaactccaagtactccaccttcagagatttttgttccacatcttcatttcaagatagtggctacaatgagttaaaatcttgtagctttgataatatagataaagaatatcttggaaagaaagaaaaaggcccaacattactctatgagcaccctgaaacttcaggcctgggcttaacacatcctttagaatctcccactcaaaaaaagaaatgtatcttgcctagaaaggaaaaggataaaaccccagaactttgtgaaacacctaaaatcagtgggaaaaaatgtttacctcgcagaaggttgaatgtatctttcgctcttctaaaaggggactttgaatcacaaaatagttctttagaaagtagtataagccaagttatcaacttagaaaaaaatattccaagcagtgcttcaggtttttccagggcaaataattttagccctttagttactagcactttaaaaacagaagaagtgacttcatgcagtcaaaaattgaggcttaatttttctcagcaaaagacttccacaattgatgattccaaagatgattgtagcctatttgaagttgaatgtatatctccaattcagggcaataattttaaagactctatcacacatgactttagtgatagcagtttatgcattaatgatgagaatgcatgtccagagctcctgggctcctctgttagtggaacaacttgtggaacagatgaggacatatttgtgactccgataagtaatcttgtggcaaacattagatttaacgcaagtcaaatactttctccttcacctgaagtgaga

SEQ ID NO: 271139 - DNA, 428 bp, Homo sapiens
gttccctcccccaatacacacaagtgcacatacttctcattcacatttccattatctttccttatccgttaacagcaacacaaatatatattctaactcactaattagaataattagtacaactgatcaattattcccacatgttaaatcattactaatatgtgatagcaccttattgctagagtgaaggttaagaactatagctaaagagttcagtcatcttaggaaggaaatttaaagttgagaaacagaatcaaggcgttgagtcaagtattgccagagaaagccggaaggctacggactgcatcctgggggtatgcctacatggagaggtaggaaaagcagctaaggaaatgctgaaataggcagatcaatgtgtataaaaatattaaaatgcggtggaattcatgccatcttctgcacatcct

SEQ ID NO: 271140 - DNA, 497 bp, Homo sapiens
caacttagctagacagaagaaaggaagagtatacaacacagcgcagtctaggtgaacagagctgaagaagggtggtgtagtagttcctgttcctttcctgcctcacttcctggcctcaagtgatctacctgcctgggcctcccaaagtgcaggattacagctgatgactcccagaatgtcctgactgcaaggaacatgtactatggacccatcagaagtgagctcattttctaaacatctgtgttgccaacaggcacacacctaaagtttcctcctatggccacctgtggatcaccctgaccttcaaagctggtagccaaagttctgcttccacccccaccatctgcaaggtggcacttttcagtcttgatggataaatgttaaaaatcacaaccaacaattcttaatcatccctatgattttcaaaggaaaacgctactgtattgtcaaactttttctctacaggctaaaataaaaataaatgactactgaaaaaa

SEQ ID NO: 271141 - DNA, 402 bp, Homo sapiens
tgcacggctttctggatgagatcttcttcaccttcttcttcaacgtactggggcagggggacgggacaaccagcggccacacgtcgctctggtccttctttatgtacggcagctgcagtttcgtggtggaaaagctctacttccacctccactacagccgcggttggggcacttggaagcgggtgcccatctacgtgatcttcatctacgtgtgggagctgtcctggggtctgggactccgcacgtgcggggcttgttcctgggactattctcactacccgctcaattttatgggcctcatcaccctgatgtatttacctggctggatattccttagtgtgtaccaggacctaatttccaacgtgttgtggagggtgcagtacgtaccagctaactaaaacc

SEQ ID NO: 271142 - DNA, 477 bp, Homo sapiens
ttaagttctggccactgaaatggaaatggaagtatggtatgaaacttctggaaagctacataaagggacctggcttagctgggtcattacattctttctctttccttccagtttgcctgtaactagatgtgttggatgaggtcatggagcaaccttggagatagaagccacatgctaggatggtggggctgaaaaatagagcttgttgcctgaagaccattacgtctgcatatcaaccttgaattgtctccttttgagcttctttcacacaagagagaaagtatcttgtgtttatgacattcttatttgggtctttggtaacacgaacccaaaatttatcctaaccaataggagtacggttaaataaattgtggcgcatctgtatatggaatattatccagcagctacaaaggatgagataaatttatatgttctttaaataatggctaccaataaaaggattccctcttctgcctt

SEQ ID NO: 271143 - DNA, 433 bp, Homo sapiens
agacaagagctcactcactggagagcagtggcatgatcacaggtcaccgcatcctggaattcctgggctcatgagatcctcgcacctcagcttcccgagtagctgggactacaaggtgtttaacaccataccggctaatttttgttttgttttgtttcgttcgatgaagacgaactcctgggttcatgcaatcctcccacctcgcttcccaaagtgttaggagtatagacgtgatccactgactctggcaaaactatttttttaaaaaagtgacaatggcttaacacctacattagatgacaataaaaccagtgcagatggtcatgaaaagcaaacaaattcagggattatagactttataaccaagtatatctactggtctgtgaaaggaggaaatgacagagtatgaacaataaaatactataacatatat

SEQ ID NO: 271144 - DNA, 444 bp, Homo sapiens
tcttgagttactacaaaccttcatttctgttgaaatttttttcaaactgttaataggaaccaatgagatgaatgaatttagaagggtataaatagaacaaagggaccacagtatatgccatgttcacatttgtatccttagagcctagcacaaactaggttctctaggcccagcacagtggctcactgtaatcccagcactttgggaggccaaggtgggaggattgcttgaggccaggagtttgagaccagcctggccaacatggtgaaacaccatctctactaaaaatataaaaattagttgggcgtggtgatgggtgcctgtaatcccagctacccgggaggctgaggcaggagaattgcttgaacccaggaggtagaggttgcagtgagctgagattgcaccactgcattgcagcccaggcaagagtgatactccgtctta

SEQ ID NO: 271145 - DNA, 352 bp, Homo sapiens
aattaattaaaaatttttaaaaaatacaattaaaaaatacctttgctattgatgtctgtttctgattgtctgtcatcccggtacactatatttactttccagggaaactgagtcattcaacaagcctctggcttctagtgataagcactatcattagaaagaattatgttctgtgtgttaaggataagggacacattctttttggaaaatagtgcttgtgagtctaggaatagttgtataatctgggaatatatgctaatgctatagctgagttcaaatcacttttttaaaaatgcaaacttatcttctctgtcaccaagcatgtcttccatacaaaaggcacatttctgta

SEQ ID NO: 271146 - DNA, 342 bp, Homo sapiens
gtcaaagctgtttccaccttagaaacagcagtgatgtttctagcagtaacatccagtgtcaaatattggtggtatcggggggatcagcagcagcatccctgccaagaggtatcagctgtggtgtctacatggagcaattctgagtatgatttttgaagccattcctaggagtgtagccccattcctactcctctggttctcccagagatctgtgagctatctaatcttctcaaatacattcttgcttctatctctcactttctctcttttttttgttatttctcattataactttattttaaaaattagttctgaaaaattggcactatccattaaactgaa

SEQ ID NO: 271147 - DNA, 436 bp, Homo sapiens
caaaagtgtatcttccaaaaagtacattttgtggtagacacttttcctctgctaaaccatatgacatcaagtggcatcccttttcttcctttgtggtcattctaaccctgatcccagattggacaaggttgaaatatcagcatgaagtgaagttggttctggttaaacttttccaggattgtcccatcttccagtccttgtaaatgagtgtcatgctttgttgccaagtcaatgaggagacaatgttcacatggagacccttgggcacagatgaaactggaattccttctcacccatttcatacagatagtatgaaactcatttcaactgagaagtgaaaattctggttaaggaagaattggtacttgaaagttgttactttaaaaaattatcttgattcatggttttacaagtcagttataaatgttaatagcct

SEQ ID NO: 271148 - DNA, 561 bp, Homo sapiens
caaagaaaattgaataatttctagcatttcacacaatttaagaatgaatttattttccacttcataatgtggtatattatcattcataatgtagaataacatgctgtggatttacagtgtcttttaaatcattacgcctaacccaaaggatgtagacttccaatttttaactattataaataatacttgataaatgtctaggtgcataaagcatcttcttccacagcattattttttgaatgagagatgttcagaagtagaataactacgtcaacatatccagttcttgaaagtacattgcaaattacttaaagttatagtcccataagaaggatattgcattcaatttaaatatctttttcaagacctgaatccctgtattgtaaaggggaaaactgaggcacactgacattaaagtggcataacctaggtgaatcaatagcaacatttccaacttttacccttctctggggtaaaatgcttcactgttgctgttaatctctattactatcctgaaacgtttcctgaaatgataataaacagaaaattttaacataagaa

SEQ ID NO: 271149 - DNA, 869 bp, Homo sapiens
atttttaaaacaaaaatagattttgtttaaaaaattctttctatatgtaaatattctaaaatgtaatattccacttggcactaagtatttttgttcactcttctcatccatgtcattggtctcccttgttatagtcttaatttaatttcatcacatattctttgtagattagatcagtttgaaaacaatgcctttagtgtcttccatcttagtaggacatttcctactgaagaacaaaattatctacagtcttttttccctcgcatcaagaccaaaatatgaaagcagtatgtctttaattagaataaataatgaagagtcttactctaactacagaaaatataacacctgtttagattcctaaatagttgaagatggtttattggaaattaacctcatattacagggagtctcctgaatgtatcctaaaaggatatctgtggcctggacttgaattgcttcctgatttctgtgtgtctctgtctgttgcctttgcataacaggtcactttaattatcaagtgacccggtggctacaaggcactcatgaatgttgcagtttactgcaaggataggtgacagagatagacagcccaaaagaatggctcaatgttgtggtcagggttcagggcaatagaaatgccatagagccaagaagaagaaagcaggttttactgagagttctacctgttgggcaaacagacaaggaagtaatcatggttaatggtggtaacctttataaatatgttataaaattaattaaattatttcaatcattatgtaacatgtattatgaatcgtaaatgctgggtgcaaaacatggtattaaaataaaaactataaatatatttatttacacaaaatggtgta

SEQ ID NO: 271150 - DNA, 227 bp, Homo sapiens
aaggaaagccggtgatgaacaaggctattgcttaaagactgaatgacatggaccccagagtttatgtgagttactgtaaaaatcagggcttcactcccaactgagagccttgcagagtgaggagtttctctagagaccatctgataaatgcgggctcccacacgcagagatgtgagctagagccgtgcagcaaataatatatattattttcttctccgcttaaggtc

SEQ ID NO: 271151 - DNA, 261 bp, Homo sapiens
taaccaagagtaaggacacattctagtactcagttcaaactctaagtggatatgaactgacagagaacaaaaccaagcctggttacatcagaagataccacctctaatttcactgcgtgccagaacaaagttgaatacctcttaaaagaagaggtcataactaatccatgatgaacagcatacaatagaaaactagtagacatggtcaaaatattacccatcactaaaagagaaaacatttaataaaagtgacattacgat

SEQ ID NO: 271152 - DNA, 491 bp, Homo sapiens
gagcctaggagttcaaggctgcagtgagctgtgatcacatcactgcacttcagcctgggagacagaatgagaccccatctcttaaaagaaaaaaagtgacaaaattagaaatgtagaacaggtggtgtttgtcaagacttagaaatggcagagagagagggatgaatgtgatgagttttgtagtgatggaatagctgtgtatctttttgcagtggtgattatacacatctgcatatgtgacaaaatggtataaaagtctgtagacacattgaatcaatgtcagtgccctggttttgatactatattgtagttatttaagatgtcaccattgggagaaactaggtttaaaaaagtacatgggacctgctatctatgactccctgtgactctatttcaaattaaaattttatgtattgtacatgcacttgattttatttctgtaaagcaaggcatatatcattttctagtcgtggacattttagaaaaaaaaa

SEQ ID NO: 271153 - DNA, 457 bp, Homo sapiens
cctggcttttttttttctctctctctccaggacaggacgtcccaccctttcttagtccgtaacgcacctttggacatgatggaatatacgaaggggcctccacccacagcatgaccaatccccagcatccaaaatcgcacacataccaatatgtgcacacacacactcacacccacacccataaagattttgcactccttgaaggtacactaactcaccatttttatcatacttatcccagtgtgccacagttactggcttatatgcctgtctctgctatcttattttatctgtctccacaacacagcaaactacctggccttcaataaagggcttatgaattattcatgaatccattttgccaggtgcctagccctgtgtctggcttgaagcaggtgttcccaaggtgtggcatggctgagtgaatacaaataaaaggtatacaaaagcactcagc

SEQ ID NO: 271154 - DNA, 301 bp, Homo sapiens
aataaaataaaataaaaatacaaacttaaatagcttagcaacttattctaaataattctgtaatgaaaagctgaaaaagtagtttttggcttaaaatttttaaattttttcccaatcaatatactatggcatgcttctgatcactatctagtgttttaattatttgattttgcaaacacaattttcctcccattgaaactgatctcttaagcccaacagaccaaggacattgaacccaggcaacatttcaaatgcggaacacaccaaaatgctctagcagttggtttttttttttttccca

SEQ ID NO: 271155 - DNA, 437 bp, Homo sapiens
  misc_feature (66)..(66): n is a, c, g, or t
ctgattcctcactcttactgaggcaaggtaactttgtcagatggtgagtgttattttttcgttttntttttgagactctgtcttaaaaaaaaacaaaaaacaaaaatctaactgtaaaataggattactacttctacttaagtatctaggagaaaagatgctttttattctgcacatatactgtatttttgtatcacaacgcagttcattttaatgttatgaatatccattgtttttcctgatgaacaaaactgtaggctcattttggtgaaaatgttggtttttaaaaaatgcagattcacggccaggcgcggtggctcacacctgtaatcccagaactttgggaggcggaggtgggcgtatcaaaaggtcaggagttccagaccagcctgaccaacgtggtgaaacgctgtctctactaaaaatagaaaaaaaaa

SEQ ID NO: 271156 - DNA, 308 bp, Homo sapiens
tagtcggtgtctttctatgaatttatccatttcatctaagattatatacattttatttcatgcagtttactattaaatctgttaagaggaaaaaggagaacaaatcatttgtcttttataattacccacattattacctttattggtgctattattttttaggaatgattcaacttaatatctggtgtcatttgttttctttaatatttcttcctttactattgctttctttactgatttttgtaaagtgaatccagcaacaaattatcttagattttgtttgtctttatttcatctttattttagga

SEQ ID NO: 271157 - DNA, 233 bp, Homo sapiens
aaagcgaaagagagggatgaaggtttgcttttgaaaaaagtaaaccgcctttctccggatgttgacttaggagccaggcaattcgtcgcgtcgggtcctccgatgctggcatctctgagaattttaaaaagccgatataggtgctggttaagcacctcacgagctgaactctggtatctgtgcagaaactaactttcatggcagtgtccagcagaggctgccttggaagccag

SEQ ID NO: 271158 - DNA, 299 bp, Homo sapiens
aaaatcctattttatggatattgtgaaattgaagtttaaagtcagtttcaaagttggaggactgacatttcacattttactataaagttgtacgactatcaagtagagtggtgttttcaagaaatagactcatagatcaatggaatgtgatagagtgcccagaaacagacccatacaaatacagacaatggatatttgacaaaggaacaaaggcagttcatttttcaacaaatgctgctaaacaattggatgtccaaatgcaatgcaaagagagagagagagaaaagatttcaacagag

SEQ ID NO: 271159 - DNA, 500 bp, Homo sapiens
tattctacttactgtggcttcattgcataaattttatgctcattggagagaatatttactcacaatctagcccatccattcttataaaagagacctctgaaagctaagagtcactttcctgagggaaatgcaagactctgggagagagagggcactttgagaatgggaaaattgcctgtgaaatcaaatttaggcgaaaagatagcccagcagccatatgtaaatcattccctcatgtaggaacaatgctgtgcacttggtaattcaatagaaaacattagtcatttatcatccttaattatcagtcatctctaactgcatctggtttgcattttttattagaaaggtttttttttttttgagttggactcaggcattttttttcttccgttcctgatttcattttgttattctttttaaaattccatcactaattcccatgatgtgaagaggtttctatttcataagacacaataaatcaagcaacgcctctgttgtaa

SEQ ID NO: 271160 - DNA, 90 bp, Homo sapiens
tggacctggggagaatgtgtaaaggacacacaggaagtggccagctgggagttgattgttttttcttatcaacattacaatgaaatgata

SEQ ID NO: 271161 - DNA, 400 bp, Homo sapiens
ttacaaccctcctacctccaggaaggattcaatcctggctggattaaatcctggctgaccatgagtttcttaagactttccccaaccctcctgaccccaaatgtggatatgctttccatttatgtattaatttggtgtttccattctgttggcttgctatctgagtcttaggccactgctgtgtagagaacttctggactaggtctgccctaactacctcattattatttgataacaatgagagtgagtgtagcagggatagaattctggagatcctggttcaagtctcattcttctagagtataaccttagataaattgtgttccttctctggacctcaatttcctcatctgtgaagtgaggggtatatatacagtctctgtaatcctcctctatagcc

SEQ ID NO: 271162 - DNA, 409 bp, Homo sapiens
gctctggggcaggatgaactggagccacatgtatcacctggactctgtcttgtccctgtcacaccccaagggcccagaatgggaggcagtctgcactccttccccagaggcagggactgagtctgccaaatgaataatcccagggcaggaagacactttcggggtgctgaaccctagaacggagactttagaaggctcagcacctaaagaaccagctctgaagccctaggtcctgactggcagactcttctctctaaaaggtataaaatgagaggcctgaggcagcagcctccttataagttactgttaagtaaaaagagctgtaggaatgcaaggtggtgtttattttcagaggagtccccaagccattttcttactaaagcctcatatagtctagaaagtatatttg

SEQ ID NO: 271163 - DNA, 426 bp, Homo sapiens
ccatagaaaaagcagggagaatagaatagcagtgcctacttcatcaggctgttgtgggaattaaatgacttgacacatctgaagggctgatgatgtgatgcttgagagacgcgggatacaacccttgcagcccttggcaggctgacggtgcaggcactttccctcaagtatctgggcccttccgtgccccagtgccacctgcctccccagagcaattaccaatcacatcaacaagggctacccagggtggtcactcccctgctcagcagttctctgcgtctgtagctaccgtgccttctcagcaccccgcacgatgtgtacctcctagaagtcactcaatgagcatttgaagtgaacaaacacctggccggatgctaacctggagggtcagattttacacacatgactaataaagaccgtcctgcc

SEQ ID NO: 271164 - DNA, 565 bp, Homo sapiens
aactggattaggagagcttctggatagctgaacacatggaggtttctggagggtgtggcccccagagggcatggaagctctgcacccctgctcccatacctcaccctacgcatctcctcatctgtatcctttgcaatatcctttgtaataaaccgaaaattttatcataatgagcatcaaaagaatcccaaatgagaaaactgctttttgcataagtgtaaattaagagatggaagtcacatttcaccatggcaaacatttgctgcatgcaaaatgactgaaacaaggtcttgatctgtcaccaggctgaagtgcagtggtacaatcaaagctcactgcagtctcaacctcctaggctcaaacaatcctcccacttcagcctcccaaccagctgggaccacaggttgacatcaccacacccaggtctgctggaatttgctggaggtccactccagaccctgtttgtctggatatcaccagcagaggttgcagaacaacaaagattgctgcctgttccttcctctggaagctttgtcccagaggggcacccaccagacggcagctg

SEQ ID NO: 271165 - DNA, 488 bp, Homo sapiens
gcaaaggccctgtgggagagaatttggatactgaaagaattaaaacattcaaagtggctggagaaatagggctaacatcttacacgtacttatatgccatgttaagaccacgttaagtgctgagaagctgtggaaagtcctcaagaatttcaaggtctgttacagaagtctcggtttacttcaatttctgttctgcttctctctttggcaccatcaggaaaccctagccccgtgtctgtgaaaactccaaagcttaacattctaaccactctagggagggaggatgggaggaagagagctgagtgtgcaccaaggagcggtaagatgccagacctgtgagtgaagaagcatcttggaagtggaccctatagctccaggcacctgctgacacatagtcggaggcaaaccacccagtcaagttcaacccaaattcctgacccaaaaaatcataagcaaaataaaatatttgtttaaagccaaaaaattgt

SEQ ID NO: 271166 - DNA, 475 bp, Homo sapiens
tattcaattatcttcttcctgttcaaacagtccctctgctatggctcttcctcagtagaaacaactggcaacaaaattcaagtttatgattcattcatcagcaaacatgtgagaatcatctacaaagaaccaagaattgtggtctgttacagaagtctcggtttacttcaatttctgttctgcttctctctttggcaccatcaggaaaccctagccccgtgtctgtgaaaactccaaagcttaacattctaaccactctagggagggaggatgggaggaagagagctgagtgtgcaccaaggagcggtaagatgccagacctgtgagtgaagaagcatcttggaagtggaccctatagctccaggcacctgctgacacatagtcggaggcaaaccacccagtcaagttcaacccaaattcctgacccaaaaaatcataagcaaaataaaatatttgtttaaagccaaaaaattgt

SEQ ID NO: 271167 - DNA, 1367 bp, Homo sapiens
aactggattaggagagcttctggatagctgaacacatggaggtttctggagggtgtggcccccagagggcatggaagctctgcacccctgctcccatacctcaccctacgcatctcctcatctgtatcctttgcaatatcctttgtaataaaccggttcaaaaaggccttctttcaaaccttccccaaagcctattttctggaacactaaaaactcaggcaaatttgaggtctatcaaatgtaaaaagtacagactctactgtgaatctcagaaattctctaaatcataacacattcaatagctgacagaagacttttgtttctctttttcccagcatttgggctaaagtgatgatacgcaatgcaagaacgaactagcacaacatcagtaagaaaaaaagggtgaaagctacctgttactacgagaacatttgactagaagtcaagaaactaggattcgagttcctgctccagcaataatcagctatggttttagtttcctaagttgtacttgagtgactggaaggagagctaaactatataccaaagaagatgaatggctagttgtaacagggaaaattttatcataatgagcatcaaaagaatcccaaatgagaaaactgctttttgcataagtgtaaattaagagatggaagtcacatttcaccatggcaaacatttgctgcatgcaaaatgactgaaacaaggtcttgatctgtcaccaggctgaagtgcagtggtacaatcaaagctcactgcagtctcaacctcctaggctcaaacaatcctcccacttcagcctcccaaccagctgggaccacaggttgacatcaccacacccagtccctctgctatggctcttcctcagtagaaacaactggcaacaaaattcaagtttatgattcattcatcagcaaacatgtgagaatcatctacaaagaaccaagaattgtggctggttttgaactcctggcttcaagagatcctcccgcctcagccccactaagtgttgggattacgggtatgagccactgcccctggccaaaaaaagttttacagtcagaaggaaaacaaaaggaatctggatctacacaaggaatgaagagtactggaaaggtgaaaactccaaagcttaacattctaaccactctagggagggaggatgggaggaagagagctgagtgtgcaccaaggagcggtaagatgccagacctgtgagtgaagaagcatcttggaagtggaccctatagctccaggcacctgctgacacatagtcggaggcaaaccacccagtcaagttcaacccaaattcctgacccaaaaaatcataagcaaaataaaatatttgtttaaagccaaaaaattgt

SEQ ID NO: 271168 - DNA, 1205 bp, Homo sapiens
aactggattaggagagcttctggatagctgaacacatggaggtttctggagggtgtggcccccagagggcatggaagctctgcacccctgctcccatacctcaccctacgcatctcctcatctgtatcctttgcaatatcctttgtaataaaccggttcaaaaaggccttctttcaaaccttccccaaagcctattttctggaacactaaaaactcaggcaaatttgaggtctatcaaatgtaaaaagtacagactctactgtgaatctcagaaattctctaaatcataacacattcaatagctgacagaagacttttgtttctctttttcccagcatttgggctaaagtgatgatacgcaatgcaagaacgaactagcacaacatcagtaagaaaaaaagggtgaaagctacctgttactacgagaacatttgactagaagtcaagaaactaggattcgagttcctgctccagcaataatcagctatggttttagtttcctaagttgtacttgagtgactggaaggagagctaaactatataccaaagaagatgaatggctagttgtaacagggaaaattttatcataatgagcatcaaaagaatcccaaatgagaaaactgctttttgcataagtgtaaattaagagatggaagtcacatttcaccatggcaaacatttgctgcatgcaaaatgactgaaacaaggtcttgatctgtcaccaggctgaagtgcagtggtacaatcaaagctcactgcagtctcaacctcctaggctcaaacaatcctcccacttcagcctcccaaccagctgggaccacaggttgacatcaccacacccagtccctctgctatggctcttcctcagtagaaacaactggcaacaaaattcaagtttatgattcattcatcagcaaacatgtgagaatcatctacaaagaaccaagaattgtggtgaaaactccaaagcttaacattctaaccactctagggagggaggatgggaggaagagagctgagtgtgcaccaaggagcggtaagatgccagacctgtgagtgaagaagcatcttggaagtggaccctatagctccaggcacctgctgacacatagtcggaggcaaaccacccagtcaagttcaacccaaattcctgacccaaaaaatcataagcaaaataaaatatttgtttaaagccaaaaaattgt

SEQ ID NO: 271169 - DNA, 388 bp, Homo sapiens
atccacattcattcatcatgcttggcactatgggccctttccatctgaagccccctggttttcattagttttggaattttttttttctgttcttttttattattttctctcctccatttcctctggtctttcttatggtaatgaataaatattgaactgaggtacctgaaaataccaaagtaaggaactacataacctaccagtacaatactttgttgtattttcctcctaggaagaactgcctttcctatttctttttctttaggtctgttacagaagtctcggtttacttcaatttctgttctgcttctctctttggcaccatcaggaaaccctagccccgtgtctgtaagtgtacacaaaatttgaaggtgggcgcgggcttgta

SEQ ID NO: 271170 - DNA, 673 bp, Homo sapiens
gttgtaaccattcaggaaggaacttcctgtcctttatttaattaaagcaacttttcttgaaaaacaaaacaaaacctcttttctaactagcatttacatgaagagttgcctacgttaaaagacacagcaacctgtgaagagaaatatttaagctaatgtgttccatcgtgctggtgagcactttcaaaggagtgcatgaaagatatcacagcctcacaaatgcagagaaaagcctcccttggccactgctgatcaggaagtgagactttgtcctccccacagtgctatacctagccggctggattatcgtcctcatggccaaaaggagactagacatggaaggcaaattgcagttagatgaatttaaccagctttctctacaccgcatgaagccagcgactgtgagggctctgctacgcggctgagcgggctgtgcaggcattgccaaggtctcctcccttgttgacgttccctgctcgtcttcacgtgatcccatctcagggctctgccgtccacgccctcaccaagctggatcctggaagtcatgcaattccttcttccttacttctgtaaaccaaaaagtgtctgagacagatctcagtcaacttagaggtttattttgctgaggttgaggaaacactcaggaaaaaagaaacacgagttacaataggat

SEQ ID NO: 271171 - DNA, 762 bp, Homo sapiens
gttgtaaccattcaggaaggaacttcctgtcctttatttaattaaagcaacttttcttgaaaaacaaaacaaaacctcttttctaactagcatttacatgaagagttgcctacgttaaaagacacagcaacctgtgaagagaaatatttaagctaatgtgttccatcgtgctggtgagcactttcaaaggagtgcatgaaagatatcacagcctcacaaatgcagagaaaagcctcccttggccactgctgatcaggaagtgagactttgtcctccccacagtggtaagagcctctgggaaatttactctgggctgtgtatctatcacttgctctaaatcaacaaatttgtaattgattatgtcacatttcagctatacctagccggctggattatcgtcctcatggccaaaaggagactagacatggaaggcaaattgcagttagatgaatttaaccagctttctctacaccgcatgaagccagcgactgtgagggctctgctacgcggctgagcgggctgtgcaggcattgccaaggtctcctcccttgttgacgttccctgctcgtcttcacgtgatcccatctcagggctctgccgtccacgccctcaccaagctggatcctggaagtcatgcaattccttcttccttacttctgtaaaccaaaaagtgtctgagacagatctcagtcaacttagaggtttattttgctgaggttgaggaaacactcaggaaaaaagaaacacgagttacaataggat

SEQ ID NO: 271172 - DNA, 1305 bp, Homo sapiens
taattcatgttcttgaccatattctcatcaagcagagggaaggggttgagagatagaatctgggaggcttcctggaaattcattcaaccagcattgattccacaagaatgtactgagcccctctgagtgctggccactgatctaggcactggggacacaacagtgaccaaaagagaatccctgtatcccttcttgtggagttcattctagttggagaatagagagatacatgaataaattgattttgcaggataaataggatgagttacaggatagatggaatatctttgttttataaatacacagattgctttgtattgacttcaggtggcttgtagcaagagtataaatgatgactagtaatacatataatctgaagcataaaattgggccaaagaaaaacaagtacacaaatttgcatatgagtaaagcaaattttttttttttttggtgctgatttattaagtagtgtcgttttgaatgaagaagttcaaaagggtattttgtacaattaaaagtgaattgaaaaggagtaagaaaagaaagtggctgattgcaggaggttctagaaaataaaaaagaagcccttagacttggcatgcaggacacttgttgaaagtcttgttaaggaaagtggggaatatttcattgctaattatctttttgagttggctctaagcaggaaagactatgggccaggcactgtggctcacacctgtaatcccagcactttgggaggcctaggtggaaggaccacttgaccccaggagtttgagaacggtctgggcaatatagtgagaccccatctctacgaaaaataaaatattaggccaggcacgatagctcactcctgtaacgcctgcactttgggaggccaaggtgggtggatcacctgaggtcaggagtttgagaccagcctgaccaacatggtaaaacctcatctctactgaaaatacaaacattagccgggcatggtggcatgtgcctgtaatctcagctactcaggaggctgaggtgggagaatcacttgaacccaggaggcggaggttgcagtgagctgaggttgcagtgagctgaggtcgcaccactgcatgccagcctgggcgacagagagagactccatctcaaaaaatgaatgaataaataagtaaataaaataaaaaattaggcgggtgtggtggcgcatgcctgtagttccagctatgcggacggctgaggtgggaagcccataggttgaggctgcagtgaaagccatgatcgcgccactgcactccagcctacgtgacagagtgagaccctgcctta

SEQ ID NO: 271173 - DNA, 294 bp, Homo sapiens
tcaagaaacagtacagcacaaagacctggcattctagctgaagagctgtaataataaacagaaatttgaaaaccaggaagacaagttttccaagagtgcaactgtggcatttcaaaggagatttaacaagaaattccggaagatggccaaaaataggtttagataattgagattctttatttgaatacttgtttttgatggagaaacatacttaagaggaaatgaaggttctgtctaaggtctgaaactttttttcaccctaaagcaggtttgcttctgaagaaaactattagc

SEQ ID NO: 271174 - DNA, 468 bp, Homo sapiens
gaggcttagaagattaatgctgctctgaaaacctagattttggaggtattcaaattaagcatggtatgtaatcttcctgggcttgctttctacaaaaatggactcaaagtaggtaactattttgatcaccattttatctatggaatacgaagtaatttacacaaccagaaaattttgttttgatgggatgtgattacatacaatcatggcttaagactattttgcagctgtgacttaataaatccatgctatactatcaaaatcagagtagcataatcatcgtgcacttaaattcatactaaggagaaatctccactctcacagtgttagagagagaattttggttaaagattagcaaaattactattgcttcatcttaaatacatcttgctcttactgaaagtttcaatttcctgttcccttacattctttatgctgcagtgatggaaggggcttcggtttgcaaca

SEQ ID NO: 271175 - DNA, 353 bp, Homo sapiens
taggagattgttttttggctttgaaatgtaatattttttatagtgaacttattaaaactactactttcttccataatctcctggaatggcccaccggctttctctcttggttcattgcagctatagcaccaggctttcttgacgaaggtcttctctcttgaacggagtctactccttaaaaagttccatgggtcacctttattccactttgccatatcaagcattgtaactgctactcactttagtccccttagccaggacgcgtggggaccacggtcttacattttctcctagtaataaagttagatattactaattatgccagtgcattctgatggatcaaagcatgcagg

SEQ ID NO: 271176 - DNA, 605 bp, Homo sapiens
ttggctgggtataaatactactgataaaaaatacctcatataaaaacaggtagtatcatttctaactaaatttacgcttaattccaacagggcagagaccactgtctatcttgttcactactcacctatgtctaaattcactggccagtacacacttagcactcaataaacactggttgctcaactaattgctgtttctattagaaatcttaatttcaaatgtcttaaacttagtatcccagtgattgataaagatacaccaaagcagtggcttggtacacttacatttgtaaagagaaaattcaaaacagaacaaaatacttcttacatggacatcagttctaaactttctacattccacattgtcatttccatataagaacctatggcaacgtatgaaaaggtcttcaattctgcaagctttttaaaaatgcaactaacttaatgcaaaggcccaggtactctataaaaatacacctaccaactgttctaactccaaatatttcttaaaaaacaaatgtgatagtcaagaactttaaaaatattattaatcacctttgtcatgattctccctcttatatatatacaatagtggcaagttattc

SEQ ID NO: 271177 - DNA, 651 bp, Homo sapiens
  misc_feature (97)..(97): n is a, c, g, or t
  misc_feature (114)..(114): n is a, c, g, or t
  misc_feature (203)..(203): n is a, c, g, or t
tagctgttctagaggatcccggggcttcaacggaacttaactggaagcttctctcactctccagaagagcttcccatgcacctgatgcatgggaaanataatttgatcattttnaagttacagtccaaatcttttgtacctgaataacatgttgcccagtcagtctctcttcctggattcacaagtctttcatggtagatccngctgtaatcccagctacttgggaggctgaggtaggagaaccccttgagcccaggaatatgaggttgcagtgagctgactgtgccattgcattccagcctggacaagagaccctgtctctataacaaaaattctagggaatatcttcagttagagctggtttgtaggagttaaccgttgatctatgtagggacaaggttctaggagaaccaagatgacggagggcagctgggagttgtgtggagaggtaaggctggcaagatgagggtatttggcagtgatctgatgcaggaaggaggcttgcacatgataaagctaagaaagtcttgtggaatgaaagttccgttgaagccgtcgacggcttcaacggaacttttccaaggctgtacagacatggcggcggctttcggaaggcggctaagtccggcagggggacacagagagcgaagc

SEQ ID NO: 271178 - DNA, 610 bp, Homo sapiens
cgtggtgggtcacgactgtaatcccagcactttgggaggctgaggtgggtggatcacaaggtcaggagttcaagaccagcctggccaacatggtgaaaccctgtctctactaaaaatacaaaattagctgggcgtggtggcgcgtgcctgtaattccaactacttcggaggctgaggcaggagaattgcttgaacccaggaggtggaggttgcagtgagccgaggttgcgtcactgcactccagcctgggtaacacagcaagactccatcccaaaaaaacaaaaacaaaaacacacacagtttgttttagttttacccttggtagggaagggacagacaaagacacacagccttttaagataaatgctagcatacagtacaaattttttccaccttattttttttccccgcttaacaatatatccagggtacaatccagggtatagcaggatatagtgatagtcttcattcttttttcaaagctgaatatattacagtttattcaattagtcatctattgctgaacaattcagttgtgtagtctttagctattataattcgttgctggaccttctttctgtatctttagcggtagcaaatctctgctact

SEQ ID NO: 271179 - DNA, 759 bp, Homo sapiens
agggatcatcttccgggagcgtggctaggggcggagcgactgccgcgcgatagtcagggagctgtgcgggtcctggttgcaagagaggaaggattaaaggaatggagggcatcataaacatgaagaaaaatgtgagagagtatgataattgaaagaagagtttgtgttcaaagggagagattaaagatgtgcaacttcagaccttggccaaagtgaaacatttcaccaagattcaggctgtgagaaacatcttgcctacccacctgaccacaaggcagacaaaggcccaacggaagaaacattcttatcataccctactcggcaaaggcccaacggaagaaacattcttatcataccctactcggcaaaggctcaactaaagaaacatctctatcatattctgttgggagaaagtgcaaagaaacaccacgttctggaggaataagagccagaactgcctcatcatgggaacatcttatgaatatcctgccgggcagccagctatatggcccagatctctgccgctcagacccattaagtaccccagcctgtaagcggcggtgagctctgtctggccctaagttagttggccctcaacttccgcaggtgtctgcaatatacctgtgttgctgtttgagctgccccctctctgtgtctttttttaaccctcgtctcccttcaaaacctaacagtaagcactcaattcttacttgttgaactaaatgaatgatagacaatgaccaacacgaccccacgcaa

SEQ ID NO: 271180 - DNA, 418 bp, Homo sapiens
tggctgttatgttaaaaaatacagttttgcgtcctgccttttctcctcagcattacgtaaatattttcctgtgtcattaacattcttcataaacattgtttttgatggctgcgttctattctggtctatggatctactagggctgagttcttagcttgtgagttggacacctggtctcccaggtgggagaaagagccccagctgggaggtggggtctgcccacatggcaggccgtggcactcaccctggcagtcctcccctgtgcattcctggctatgctacatcctgcccagtcctgtggacatccagcattatccattcccctctttgagcttctgcagccctgggcatgaattgaaggctctttcaggaagccttctctagtcacccagcttggtgtggccagtgggtatttgcc

SEQ ID NO: 271181 - DNA, 521 bp, Homo sapiens
tactacccacccagactaatatcattttaaaattacattctatgaaaggtaacataacttgtcgaaaccagtgtaattttacctggagagactcagtggattggctacctgaggccaccatttctttttccatcctgttataacagagcattcagctaattatctttaccttagagctttcaggaagcagaagatttctcagtggatgcagggtactcagttactcctatttagcaaaaacaaaaacaaacaaacaaaccggtagcattgggtgagcacataagccatgtgaaaccagaatgctcagaaaagaaacctgatttgtcaaaatctattgggataaaagactttttagaaaaggaacatccaatgctggccaaggatgtgaagaaagaggcctttccgtacattgctgatggagttacatatggataaaatttttctggagagcaacttggcaaagcacatgaaaggtgctttaaaaactatgcataataccctttaactcagcaatctgtcct

SEQ ID NO: 271182 - DNA, 393 bp, Homo sapiens
gtgaggtggaaacctgcttgcaaggcccccactctttgctgagagctttcttttcacttaataaattccgccctcttcccccttcagggtgtctgtgtgcctaattcttcctggtcatgagacaagaacctggattagctgagctaaggagcaaaaaatcctgcattactagcagagaatagaatcatggttatcaggggcttgcagtgtgagggatgtggaaattaggtcaaaaggtacaaaatttcagttagatgaaagatagcaatatttataggaggatattcttttaagcacagagttcttaaaatcagctgacttccctttagttatgtatacctaacattgaacagttgatttttgaaaattttctgtgaactcaaaagaaaaaaa

SEQ ID NO: 271183 - DNA, 325 bp, Homo sapiens
aaaaaataaaagtgaggtaactgccagttacagtgtatcaggatctgagttcctcgtaggtattgtctgtggattcacttttccatgatgtttctaaccctatatgttagctaattgaaatatgtgagaggtgttgaacaactttagagcaggtaaagaaatattttcagacttttctagaatgatctgcaaaatgcaatacttgccattggaagcattcttcatggctaaaatgcagatgtaaattcatgaatggtggcagtgcatgctttctttatattaataaggttgttataatttaggacagaaaagtaaaaactgggtc

SEQ ID NO: 271184 - DNA, 242 bp, Homo sapiens
ccagtaatacattgccctaaacagagtgctatgaagcatacaagagaggtagacagactggattggtttggtatttttaattatatgtcataaaatcggttgcatactgttgaattttcttgccctacctagattttccccagctttgttatacctttcttgaagtaatagttgtccctcagtacctgtaaggggattggttctaggactcccctcaagtaccaaaatccgtggatgcttaa

SEQ ID NO: 271185 - DNA, 414 bp, Homo sapiens
tgcctgaagatcagctggtatggctggctgagatggagctacctgttgcaagaatatactcctaagttaggttgcagtttgattactgagtttttggtacctcttagattttgtacctgggacaggttcctcacctcactcaccctggccctgttcctgagacaaggaatagctccttttaagatgctgattatcatgcttctgccttgctgggcacacccacactggttgtaatactcaccatctcttcccattttcacatctggactcttcttctcatgcccctcaacccttaatccctccctttctttgtactcttgcttctcttctgtccaatctttgtgtccatctcccaaggccatctcccatggtatattccccacctccccacgccagccctatgcagtctcgcca

SEQ ID NO: 271186 - DNA, 462 bp, Homo sapiens
gtcagcttttggtccagtgactcactcacagaaactccaagacagattaaactagcaagagttgaatatctgaatttccaaaattatgaggctacaaaaagaagcatagattaaagttaggaccaaatgctgctcagaaattgttttaatctcaaaagtagttggcaagttttcagagttcattttcaaggcctggtgtatgtgaaacaactgaacattcagagctatttcattttcaaagattctcacatccaacagagagaagaaggtcatacgaagacacgcagaatttggacttatgcggtcacaagtcaaggagtgcttggagctaccgggagatggaagagtcaaggcaggattttccctggaagatttggaaggaacatatttctcctgaaaccttgattctagccttcactaatgacagagaataaatttctgttcttttaagccaaaaaaaaa

SEQ ID NO: 271187 - DNA, 728 bp, Homo sapiens
  misc_feature (41)..(41): n is a, c, g, or t
  misc_feature (51)..(51): n is a, c, g, or t
gggctgcctggagtcgggtacggtgggcggggagcaaacanggcaggaggnaaggagccactccaagtggctgagggtccccgatggccgcgctgtccaggtggtactctggctggcttccccgcctcctccacagctgcagaggggccgctctgccaggaccccctgcctggctgggacaggcccctcttcccaaggaacagaatgactatttaggtgagaggggcccactggcgctgctggggtggggaatgtgatgttggcgatctgcggtatcttcagggtgacagccatacccaacgcgtgggacctggcttccacatctatagacctgacctaaggaaatatgtgggcgtgtgcataaggatgccatctcaggactgcgtattaataaaaagctgaatcaaacagtgtccaacaagggtggctgttccagctggttatggaatgtgtttaccatggacttccaggtcctcctgagaaatgacgacctagatgtgggaagatggtctcaacgtattgttctgcaaaggagaaaaaaagcaggttgcaaaacactgggaactgtctgcccatcttcgaaaagtaagtcatatatctagaaaaatctggaagggtagtcacaaaaacatcatcagtaggtactgtggagagggtggatttcacgttattgttactttccccttttatattaatttttgtgcaataaacatgtgtatttgtaatca

SEQ ID NO: 271188 - DNA, 338 bp, Homo sapiens
gaagtaaaataaatagctagacgacctcggcgccaccacctcgccctggtggttaaaatatcaataatattaacccctgaccaaaactattggtgttatctgtaaattccagacattgtatgagaaagcactgtaaaaactttttgttctgttagctgatgtatgtagcccccagtcacgttcctcatgcttacttgatctattgtgactttttcacgtagaacccttagagttgtcagcccttaaaagggctaggaatttctttttcagggagctcggctcttaagacatgagtctgcctatgctcccggtggaataaaaaaacctcttccttcttt

SEQ ID NO: 271189 - DNA, 400 bp, Homo sapiens
gtctttcatatactcatcatgtttgttttgtacttgctctttgtctcaaactttgtcaagggatatgaatatgagtaagatgcagctcttcacttcccagagctcagctattaagttcttcttcacaccggtaatcccagcactttcagaggccagggcaggcggatcacgaggtcaggagttcaagactagcctggccaacatggtgaaaccccatctctactaaaaatacaaaaattagccaggcatggtggcgcgtacctgtagtcccagctactcgggaggctgaggcagaagaattgcttgaacctggggggcagaggttgcagtgagctgagatcactccatggcactccagcctgggcaacagagcaagactctatctcaaaaaaaaaaaaat

SEQ ID NO: 271190 - DNA, 661 bp, Homo sapiens
tcgcagttgtaggagcagcaacaacagcagcagcaacagcagcagaagcatgaggatggagactcaaatggtacttgcttcgtttaccatgctatctatctagaagaactaacagctgttgaattgacagaaaaaattgctcagcttttcagcatttccccttgccagatcagccagatttacaagcagggccaacaggaattcatgtgctcatcagtgatgagatgatacagaactttcaggaagaagcatgttttattctggacacaatgaaagcagaaaccaatgatagctatcatatcatactgaagtaggagtgcggcgtttcgtgcccagtggctgctccttccttcacctctgaaaacggccctcttgaagggggatatgaatggagatttgaaggtctgcaagaacctgactcgtctgactgtgtgtggaggagtccaggccatggaggcagaatcctggccctctgtgttggcccaagctcttgtggtacacacagattactgcccaatatgcagttctgcagctgttttagttaaatttctggaccttgttgttgttaaatatcagtagaaactctacataatttagagtgtatgtagggcataatgatgatgggaattgtgtgatgtttaacaggaagatcttaaatttt

SEQ ID NO: 271191 - DNA, 911 bp, Homo sapiens
ctgacttatttcacttaacatagtgttctgcacttccatccgtgttgttacaacatgacaggattttttttcttttttttttagtagctgaacagtattccatttcgaatatgtactgttttctttatccattcatcagttgatagatgcttaggttggttctgtgctttggctgttgtatagagtgctgcaggaaacatgggtgcaggtatctcatcaacatactgatttcagttgctttgggtctataactacaagtgagattgctgggtcatatggtagctctatttttaggcttttgaggaacctccatactgttttctataatggctgtgccaatttacatgcccaccaacagtgtacaagggttcccctttctccacatcctcaccagcacttatctcttgtctttttagacgatagtcatcctaggacatggtgaggtgatttcacaccgtgggtttgatttgcttctccctggtgattagtgtcggacaccttgcgtatgcctgctgaccatttgtgtactgtctttagagaaatgtctattcgtgtcctttgcccatgttttaattgggttatttgttttttgctgtcgagttgtgtgagttccttacatattttggatgttagccccttattagatgcatggtttgcaaatattttctcccagtccatagactgccttttcatttacttcattggtcactttgctgttcagctaagctttgctatgtgaggtagtcccacttgtttatttttgcttttcttgcctgagccttggggggtcacactccaaaattgagctatagagagaaacaattttggagctgcctccaggaatagaagactgagataatttggactcactttctggttgaagacaaatagaaaagctagcaaaacatttt

SEQ ID NO: 271192 - DNA, 138 bp, Homo sapiens
aaagactcagatcaaggcagcatctctctgagcaaggaatgaggatccttctatagaaaagctgggacctggctagtgtgtctactgaactgctctttcaaagttctgcactccctccacacggggcttgagtttcca

SEQ ID NO: 271193 - DNA, 346 bp, Homo sapiens
gggctaggagttcaagaacagacatgcaaagggcttaatgccagggataaaatacttccctgtgccatggtagtccacccctctctttcccaaacccctaaccgtgtatgccattgcaggttcctaaatatgtaagtgcgtagagaaacttatggcagaaactgatagcacggtaacttacagaagaaggtggggttgagtgggaatatgtaagatttttactttttactttctacttgtttattttaaaaacattttgcaggccaggtgcagtggctcatgcctataatcccagaactctgggaagcagaggcaagaggatcgcttgagactaggagttcaagac

SEQ ID NO: 271194 - DNA, 286 bp, Homo sapiens
acagtctatggtggtatttttgtccatccaaagtgaaatgagaaaaataaagatcgtgtatattgtctttaattacaaagtaaacataatgtttgtgtaatgttataaggcttcctgctgccctttatcaaagagccccccctttatttggagtatggaaacacatacttggtttcccttagcactgctagattgccctccaaaaatgtctttttgtaactgaccctcttactggcaaggcatgagggttccatgtttgcccacacccttgcctccatctggatta

SEQ ID NO: 271195 - DNA, 289 bp, Homo sapiens
ccatccaccctattccccattccccaccacggtctatctggagccccttgagtcaagaccccggttcccagaagtcacaggagcagaaagaagaagggactaaggagccagctcatggctgtgggcccagcattaggggctgcaggaaggagaacagcttgatccagccaccataccagcctctgtcctcctcaccacaatactagactgacacctggaccagctcttcctgaacctccagaatggagaaaataaagttcctaccaaatggtggaggcagtgacacagt

SEQ ID NO: 271196 - DNA, 488 bp, Homo sapiens
gcaggcgctcaggcacaccccgacatccaaagcagactcctgggcgcgtccggaaatcccgtcggaaaaggcgcggttgccatggcgccggagatgctccccaagcatcctcataccccgcgggacaggaggcctcaggcggacacctccctccatggcaatctggcaggagcgccccttcctctgctggccggtgcttccacccatttcccctccaagaggttaataaaggtttgctcctcagcacccccccgcccaacccggcgtttccatacggtttgttcacaggccctttctaggccggtggtgaatgctcacttacattgaccgctgcgagggaattgttcggcgagtgctgcccatcttcaaatcaatgcctgctcagaacaacagaaagggcctcagatgtactggtttccacagaaccattgttaggcttttgtgaagcatttttgaacctaataaataatgtcaaaagtcaaaaaaaa

SEQ ID NO: 271197 - DNA, 393 bp, Homo sapiens
ttaacatcacagctgcctgaggtagagcaaataagagactggcaaaaaaaaattgaaagtcttgagagtgcagtggtgataaggggctttaaaaagctttgacatttggctgggcacgtttctcacgcctgtaatcccagcactttggcaggccaaggcaggtgaatcacgaggtcaggagttcaagaccagcctggccaacatgatgaaatcccatctctactaaaaataaaaaataaataaactggcaaggcatagtggcgggtgcctgtaatcccagctactcaggaggctgagacaggagaatcacttgaacccaggaggcggaggttgcagtgagccaagatcacgccactgcactccagcccaggtgacagagtgagactccatctc

SEQ ID NO: 271198 - DNA, 339 bp, Homo sapiens
ttatgtgccctgctcccctctgcctgccccttctccctgtccccaggtctcccctgtggtgggggatgcaggtcccgttttcctatggggcactggctttggagaccacccctgccccgacccctgttctctgattctatctaagtgcttaatctctccccccgacccctatcctctgattctatctaagtgcctaatctttcccagcggcagccctgggagacatctcctctctcgctatggggctgctgggatctgtcttcccaacctgacacttcacaagtctgtcccctctactttatcctccccctaagtaaaactccttaaaaccgcgttcct

SEQ ID NO: 271199 - DNA, 528 bp, Homo sapiens
aacagcaggtcatcagcaccactgtgagctgacctgagtcaaaactgattatcacctagcctggtggatcacagtggcgtttggggtccccaaaatgagtcaattctggaccaaagtctagtatccttgagaagcctgggtacattttctctgttgcatagttaccctgctaagtgactgtagatccctttggggaaagctaagaggaaagtttacagtgtatctttttggcagtataataggatatttccccaaggaaaattggcctgggaagtggatggctctatttgatgaacaaggccaggcctctattcaccagtcctgcactggtgaatagacctttggcaagactccattggaagaaaaaaagcatgcttaaaaatcagtaagctttggccacgtgcagtggctcacgcctgtaatcccagtactttgggaggccgagttgggaggatcatctgagccaaggaattcaagaccagcctggccagcatgggaagaccccatctcattaaggaaaaaaaaaaa

SEQ ID NO: 271200 - DNA, 227 bp, Homo sapiens
caaagggagaaacccagagctgaggccggtctgcagcaggtgccgggcctgagacctttatgttgtctgagggaaacacctccatcccctgtcaggctcagagtgtccttttttgttctgggaaccatttctgtgtcatttgtgtggaggctgaagttgcccggggtcgtcctgcaaggcgtctcccagagcgaagtccctccgacgtgccccctggtgatgatgtt

SEQ ID NO: 271201 - DNA, 379 bp, Homo sapiens
actgctgtcctatccccatgtccaccccttctcctcctggacctcacggccgcgttggatgtgggtgaccactccttctttcttgaaaccctctgacctctgagatttggtcccctctcaggccaagacttcttactcttcacagaccggcttcttcctgctgcccctgaaaccatgatgttacccagggttccagcctcagctctccttctgctcatggccttccctctcctgggtgatgccaagcacccccagggctttgacacccagctgtctggggattcttccccctctcctccacactgtccctccagcctggactccaatcaatggcagcctgccagacacctccgtctgggtattccacaccacgttcaaa

SEQ ID NO: 271202 - DNA, 710 bp, Homo sapiens
agagagcctggaaaagtatgtgtctagccaaagcaaatgggattctgtgactggcttccatcaaggcagggcaggttgcctcctggacaaatcagagctctgggagaaagcgggaggggaaggtctacaaccagtcatgcccgctgcaactcatggagccacatggagaggagacaacacggtgaaattgtcaagagcaggagctagggctgaatctggaaggccacttaccagtgcagagctttgggtgtgttgcttaacctccatgtactcatctgtaaaatagagctaaaaacaatgtttctcttcctggactgctgtgacggtctagaagagtttatgcacagaaagtgcatttacatgtaaatgctccgtaaatgctgacttcttgtttgccttaatggcagaacccatccttccatattccagaaaaagacttgatttttagttacgtgaatggacacctaaccctgatggacagcttggggtcgggggacaagcttctttcttggaaggatgttcaaaggaccatgaagcttttggttttgccaactggggtttgtaagttgaagaacagagctgagtaattcaggacaggggtgtccaatcttttgtcttccctgggccacattggaagaattgtcttggaccacacataaaatacacttatagtaacaatagctgatgagcttaaaaaaaaaatcacacac

SEQ ID NO: 271203 - DNA, 366 bp, Homo sapiens
actgactaggatctccagcaatgtggaattaacatgatgacagcaaacattcttgtcttattcctaacttaaagggtgaactttcagtgtgttagaattatgtgagcttacagtagatttttaaaatgtatatcccttttctatgaaggaattttgctatttctttttgctaagagtttttttttttaccttggtaaaattcaacatttaccaacctaaatgttgaatttatttatttatatctatttattaaattaatgtaatttaactatttttggcagagagtctcactctgttgcccattgtagtgagccaagattgcaccaatgcactccagccttggtgacagagggagactccattatc

SEQ ID NO: 271204 - DNA, 449 bp, Homo sapiens
atttttagtagagacggggtttcaccttgttggccaggatggtctcaatctcctgacctcgtgatccacctgcctcagcctcccaaagtacaggtaagagccaccgtgcccagccaatagatataaatttttaaaggaggtatgagagatcttcaacccttcacctccccatctcctcctataactgagtagaagagaaagctcaaggcaggtgggggatctgttgaaggactcggtataataccctggaatggggcctgactctcctcactaccaggccagggcctatatgattttagtttttctgttttctttttttaaaaaacttaaataggtgtatgtgaaaaagcagcaagttcctgctctactccatctgcccaagtccttccagggccaccagtgtcttttcattgttttgggatgttttttgtttgtgtttttgtttgttt

SEQ ID NO: 271205 - DNA, 576 bp, Homo sapiens
tgcagaaattcaactcagtgccgcaataacaggatgcacctgtagatttcgtagaattagcagcagcattctttcaataccagtttgagagaaataaccctgtttgcatagtgccaactggggcagaatctgaagtgtcttgcctgcctctcggccatgggaggcaccgatctcagcaacatctatccaaccgccatccacttaacaagcaaagatggaaggccctcgtgctccaggctatcctgcaatggttcatttgcttttgatgggattatcactttgacagatgtgcttgcaattaactgggggctttctgcttccaatccaaattcccacaggtggatcactggctcttggggagcaaaaacccttctttgtttgtttttgcttctcccagagcctgggcagagctccccattcctggatcctacgttgatatgcactgaattgaattatactaaagggtgcacccaagagtgcatgagcgaagtaaaatgtaatttgtgggacctcatgtggacatttcaggtccgtgtgtacaagataaaggagagaaaatcctgggggacaccacag

SEQ ID NO: 271206 - DNA, 282 bp, Homo sapiens
aaaaaataggaagaatgtagactactctgctctcagatcaaattaatattcctttttttgcagtttaattaggcataaataaaaagccacgtgaagcctggagatactggacatagcagatttgtcaagccatttttcccaccaccagtgcctgagcacgacctcatttgtcttggtcaatgaagctcaaggaagcattgcactttggcttccgctttaagttttgtatgttgatatgtatcccatgtcttctaacaataaagtgctatttcactgacatta

SEQ ID NO: 271207 - DNA, 347 bp, Homo sapiens
gatatacaggaaggagagcaggataaagactgcccgctcaagaatcatccacttttggccacgttggcttcagctctgctgctccctgccctgtgtactttgaagcgaactggggctggttttataagaaaagggagaagaggtgccctggaagttaagtgggtcccagggggtagctgcacccagaatgggggtgggggtcctggttctgtggatggagtaggaggaggtctggctgaaggagccaggccccatttcctaccccaactccacctttctttgtcttctccctccccccttccccccctcactcgcaataaaaacataattatggtgctttatagaaa

SEQ ID NO: 271208 - DNA, 474 bp, Homo sapiens
ttttccccatgttacacatatttattccttctctatattctacatagcatttatcaccttctaatattctatataatttattttttgtttgttttggcgcctccccacacacataccagaatgtgaaccccataaggatagggagtttcatttgtgttgttcaccactgtatctgtagcacctagaaaagtgcctggcacatagtaggagctcaattaatatgcacaggatctatgtacattatatagaggaactcagttaatactgaaagcatggacaaatatgtagaaagtatcttttaaaaaatgtcatcccacattatttaaatacaagtaatgtttaaatcataacatctaaaagatcataataaaaatcactaatacgtcatttgtatttttgacccaagattgcccaaagggaaatatttttaaaaagaaagagagaatatgcaatgtgtatgatgaatgaataaac

SEQ ID NO: 271209 - DNA, 375 bp, Homo sapiens
ctctgccacctctattttgaatgttctcagttccctccaggctactagaagcatctgggccagggctcatggctagataagcacccgagatcccaaacaagcttcccatcctcgttttactttttgttaaacttatgaaaatttattaagatatgacttacatccctggtaagtgcacagctcaaaagacattcagagatggaacacaccagcccccagatcacaaagccaaccatgcccagcccttcccagcacccccagccctgaaacctgacttctgacgacaccatgagcctgcctttatactttacactcatggaaggataaccatcttcatgttgtaaaataaatgtttactgttgaaatgattttaca

SEQ ID NO: 271210 - DNA, 544 bp, Homo sapiens
ccactatggacattaaattggtccagcaccatttatgagaaaaaccatccttttctcagtgaacttcagtgaggcctttgttgactgtgggtgaatctgtttctggattctattctgttcggtgatattatttgagtttcaccactgacccacagtgcaatcacagacgaaaatttacctttcttataggaatgaatagctacataggatatttgtacaaaaacacttatttgttgagaaactatttctgggcactttataggcatgataacatttcacactcactataaccctgttggggtaggtcccattctacagacaaagctaaaacttagagagatagagtgcaatgctcggaaattaaggggtggcagaacttgagtgtgggtctgcctggccacaggactgatgcccttgccactgtgccattcttcctcaacataggattaccgggaaaactactgttcagtgattattcctataaactcttacatttctgtacagaagtgaattttgttttcttacaaattaggtgtttccatta

SEQ ID NO: 271211 - DNA, 409 bp, Homo sapiens
gtgaaacccggtctgtactaaaaatacaaaaattagctgggtgtggtggcgcacacctgtaatcccagctacttgggaggctgaggcaggggaatcgcttgaacctggtaggtggaggctgcagtgagcctagattgtgccattgcactccagcctgggcgacacagcaagactgtctcaaaaaataataaatagaaataaagggcttagtaaacacccaaaatataaactactttaaaaaggtgatcttgccgggcgcggtggctcacgcctgtaatcccagcactttgggaggccgaggtgggcagatcacgaggtcagaagatggagaccatcctggctaacacggtgaaaccccatctctactaaaaatacaaaaaaattagccgggcgtggtggctgggcgcct

SEQ ID NO: 271212 - DNA, 495 bp, Homo sapiens
cacgaggaggaggcccagcccacctctgcctgcacctgcggtcagcggggtgcagagtctgtgaaggcacctcccggagtgggggctgcaaagatcatggccactgtgccacccacaggggcccaggccggacgcctgggctgtgccgcctcggcagccaggccgaggaacgtgcaggtgcggccgggagcccgccggccacagctgcatccatgcccttctccgagtggtgatggcggggagaggcctggctgtctacgggcagattgcttgggctttcacagaagcccgctgttagagcagattcccggccttgggtctctctgctccagctggacgccctgagcctcgccgggcccagtccacccccgtccactctgccaggggcagctcagagccctcgccacgcggggctgagcgcagggaaggcagcatcacggagttcgctcggctccacagaacacccgtgttgctcgcggagactttttgtttttg

SEQ ID NO: 271213 - DNA, 648 bp, Homo sapiens
tccctaggtaactcaggtcttccttctggaggacctagaagtggtcttaatgccattaacctggtgtctgatatgccagaagttaagtgtgggctcctgagtgtccctcacgcctcccatttcccacatccctggctgcacttgcttgttctgattgcttcatttgtttactgacaagcactccagtacgttcatctctcattctttcactcagtgtcacgaactgaaagtttgtgtttccccaaaattcatatgctaaaatcttagcccctaatgtcatggtgttagtaagtggggcctttgggaggtagttaggtcataagagtggagccctcatgaatggaattaatgtccttacaaaaagacacaagaggccaggtgtggtggctcacactgaggcagggagatcttttgaggccagcactctaggaccagcctgggcaacatagaaagaccccatctctacaaaattgtttttaaaaaattagcagggcatagtggcatactcctgtagccagccactctagaggctgaagcgggaggatcacttaatcccaagagttggaggttactgtgagctatgtgggccactgcactccagcttcggcaacagagcaagaccctgtctcttaaaaaaaaaaaaaaaaa

SEQ ID NO: 271214 - DNA, 460 bp, Homo sapiens
tgagatggagtttcactcgagatggagcgcccttgtcgcacatgctggaatgcaatggcacagtctcggctcactgcaacctccacctcccagattcaagcagttcttccacctcagcctcccgagtagctgggattacaggcgcccgccaccatgcccagctaatttttgtagtcttagcagagatggggtttcaccatgctggccaggctggtctcgaactcctgtcctcaggtgatcctcccaccttggcctcccaaagtgctgggatcacaggcacgagccaccacgcccggcccccgctgccatcttttctttccaatcagaatcttccaatttacactacgccacattcccacacatgctttcccttcaaccttctttttttttttgagatggagtctcgctcttgtcgctcaggctggagtgcagtggtgcgatcttggctcactgcaagctc

SEQ ID NO: 271215 - DNA, 433 bp, Homo sapiens
atctctctctttaatggcagatagtcagataatagaacaataaatgttagtaatgttatattataattaaattatctgtgtcataaggcattcagcacattcaaaagataactcacctagcatgtttttaataagccttggatggcagaggccccttaccctttgccggtcacccatctgctcctgatctgagtcaaggtgaagcttggtttgtgtttccagaccacctccagccacagtagagacaacagagatttctaaccccctagcaaaagaccctacatagtgcatttggaaggttaggaggaagaaaagtagttaagaagtctgaagttagggaccctggccctgaggcctgtgggacttggatgaaggacacactctaagcaagaacatgagacttgtgtgcatgtggaagtgggtccattccagg

SEQ ID NO: 271216 - DNA, 119 bp, Homo sapiens
ttccacctccttaacactaaggtgaccttaaacctgaattattgacgtcagatgacatgttgccacttccacatggattgggaaattttcttctcagggccactgacctgcccctcttc

SEQ ID NO: 271217 - DNA, 233 bp, Homo sapiens
aagccctagatcagatacttctgtccaagtatcccagatcagatacttctctccatatattctcttacagcagctgatggagccttttggtggcatctaagctggttgcaatgtggttactctaacaatgcatacactttctgcaaattagagcttctttgttattttgtaatatttgaaataaaaagtgaaattgattccaaactgattcaacattaaatacgccaatgaaa

SEQ ID NO: 271218 - DNA, 497 bp, Homo sapiens
acacatgacatactcttagatgggaataactggtattaatcatccttcctctgtcaaactaacacctaaattactataaaattactatactatatcatgccacactatactatactgtatttactgtaaaaactgcagaggaaaatgaacttggtggttaaattaatcacagcatttgtctagattctgcaagaatgaattcatgaggatggatttaaaagctttttcaaggccgggcgcagtcgtcacgcctgtaatctctgcctcccaaagtgtcgagattatagctgtgcaccgctgcacccagcctaggggacagttttataatcagtcttcttggccttcagaggactctgctggtggctatacccagctagtggcttgttctctctttccacttttattgccctgaaattctaaatattccatcattttggtagaagaaaaccagaccaaactaaacattctcatgatttcatccaccttttaaaaaaaaa

SEQ ID NO: 271219 - DNA, 468 bp, Homo sapiens
tagacgttcaactttgtaacttcaccttagtctctgagggccacagcttcatttacatgagaacttgaagatttttagtgttatgcctactctgccaattcttggaacatttgcggaactgagaatttacttcttcgtttattacttcctaactacattttaaagactcatttgttctagattcagatcattcaacaaaacatggcatgatttccacagtctctgacattctgattgcattgcttgagaaaattctcagtctgggaatctccttaaaatgcagcacagatgatggctgaataggaacagctccggtctgcagctcccagcgagatcaacgcagaaggcgggtgatttctgcatttccaactgagggtgtaacactgtgaccaacgaagagagtgttttctatcagtgactcgcagacttccctttcactggaatccagcttattagctgcatggttaa

SEQ ID NO: 271220 - DNA, 481 bp, Homo sapiens
tgttagtggactttaagcatgaatatcaaacagcagctaaccactttgtgcaaaaactgactttctattttgaaagccacttgagggagctctacctcattgtttaattatgttagctatctcctcctcttcctcaaggaagacttcaaaatgaactgtgactgacttcgtttctgtttcactgccaccagaaccttccctgcacggtaacatttttccattttgaagaaaacaggctcttctcaactttggtcattaaccattgtaaaaatacttttgcttcattcatgctttctgggatttttatatctgtgggttaagctcactccagttgggttatttagagtatgcagtgttttataatctttttctttcagctccaaaagatgtgctccttcctcataaaccataccctgaggtctctcagagcgaacctggtaaattaattatttcatccttctggctaagaagtatatttttc

SEQ ID NO: 271221 - DNA, 252 bp, Homo sapiens
attcactgaacgtttgtgccctctaaaatttatatgttgaaatcctaacccccagtatgatgacattaggtggtgaggccttgggatgtgagtagctcataagtgtggagtcttcatgaatgagattagtgtccttataaaacagaccccagagcctgtaatcccagcactttgggagaccgaggtgggcggatcatgagttcaggagatcgagaccatcctggctaacacaatgaaaccccatctctacta

SEQ ID NO: 271222 - DNA, 377 bp, Homo sapiens
atcgaggctgacggaatcctggacatgggctggcatcacgggccatcttctacttgagatatttttcagataacacaagtatggaaaaaggaaaaagcaactgtattgaaatctcctaaatgcagcagatttggagcctgcaaacacttcttttagggaggaggcagtattgctcttaacctagaaggcatcctcaatggtctttgagacgtttggaaacgtgtgcacaagtgaaattattttacctacttctcttgaacgcatgatgtctcatatccaattttatttctaaacatttcttttaaaaaatagttatttctgtgcacttctgattctgttactagtaagaacagtaaaacctgattggctataaaaaa

SEQ ID NO: 271223 - DNA, 342 bp, Homo sapiens
agcactgtcccttttcgttggactcacaagaaatgtgttggacctgagccttttggactcaggagggaaacttgagtccatacctaaggtgtaaacaactgttacactccatttcaagaaattttataggaattattttatagtagcaggatactctgagaataatcccaatatttataaaaacttaatggctaaaaagtagactcaaacttccattttaaaggtttaaaattttttcctaaaacttaaaagtaggcagtgaaatttggttgtatctttggagaactctttcaccacataaagtattattttaaaactccccgtaaggggccttcatcgcct

SEQ ID NO: 271224 - DNA, 467 bp, Homo sapiens
taaatcatgctcctgttttcatatattatgagcaaagtgctgttatctgagagtatcagctgactcagaccattcagttcagggattcctctaggctcctgagtaggggcttagatagggcaaattctgatggtcttacaagggaaccccagtccttcatgtcataagagcatctctgcctatagcttcatctgatctcaacacagagaactaataaggtagggacatggcatgatttggacttcaggaatattactttcctagttggaaggatggataataggagcaatattacagtctagaaaacatgttacaaagatattgcaattgaccaggctagagagaaagaggaactgaacaggagaaatgacggagaagagatatacatttgagtaatagtaggaggtaaagtcagtatcccttggtcattcactaaccatagtgggggaaggagcagaaaactcttg

SEQ ID NO: 271225 - DNA, 432 bp, Homo sapiens
taaatcatgctcctgttttcatatattatgagcaaagtgctgttatctgagagtatcagctgactcagaccattcagttcagggattcctctaggctcctgagtaggggcttagatagggcaaattctgatggtcttacaagggaaccccagtccttcatgtcataagagcatctctgcctatagcttcatctgatctcaacacagagaactaataaggtagggacatggcatgatttggacttcaggaatattactttcctagttggaaggatggataataggagcaatattacagtctagaaaacatgttacaaagatattgcaattgaccaggctagagagaaagaggaactgaacaggagaaatgacggagaagaggtcgacgcggccgcgaatttagtagtagtagctagtagtagtaggcggccgc

SEQ ID NO: 271226 - DNA, 698 bp, Homo sapiens
atgactgtttgtcattgggccctgacctcccttgtcatcctgatctctagctagccttcagattccccctcccatgacacactcccaatatgttccacacactgatcccctgatgtgtcatggtgattcctggctgtgcctttgcctgatgaagtctaactcattaatcaagactgggttcagatgtcagctcccttgagaatatgtctttacctgcccctccttctcacacacacatactccttcaatctcccaggaagaaagcatctcttactcctcttgacgaccacccaaccttagcagtatgtttatatgagcatgtcacttggcatgagttctttttccaatttgactaagagctcttttagtgtggggagggttggtgttgtccttattgtagttactgccagggctcagcctcagagcatcagacagaactctgagataggtgctgtaaattttagaggtatgtgctctaaaagttagctgaatgaatgagagaaaaccagaaagaggtcttatgaagcctcaggtgataggaaccagctattggattcttttaaatgacctgcccctcttggattcttaagtgtattattatttcattcataaacccgttttgagccccatttttgtccattgtaagtgctatcataaatacaaagatgaataaaacttagttttcactgcctcaaaaa

SEQ ID NO: 271227 - DNA, 405 bp, Homo sapiens
aaattatttatctcctctttatactccataggatttagtataacttaaatgcaattttatttttatattcaccaatatgtaacttcatcaagtttccatgacaaagtaatttcttaatgggaatgaaaatactgtcacctgtagtcacaactcaataaagcaataaacagcagtaggattctgaaaaactttttttatattgacacatttcattttctccctttattctaacatttatgtggcagggattttagaggcaggacacacacacacacacacacatatacacactggaccaattaccatcaattcaaggtctttactttgtactggaatatagttttgtttttgccataaagatttttttccaacagaaataactcaggaagaataaaaaagaaagtt

SEQ ID NO: 271228 - DNA, 101 bp, Homo sapiens
tcaaagtgataagcataaggaattaaaactttttcaacagcaactttaagtggcatacatctttggaaaaaaattaacagacaattctggcaaatcatgaa

SEQ ID NO: 271229 - DNA, 322 bp, Homo sapiens
taggaagtggccgagctgtctgcctgcacacggggctcccacccagaactggccacagggacagggacactcagggagccccccaagagctggccccagggacactcacggccacgcctgcggccccccataccatggcccttcatggcgtctacttcctcctgagcatttcagctgactccactctgtcctcacccccctttttgtgtctcacggtccttgcttaagtccaagtcacgccctctcactgtctcttacacacatctctatcgctacatgtgaggtctcttaactactttctggaatacagaacataaataaa

SEQ ID NO: 271230 - DNA, 387 bp, Homo sapiens
tattagattgtattgacttaaaggttgagtacatgtgaaagaccatagcctttggaacagccgcagaataatactcagctttaatttcatatgggataaacgtattcaattcagaatactataaatatgtaagcagaaaactgaattgtgagtaagttattaggtaacactaaacatacataaaaattccatcattattgggggtcagtttctcaccttttgtttgacattccttagactttaacaccatgtctaatgatttctacttttccttgggtttgctggtatgattgtctttactaagatttttattatactgattttaaaatgaatttccatgactttgttgaattttattgtacagctatttaatcagtctatcctgag

SEQ ID NO: 271231 - DNA, 435 bp, Homo sapiens
cagttcaagaacatcagacacgctcaacaaacacttgttgcttgactgatacattatggcgggtaacgcgtcccacgtatttcttcttagagatatacattacgctatacgtttctgaagaatggctcgatttacaggggttcccacaacgatttgtcacatataaaagagtgggtggtatttttacgtcaaagatgaacaggcgaacgtccatctaaatcgtgtggtatcagatgcggggaggcgtgggggagggagcgggggagaaagcgttaattcttccagctttagagccagacgtaatatttaaaacgtggattgtttttcaaattaacttttaaatggacacgacagcaccttatcctgcattaatattgcattgcaactagaaagaaaaccagtggaggtacgcctatctcctctctagttggcaaa

SEQ ID NO: 271232 - DNA, 402 bp, Homo sapiens
ctgacctaagattctagacctatgacccagaacaggctgattctatagcgacaaacaaatttagccccaaagcccttggttctgagcactgcagatggtaaaccgggggaaaactttgtccctacaaagtgccacaagtggagtgtcctctggaaatctcatagcaacgaccattttctccactcctcggcacataatcttctactgactcacaagagcaagacccttgggcataggtccttatttgctagctgagctatcgttgcagaaggctgaagaggagagaaacagtaattcagtgtcatgactctttgctcctctttgttttctctagaattagtaaactatgaagagattaagaagaaagcagctgggccaagaataaggcctccaaagctcttt

SEQ ID NO: 271233 - DNA, 358 bp, Homo sapiens
caatcctcccacctcggcctcccaaagtgctaggattacaagcacgagccaacacgcctggctcagatgtctgttgaattgggcatttgcagtgccatgtctgtactaataattgctaccgtgtattcattgctcgctgcaggcctctcggaagcacgtgacatgttatgttgtttaattctcacaataaatctaggtggtatttccccccatttacaggtacagaaacctcagagagcttaagtaactttcccacggtcactcactgttgttgttaagtgaaagaggtgacagtgaactcaggttcagtcacttcagagttgttccttttttttttttttcctgagacagtcttgct

SEQ ID NO: 271234 - DNA, 346 bp, Homo sapiens
tctctagcctgggtcacagagactgactctctctgggggggaaagaaaaaattagaaaacaactgtcatgctgggcgcagtggctcacgcctgtaatcccagcactttgggaggccaaggtgggtggatcacctgaggttgggatttgagaccagcctgaccaacatggagaaaccccatctctacaaaaaatacaaaattagccaggcatggtggcgcatgcctataatcccaggtacttggaggctaaggcaggagaatcacttgaagctgggaggtggaggttgcagtgagccgagatcgtgtcattgcactgcagcctgggcaacaagagcgaaactgtctc

SEQ ID NO: 271235 - DNA, 471 bp, Homo sapiens
gatcattattatatttctaaaaactgcttagtgatctaaaacatctagaagccgtgatatttaaacagatctggtacaaaacaggaagccagtggcctggtgaattctcacacttggagaccagaagtgaaaatgttctgcctgcccagagtagcagcaggccagcaaaacaacaggtgtggccgggcacggtcgtcacgcctgtaatcctagcactttgggaagccaaggcgggtggatcacttgaggtcaggagttcaagatcagcctggccaacatagtgaaaacccatctctgctaaaactacaaaaattagccgagcgtggtggctcgtgcctataatcctagctactagggaggctgaggcaagggaattgcttgaatctgggaggcagatgttgcagagagctgagattgtgccactggactccagcctggagacagagcaagactgtcaaaagaaaaaaaaaa

SEQ ID NO: 271236 - DNA, 431 bp, Homo sapiens
atctttagcatttctgatcttgatttatttatttgtttcttgaattcttggcctcccaaagtgctgggattacaggtgtgagccatcacacccggccacaaactagtttatttctgatattgctggggcaatccagtcattttgtgaagtctgtgatgcttaaaatagaattgctgacagctggggtgggtctgagttcatcaccactacaactgagctgttgcagctgtatgtcagcagacctaggtttagctgactcatcctggctattaggatgagctggggtgctgcttcttgttggggagagcagtcctgatggttctgcagtattgtttttccaatttatgtagactaaaaggattgtaggattggggagagaaaaatggagacttttttcctaaagagcttgagtttgaacggtactgaaaaaa

SEQ ID NO: 271237 - DNA, 639 bp, Homo sapiens
acagctggaaatgctgggacgtgcagcatcctatactgcaagtaggccccatgaaacaaccctaaggcaagaaagcatccactatgctcagagaacagcaaggtggcccagttgggtagagcagagtgacctgtaggaagaataatggatgtcaggaggattactctggatgctatgctgagaagaaactgaagacaatggtggaagtgggaaagcttatgactcagaataactatttctaataacaaattttaagttctcttcatgcagagcagctgacacaaatcttcaactcattgatgatggcatctgactgttccaggtattaagaagagagaaagaatctgagaaattatggcgtactcaactgtggacagctgaaagtctggcatagcgtgccctcatcatcacaaatgggctcgcattacaagctacacttatttgacaactatcagcatttgtcaaccggcactcagatttgaagactcatttcacagctggagcaagagaagacaggaaggaaaaatcagagtaaggtttcaatgagtttctgcaaattctcagaagttttgctgccactcagtgtcacaataacaaaaagaaataaaaatagctgatatttactaaacaaaaactctg

SEQ ID NO: 271238 - DNA, 584 bp, Homo sapiens
acagctggaaatgctgggacgtgcagcatcctatactgcaagtaggccccatgaaacaaccctaaggcaagaaagcatccactatgctcagagaacagcaaggtggcccagttgggtagagcagagtgacctgtaggaagaataatggatgtcaggaggattactctggatgctatgctgagaagaaactgaagacaatggtggaagtgggaaagcttatgactcagaataactatttctaataacaaattttaagttctcttcatggtattaagaagagagaaagaatctgagaaattatggcgtactcaactgtggacagctgaaagtctggcatagcgtgccctcatcatcacaaatgggctcgcattacaagctacacttatttgacaactatcagcatttgtcaaccggcactcagatttgaagactcatttcacagctggagcaagagaagacaggaaggaaaaatcagagtaaggtttcaatgagtttctgcaaattctcagaagttttgctgccactcagtgtcacaataacaaaaagaaataaaaatagctgatatttactaaacaaaaactctg

SEQ ID NO: 271239 - DNA, 990 bp, Homo sapiens
gcggccgcgtcgacaaaaatacaaaaattagctgggcatggtggcagacacctgtaatcccagctacttgggaggctgaggcaggagaatcacttgaacccgggaggcggaggttgcagtgggctgagatcacaccactgcactccagcctggacgatagagctagactctgtctccacaaaataaaaaattttaaaaaataaaataggccgggcacggtggctcacgcctgtaatcccagcactttgggaggctgaggcgggcgaatcacaaggtcaggagatcgaaaccatcctggctaacatggtgaaaccccgtctctactaaaaatacaaaaaattagctgggttcggtcgtgggcgcctgtagtcccagctactcgagaggctgaggcaggagaatggcgtgaacctgggaggcagagcttgcagtgagcagagactgcgccactgcactccagactgggcgacagagcaagactccgtctcataagtaaaataaaataaaatgaataaaataaaataaaatataaaataaaataaataaaaaataaataaataaaataaaataaattgagagtgcctagatggcagggaagatgccagtggagatgactgatgctctttgggatctcactcgatagttttggagattacaagtgtcattcagggaaaatgaggcacctctgtgacttttctattctctatcagatgacaatgaaagttatcctgattgttggccaggcgaggtggttcacgcctgtaattccatcactttgggaggccgaggcgggtggatcacctgaggtcaggagttcaagaccatcctcgccaacatggtgaaaccccgtctctactaaaaatacaaatcttaactgggtgtggtggtgcacacctgcaatcccagctgctcaggaggctgaggcaggagaattgcttaaacctgggaggtggaggttgcagtgagccaaggttgcgcaactgtactcca

SEQ ID NO: 271240 - DNA, 444 bp, Homo sapiens
tgtcttgttttagtttgttggttggttgggtttttgttgtttttcctgggatatggacacattcattattttttttaaagttgtattattctgctctataaatgttcagtaaatatttatttagggagaagccacgtgctcagtattggggtaaaaatggattatagtagttctcaccctagaggtagtcataggctgtaagacaacatttttcaaaccattggtcagatcccttcgcagcttcaaatcacagtgactccctggagatctgggtgactgataagccccctataccctctctgtcagcctggcccagcaccatgttcaagttagggaaggacatcacccttcagtgccgaggacccctgccaggtgttgaatttgttctagaacatgatggagaagaagcacctcagcagttttcagaggatggagactttgtca

SEQ ID NO: 271241 - DNA, 391 bp, Homo sapiens
ttcattaaccacgaccattacaagtcttgttaacatattttgtctatagcctgcaaggaggaaaacatgattcttctctatcaccttctaattaggtatcagtaactcaggggtggccctggggctcatcaacagctccaccattgctctcagagtttggttcctgttcctgtagcttccatgacagtgattctctttacccaactcaccgcacccatggcagtgattctctttacccaactcaccgcacccatgacagtgattctctttacccaactcaccgcacccatggcagtgattctctttacccaactcaccgcacccatggcagtgattctctttacccaactcaccacacccatggcagtgattctctttacccaactcaccg

SEQ ID NO: 271242 - DNA, 422 bp, Homo sapiens
acagtgaatgtggaaactttgcacgtgtttggatgtattgattgccttaactggcagctctttgcactgccagcttccctcaattacatgaggaaccacgagggggcaatgtcttcccgagcaataatagctgagtggtggtcttaggaccccgtggtggcccatgatgctagcactgtgtctttggccattcttgcctgtcatggagcatactccacagaagggcatggtcttcttggatcccggcatgggcccaacaaaaatgacaatgtagtcaatagttccactcagacctcacttaggagcaggtgaactatgttgtgtgatatcaggatgcccggagaacctctcctatccccacccagggaagcatggcttaattccaaataaagaatctgatttctttgtctttaaaaccaagc

SEQ ID NO: 271243 - DNA, 888 bp, Homo sapiens
ccagaggctcgtaatattcaaaatgtccaagatgcaatgcagaatcacgtgaaatacatgagtcaggaaattttcaacaattcaaagacaacagacactaaccccaagatgacacagatgttggaattatgagacaaagactttagatattataacactgtttcagaaagtgaccattccagaaattgatggaaatgtcaaatttttcagcaggaaaatagtaatttgactcacttctaataaatagaatatgatagaagtgatgtgatgtcacttaaaatatttggttatgagaagactgtggcttctgcataggcatgtgctctcttgaatcacttgtcctttcagaaaccagttgccttatcgtgaggacacggcctgtggagagttccatgtagtaagtaactgaagcccatggcccacagccagcaacaaactttggccttctagcaaccatgtgagtgagcttagaagtggatcctctcttgcctgagccttcaaataggactgcagccacagccaactacttgcctgtaacctcatgtgagacgctgagccagaaagacctagctaaaccactcacttctggcttcttaacccccagaaactctgggttagtacgtgttttaactggtaggttttggggtaatttgttatgcagcaacagataactgatacagaacttggtacttggaggtgggcagctgccataatgaaaacccaaaatatgggaggggttttggaacttggcagtgggtgttaagtaggcatgcgctggtaaaaacctcaagtgctttgaagaaactatagcagcatcatgtctgacaaggctgtagatgaggacttctagaagagtgaggtaaatgttattggaaaactggaggaagg

SEQ ID NO: 271244 - DNA, 478 bp, Homo sapiens
tcaaaggttattacatatatgtcatatgcatttgaatgtgttacatactcaatttgtaagccacttaattggaatgtgacatatatcttcctatagaaatgagagttaatagtgcctacattctcaggctagccctcaaaagcctattaaacatctctttgaggaaacactgggcaatggtcaaattcagagctctggttctgatgatgtaaaacgaggttaggccctctgaggcaaagattggaaatgaggtggtagggacagagtcaagcaatgtctctgaggctctcgtgctatacaaaggaaagagctagggctttgaactcaaacagactagggtcatgtcagatttaccagttactagctctgcagtcatcaagaaattatgttctctttgccttcacatagttacctgcagaaggggaatggcttgggagcactgtgaggatgaagtaaaacagcatatgcaatgcacctc

SEQ ID NO: 271245 - DNA, 514 bp, Homo sapiens
gaaaatagggagtgatgtgtaaattaagccattccaagttttaacaatttaggggccatttgaaggtctttgcaggagggaatactcggatagcaaacattgtggtagttgtaaacatgaacagtttttaatgtcaagtcagggagtcctaaccaagccacaataatgaattttactcagctctggaacaagaattttgaaatgttatgttagttgttttacggtatgttgctgagcgtatgcgtgtgcacggttggtgttaagaagggcgtataatctgctgggctttctctattgttgattgttgctaataattctctggttgaagaaaaatatttccttttcaggaacgtattgggaatatatttgaggtgagtaaaggtatatattcttttttgtgcttgggcagaagtactgagtttttactgtttaattgtaataacataaatctaaactattgatacattttgcgtatttatgtgtatatctatgtgtatagaaagtgatacatatg

SEQ ID NO: 271246 - DNA, 364 bp, Homo sapiens
atattaggttttcttggccactacctgtgctgctaagttgaagggcaatgtcttttaggatatttggtcacccctctatttatacacagctccgaagaaacccagcactggacaaattctctcaaacttttccccaagcttggccaccaatctgttttagatgaagactccatttggaggaaatctgctaattatctgcctggctttcaggaaaacagctttatgcattttactggaaaaatgcttttgccttggtagcattcccaaaaccaagtcctgcgactctgtctgaaatcatgctaaaacagaacagaactcagaatcttactacgctcactctgcaaaataaaagcagtacctgaga

SEQ ID NO: 271247 - DNA, 1097 bp, Homo sapiens
gctgcccgcacgccccgacgggagctgcgcccagcctcccctctggagtctgcactccaggcttcttcccggccggtggccaaggccccagcaccacggtccctcctgcagggcatccagcacctacccttccactgggcggctcctggttctggtcccggctggctcactcaggctgcctttggaccagattcttgaacttttccaccaaggatgttgctgctgtttgtagcgtcggatcctggaaaatcgctgtgttggggagcagcaggctctcccttgctcccccagggcctgggaaaatcaacccacctctgccccccgaccccagggctgtaacctggtgtctggtagccccactgtgataaaccgaagcccagcacagtttgggactcgccccgagttgacttatgcagcccccagaacagaggctgaaacccggcgcatcctggtgaagccacacccagccggcctggtcccaggccccgggcacggggtcccctccactcccatctgcttccctttcagagccggggctgagtcggcagggacgcaggctcagggccctggattcccgctttctggacacttgcgtgcatgcccagcaccagctcgcccttctgagaaagcaatccctcctcagaggggagaagccgtggctgtgatgggcaggaagtggtcaggacccactgccgagcaccaactccccatgccaccaccaggggtgcgcctggactcctggaaaggggtcgcgtcagggtgcagcccatcaaaggcttcccaagaggcaagaggcaaggagaagtgtcctactttaaacggccagcctcagtggtcggccctgttcactctgccacctcagagagagtgaacccagcagaggtgtgacgggaggctggggagagaccccagcaccttgagcacacaggagccaggaggagcccaacagagcagcaggggctggggtcttctcctgaagcctgactccatgggaccccaaagaagcagatggaaaactgaaaaagaaaacccctcaagtgagccactggaaagaaagcaaaacaagagaaaataaatgagttgtttgacataaaaaa

SEQ ID NO: 271248 - DNA, 408 bp, Homo sapiens
gtttgccagaggatgttttcctcagtgtctgttcgaccttcagcttttttggtcttccttttacgctgcatctgagctggtctgcctccacgttcttgcgccttacaccgatctccagtgtcaccttggtttaaggctcttatctcataggagcaaagaagggaagaaggactcagacagggcttcgtgtctttccaaaaggatctactgtccctctcctccagggggaacagtaagggacactttctcagtacccacacccttgcctcaatcttttttgtaagcatccaatgaaatctgtggagaagagcctgtgagtggatacaaactccccctgtgtctgcagccccccaggcgatctctgttttcttgctggtccacactaagttcattaaattttaactgaat

SEQ ID NO: 271249 - DNA, 491 bp, Homo sapiens
ctttgctgtgtgtatacattcaaaaagtaatgtatatatgcatatatattatttaaaaagtcaaaatgtatattaaatatcaaaatattgtgtatatacgtgtatacatacacgtatgtaaatgtgtatatacatatgtatgtatgtgcatagatacacttacatacatacatatgtatatatacgtttacatactatgttttgacatttaaaacaggctgtaattacaggctcacacctgtaatcctagcactttgggaggccgaggcaggaagatcacttgaacccaggagttcaaaagcagcctgggcaacatagtgagaccttgtcgctataagaaaatttaagaaattagctgaatgtggtggtgagtgtgtgtagctccagctactggggaggctgaagtgggaagatcacttgaaccgggaggaggaggttacagtgagccgagatcatgcctctgtactccagcgtgggtgacagagcaagac

SEQ ID NO: 271250 - DNA, 250 bp, Homo sapiens
tatcccaatcacactgattgatttttacaaattgtgtaaatgtattaaaatatcatatgtggatgggcgcagtggcacatgcctgtaatcccactactttggaaggccgaggccaaggtgggtagattgcttgagtccaggagttggagtccagccagggcaacatagcaagaccccatctccacaataaataacaaaaaattagccagacgtggtgcccacctatagtcccagctacttggtagactga

SEQ ID NO: 271251 - DNA, 537 bp, Homo sapiens
gaaaccatacacagaggaagtttgccatcagctgaagagtgcttaactgaggcgtggcgagcagactgcacagttcttgccaacatcagagttaatttggtaaatcttggcatctgctttccttcagatatttacctaaagcctccatctgcctctaaatatagatggatgagaagttcagcatcatttaagacacattattttgcacttggctatatataggaatgtactgttgtataagtagccactttaatctggtttaaatttaatttggctcctggacatgcgtatgtatatgttggttaagcatttccttttcctacggtcatctttcaaagtgcacgttgcttaaacatataagggcttacttttctcatgtaacaggaattcaaagtgggtgtttgctagtggtggttcagtggcttgaggatacgggggctgaggtctctgatattctcttggtctgttcctcatggtctcaaggtgggtgcaacaattctagccatcatattggagttccaggcagaaaagtggaag

SEQ ID NO: 271252 - DNA, 814 bp, Homo sapiens
gtaaaactctgtctctactaaaaatacaaaaaaattagccaggcgtggtggcaggcgcctgtagtcccagctactcgggaggctgaggcaggagaatggcgtgaacctgggaggcggagcttgcagtgagccaagatctcgccactgcactccagcctgggagatagagcaagactccgtctcaaaaaaaaacaaaaaaaacaaaaaagaaaaatatgggagacatattaacagcaactgctgttaatggtttctaatagatcccctcagaggtattcattccaagtacacataagcaaatgcatgctttttattttttcacataaatggtggtatgttgtgcaccttgttttttatttcacttaactaacagcatttcttagcgattatttcatcagtatacaaaatgattcctcattcttttgtagggatgcatcgtattctactgtatatatgtatcataatttattggtccttttgccggacatgtagattatttccagtattttgctattacaaacaatgctgcaataaataacacgtcattgctattacaaactgtttgctattacaagccatgctaaaatgaataacatgtaattcccaacaagtgggcatgtatctgaaaaacatctcttcaagaagtaaaatcactgacttaaagggcatgcacatttttaaacttggtagatactgtccaattgtgtcattttaccctcctactaaaaatgtatgaatgtctgtttctctacatctcaccaatagaatgtataataaacctcattgatctttgacagtttgagaggtaaaaata

SEQ ID NO: 271253 - DNA, 430 bp, Homo sapiens
ttctgctcatctgtgtgtagttcttgtttttaagcttccagagagacactgattcctagctagtttctaaccctagcatacagcaagatggaaagctcaggacacaagattaaagtgacagcctggagggcaggacagggagtctgggctgtggctggagcacccatcaccattcctgggccacaagccgccttcagggactggcttcctgttctcccaggccccgctgtggctccttggccttagccccaggttctcaacatgaacagactgtgaactccttgtgaacagcgatgagttttgtacattcccctaactggggcctctctcccgcagtgaatgagtaagtgacagacacagttatactaaagttataagttatgtccagcaaaagagaggcattgccttctctgttgtcatctgtcctccc

SEQ ID NO: 271254 - DNA, 935 bp, Homo sapiens
  misc_feature (1)..(1): n is a, c, g, or t
  misc_feature (42)..(42): n is a, c, g, or t
nttccggccgcagagctccaccgctgaggccaacgaggccantagtttatttggcaattcataaagatagggactcttgagaggaggttgagagcattgtagggttatgtaaagacttccagaagctgtaaagacttccagaagcaagaagattcaaccatctaaaacgccatgcaggaaaatagccaaaccttctccatttaagtagagaataaatcttagtagcgttctctgcagaatataacaacgctgcaaaaaggccatttcacaggaatataatcaaaactgcagattctcagggtttcccgtaagacgacttctctgctcttctgtttgtggtttcttttttagttgtacatctctcctagacaagtccaaggaactactaacgagaagatttcaggaagaggcctacagcaattgcttggtgcttgggttcatttgcggaatcttggcaacaggtctacagagaagcagttccacggcaaaagagctgtggggcagttgaataatccatccaaacaatgaggagtaaaccctgagtcaagaaaccagcaaaaagcagaagactgggtcagcaaataaagggagaagatccttgcctccttcagtgcccctagcatgatattctgaaaggccctccactaaaatacaactacagttttaataaattactaaaatagagaatagaagtagtatgtaagttgggatagggtgatctgaattaagtgttttaacattcatgaactgttcaggacaaaagctgtaagatattggttaacctcaacattgttaaattaagtgtgcactgtagtatcaaagatactcataagaatggagagagtaattttctaaatagtggagggaaaataggaattaatttttttcaaaagtgggacttaggttgtctaaagaaaggccaaaaaaagcataaa

SEQ ID NO: 271255 - DNA, 860 bp, Homo sapiens
  misc_feature (1)..(1): n is a, c, g, or t
  misc_feature (42)..(42): n is a, c, g, or t
nttccggccgcagagctccaccgctgaggccaacgaggccantagtttatttggcaattcataaagatagggactcttgagaggaggttgagagcattgtagggttatgtaaagacttccagaagctgtaaagacttccagaagcaagaagattcaaccatctaaaacgccatgcaggaaaatagccaaaccttctccatttaagtagagaataaatcttagtagcgttctctgcagaatataacaacgctgcaaaaaggccatttcacaggaatataatcaaaactgcagattctcagggtttcccgtaagacgacttctctgctcttctgtttgtggtttcttttttagttgtacatctctcctagacaagtccaaggaactactaacgagaagatttcaggaagaggcctacagcaattgcttgagttgaataatccatccaaacaatgaggagtaaaccctgagtcaagaaaccagcaaaaagcagaagactgggtcagcaaataaagggagaagatccttgcctccttcagtgcccctagcatgatattctgaaaggccctccactaaaatacaactacagttttaataaattactaaaatagagaatagaagtagtatgtaagttgggatagggtgatctgaattaagtgttttaacattcatgaactgttcaggacaaaagctgtaagatattggttaacctcaacattgttaaattaagtgtgcactgtagtatcaaagatactcataagaatggagagagtaattttctaaatagtggagggaaaataggaattaatttttttcaaaagtgggacttaggttgtctaaagaaaggccaaaaaaagcataaa

SEQ ID NO: 271256 - DNA, 210 bp, Homo sapiens
gacatcctgccgcgtcactgcacagtgcgcgcgggccctgagcacccggccatggtgcgcccgtcccggggcgccccagtcacgcacaacgggtgcctcctgctgcgggaggctgagctgcacccgggcgacctcctggggctgggcgagcacttcctgttcatgtacaaggacccccgcactgggggctcggggcctgcgaggccgccg

SEQ ID NO: 271257 - DNA, 1964 bp, Homo sapiens
  misc_feature (1961)..(1961): n is a, c, g, or t
  misc_feature (1963)..(1964): n is a, c, g, or t
ctactgtgaggggatgaaggtgctccctgcatctggccttgctgtcttcctcatcatggctttgaagttttccactgcagccccctccctagttgcagcctcccccaggacctggaggaacaactaccgcctcgcacaggcgtatcttgacaaatattacacaaataaagaaggacaccagattggtgagatggttgcaagaggaagcaattccatgataaggaagattaaggagctacaagcgttctttggcctccaagtcaccgggaagttagaccagaccacaatgaacgtgatcaagaagcctcgctgtggagttcctgatgtggccaattatcgcctcttccctggtgaacccaaatggaaaaaaaatactttgacatacagaatatctaaatacacaccttccatgagttctgtcgaggtggacaaagcagtggagatggccttgcaggcctggagtagcgccgtccctctgagctttgtcagaataaactcaggagaagcggatattatgatatcttttgaaaatggagatcacggggattcctatccattcgatgggcctcgggggactctagcccatgcatttgctcctggagaaggcctgggaggagatacacatttcgacaatcctgagaagtggactatgggaacgaatggttttaatttgtttaccgttgctgctcatgaatttggccatgccctgggcctggcccattccacagacccatcagcactgatgtacccaacttataagtacaagaatccctatggattccacctccccaaagatgatgtgaaagggatccaggcattatacggacctcggaaagtattcctggggaagcccactctgccccatgccccccatcacaagccatccatccctgacctctgtgactccagctcatcctttgacgctgtgacaatgctggggaaggagctcctgctcttcaaggaccggattttctggagacggcaggttcacttgcggacaggaattcggcccagcactattaccagctccttcccccagctcatgtccaatgtggatgcagcttacgaagtggctgagaggggcactgcttacttcttcaaaggtccccactactggataacaagaggattccaaatgcaaggtcctcctcggactatttatgactttggatttccaaggcacgtgcagcaaatagatgctgctgtctacctcagggagccacagaagacccttttctttgtgggagatgaatactacagctacgacgaaaggaaaaggaaaatggaaaaagactatccaaagaatactgaagaagaattttcaggagtaaatggccaaatcgatgctgctgtagaattaaatggctacatttacttcttttcaggaccaaaaacatacaagtatgacacagagaaggaagatgtggttagtgtggtgaaatctagttcctggattggttgctaaatagaaaagcctagtcttctcaagcaatgaggatgactacaagcagcctctaactggatcttaaggactaaagcagaatgtaggagagggattcttccaaaggccttcaaatcaaattagaattcactgagaataataatacttccaatttttttcatagttgtataatcagaatttcaatccacattagaaaagtttttatatgggcaactttatgcgaaatccaaatcaacacaatgcactctgcagttagacaccattattttttcttacctaatatactgaagcagattgatccgtttgatttttatttccaggaggaagactagtggtggattccatgacatatattgtaattcttttcataggaaatgtcattacagtatgaattataattatttacaagcaatggcttttgtggccatcatttggccatcatttgttataataaatataaatttcccaatttttacttaaaagacatcacaacacaaanann

SEQ ID NO: 271258 - DNA, 2008 bp, Homo sapiens
  misc_feature (2005)..(2005): n is a, c, g, or t
  misc_feature (2007)..(2008): n is a, c, g, or t
ttttttttttttagaccttgacaatttttctttaatggataaaaggcaaaaagatctaggaaattgcttttcctttgagccctggagacctggttattaggcttctgattatcagagcttctccccatcttctcagtgcctagagacccagatcccccaacagcttcctggggtgctaggaatctggccccaggggatctggagggtgggaagcccagaaatgggcacaccattcaaaatcagtcagatttcacctgaggcacaaaagacaaatttcatcccaagaagctttcagccagctctatccatttccaggagggggaaagcaccagatctgcctgacccttgagggacaggaaaaatgccatgaatgtctccatgtcacaaactcagctccagaaccttggtggcagtgttccaatgggaagcgattcctgtgggccaccgagaagggctgagctcaaacacttgcctttggaggtccttgtgccctggaaagtcactgccttcggatggccactgtcactcagccaggaggcaaagcacatatttggcacagctattatgacacagatatcaaagaagttctataataaaataataatctttagaagacttactatgtgccaagcactctgctacctgctttacaggaattatttaattctcacaacagccttctgaggacctcggaaagtattcctggggaagcccactctgccccatgccccccatcacaagccatccatccctgacctctgtgactccagctcatcctttgacgctgtgacaatgctggggaaggagctcctgctcttcaaggaccgcacagagagaaagtaacaaagtattttttaaaaagcaaaatttacccagaatcccaccacctggagtgtatcagtctgcaggagctgctataaccaagtaccatagaccaggtggcttagacaacagaaatgtattcctcacagttttggagggtaagaagttcaagatcaaggtactgcaaggattttctggagacggcaggttcacttgcggacaggaattcggcccagcactattaccagctccttcccccagctcatgtccaatgtggatgcagcttacgaagtggctgagaggggcactgcttacttcttcaaaggtccccactactggataacaagaggattccaaatgcaaggtcctcctcggactatttatgactttggatttccaaggcacgtgcagcaaatagatgctgctgtctacctcagggagccacagaagacccttttctttgtgggagatgaatactacagctacgacgaaaggaaaaggaaaatggaaaaagactatccaaagaatactgaagaagaattttcaggagtaaatggccaaatcgatgctgctgtagaattaaatggctacatttacttcttttcaggaccaaaaacatacaagtatgacacagagaaggaagatgtggttagtgtggtgaaatctagttcctggattggttgctaaatagaaaagcctagtcttctcaagcaatgaggatgactacaagcagcctctaactggatcttaaggactaaagcagaatgtaggagagggattcttccaaaggccttcaaatcaaattagaattcactgagaataataatacttccaatttttttcatagttgtataatcagaatttcaatccacattagaaaagtttttatatgggcaactttatgcgaaatccaaatcaacacaatgcactctgcagttagacaccattattttttcttacctaatatactgaagcagattgatccgtttgatttttatttccaggaggaagactagtggtggattccatgacatatattgtaattcttttcataggaaatgtcattacagtatgaattataattatttacaagcaatggcttttgtggccatcatttggccatcatttgttataataaatataaatttcccaatttttacttaaaagacatcacaacacaaanann

SEQ ID NO: 271259 - DNA, 345 bp, Homo sapiens
gttggggagattccctgggacctgcctctctgctgcaggcaaaaaacctgagaaacgtttattctatttgttctgtgccctatatcgataacttttctctgttgaaaaagtttgctttgagtataatatttatttttagtaatgtactgtccccaaatttgaataatgaagatactgttccctaatggtcaagtactatccagactcagtgtgttaaaaagaaatgggtcaggcatggtggctcacgcctgtaatcccagcactttggtaggctgaggtgggtagatcacctgaggtcaggagtttgagaccagcctggccaacgtgatgaaattccatctctac

SEQ ID NO: 271260 - DNA, 635 bp, Homo sapiens
caatttgagtcatattttcattctcttgaatcaaagggtcacttaacaaacatgatttaattatatatgtcttgcctgatttttagtcacagagaaattccgagatgaaaactctggaaaggtgtcattaactcaaggaagacaagggcagagttaggctagcaactagacactctgtgtacagtttcatatacaagcaagactttcctttaatattgataaagaattgagtatcatgtatgcattcccttttatgatatacaattaattgtaagttatttccccttgtatgcaaccatccacatttttcttctgaccttttcctcaagtcttacaactacttttaatgactgcattttggaggtggtcccaggagaacagatgttgccttataatggtgtttttccatttttttctttgattgggcaagggggttggaagtattatttagtcattatatggattcctctaaaaattgttcaatagaatatgtattcatttattcacttacttattgtttatttattgcctagagtatacccaacactgaggatacaataatgatcaagacaggtctaatttctgtcccatagagcttaaattgtaattagaaagaatttttttaaataagcaaa

SEQ ID NO: 271261 - DNA, 787 bp, Homo sapiens
  misc_feature (19)..(19): n is a, c, g, or t
ggaggaaaccgcgcttttnttgggtgttcacggataatgaagctgatgtgagagccctggagagaaacatcagtcaaaggcatagggaatcccatccagcgtccctctactctcctctgcagcttccatggttggaatgctgagccattgctaggacgatgaggctacaggaaagtgaaatgcacctgctgcgatctgatccaactgaccactcctgctgctcctcccttgcacctcaggcatctccttccaatctggaggaaacacttttacctccacttttcttttacagtcctccaaactctgttccttctagggagcacaagtacagaaatagaaacctggactcccttcatcctgcttcacaaacttacaatgttaaagaaagaaaaaaaaaaagaccaagtacattacctggtagaattggagagatgggcacgaaagagctgtaaatacagttagaaaacacactagcatttacaaatgtgtatgagaaacaatgaggaggattttcagagactatcataaccatttatttttctaatatgtgataagtaaacgcacagaaaatcaatttaatatttggggcttttatttctcattttttagattgccagaaagactgtccagtgttataaagtttgtgtcaatattctggaattggcaattttgtcatttatatgggagaaatagctaaaggtgtagtataaagtatttgctcgtaggtaatggaatgttacctttacccaaagatataaaaaataaacggtagaacaaaaactcagag

SEQ ID NO: 271262 - DNA, 1127 bp, Homo sapiens
  misc_feature (19)..(19): n is a, c, g, or t
ggaggaaaccgcgcttttnttgggtgttcacggataatgaagctgatgtgagagccctggagagaaacatcagtcaaaggcataggcaggttgtgaatacaaacctcacttgtttccagacagattcttcatcataatgattaggacaatgacagtacaaacattctcatcctacaaaaataagtaatcacaaccacaccttatccaatatctgtacagcaattgtgccatacacattaaattcagatttttataatgtaatttaatctgtatttcaagccacaatcttgctgaagttcataatgttttgttccaaccattcttgtaatcccctctggtgacatgccatggtgccagcatcttagttgttcccatggcactagtaggtggaggcatcgagactgctgtgtcctctcttcttgcagggaatcccatccagcgtccctctactctcctctgcagcttccatggttggaatgctgagccattgctaggacgatgaggctacaggaaagtgaaatgcacctgctgcgatctgatccaactgaccactcctgctgctcctcccttgcacctcaggcatctccttccaatctggaggaaacacttttacctccacttttcttttacagtcctccaaactctgttccttctagggagcacaagtacagaaatagaaacctggactcccttcatcctgcttcacaaacttacaatgttaaagaaagaaaaaaaaaaagaccaagtacattacctggtagaattggagagatgggcacgaaagagctgtaaatacagttagaaaacacactagcatttacaaatgtgtatgagaaacaatgaggaggattttcagagactatcataaccatttatttttctaatatgtgataagtaaacgcacagaaaatcaatttaatatttggggcttttatttctcattttttagattgccagaaagactgtccagtgttataaagtttgtgtcaatattctggaattggcaattttgtcatttatatgggagaaatagctaaaggtgtagtataaagtatttgctcgtaggtaatggaatgttacctttacccaaagatataaaaaataaacggtagaacaaaaactcagag

SEQ ID NO: 271263 - DNA, 750 bp, Homo sapiens
  misc_feature (19)..(19): n is a, c, g, or t
ggaggaaaccgcgcttttnttgggtgttcacggataatgaagctgatgtgagagccctggagagaaacatcagtcaaaggcatagcttccatggttggaatgctgagccattgctaggacgatgaggctacaggaaagtgaaatgcacctgctgcgatctgatccaactgaccactcctgctgctcctcccttgcacctcaggcatctccttccaatctggaggaaacacttttacctccacttttcttttacagtcctccaaactctgttccttctagggagcacaagtacagaaatagaaacctggactcccttcatcctgcttcacaaacttacaatgttaaagaaagaaaaaaaaaaagaccaagtacattacctggtagaattggagagatgggcacgaaagagctgtaaatacagttagaaaacacactagcatttacaaatgtgtatgagaaacaatgaggaggattttcagagactatcataaccatttatttttctaatatgtgataagtaaacgcacagaaaatcaatttaatatttggggcttttatttctcattttttagattgccagaaagactgtccagtgttataaagtttgtgtcaatattctggaattggcaattttgtcatttatatgggagaaatagctaaaggtgtagtataaagtatttgctcgtaggtaatggaatgttacctttacccaaagatataaaaaataaacggtagaacaaaaactcagag

SEQ ID NO: 271264 - DNA, 351 bp, Homo sapiens
aattggggagggaaaaggaatgaatttgaagattgatacgaagtatgtaccactcagagaaaagggagtcagaattattgaatgttatgcatatttaatgctattggcaaaattgccatttttttagatgaattaatcaatgttgattttaggctaataccattaaatgttggatttctttatctccccttctgattccatggtcaccaagcaaccttctcattgtgatctggtgttctttacaagtctaactacagagaatgaatggctgatcctacagacttcaacaattttctgtcctcagacagtgatttatcataatgaattaataaaatgacttctgactttgaa

SEQ ID NO: 271265 - DNA, 185 bp, Homo sapiens
atgtgagctaattgccaaattactgatgtctatctttgattccagcaaccttctcattgtgatctggtgttctttacaagtctaactacagagaatgaatggctgatcctacagacttcaacaattttctgtcctcagacagtgatttatcataatgaattaataaaatgacttctgactttgaa

SEQ ID NO: 271266 - DNA, 304 bp, Homo sapiens
gagtgtcctcctcctcccgtcctgggaaacctcatccaatgggcaaagctgaaagggcctctgacaggcctttggggacctccttatatatatccttacgtatatacccaagataattggaaacttaacgttcacacaaaaactggtatatgaatgcttagtagtagtattcgtagtagctcaggagtggaaacagcctgagtgtccgatgacaaatggaaatgttctatagaatgtaatgaatattccatagaatggaatattacttggcaataaaaatgaatgaagttccgattcatgctac

SEQ ID NO: 271267 - DNA, 381 bp, Homo sapiens
aggatgaaaatggctttgacacattcaaggtactgagtttgtgcttaggaaacactaaccgctatgactccgtgaccaccctgtcaccttgtaccccatttttctatcctattacaggtttacgcacttcctgtctgtctcctctatgagactggagtctgcggcagacactgtatctactcagttcaccgcctcattccaagcacctagcacagcgcctggcccacagtggatgcgcaagaaacccatggaatgaatgaataaatgaatgaacgagtggacaaaccacttccccaatacctagctcagtgcacggcctatgaccagtgcgggccaatgctcgctaaatatgacctattagtaaatcagtgaaactgcaaa

SEQ ID NO: 271268 - DNA, 750 bp, Homo sapiens
gagaaagaagaaaaatagaaaaagattaaacatatatttgggagattttccaaataacagttcaaactaaaataaccaacagatgcctagttagaattaggccctttcttttaattgaagcattagcaaatgggtctatcacattttctaatacagttttgagtcatgaattaagtcaacaggtatttggttggatagaaatcatgccaacaccatgtatgtgaaatttggtgccatcttactttgaacatcactggattgcatgaaatcatcacggtttcaccatatgaaattccaatctagatggaatcagtgccaaagatgatgttattagagaattacatgttactaacatttttgaaaaatatagaaatcaaattgtggtgtgtgtgtgtgtgtaaccaaatgctagagcaaattgttttgctgaagaagggttgttatcctcaaaaagtctagtcacatacagaaaccacagtctacagaatgaaagaggatcccagagaatatgaaggttgagctctgtgtggcaaagaggagtcaagattttgccctgaggaattgctaaatgggagtcaccctttactgagatgtttgaaaagtaagcttgagggaagatgagaaagtttaatttcagactttagttctaggtacctaatggatatccaagtggagatgtgaaggagacagttggatatataaatgtggattatagaagaaaaacatctgagctagagaggaacagcaggt

SEQ ID NO: 271269 - DNA, 339 bp, Homo sapiens
cttcagttctctgagttcaagaatttgtaacatttcaccccctgctccttcctgatcttctgtggagcatcttttttccatccatgctctactcagagcccactttcccttccctgacaccagcttcactgaggctggttggaacctaacacaaaacattctcagtaatgactgaattcccacaaagaattccatatagaccgcatatgagttgaatcttctaagacatgaaatatttgttctcttcttggctaatatgcaatgcaaatcctgttgcaaatgtacgtcatatacctctgaaattcctgatgtattcaatgaaataacatctttaaagtt

SEQ ID NO: 271270 - DNA, 1017 bp, Homo sapiens
cggcgctatagcaacggtagctagctgcagggccagtggcacggtgagtacccgggaggatgggggaggatgagggtgggtggaggttgctgaccctccccactgcagcgcgggccggggtcctagggtccgctctgccgcctggagaaggccctggagttggccctggagttctgctggcgtgaaagcagcccagcccaagacacctccacatcctcaggcctgaatcacaggccgccctttatccccacgtccaggaccaatttgaaatgttatatcccagccatgaagaggccatgtctggtccaactgatgagactgcaggagacttgcctgtgaaagatacaggtctaaacctctttggaatgggagggttacaagaaacttcaacaacacggacaatgaagtctcgccaggcagtgtcacgtgtcagtcgtgaggaactggaagacagatttttgcgtttgcatgatgagaacattttacttaaacagcatgcccgcaagcaggaggataaaattaaaagaatggccaccaagttaatacggctagttaatgacaagaaaagatatgagcgggttggtggcggccccaagcggctgggacgagatgtggaaatggaagaaatgattgagcagctgcaagagaaagttcatgagcttgaaaaacaaaatgaaaccctcaaaaacagactgatttcagccaaacagcaacttcaaacccagggttacaggcaaactccatacaataatgtacaatctcgtattaacactgggcgtagaaaagcaaatgaaaatgctggtttacaggaatgccccaggaaaggtataaaattccaagatgcagatgtagcagaaactccacatcccatgtttacaaaatatggcaacagtttacttgaagaagccagaggagaaataagaaatttggaaaacgtattcaggtcacaaagaggccagatagaggaggtagagcactggcttgagatcgtgaagatcagttgaggagaacagagca

SEQ ID NO: 271271 - DNA, 717 bp, Homo sapiens
cggcgctatagcaacggtagctagctgcagggccagtggcacggtgagtacccgggaggatgggggaggatgagggtgggtggaggttgctgaccctccccactgcagcgcgggccggggtcctagggtccgctctgccgcctggagaaggccctggagttggccctggagttctgctggcgtgaaagcagcccagcccaagacacctccacatcctcaggcctgaatcacaggccgccctttatccccacgtccaggaccaatttgaaatgttatatcccagccatgaagaggccatgtctggtccaactgatgagactgcaggagacttgcctgtgaaagatacaggtctaaacctctttggaatgggagggttacaagaaacttcaacaacacggacaatgaagtctcgccaggcagtgtcacgtgtcagtcgtgaggaactggaagacagatttttgcgtttgcatgatgagaacattttacttaaacagcatgcccgcaagcaggaggataaaattaaaaggttatgataaaaagcttttagctttttttcttgactcagtaaaatttggagggtatggtattttataaacttaattgaataccccaccttgaatcttgtttggaacaaggcaggatgtaaataagtacaatttttaaaaatggaaaatcttgcaaactagaataataaaccaaaaagattatgagtgttta

SEQ ID NO: 271272 - DNA, 769 bp, Homo sapiens
cggcgctatagcaacggtagctagctgcagggccagtggcacgaggccatgtctggtccaactgatgagactgcaggagacttgcctgtgaaagatacaggtctaaacctctttggaatgggagggttacaagaaacttcaacaacacggacaatgaagtctcgccaggcagtgtcacgtgtcagtcgtgaggaactggaagacagatttttgcgtttgcatgatgagaacattttacttaaacagcatgcccgcaagcaggaggataaaattaaaagaatggccaccaagttaatacggctagttaatgacaagaaaagatatgagcgggttggtggcggccccaagcggctgggacgagatgtggaaatggaagaaatgattgagcagctgcaagagaaagttcatgagcttgaaaaacaaaatgaaaccctcaaaaacagactgatttcagccaaacagcaacttcaaacccagggttacaggcaaactccatacaataatgtacaatctcgtattaacactgggcgtagaaaagcaaatgaaaatgctggtttacaggaatgccccaggaaaggtataaaattccaagatgcagatgtagcagaaactccacatcccatgtttacaaaatatggcaacagtttacttgaagaagccagaggagaaataagaaatttggaaaacgtattcaggtcacaaagaggccagatagaggaggtagagcactggcttgagatcgtgaagatcagttgaggagaacagagca

SEQ ID NO: 271273 - DNA, 707 bp, Homo sapiens
cggcgctatagcaacggtagctagctgcagggccagtggcacggtgagtacccgggaggatgggggaggatgagggtgggtggaggttgctgaccctccccactgcagcgcgggccggggtcctagggtccgctctgccgcctggagaaggccctggagttggccctggagttctgctggcgtgaaagcagcccagcccaagacacctccacatcctcaggcctgaatcacaggccgccctttatccccacgtccaggaccaatttgaaatgttatatcccagccatgaagaggccatgtctggtccaactgatgagactgcaggagacttgcctgtgaaagatacaggtctaaacctctttggaatgggagggttacaagaaacttcaacaacacggacaatgaagtctcgccaggcagtgtcacgtgtcagtcgtgaggaactggaagacagatttttgcgtttgcatgatgagaacattttacttaaacagcatgcccgcaagcaggaggataaaattaaaaggttcaaagaaaaggtgagacaaccattgaagaatgaaaatagggtttttctgcttagaatccatcctaaggaggtggttccagttcagtttctactctgtggacttcaacaacccactggcatgctatgtgcaggccttttactttgagttgggttttagtcatgatgatggctgttttca

SEQ ID NO: 271274 - DNA, 495 bp, Homo sapiens
gacggagtttcactcttgttgcccaggctggagtgcaatggcacgatctcagctcactgcaacttccacctcccaggttcaagtgattctcctgcctcagcctccctagtagctgggattacaggcatgtgccaccatgcccagctaattttgtataaatagcacctcttaaagaggtgctttgagagtatgtttttaaatcacaaggagaaaaatcagaactacaaatatgtaaaaataaatagaaagtgacccaggccaggcacggtggctcatgcctgtaatcccatcattttcgggaggccaaggtgggagaatcacttgaggttaggagttcaagaacagcctgggcaacatggtggaaccccgtctctacaaaaaataaaaaaacataactgagcgtggtggcatgcacctgtggtcctagctactcaggaggctgaggtgggaggatcacttgagcctgggaggtggaggctgcagtaagccatgatc

SEQ ID NO: 271275 - DNA, 338 bp, Homo sapiens
actgaaaatacaaaaaaatttaatacaatctctccattcaatgataaccactatacaagctcttgagtatttactcattttctatcctctgtattttctatcctatgtattttgcctactttctaccctacgtaaaaattgggatcactacaatatacatttttaaatctttatagttagaaagtaattttgttcatttaagaacattaaaagctgcgtacagcggctcacacctgtaatcccagcactttgggaggctgaggcaggcaggctgcttgagcccaggagttcaagaccagctttggtaacatagtgagatcctgtctgtagtaaaaata

SEQ ID NO: 271276 - DNA, 300 bp, Homo sapiens
tgaagctcttcccttgcatgaaaccagaaagcaaagcctaggagcgatggttgtttttacacatgcccaatcccagtaaaatataaaaacatggcatacaaaggggcaaagtaataagtctcaataaaagaaataaaaaaaaacttcagagacttactctaaagaaattcagacctatgagctgtctgacaaagaatttaaaacaactgttataaagatgccaaatgagctaaaagagaacccaaatagacaactaaacaaaaccagaaaaattatccataaacaaaatgagaatataag

SEQ ID NO: 271277 - DNA, 492 bp, Homo sapiens
aacattttcacatgggaacacttagatgggagggaaaccagctataatacctataatacccatcacctcattgactgccggagttgatataaaaatatcacagaccctgggggcatcctcctcttctcctctgcattcttcctgaagctgtacacgcaggcaaaaaggctcctttcacatttgttccctttgctaggtgatctgttgctggggtttcagattagaatcacattcacacgcacatttccaggtgcagtgtaccgcccagtgtggggctctcatatggcttgttgtggttctgtcactaaatcctgtgttcaaagacattctgggatagctgtgaggaattagaagtgactcctgggccaggcgcggtggctcatgcctgtaatcccagcactttgagaggccgaggcgggtagatcacctgaggtcaggagtttgagaccagcctggccaacatggtgaaactgtgtctctactaaaaataca

SEQ ID NO: 271278 - DNA, 389 bp, Homo sapiens
ataggtaaggctcccttgccattgggtttcctgtttaatggttgggtttttccagtaaaggtttctccctgcaggaagtcggagcttcagaggagtgcaaggtcacggtgtttgttatcccacctgcctgtctgtcaagtcgctgaggattggctttgttcctctaccaaaggccacagcccctgccagggaacctcttgtccagcctgccatctgggtctattctttcctccctgtatgtttccagacctagggctggcagcagctcccttctattggtaccctcgaggtactgtgcctgccatgtcttcttgcttcatctaaaccctgcacattcctttgtaaaaagtggttttaattaaactcacctcaaattttccagtgtaagt

SEQ ID NO: 271279 - DNA, 393 bp, Homo sapiens
tatcctgacatacagctgcagagacagacactgtattgcctcggggagaactccagccccaaaggtttctccctgcaggaagtcggagcttcagaggagtgcaaggtcacggtgtttgttatcccacctgcctgtctgtcaagtcgctgaggattggctttgttcctctaccaaaggccacagcccctgccagggaacctcttgtccagcctgccatctgggtctattctttcctccctgtatgtttccagacctagggctggcagcagctcccttctattggtaccctcgaggtactgtgcctgccatgtcttcttgcttcatctaaaccctgcacattcctttgtaaaaagtggttttaattaaactcacctcaaattttccagtgtaagt

SEQ ID NO: 271280 - DNA, 498 bp, Homo sapiens
ctgtcagtttgctacataccttttacatgacagttggctattttagttactttttatgattatagtttatttctttattattttatacatgttctcattatccatttggctacatagagaatccaaattttgaatagtgtggtaaaatggaaggagccctgaatgaagacactgtaagaattgggttattctgttcctactagttgtgcagctttgagcaagtcccttagttttctcatctgaattttttttttctttttttgtcttccctacactgattccatgaatttattatggcaattatctagaaaaaaagaataatgcctacgtccttacaggattatggagatgtaaagagaatatataaaaatagtttttaggctgggcacggtggctcatgccagtaatcccagcactttgggaggccgaggcaggcagatcacgaggtcaggagatcgagaccatcctggctaacacggtgaaatcccgtctctactt

SEQ ID NO: 271281 - DNA, 524 bp, Homo sapiens
ggatcaggaaaagacctggaaaggagagagaattatctacggaatggagagtttcctcacaacagacagctttgccaggtcatttcaaaatgtatcaaataaatatattttgaagtaaaatacttggatttctttcagggcctcctgtcacattgctatcttattgctacaaaaagtctgttttgtcagtcttaagatctctgttttaatgttaatgctggtcagttgtgcctgaattccaaagagaggagagtataatgaagcatgtccgaccctcccttcccatcatggcctgaactagtattttaggtttctttgaaatcccctcggctgagagttgggggtccattcagtggttcgggggcttagaattttatttttgtttagaatatttattattcttttgtttacagcaagttggctgttttcccatattaatgtctggaagttttaaaatgttttttcatgcactgaccttctgccaggtatgtttagtatggatgtttctatgctgttgacaaaca

SEQ ID NO: 271282 - DNA, 377 bp, Homo sapiens
acatgtaatggacagaggtaatagcacctgttgtcaccaggtaccaccgaagacctggactgaacccaatagaaagtgaaaagtggctgaggattataaaagcagcaaagaccaggccttctcagagatgcctttggagactctgcccggggttgtgtcacaccttttcctgaactttggctcaattgaagaaggaaactttcaggggaattccaatagtaaacaacagaaccagcagttttacaataaactgcagagctccatttcaaaacacaaaaatagagcgtctctgcagtgatgtactgccttaaggaagggtaagatttttttcacggatgttaccaaactttaatgaagtacatgttgtccactccgtg

SEQ ID NO: 271283 - DNA, 543 bp, Homo sapiens
tgctaaatttcagatagtgccagtgccacacttgagttacagagctctgtcaagtatgaagttggctatagttatcagtgcaactactgatgacagactttctcattagctgagatgggatgaaagtgtttaactgactcagagtggtaggtgagctcaaataggaaagaaaccaatgtctggtatggatagcaaaggagtcaatgatcccatctttactaccctaaactgcatgacctcacattgtatttgagtgaccttggcacaatccacctgaaaatgaatgtttttttctactaatgaaactctgaacttacagaaaactatctactttcaggccaggcatggtggctcatgcctgcctgtaatcccagcactttgggaggccgaggagggtggatcatgaggtcaggagtttgagaccatcctggcaatatggtgaaaccccatctctactaatataattagccgggtgctgtggcacatgcctgtagtcccagctactcgggaggctgaggcaggagaatcacttgaaccagggag

SEQ ID NO: 271284 - DNA, 545 bp, Homo sapiens
tgttattttcccattcaaaaaaaaaaaaaaaacttgagttacagagctctgtcaagtatgaagttggctatagttatcagtgcaactactgatgacagactttctcattagctgagatgggatgaaagtgtttaactgactcagagtggtaggtgagctcaaataggaaagaaaccaatgtctggtatggatagcaaaggagtcaatgatcccatctttactaccctaaactgcatgacctcacattgtatttgagtgaccttggcacaatccacctgaaaatgaatgtttttttctactaatgaaactctgaacttacagaaaactatctactttcaggccaggcatggtggctcatgcctgcctgtaatcccagcactttgggaggccgaggagggtggatcatgaggtcaggagtttgagaccatcctggcaatatggtgaaaccccatctctactaatataattagccgggtgctgtggcacatgcctgtagtcccagctactcgggaggctgaggcaggagaatcacttgaaccagggag

SEQ ID NO: 271285 - DNA, 426 bp, Homo sapiens
aatggaaactaagtaacatgaattaacatagtccagggtcacaaagcaacatggaacaagaacctggatctgaattcagaggcagaatgctgggcctgagaatcaggagagtcaatggtattagtgcttgtccggaagccatcatgcttcaaaaccaagaagagctgattttccagttggagtctaaagaaatgagtggcagatgtgttcacagtactacaatccaaggcatgattttgtgctgtccttggaaagcaccaaactaaagaagatcctacagaacatagatgatcccatcccggaccatatcctcaagtgaccggctcctgtgtccacgtggccttgccaaaaggcagctagacgttctcagggatttcccagaaggcaaatattcctttcctcataaaatttgcgtatggtgctcag

SEQ ID NO: 271286 - DNA, 357 bp, Homo sapiens
cactatatctctataaatataaagaaagatttcagtaaaatctatattccttcacatttttgacaattaaatttgtataaagatgcagaaatagacacattttttgaagaaaaacatttggaaatataagcaacattcagctcatagatataaagaatttctcacagacataaacacggtccttaaggaaagctcaagggtaagccccagggaaggcatgtttctcaatgtggtcatgaaaaccatgcttgaaagtttccatgggatgtgggtcaactgcacacacagaaaaccaaccatgtcaagagaacctaagaaagtcaaaattggataagcagccctgcacagacaaaaaaa

SEQ ID NO: 271287 - DNA, 491 bp, Homo sapiens
atagggagtacaggcttgaatatgtttggcttagtttagattgtagattaccaaggaagaatggcaatttgtaaaacaaatttagctgctcagtatttttgagagaaaactgaagagtttttctcttgaggttttagaagcttttaagattattagctccctaaacagatatgcatattgtcagtgatatcctaacattttggaggtttaatactattaggttaattataaccaagaaatgtagaatgtagaatgacgcatattttatgcctgaaatttgcttgtttggaaaaaatgtaaaatttcttatgtgggtgatttcaaaaatttgatttgaaatatataattaaaaagttgctatattggcctattttaaattgctatcattgatgggcagcatagtcaatttcacaaagaaggccaaattgtgcaaatactaatatagtgggtgatccctccttgggagagttacaaacctcaatcacaaatgc

SEQ ID NO: 271288 - DNA, 444 bp, Homo sapiens
tggaggcagagttttgcccttgtaccccaggctggagtgcagtggtgtgatctcagctcacagcaacctccgcctcctgggttcaagcaattctgcctcggcctcccaagtagctgggattacaggcgactgccaccacacccggctaatttttgttttattagtagagatggggtttcaccatgttggccagactgatcttgaactcctgacctcaggtgatccacccgccttggcctcccaaagcgctgggattacaggcgtgagctgccgcacccagctgtaaactggatttctaatggtagatttttaggtattaacaatagataaaaagatactttttggcatactgggtattgggatggggttagaacaggtgttctacccgacatttacttaaaatcgccctcgaaatgctatgtgagctgtgtgtgtgtgtgtgtg

SEQ ID NO: 271289 - DNA, 650 bp, Homo sapiens
tgaactaaaaccaaaaaaaaaaatttaatgccaaagagcagaaaacaacttacagatcaatgagctctagagggaagttttttccctcactttgatcttttccctgaaaatgacttcttgcttatgtttgacacaaaggaggaaattccattgaaaataagagttttcttggttttaccaagaggctgatccttttttccagtctcaggttttgcccattttgccacaaactgacaaaaattaacaaaaagaaagatactaaagccctttgagtttggcatcttgcagccccatttgttaaaacctgcaaacatttccaagtactgtaattagtacattcattattgaaacagcactttacatttaatgtgccaaacataacttggtgagcaaattaaacttacatacgttttaaaaccaaatagacaaagtattatatgtctaatctccccaaaacttcaaagctaattttttaatatttaagtttttaaaactccttattcttctctctcttgttcttcctgtctgctaccaaataaaaaatgtctgtccacataccatccaatgctcttgtcctgtgtagactggaacccaagcctcttaagaccaaaactatctgaaatgagttctggcttaggaaaaggaccagc

SEQ ID NO: 271290 - DNA, 604 bp, Homo sapiens
aaatatagttaagtaattgttaactcgggcattgattgaaaggtgtcctttccatcttccctctaaaagcctcaaggattatttctcaaactcctctctccattaaactaataaaacaaaacaaagccacttttataaaataataatactcaatggaacaggctgtgagatgccaagcaatttaaattctaacagtatattttaatgatgcttttctattacagggaaacaaggcaactcagaggactgagagactcaggacttccagacagaggatcaggcgtacctcatgcatgggtgttttggaagaaggccattttgaaacctactctgtatcattacagactttcagtgaattaatttagaataaatccacctccttccctgtatgtggtagaatttcactgggatacaacgtgaggacagagatttgaaccctcagtcccacttatgatgcggggcttcaggggcaccacggacatgctccgcattcacccatctgtgggggaggactaaggaagctgcgctggtgtgtgagaaagtaatgggctcttttaagcccttttacttaaagcaataaaagaataactgcgtcatctgctgg

SEQ ID NO: 271291 - DNA, 551 bp, Homo sapiens
ttgtcaggcctcatttggtcagaagcatgtttgtttctcttgtcagcttcttgattggtttctttccagattctgcagggcagccatatggtcatttctgcatgttttctagattgcttctgtggtagggttccaggtttggttgatgagtatttcagattctacccacactgagagagcttcagttttgctctttggttttatttcagatagcatattcacaacttgtgtccttcctgtcacttatctgaagttcatttgaatttggtgattttattttacgtggcctatgtatttggctaatgtttcatcattttatatgtcaaggaggaagactattaatggctgttgaagtgcttagattatgctaacttaggaaaactaaatctagtaataattctattggatgataaatattaatgtacattagattgggtagaaaaacataccagtcacctttccatatcttgtattctcagttattttgttacctttttttttaaatttattttgaaaatcattgtctataactgcaaggcaaggagaaaatt

SEQ ID NO: 271292 - DNA, 502 bp, Homo sapiens
ccatctgatccttccttgcctagtggtctcctttagcacaggacagcagagcattctctctgtagctcattcagaaccctttcactctgaactgagagataaagaataagatgtcagatgtgtttctgcattgggataagtaaggacaacgcatatcctgtgggaaggatagcttttacacccagaactgtctgagattttacagttaagctacatcaaaaacattaaaaacagggaaacagaaatatcaagtaagaatgaatctagtagaaatatctcaaaagataataacaatatgattatatatttgtactttgtgttaattatttgtgaaatatttttcttgcatgaggcaatagaggcaactcctgcttctttgagcagaatgagaatttagtttaaagatataggggagaaaatagaataagtactgtggcattggcttggaataggtgttattgtgagtatatgactttcattaaaataagaaatatgtaaaagt

SEQ ID NO: 271293 - DNA, 510 bp, Homo sapiens
tgtactctgaaactagactggatcagtactttgagagcagatctatcactgggtgaagattcgtattaaccaagctcacaaggctgatgtataagccagaaactccatatcttgagtgccaaaagtaacaacgaaccacaactgccacaggaccctggagtgctcagttcactataatcagtgtaggctgatgcactggggatgccaagccgtcatcggaacgttgcatgatgaacatgtaatcaaggcttgggaagtctgcagaacaagccatggttcaacatcagcaggccatgatgggatggactagcaagaacagtgctggtcctgttggagaaccaaagggccctggtgggcagccagagtctgaatgggcaccaccagcttctgcttcaacttgcctttcagaagtgccctggctggccagcaacttctacacaatctttctctaaattgaactcagagcaattaattaggttttatattactaaattacaatcgcatttcagc

SEQ ID NO: 271294 - DNA, 450 bp, Homo sapiens
gggcatgttaaggcttgacctccccgtcagctggggttctgttgacttccaggcaaacgcctcttgccaagtcctccaggagcttccttagctccaggagttcaggacggggtggggaggggtcatctgcccttgaaccctggcaggaggacagaggggagactggtttcgggaagagtccgtgtttgtgaatgggaaggcggtgcgtcgcctggcctcccacgcctcctcccctgcgggcttaagatgaagcctcccaggaagaggaggcggcccgggaggctgaatccacccagctatgtgttaccttggaaaccacacacttgtcctcgccctaggccatgtgaagtgagggggccgtggacacgcttctcaggaagcttccagtgtaactcaggatacaaaaaatcacagtcccagcatgggcagctgagagaatgaaaatgttca

SEQ ID NO: 271295 - DNA, 423 bp, Homo sapiens
tggatggttttaaggtatgttttggaggtaaaattgttagaagttggtaatgaattagatactggaaggttggagcaggagaaggtatgtcaaggatgattggtttctgtcttgaacagttatgtgaagggagatgggaaagagcggaggaagaaaaaatttgtaatataagatgaagcattcaggtttgggtacatttaggtttgagatccttgtgagacatccaaatagagatgtcaaagagcaaggcggcttaggaatctcgagctcagaacagaggctgtaagtagacagctgtgttctgtcaggtatgaaaatagatttcaaagccatgggaatgagtgagcttgcctcaggagaaagtgtatcatggggagagaaggcccatgattgggctttgggacccctgacatttagagattg

SEQ ID NO: 271296 - DNA, 546 bp, Homo sapiens
gaaggccactgaaaggggaagctaaaagcattggcttcttaaagatcccaagatgaagattttcttgaaagaagggcatttccgagtgtcgtataacagcttgcttttgactcctcctggcccccagggaagccattaagctggaatgtatcagtggtggaatgatccgttaaattcaaggtgaaaacgtcacaccattcaccctgtcacttgtatcagaaatctttaaaatagaacataagagagtctttatctcaaattctgactcattgggtcattttactcctggtgttatgtagtggttactagaatagaatgcagagttagaattcctgtgggaaacgtgcttttctgaggatacccctcaggtaagtgttctttgataataaatgacagggagcaagagggatccgagacccttgggcttgcaagatttccatcaaaccctcaaataaaaggaggcatcaactgttgtataaattcctccccacctaatttccaggtgatgctctcaaagtattctggcaactttctgtgtaaacccca

SEQ ID NO: 271297 - DNA, 433 bp, Homo sapiens
gccctaatccagtaggactagtgtccttataagaagacgagattaggatacaaacaccacaagggacaacgatgtgaggacacagggagaagatatccatctaggagccagggaaagagtcctcagaagaaacctatcctgcccactccttgatctcagacttcctgcctcctagaaccgagagagaataaacttctgtagtttaagctactcggtttgcggtctcagtcacgggagtccaagctgatgatcacagttgtgatgagaactttacaaattgaatcatgggaagtcttgcaatagtgagatctacgacctggtagatcctataatcctataatctgagatgctgattctacaactctgagctgctaacgctttgcttctgggtcacagaagcttctggaaataaacttgtcccacaaactgataa

SEQ ID NO: 271298 - DNA, 410 bp, Homo sapiens
ttaactcagcactaaaaccaaaggtcttagagcatctgacccctgctatctctctgacctgatctcctgccactctaccccttgcccattatatcccagacatgctggccccctgattattcctctgtactggccagcgtgcttctgattcaggccctttgtactttctgttccctctgcctggaaatcttttctccagttgttcacacggcttgctccctcacttccttctggtctctgctcaaaggccgtattatcaatgtagctttcctggaccatcctatacaaaacagcaccccattccccacaaagcagcagttccaatattcctcagcagtttctctttatctacagcactcatgttatattctttttattgtttattatctgtcttctcctaccttgaggtc

SEQ ID NO: 271299 - DNA, 463 bp, Homo sapiens
agaaaaaatgaagactggcatgctgtgtttatttataccagctctgtgactttgagcaagtcccccctgccttctgggacacagctccctcctctgatgaagcggggtgggagggccaatggtctgacattgaaattatgggctgaatgtaatgaggataaagtcaggcaatcacagagcgccagcccccatccagagttaagtgcttaataaacggtgactgatggcaggttctcagggtgtcccaggaacttccccttcgctggtggttctctaccctgaggcagagtagaatcaaggacttaactcagaccttcactcagaaaaggcctttctgcaggtgctgggctaattctgggatgtggttctctgatgagagaacccagtccacacttggaattcccagaggaacagataccgtggcccttgcacaaccttcctcaaatatacactgtctcagtgg

SEQ ID NO: 271300 - DNA, 553 bp, Homo sapiens
gcctgtgcaggtgtgaaggttaaaaaaaaaacacacaaaacacacacacacaaaaaaaacaagaagcaataaaagggagaatccatgtatttgggtctgatcatgagctcacgattctgtccctttggtctgacaactgtccttgtgttgtgcctggctgtctccattcctgcagctgaatgttcttgatatctggtagacaaatgctcacaagtggctcttcaagagtgtgttactccacttggccttcagaatctgcttctcaacgttcacctccccaaagagaaacatttgcttgggttttgactgggcattaacatatttgagtcttccatgggtttctatttatttaggtcttcttactgtcctgtcgctaccaaaaaaattccttaaaaaattagctaggcatggtggtgcacgcctgtattctcatcaagtcaggaggccgaggtgggaggatctcttgagcccaggaggttgaggctgcagtgagccatgattgcacgactgaactccactctgggtgacagagtgagatcctgactcaacaaca

SEQ ID NO: 271301 - DNA, 654 bp, Homo sapiens
tccccctagcagcgcaccctggaaccccccgacaccgcatggcaccgcacgcctaccttgtccacccagattctcgcgccctcggtccactccgacaactctcaggagcgcatccaggcccggcgcctccgcatcgctgcgcgcttagaagcccggaggcggctgacctgaagatgacaaaaggccagaagactccttggcttacttcgtccgaccacccggcaccctcctcctcatgtttatggttccaacctgacaacaaccctggaccacagagacctcttcctggacgactgccaacttcaggccagtttggaccggttccctgagactgcacagatcctggacttgtgccctaagcatcacctttttgcatttatgacccaattgtagtacatttaaatgttaaatctccaccccaaagtgaacatgagtagcatattgttgtatgttccgtgcacatgtaagcctaatgcacgtgcgtaatgagttttctccgtaaatattcacaaccttctcctatatcctgtagaatatgcgtttcctacctcctcacctagcagaaatatctgccttattttctccccttcaaagcctgcttctcagtctcagttgaaagcttgcttcctgcctgcaggttgtgtcctttagaaa

SEQ ID NO: 271302 - DNA, 2555 bp, Homo sapiens
  misc_feature (15)..(15): n is a, c, g, or t
  misc_feature (18)..(18): n is a, c, g, or t
  misc_feature (21)..(21): n is a, c, g, or t
  misc_feature (24)..(24): n is a, c, g, or t
  misc_feature (36)..(36): n is a, c, g, or t
  misc_feature (1321)..(1321): n is a, c, g, or t
agcctatttggttcncantantanaacacgctcgcntttaaaaagcaggctgtcggtcggaatttgggatcacctgaggtctggaggtggtgcggagggagccgcctagggaccaggactcctgccatgaatccgccggggtccctagaggccctggacccgaacgtggacgagcacttgtccacccagattctcgcgccctcggtccactccgacaactctcaggagcgcatccaggcccggcgcctccgcatcgctgcgcgcttagaagcccggaggcgggaagcacttggagaatatttagatgggaagaaggagagtgaggaggatcaaagcaagagctacaaacagaaagaagaaagccgattgaaattggctaaacttctgctctgtggcaccgagttggtgacaaatatccaggtggctatagatatcagagagattcacaggagagtcgaagaagaggagataaagcgtcaaaggattgagaagctggagaatgaagttaagaccagccaggacaaattcgatgaaatcacctcaaagtgggaagagggcaagcagaagagaattccccaagagctgtgggaaatgctcaatacccaacagctgcactgtgctggactcttagaagataagaataaactcatcagcgagttacagcaggagttaaaaacaaaggatgaccagtatgtgaaggatttgaagaaacagtcagatgacatctgcctgcttctggagcggatggaagaacaggtgaagaatgtgatgaaaacctttcgtgaggagctctataacattgagaaagcatttgaggtggaacgccaagagctactggccagtaataagaagaaatgggagcaagcccttcaggctcataatgccaaagagctggagtatcttaacaaccgcatgaagaaagtagaggactatgagaagcagctgaacaggcagaggatctgggattgcgaagaatacaacatgatcaagatcaagctggagcaggatgtgcagattcttgagcagcagcttcagcagaggaaagcaatttatcagctaaaccaagagaaattagagtacaacttgcaggtgctgaagaagagagatgaagaaagcacagtaattaaatcccagcagaagaggaagatcaatcgcctgcatgatatacttaacaatctgagatcaaaatatgccaagcaaataaagcagtttcaggaggagaaccagtctctaacctcggactacaaacgtcttgtgatgcaattcaaggagctacagaaagccatgaggcattttgctcttattgatgatgagaagtttngggagatttggctgatgaatgaagaggaggcgaaggacctaatagccagagcctttgatgtggacaggatcatccacacccatcatctggggcttccctgggcagcacctgatttctggttcctgaacaatgttgggcctatttctcagcagccccagaagtccgccacacagatagtagaagaaatgcttatgcgctcagaagaggaggaggcagaagaggccgccgcggaaccagagtcctacctggatttgccgaagcaaatttctgaaaaaactaccaagaggatcctgatgctcctgtgtgacgagtcggggttcctcatagagagcaagctgctgagccttctcctgcccctggagcagaatgaatgctatctgctgaggctggatgccatcttctccgcccttggaattgaaagtgaggatgacttgtataaactggtgaacttcttccttaaatatcgagctcaccgtttatcttccagcctccagatcaagccctgcagtcaggcgagcatggagaaggcgagcatggaggagacaagcacgaggtcagaattggagctggcagagcagacggagatggagggagaaaaggaagaaagcctggtggaaggggagaaggaggaagaggaggagaccccaccctccccctgggtcatccaccccaatgatgtcctcaagattctggaggccttcgtcatgggtctgaagaagcctagggactcgcgggccccgctgagggtacagaagaatgtgcgtgacaactccaaggactcggagtactggcaggccctgaccacagtgatcccttcctccaagcagaacctctgggatgccctctacacagccttggagaagtaccaccttgtcctgacccagagggccaagctgctgctggaaaacagttctctggagcagcagaacacagagctgcaggcgctactgcagcagtatctgaactccaagatcaactctgaactgcaagttcctcccactcaggtgttgcgggtacccacaaaatgagctggaccgccaaaggctgatgtgttagggctggcctgatgctggtgtctgtgccggagccagctcatatcacccactgggccgcacctgggcctgctctctggattttccagggctgtctttatagcctgtcgaaataaggagccagaggagttacctgtgtcctgcattatgattaaagccttttaaagttgaaaatgaatctc

SEQ ID NO: 271303 - DNA, 826 bp, Homo sapiens
  misc_feature (15)..(15): n is a, c, g, or t
  misc_feature (18)..(18): n is a, c, g, or t
  misc_feature (21)..(21): n is a, c, g, or t
  misc_feature (24)..(24): n is a, c, g, or t
  misc_feature (36)..(36): n is a, c, g, or t
  misc_feature (753)..(753): n is a, c, g, or t
  misc_feature (757)..(757): n is a, c, g, or t
  misc_feature (761)..(761): n is a, c, g, or t
  misc_feature (792)..(792): n is a, c, g, or t
agcctatttggttcncantantanaacacgctcgcntttaaaaagcaggctgtcggtcggaatttgggatcacctgaggtctggaggtggtgcggagggagccgcctagggaccaggactcctgccatgaatccgccggggtccctagaggccctggacccgaacgtggacgagcacttgtccacccagattctcgcgccctcggtccactccgacaactctcaggagcgcatccaggcccggcgcctccgcatcgctgcgcgcttagaagcccggaggcggctgacctgaagatgacaaaaggccagaagactccttggcttacttcgtccgaccacccggcaccctcctcctcatgtttatggttccaacctgacaacaaccctggaccacagagacctcttcctggacgactgccaacttcaggccagtttggaccggttccctgagactgcacagatcctggacttgtgccctaagcatcacctttttgcatttatgacccaattgtagtacatttaaatgttaaatctccaccccaaagtgaacatgagtagcatattgttgtatgttccgtgcacatgtaagcctaatgcacgtgcgtaatgagttttctccgtaaatattcacaaccttctcctatatcctgtagaatatgcgtttcctacctcctcacctagcagaaatatctgccttattttctccccttcaaagcctgcttctcagtctcagttgaaagcttgcttcctgccnctgnccanggttaagtgctgcggtttaaagaaataaagnttctctttagtttcgggggggggggtgggggcgc

SEQ ID NO: 271304 - DNA, 396 bp, Homo sapiens
ttatgggcatgaccttgtttctgtactcccagcctccaaccagcaagaaaatgggggtctcagtcccacagccacaaggactgggattctgtaaatgccccagatgagctgggaggcagattcctccccagagcctgcagatggagttcagcctgcccctgacaccttgcgtgggagacactaacagggagaagagctgagcctcccccagccttctgacctacagcaccatgtgatcatgaatatgtgttattctaagccactaagttggtggtaatttgttatatagcaatagaaaacagatgcattaagtttgtctacaatgcccatgcctgcagtcatattctttggcttcctagaaggtgaccagcaatacatgtcagagtgtacaattag

SEQ ID NO: 271305 - DNA, 327 bp, Homo sapiens
agataattattatttttgattgtttgtattgttgttaataggtaaataggagctataaggcaaccaaataaagatatcttgaaagcaaaaaggtctaaggtaatgagatgcttgttcttctcatgcagatctgtgttaaatccttcatttttgtaaagccttttcatagaggcccactggacatgtaagatgatgatatttcaaagctggagaggtagcactatttctaaattgggaatacatgcctggctgcttcaaatattaatcataaggcagctatcgaattgacaagaaactgaaaactattgtaatcccaaacatgcttta

SEQ ID NO: 271306 - DNA, 932 bp, Homo sapiens
aagagccctgaggaccaagactggaaggcagagaggatgtgacatcaggtgggatggctggggacagccaggtattcacaccacagttaggatcttgtcttgcatctccatggaccatgaacaagacttgtttgtacagaggctgtaaactgctggctatagtaacagaggctagagaagcagcaagagcgtgagccagcttacatgtacatggctgtgctattatctgggcaatggtgccctgaacagggggtgcggcgcctgtggtcccattacaagtggctcacacttctaatcccaacactttgggaggctgaagtgggaggatcactttggcccaggagtttgaggctgcagtgagctatgattgtgccactgcactccaggctgggtgacacagcgagaccctgtctctaaacacaggagaaatcagaatctgtggacgtccttgcatttattggacactctagtgtttggatgttttgcattgtgcagtcagggtttgtcttttcagcggttaggcttctagaggtgttattaagccctggaggagggcagaaatgagatgcagatgcctgttgaggggcaattcatggctggggaaggagggatgttgggtgaaggagagaattcactcataatcttcccacccgctcagatccagctcagaggaaagtccctgaaaccgcaggagacaactctgatgttttcagagcatggggagagcacggtggggtgatctggagacacggccagcagagacttggagccaagattcctggatccccaacaaatcactgaattcaggccaggcacagtggctcatgcccgtagtctcagcactttgggaggccgtggtggaagggtcgcttgagcccaggtgctcgagaccagcctggggaatatagtgagacctcatctttacaacagca

SEQ ID NO: 271307 - DNA, 471 bp, Homo sapiens
ctttgcagtggggaggagcctggcctctcctttcccagggtgtagtacctgggattcaatttgtgaggcgggaagcgcactagcaggattctgactttgcagagtgtccttgtttccctttttttcctttttgttgaataaatcttgtttttctcacccttcaaattgtctgtgagcctaattttttcgtggttctgtgacaaggaccttgtctttagctgaactaaggaaaattcctgcagcaataaaacttctggaatgaagtttttgtttaggaaagaaaacaccaacagcaaaacatacaaattgccagcttaaaaaaactcataatatgcaagaaattatttcaaaatcaacttgaattttttaaaaattggcattttaaatctataatctatataaaatttaaatttatatatttaaatatataatctaatcatataaatctataatcatgtctaagtgtatcag

SEQ ID NO: 271308 - DNA, 951 bp, Homo sapiens
actttgtgggtgcttctgcccttccacgtagagcagctgtcaggaactcgggacactttcccagcccaattcacagaaggaaggccagaagcttaacccagtagtgtctgagtacctgcttggcaaagccttctacggccaaaatgaaaaccctgaatccactaccaggtgctctaggtaagacaagacaagccaaaagccagaaataccatctctggacatggcctcaaagtaagagctccgccagcccaactaaaagttaaaccaactcctgctctggaaaacttagtacccgaggttgaactgcccagtctctttcctgctctgctggccaaatccatggcaggtccaagtcacatgcctcttttcgtgaaggaaaaatcatcagcacctcctacaaaggtcttcctaatcacttcattttgggggtaggggtgtggattttaaaactttgaagactatgtcacactcaccttgcccctcacctctggccttgacaaccatcttgctttacaagtgaattccgccaggtttctaaagatggtcacaacacaggtgccaggaatgccttcctgggtacatggagttcccgcccacgaccacagaagacattacacaaaactgcccaaaaagtatgaaatggcaatctgacaacaacctgacttaaaagccagtaaagacatcagaaaagatgttggtgtgcagcaagaaacccttcgcagcacctcacatgggcaaaaccaaagaggtaagaccctgatcttcctaatggcagacagtgaactacgaccaccccagaaatcacataaaagcatagaaggtaatttctattcaacaaataattactggcactcacagagaaaagcatggtgggacacaaattaatcaggcaaggcactgccctcgaggcactttcagtcttggcggggagtagtggagggcagaagaaaa

SEQ ID NO: 271309 - DNA, 182 bp, Homo sapiens
gtctaatcacatggttctcctcctgttttccatcatttcctgttcatctttaaggttccagtttttgtgtctctgcctggagtaaggaacagatatattatttagtgttttgaggtgaacctaattcattaattgtgttacttggtaagaaattgcatatattgcatataaacaataaatgt

SEQ ID NO: 271310 - DNA, 432 bp, Homo sapiens
tgcagacattgccaaacatgctctgcgtgactgccctagagagggcagttgagagaatgggaaaggataatgtgtgtatttgtgaacagataactttgagttaatgaagagatgaaatggctaagtattatcattaaggaggaatttttcatgttttccattatttaaaaaacattggcacagagttttcaaatgttggactgcactgaggtctaggtttctcccctttagtgtttattttctttgaccccatatgcacataataaaaagactgagtaagaatggaatgcttgtaaattagtaatgctaatctagctacatccaagggcttgaaactgctctacaaatatattttcactgtaagtttattttgtttccttcaacattgactgtgttctttttcaaataaacggaccagaggcataataaaat

SEQ ID NO: 271311 - DNA, 1818 bp, Homo sapiens
  misc_feature (1802)..(1802): n is a, c, g, or t
gcttattataagaacctcctagtgtatttgtgaattgaagagctccttcttatttttcttaactaaatttgactagataattgaaattctaagtagaaacttcaatcaaagcaagatctatagttacaagttaagatgttaattataatccccaggataatcaccaagaaaataaataaaaataaaaaataagcagcaaaggaattaaaatgatacactagaaaatatgtttttaacatataggaaggcagtaatggtggcacacagggacaaagatgacacaggacatatagaaaacaaacagcaaaatagccattaaacataagtggattaaacactgcaaccaaaaggcagagataggcagaatgaaaaaatacatgaaccaagccaggcacagtggctcatacttgtaatcttagcactttgggagtctgaggtgagcggattgcttgagcccaagagtttgagaccaccctgggtaacacagcaaaaccctgtctctacaaaaaatacaaaaattagctgggtgtggtgacgcttacctgtagtcccagctacttgggaggctgaggtgggaggatcacctgagcccaggatgtcgaggctgcggtgagccattatcgtgccacggcactccagcctgggtgacagagtgagatcctgtttcaaaaaaaaaaaaaaaacaaccatgatccatctatccatcttatatgctgtatataagagacaaattagattcaaaggcacaaatagattgaaagtaaaaggaagaaatatgatacaccatgcaaacagtaaccaaaacagaacagaagtgaatgtagtaatatcagacaaaatagactttaagacaaaaattattagagacaaggaagaataaaggctcaattcatctggaattcataacaatcataaacatatatagacctcgtacagaggcccaaaatatacaagcaaaagttggcagaattgaagggaaactaacaattcaacagtaaaacttgggactgcgtgtggtggctcatgcctgtaatcccagcactttgggggacttgaggcaggcggatagcttgagtccaggagttcagggccagcctgggaaacatggtgaaaccccatctctatttatttaatatataattagcaaaaaatgttggaaaattcaatacccaactttcaatgagagatagaacaactagacagaagaccaacaaggaaatataagacttgaacaccactatagactaactaaaagacatctatgatgcactccaccaaacagtagcagaatatatatatatccttttcaagtgcacatgaaacattctccagaatagacgatatgctaggtcaaaaaacaggtgtcagtacatttaacagtactaaaataatactaaatacgttctctgagcacaatggcatgaaattagaaataaataacgaaggacatttggaaaattcacaaaaagtggaaattaaacagaatacttgtaaataaccaatgggtgaaagaagaaatcatgagggaaattagcaaatactttgggttagatgaaaacaacaacaaaacataccaaaacctatgggatgcagctaaagcagtatttagaatgacatttataactgtaaacatctatattaaaaaagaatgatagtgaatcaataacctatatttctgccttaagaaattagaggccgggcgcggtggctcacacctgtaatcccagcactttgggaggcccaggcgggcggatcacgaggtcaggagatcgagaccatcctggctaacatgtgttatggtnaaacctcgtctctact

SEQ ID NO: 271312 - DNA, 344 bp, Homo sapiens
gcagctgcctcagtgacgactgccggcatcgcggcgacctgaggagatcaagccgcaggccccgccgtcgccaccactcccgccagtcttccttctccgctcccggccggggcgtcaggaatgggccccaatcgccgtgggccccgcaccctgcgtcgcccgtaggccccagtagccggaggccgaccggcctcccactacccctcgccctagccaagccgtccccaccccaaatccccgggaaggaagatgagggagacgggcccggcgcttagcagccagagcagcagcagcagcagcagcggtcgggggagggtgtttcgccgtttcctctcagccgccag

SEQ ID NO: 271313 - DNA, 158 bp, Homo sapiens
atggcaagaacttcaagtctctaaagaaagaattgaagaagacctcagaagatggaaagatctcccatgctcatggattggcaggattaatatagtaaaaatggccattttaccaaaagcgatctacagattcaatgcaatccccataaaaaaaaaat

SEQ ID NO: 271314 - DNA, 980 bp, Homo sapiens
ggggcagacgtgggacgggaaggacggctgccgggactggcgcgcggggacactgggccgacgcgtggagtagcggggagagcgggaagcctgagggggcggggccggcgcgaggccgtgggtgcggcacgaggatgccggcggcgggacagcgcccgtaggcagccccacgggcagggcgcgcgggcggggcggggcgggccgggccagaggagctcccggcatgtcgcaagggctcccggccgccggcagcgtcctgcagaggagcgtcgcggcgcccgggaaccagccgcagccgcagccgcagcagcagagccctgaggatgatgacaggaaggtccgaaggagagaaaaaaaccgagttgctgctcagagaagtcggaagaagcagacccagaaggctgacaagctccatgaggaatatgagagcctggagcaagaaaacaccatgctgcggagagagatcgggaagctgacagaggagctgaagcacctgacagaggcactgaaggagcacgagaagatgtgcccgctgctgctctgccctatgaactttgtgccagtgcctccccggccggaccctgtggccggctgcttgccccgatgaagccggggacactcctctgcccagcaaggagccttggtcattttcatacctgggaggaaggcttttccttcacaattgtatacagggggcacctgtggccaggcctcctcctgggagctccaggaccagccagctgtgttccctgcagactgggctcagcccgacatccaacaggcgccaaactcacagagcccttgtgcagatccagcatggaggccaccctcaggagtgacttctcatccaccctggcagctagtaggttctgctgttatgcagagccatttcctctagaatttggataataaagatgcttattgtctctcccttctccagttctgggaatttacaggcacaatacacttccttttcctgg

SEQ ID NO: 271315 - DNA, 606 bp, Homo sapiens
agttctacgcctctgtaaaccctgatggagaggaaactgaacaggaatatgagagcctggagcaagaaaacaccatgctgcggagagagatcgggaagctgacagaggagctgaagcacctgacagaggcactgaaggagcacgagaagatgtgcccgctgctgctctgccctatgaactttgtgccagtgcctccccggccggaccctgtggccggctgcttgccccgatgaagccggggacactcctctgcccagcaaggagccttggtcattttcatacctgggaggaaggcttttccttcacaattgtatacagggggcacctgtggccaggcctcctcctgggagctccaggaccagccagctgtgttccctgcagactgggctcagcccgacatccaacaggcgccaaactcacagagcccttgtgcagatccagcatggaggccaccctcaggagtgacttctcatccaccctggcagctagtaggttctgctgttatgcagagccatttcctctagaatttggataataaagatgcttattgtctctcccttctccagttctgggaatttacaggcacaatacacttccttttcctgg

SEQ ID NO: 271316 - DNA, 590 bp, Homo sapiens
atgtgtatgtgtgtaagagtgtgtgaatgaatatgagagcctggagcaagaaaacaccatgctgcggagagagatcgggaagctgacagaggagctgaagcacctgacagaggcactgaaggagcacgagaagatgtgcccgctgctgctctgccctatgaactttgtgccagtgcctccccggccggaccctgtggccggctgcttgccccgatgaagccggggacactcctctgcccagcaaggagccttggtcattttcatacctgggaggaaggcttttccttcacaattgtatacagggggcacctgtggccaggcctcctcctgggagctccaggaccagccagctgtgttccctgcagactgggctcagcccgacatccaacaggcgccaaactcacagagcccttgtgcagatccagcatggaggccaccctcaggagtgacttctcatccaccctggcagctagtaggttctgctgttatgcagagccatttcctctagaatttggataataaagatgcttattgtctctcccttctccagttctgggaatttacaggcacaatacacttccttttcctgg

SEQ ID NO: 271317 - DNA, 346 bp, Homo sapiens
gcaaagatgttagcggattactttggagggaaacaaaacaaaacaggaagtaaggacgtgagggaagaaaagaaatggagcaagaacttgaaagggaatcagggctccagaagaggctctgttttgttttataatgaaataaacttgagcatgagaagcactcagagaagtcggaagaagcagacccagaaggctgacaagctccatgaggtgagaccgtggtaggggcaagccaccttagagccacacagcctctgccttgcacgggagtgggggtgatgactgttctctttatcacgatttcagcaacactcatatctaatttctgccaggtccttccagccca

SEQ ID NO: 271318 - DNA, 440 bp, Homo sapiens
ctgggtaatttatagaggaaagagttttaatggactcacagttccacatggctggggagacctcaatcatggtggaaggcaagaaggagcaagtcatgtcttacatggatggcagcaagcaaagcgagagcttgtgcagggaaactcccccttataaaaccagtggctcacgagctgtaatcctagcactttgggaggccaatgcaggcagatcacctgattgtcaggagctcaagaccagcctggccaacatggtgaaaccctgtctctactgaaaaaaaaatacaaaaattagccaggcatggtggtgtgtgcctgtaatcccagctactccagaggctgaggtaggagaattgcttgaacccgggaggtggaagttgcactgaaccgagattgtgccattgcactccatcctggtgacagagcgagactgcatctca

SEQ ID NO: 271319 - DNA, 506 bp, Homo sapiens
aatcagctgccagcgagccaagagaaaagcaggcaggagaagatggaacaacacacttgctgagtcttccggcctttatctttctcccatgctggatccttcctgccctggaacatcggactccaagttcttcagcttttggactcttggacttacaccagtggtttgccaggggctcttggggcctttgaccacagcctgaaggctacactatcggcttctctatttttgaggtttgaggactcaaactggcttccttgtccctcagcttgtgattgtgggagtcaatactccttaataaactccccttcataaatattaatgcacctatcctattctgcccctctagagaaccctaatacactcatctacaagccaaggagagaggcctgtaacaggtatctcctcccagtcctcagaaggaaccaaccctgccaacaccttgacttcaaccttctggcctacagaactatgagacaataaattttgttgtttaagctacccaa

SEQ ID NO: 271320 - DNA, 223 bp, Homo sapiens
aagggtatttggtcagatgtgcccatcactctggcagcagagtaaaggataggttttatgagagagaagaccattcagatattccagaaaagaaataagagccttgggccgggtgtggtggctcacgcctgtaatcctggcactttggaaggccgaggtggtggatcacgaggtcaggagaccgagaccatcctggctaacatggtgaaaccccgtctctact

SEQ ID NO: 271321 - DNA, 91 bp, Homo sapiens
taagtcacagaatccttactctttggaatctaaccacatatataaaatgaccaacttacaaaaacatacattaaaggacttttaatgtatc

SEQ ID NO: 271322 - DNA, 1214 bp, Homo sapiens
gcctgtagtcccagctattctggaggcagaggcaggaggttgcttgagcccaggagtttcaggctatagtgttctgtgatcccacctgtgaatagtcccagctattctggaggctgaggaagagggttgcttgagcccgggagtttcaggctatagtatgctgcgatcacacctgtgaatagtactgcactccggcctgggcaacaaagtgagaccctgtctctaaaaaacaatcatagtgataatacaatatttttttaaaaaaggtaagtttagcccagtaatagttaaggtatttcccaaggtttcacaaatagagagttataggggtaaattctagtaaagctgtttgtgacatgccttgtgaaaattattcagtcacttttataaccccatggaaaaatgtaggtggatataaaccaatttttttctttgctcagagtgcatataaattattattcttgggcgtgtaaaagtttttcttattgggcaacaacaacaaaaaacaatataaaaacagttgatttactggtgtcactgtgtttcattcatgcaggaaacatgttgagtgcttattttaatttattgatagggtttctctgtcgcccaggctagggtgcagtggtgcgatcacggctcactgtagcctcgacctcctgggctcaagtgatcctcccactttagcctcccgagcaactgggaccccaagtgtgtaccaccacacctggctaatttttaaattttttgtagagatgggggtctcactgtgttgccttggctggtcttgaactcgactcaagcaatcttcctgcttcagcctcccagagtgctaggattacaggtgtgagccatcatgctgggctttttagtgcttactatgtggcagcctctgctagatgctagggatagaacgatctaccaagagacagtatgtgtacatacctttaaggagcttacagtctggtaggaagcataggagactgttacaatataggataataataagtgtgacgatggggtgaagtgcattggtactaaagtagcctgaaggggagcaactagccaggccatggaagggtcggggaagatttaaccaagggaagtaacatacatgttagcacagaccttaaggacaagaaagatgtgggcagttgagagtcaggaagacaggagctggcacctgtaagtgcctagaaccaaaagaatcatgagtg

SEQ ID NO: 271323 - DNA, 356 bp, Homo sapiens
taaaatttactcaatttaaaatgtctgttatgggtttttttcttacattgacagcatctgctaacgtttaccgcctcttaagcgttggcaaatgataaaacatcattgttgctgatgtgtattacctcatttaaccttcacaaaaaccagaagatataaatatcattacttctgtattacagactaaagtttaaggagatttcataacctggacaagatcaccaagtaaatggtagggtctggctttgaacctaaaccctctggttccaaagtctcatctcttaaccactactatacactctcttcaaaaaacaatacactaaaatgttaacaatagaattactctaagttttact

SEQ ID NO: 271324 - DNA, 422 bp, Homo sapiens
gaaacgtccacgggcgaaggctgcgggggatgggtgcctgtctggtcagtgctccaagggaagcccagggatgtttggtgattcagcaggtggcagccttccagctctgaagacatgccgtggccaagcaaagaagcaagcaagcaagcaagcagcagcctgtgcctgctgtcggaggcgccagctttgggggaacctccaggtgctgccttctgcctgtggcagctcacttgtcttatcttgcttcctgtttagctctggaggccctggtatttcgagtttccttactgcgcctcttaaaatatacagcaatatatagcatgtttttgagtctctgcatctctgtgacctgctgggtagcagtggggtggctgctgccgccatgcagttttaagtagttactctgcagaaagtgacagtga

SEQ ID NO: 271325 - DNA, 283 bp, Homo sapiens
gctgtccttgaagttttttcccttgcctcctccccagtttgcctgttggtcccactagggcagtgccatattggcaacttcccatgtcctccacttacagcagacaaattggaaacctcccttgtgggaggaaggatgggaggatgggctccattacaaagcaatattctgaaggagaagagagccatttggacgggaagatggagctggtaaatctggcttgtctccctgcatcgggggcaagatggattttattcataaatattctcagtgatcttgagct

SEQ ID NO: 271326 - DNA, 427 bp, Homo sapiens
gataaaatcatgaagtttagttgcatggaatgaaaataaatgtttaaatatacataaagcctgggttatttacatgtgggaagatacaatacttaatttcttaggcaggacaaaatcaaaatgattgaaatgtggaattacttcctcagtttggatttgaagaaaaaacacaaaatagtagtaggttgcaacctaacaggaatattgagagtcagataattttatacttgactaacactgaatttttatttggtatttcctttgatacatgaatgaagctgccacgtaatcgagataaggccaaagattttgaggtggtcacacactggtcaaacacctctgctgaaaccctggagtcctctgcgactcctcacagcatagagtattggctttggagtcagattcaggtcaaaccaaactcttcttg

SEQ ID NO: 271327 - DNA, 204 bp, Homo sapiens
gaggccagaagaccaatagataaaaaatatctcccacccgtattccaacctattaccaagttctacatttctagctctgcaggagcctcctcccaggtctccctgggtcccatctgcccttctgccaccagtctccacccagtcaccagagagagagcttcttaaaatggaaactggatcagatcatgtcacccctgcttagaa

SEQ ID NO: 271328 - DNA, 374 bp, Homo sapiens
ctctaatcataataaagcttaggaaaatatgtgtgtaacttcagggtgctggggcagtatggaaacgggaggcctcttaaaatctagaaaaccatagagggaaagattgatttatttgagtcctatatatcaggaacatgcagatttaaatcatgagatatgatttttacccactggattgtgaaagaattagaaaaggtgaacacatctagcgttgcagagggactgctgactctcacatttattactagtggatatgtattgccataatctttgtggaaaggagactgatggtatctgttactaatgtatgtatgggccaggcatggtggctcacacctataatcctagcactttgggaggccaaggtggga

SEQ ID NO: 271329 - DNA, 591 bp, Homo sapiens
tgctactgtcacaatgggagacagcctcaggatgaagccaacactcagagaatgacaaaatcaaaacttggagattaactgacctcatatagcattgcataagcccctgaatcaagttatgcctgaagcttagtccttgagccttcaactacatgaaccaatatatttctctaattaaccaggacctttttattgcattgggcccatctggatatcccaggataatctccctacttcaagagagaatgaaggcaaggagaatgtaagaactcagaaggcaagaagagaagctggcattagaatgcggttgaacaagagaaagagttggagatgctgagttctggaggcagatctacctaaggaggaactctctgttcatcgtcttccatggcctcatctgtgatggacactggagaataaacctttcttaaaggctgcatagcattgtaccccattttcctgctggtgtaggatgtctctccatcctgacaattccagaatgcagagcatgtggacctttcctcatctattcagaacctcatctattcagaacctcatctactcagaatttaaaaacattatttaagaaga

SEQ ID NO: 271330 - DNA, 452 bp, Homo sapiens
tgctactgtcacaatgggagacagcctcaggatgaagccaacactcagagaatgacaaaatcaaaacttggagattaactgacctcatatagcattgcataagcccctgaatcaagttatgcctgaagcttagtccttgagccttcaactacatgaaccaatatatttctctaattaaccaggagaaacggactttctttaaatcatcaatctttaaaaacatcaagaaatggtggtcttcaacaaatgaggaggaatgaaggagaatgatcctattttccagtgaattatcactttactttggagactttgtgggaagacttactacgaaagttccttttgaagaactgaagtgatcttatccctgcctgaaaatgtaactctccttctctagtaatataatgaccagagaagagtgttatttcagctgattaaaatagctttgttgtaaa

SEQ ID NO: 271331 - DNA, 111 bp, Homo sapiens
acctctttgctcctctggcaggaatttcaaaatttggccccggtcagtcacaaactccctcctggttcccaggtgttctttaatttttcattgctatgatggaaatgtcac

SEQ ID NO: 271332 - DNA, 962 bp, Homo sapiens
gcaaaaaaggcaaccgctctctgtttctgaccgtcatgtctacaagtatcgctgtaaccattgtagcttggctttcaaaactatgcagaagcttcagatacattcccagtatcatgcaattcgggctgcgacaatgtgtaacctctgccagcgcagtttccgtacattccaggctttaaaaaaacacttggaagcaggccaccctgaactgagtgaagctgaacttcaacagctatatgcctccttgcccgtgaatggagaactgtgggcagagagcgaaactatgtcccaggatgaccatggcctagagcaggaaatggagagagagtatgaggtggaccacgaagggaaagcaagtcctgtaggaagtgatagtagctctattccagatgacatgggctctgaaccaaagcggaccttaccttttagaaaagggcccaattttacgatggaaaaattccttgatccatctcgtccatataaatgtacagtgtgtaaagagtcattcacccaaaagaacattctcttggtccactataattcagtttctcacttgcataagctgaaaaaagttttgcaggaagcctccagtcctgtcccacaagaaaccaacagcaacacagataacaaaccctacaagtgcagcatctgcaatgttgcatacagccaaagctcaacattggaaatccacatgaggtctgtgctccaccagacaaaggctagggctgcaaagctggagcccagtggtcatgtggctggtgggcacagcattgcagcaaatgtcaacagccctggccaggggatgttagattccatgagtttagcagctgtaaacagcaaagatacccatttagatgccaaagaattaaataaaaagcaaactcctgatttaatctctgctcaacctgcacatcacccaccacagtcaccagcacaaattcagatgcaactacagcacgaat

SEQ ID NO: 271333 - DNA, 390 bp, Homo sapiens
agctttgcagataggctatgaagttgatggatatctctgattgggcaccccagctggtaggaacacagctgcagctcctgttccacttcctttcttgtactgctgaacatccagatagaggcattgacatgcatggtttccaactgatcacttcctactcccttaaggacctcctgtcaggcagcattgatgagaagacaaaaaagctctctggctggagccactctctatgtggaatttgcatgttctccccatgcctgcactgatattctcccacatcccaaagctgtgcacagattttgactggttcccagaagaagattcagccacccatgaccctgaactggaataagcaggttggaaaataaatgaatacacaaatataattta

SEQ ID NO: 271334 - DNA, 232 bp, Homo sapiens
ctggggcttcaggagctgtaaacgttcacccctagacactgccgtggagtcaagagccccacagcctgcccatctgtatgctcccctagaagtttgagcagcggggcactgaagaagcaagccacacccacatcgcacgccctgcgagggggatgacggaacctttcccgtttcaatatgaccataggtatttaaatggtttttaataaaagatatttactgtgggaaatta

SEQ ID NO: 271335 - DNA, 333 bp, Homo sapiens
ggtttctactacatcatttcccttttctcttaacaataccagcttctcggccgggcatggtggctcacgcctgttaatcccagcactttgggaggccaaggcgggcggatcacttgaggccaggagtttcagaccatcctggccaacatgatgaaaccctgtctctactaaaaatacaaaaattagctgggtgtggtggtgtgtgcctataaccccagctacttggagggctgaggcaagaggatcgcttgagctggggaggcagaggttgcagtgagccgaggtcatgtcactgcaccactccagcctgggtggcagagcaagactgtctca

SEQ ID NO: 271336 - DNA, 201 bp, Homo sapiens
aaatctgtagctcttaacttgaattgtaaatattggtataaactcctgatgtatttctatttaaaaacgttttctggatgtgtccactgaaaaggtctagaaccaatgattaacccccccaagaacaaggagctcccaagcatccatgctttcgtatccaaatgccttttttattgaaaggaaccagggtccttgagagaa

SEQ ID NO: 271337 - DNA, 662 bp, Homo sapiens
gatgtcttcaatttatgatgtgtttattggaacataacctcaatataagttgaaaagcatatgtattttcaattctggcatgaacctatgggaatcttttgcatttaagaacctccccattttaataatttcatgggtctaagattcttcatctgtttataaggaactttagtcttagtgattagagactaaatttttttttgagcagtaagaaaacagccttttgggacagatagtgagtgattcttaggaacttgacattgccaagaaattttatagatgccgaagaattcttatgtgaaattcacataagcatgcccattactaaagacagtttgtataaagtaaccctaaatgtttattgaggaacctacagcttcaactgacttacgtgcagatatgtaccaggagaacatcattttagcttgggcgtctttacttggggttttcagaggatccaggaacctcactgtatgcaaagtcttgtggatgtacctgaatgtttttggaggcaggtcacatagtttctgaaagtgttctcttattttcctcaaatgtaggtaaccattgttacaagttatttaacaggagaatagtaacaatgtctaacttatgctaatgattttgtgtgctgagctcccattaattaaaatgtcttcaga

SEQ ID NO: 271338 - DNA, 1063 bp, Homo sapiens
gatgtcttcaatttatgatgtgtttattggaacataacctcaatataagttgaaaagcatatgtattttcaattctggcatgaacctatgggaatcttttgcatttaagaacctccccattttaataatttcatgggtctaagattcttcatctgtttataaggaactttagtcttagtgattagagactaaatttttttttgagcagtaagaaaacagccttttgggacagatagtgagtgattcttaggaacttgacattgccaagaaattttatagatgccgaagaattcttatgtgaaattcacataagcatgcccattactaaagacagtttgtataaagtaaccctaaatgtttattgaggaacctacagcttcaactgacttacgtgcagatatgtaccaggagaacatcattttagcttgggcgtctttacttggggttttcagaggatccaggaacctcactgtatgcaaagtcttgtggatgtacctgaatgtttttggaggcaggtcacatagtttctgaaagtgttctcttattttcctcaaatgtaggtaaccattgttacaagttatttaacaggagaatagtaacaatgtctaacttatgctaatgattttgtgtgctgagctcccattaattaaaatgtcttcagaatgcttgtttccagatccttggtctgtattattaagatacatgtctaggtgctacttcaggcttacagaatcagtctttggaagtcagatcaggaatctgcattttaacaagcatccaggtgatttcttgagcccctctgaagttagagcactaccattatatattgtatttcatatgttaatcttttgatttatggccaagtggacaattcccttaatttttaaaagcttgtcccttgattttctaagatatttgctctagttccggtcgccatttttagtaaaaagtgatgacagctcagcctgttatatgtagatttctcatttcttactttctgaagaaaattaagctttctgtgtcacttctgagcacgaaacaagattaaattattggaatctga

SEQ ID NO: 271339 - DNA, 458 bp, Homo sapiens
ttttttttttccgagacgagtcttgctcttgttgcccagtctggagtgcaatggtgcgatcccggctcactgaacctccacctcctgggttcaagcgattcttctgcctcagcctcctgagtagctgggattacagacacgtgccaccatgccctgctaatttttttgtgtttttagtagagacgaggttttgcaatgttggccagactgatctcgaactcctaacctcaggtggtccaccagcctcggcctcccaaagtgctgggattacaggcttgagcaccatgcctggcctaaaaattcttgattcagttctagatttttacttgataaaataaaaaggaggcaaccctaggttaggtcgagggcaaaacagaaggacacagaaactacagtcccaagtttagtcattagtggggtggaaatctgatttttttaaaaaaatgtacagaacttag

SEQ ID NO: 271340 - DNA, 554 bp, Homo sapiens
gctctggagaacaggtggtcggtttcctacgaagctaaacacacagctactgagctaccgtgggacatttatcccagagaaacggaaactctcattcacacacaagtccgtaacaggcgttcagagacgtgtctgttgtagccaaacagtggcatcaacccaggtgtcctacaggtgaacggttcaataggtggtctgcacaccacgagatggcccttggcagggagggggagtggcggatgccccgagccctagtgaagagtgccagtccagaggctgcagctgttggtccccttctagaacataactaagatgacagtctgggcatggtggctcacacctaccatcccagccctgtgggaggtgaggccagcgggtctcttaagcctaggagtttgagaccagccatagtgagaccatctccaaaaaaaaaaaaagatgacagaactgtagtgaagcattcaggtcgtgattgctgtggtgctgagaggaatccgtggtgcggtcagtggcgcggccccgcactcacacacacgagtccagctggccacgtc

SEQ ID NO: 271341 - DNA, 442 bp, Homo sapiens
gaatgtatagttccgggctccaaaacaaaggcagcccatcttagcctgagccactctgacttcactctaggaaatactgcctagatatctaaaggaaagtgatagcaactgcaaccaactgtttctgaggtctgcctgcccaccaatggccccctcagcacatgggaacacgtgtggaggtgcctggaacagacactgactcagcggggttctgtacagaggcagtgcgggtgaagaaatgaatgcagattccccaacaatccagaggtatatgcaagaggaggggcaggggttctttcaagtcaccttccaggtgaccaggtgcctttacaactctaaggctctgtgagtatgtttttttcttaccttatggaataaagggaaaaagaagacagctgccctgggtatggctttgggtcggaataaacatttctcaaattga

SEQ ID NO: 271342 - DNA, 355 bp, Homo sapiens
cgtcgacgcccctcaaggtctcttcagtttctgatccggggagccctgcaggttgtcaggatgggttttgtgggcttattgctgctttccaggacctttgagaagccgtaagtctccttcctaccaggaagccctcgctcaggaacgcacagaccgggggggagagagggtagcacagagccagggagcagggccaggcggagcgaagccaccgaggccactgcctgcagtgacgttcgaaacggacagtaggaaaaggacaaaacttgaatgacacagcagaggggtcaggagtgggaggcagaattcgccatgctctgtcatctcctccaaagccgccatgggcaatgacaga

SEQ ID NO: 271343 - DNA, 385 bp, Homo sapiens
tctgtagtcgctctgggtgagggctcctggtaggaaggagacttacggcttctcaaaggtcctggaaagcagcaataagcccacaaaacccatcctgacaacctgcagggctcccggatcagaaactgaagagaccttgaggggctccagttccacagggagcagcggagaggaagggcccagccgggggggagagagggtagcacagagccagggagcagggccaggcggagcgaagccaccgaggccactgcctgcagtgacgttcgaaacggacagtaggaaaaggacaaaacttgaatgacacagcagaggggtcaggagtgggaggcagaattcgccatgctctgtcatctcctccaaagccgccatgggcaatgacaga

SEQ ID NO: 271344 - DNA, 434 bp, Homo sapiens
gacggtggccactcttgttgggaaccttcacatagagtcctccaaggagagaaggcagaaagtgaaaaggttagtaaatctatggccagaaggctggcctctggacttccaggaccatgggcatttttatgaatgccatgacagctaaagaattagaggaaagactcaggcaatatgccaagtaacgtcccactccacttggaccaaactgttaactcaaaactaatgtggattaggtaatgtgattgttaagcaacgctataattaaagatactccaaattggagcttagggaatcaggatggcttggtaagccccacctcatccttctgccacaagtgatgggctctttcccaatcttactggctattctactgaatcataagtaaagctacaattacaggagggagtcccaggccctctcctagtaaagaa

SEQ ID NO: 271345 - DNA, 427 bp, Homo sapiens
aaaggagagaggcacagacccggatgagatgacacacactcaggcacttaaagagacatttaaaatcaacatgttccaatcgggaatctagtggtcggcagagttcaatggactgaaatgcaagaagttgaatcagccccagggaggtaactcttaactgtgatggtgcgtccaggagctgggaaaggagcttccatgacacttcgcatgaatgggtaaacaagggctggagacatttctcttctcttctctacttcatccagaatctatatacgcaaagtgttattttattatggactaagttaaaaaatataaaagaatgccattacaggaactgccaaacctggtgtacaaactttaaaataacccaaataaaatttaagacagataagcttctgcaatcaataaaagttaaataagcatcata

SEQ ID NO: 271346 - DNA, 463 bp, Homo sapiens
tctgtgggaatttgatggtttgaattcaagtgtctgtaatggtgaaggcgaaagtcctgcttgactgaggcctccgtagcctgtgactcatctgagcagtgtcccttcagaagctgcttaaacatttccctgagcttaaagaattgcactgcactctggcaatgaatcagcgttcctattgctccacatcctcaacagcatttggtgttgtcagttttctggattttggccattgtagtagatgagaaaattgagaaacggagagatgaaaacatttgcctaaagtcaaccagttataaatggcagaggcaggatttgaatgacagctgtacaacttcagagcccctccctttatttcacaacactgaagtgctttggggcgggcatgctggtcaatgtataggggtggtttatttatttattttctaactaagttactgcaggcagccgtggcttagttaga

SEQ ID NO: 271347 - DNA, 222 bp, Homo sapiens
cgagggcacagagagattcgagttgtcacccaagctcacatagcaccagtgacagaggtgagatttgaatcaggcagcctctgtctagagttcccttcctaacctccattctatactgctttcaaagatccagcccttccctcaaatcacgttttcttacttagactagggtttgattcatgtttactcactgggaataaaggtcagttaaacagaatgaga

SEQ ID NO: 271348 - DNA, 339 bp, Homo sapiens
aagatcataatatttacatatactgcaaatgtaatcttaattataatgtagtactcagcacaccatataatccatgggcagttttctcagttttaaaagtgactccaaaataattcataaaatatgatttttctacatctaatcaacccaattaatttgatcaattgaattataatttatataaaatatctcaatcagtactgcataatttcatttactattttcttttagtgcaagtcagtatttagaaatgatgagtaattaaggtttaccaatcttattttgtgctctagatttctgatacaactgttgtaatttttaaaatgtcagtataacaga

SEQ ID NO: 271349 - DNA, 1530 bp, Homo sapiens
aaggatcccgctgagatgctgggcatcagccatcctcctgcctcagacctccaagatagccaggaccacaggcacgcaccctgaggaggaagaaataccaggtgcgcatgatccaagaaaaagccatctgaggacgcggcaagaaggccgccatctacaagccaaggagaggggcctcaggagaaatcgaacctgtcacaccttgatcttggacttccagccttcataactgtgagaaagtaaatttctgtgtacaagctaccaggtcggtgggattttttatggcagccctagcagactaagacaggcatcaatggttccaatgtttacattttttttccggtaagcagaccgaagcccagagagatgaagcaatttgcccaaagtcacataccaagttaactgaagagttggggttagaatccagctcttgtgacttctctcttttcagtttcccttcccactccccccactgaaaagcttttgagtgactcttttagaagtcccggttctgtatatgaagcagaattgagcacagctgctctaatgaagggctcagagctcccaggcttttctctctcccctgccccttttccctgttgcacctctgcagtgtcctgagggttgaatggaatctagtttgaaagctattgctctacctcactgcctcctgaatgcaatgtcacaaattttcccaacttgccatttctctcacactgacataaagcattagaaacctgttgtgaagtaggaaagctaactgggtcagtagctgataagataatctggcctaggggatagatgattaggatttcagagaaggaaaggtcacccaattgatttgactctgtcctggggcgatgatatggtgaagatttctacagatgcagcagaaacatccggaaaccaggtgtgtcccagctctggtctgggaaccatttcataaattggcaaatatccaggatatacacatggctaattctgaggtgtactgaagtttcaataaagctactttggtaatgactgggagaagaaaatcctatggctggacttcattaatgttgtatggccaaggacagtgtttctctaattatggcctgtgaacctccctggatctcgatcacctgcatatttgggaatatgcaggttccagggtcccacctgaaactacagaatcagtattgagatcccaggtgattctcatgtacactcaagtgtaagattattagcacctggactttggaagcagccagataaaagtttggatcctgggttggctacttcctagatgtggccaagtcattttacttgccatgcttttgcttttcttgtctgtaaagtggacatgatacctattttacagggtggttttgaggaataaggtcagcattaaacatttatcctctttagggagacagagagaggagatgaaatagagtagaattgagaaaagcagtttcttagacctccctgtgaagtttttcttatttcaacaaataataaaataaaaaattcatacactttcttagt

SEQ ID NO: 271350 - DNA, 516 bp, Homo sapiens
agatggctgttcttagagcatctctgaagaaagatgctataaataaagctcaaatgattattatctagaattaggaaagccaagactcaaagaaaaattcctcttaatcatttgttcatctcaaaatattataagtaaatgtttagaaaagcttagcttgtcaggttatcagagaatctgattttcttatgtcctgtcagtttactgtcctacagtttactttttataaaagtaagcttcacaaggactaatctttctgcaaaagggatattgagaagatcagtacaatatctttcttcccgtggtcttaaaaataattgtgtgattatttgttataacaaaaaccagactcttagaatccttgattctgagataagttactggcgaaaactccttcactggaggtatttttaaaaataggacaaaatttgatgtctttagattgatagaggaatagtactacttgggagagctgaaatggattaaatgtttcttgccaaactttattatatctat

SEQ ID NO: 271351 - DNA, 451 bp, Homo sapiens
ggcatgaagctttgttctctgacataacctatgcatctagcactgtgcctgcctacaggaggtgctcagttactaggaaattaacaaaactgccttgcagatctttcctggctgaagatgaggagtgagggaagagaaagaagacaactaaattaggccctcagctcctatttccagaacagttctgagagtgtctgtttcagagtttgagtttccacaactgcctttgttaacaggagggatctataaaaaaccaatggtctggaccaggggctcccactctgaaagtctgtgactaccaggggcagtggagttctttcacgattcgcctaatgttgttgtcttagaaataataccacttatacaaaatacaaaaccagcaggactatttcccaaataaatgtaaatgagactggaattaataaaggtaaattcattttttaaaattaca

SEQ ID NO: 271352 - DNA, 683 bp, Homo sapiens
aaaaaaaaaaaaaaaaaatcaaatgagaacaaattacgtgaatcatttatcacagtgcctgccacaaaaggagcacccaataaaagttatctcccaggtcggtggtgattcttattatcctttcatgttccttggctatcaagactgaaggggaagtttctgatgagcagaaatccctaaggtattgagggaatttatggaagagtcaattattccaaccccctgcctctgatctcagttattcctggggtacttgggtttcagaagccccagggttaagtgttgaactctcacttggagcccaaagtggaatatggtgaggagttcattatatttcataatgtgaaaaaatatttcataatatgaacaatagcaaggcgctcatagctcagacctctctgatacagtccatttctttttatgaggtctcatgccaagagacggaaaagagctctaacagccctgagcagctttagagtattacagtgtgccaggaactgctttaagtgaccaagagcagtacccagattacttggaggtggtggacctttccacaagcagagtttcgttaagcaagcaaggggcttttggagaaatttcagattcgcatctttcaaagactgagtcaattctctgaaaagtaaattgctaagagccaatttgctaaaagtcagctctcaaaa

SEQ ID NO: 271353 - DNA, 477 bp, Homo sapiens
gcgttttttcccctctgacgggcagactatgaggtttcctaagtgctttccctaagtccagaatcaaagagatttgattggttctttccttcaccagcttattttattgtgttggatgatgacttggcttttcatgtaaccctgagagagagggatttgtttacgctcccctgggctttgggaggggactgaggtctttgaggaagaaggcagctttggataacatcgagaactaggatttggtggtgaagttgtataatgagaccacattctacccaggactgaacatgactatcgaagccaacctactcagagcatttgatacagaagttaaaatgggttcagtcttctttgtaaataaaattgtatgtttttccttgtggctgtggggtcccagttagaataagctgtttataatgacataaataaccatggcatctctagaagttatgcatcaacgtcttttcaccagtgtgc

SEQ ID NO: 271354 - DNA, 440 bp, Homo sapiens
gcaaccttctaaatggaagggcaaagcctcaactatctaaaatgcagcttttaaggactcttagatgtatgatatgccttatgtacaggagattccatctataccttgacacccacaccactcccacccctgttctctcttccaagaaggtttttggcagcaaatagttctctttaattattatatttaaatatttgtatatatttaattcacattagggataacaactaagaattatttaattggcaggtttattaggtagttgttgattgatgacatgtataacaatccaaatggtatgataggtgaagccaatgcagtggcacatgcctgtaatcccagcactttgggattgcttgagcccaagagttcgaggttgcagtgagccatgattgcatcactgcactccagcctgggtgacagtgtgagactccatctca

SEQ ID NO: 271355 - DNA, 343 bp, Homo sapiens
ttgctgcattggctggtgtctccaatagagtgtcgaaaagaagtgccgagggtagacattcttgcacagttcccaattttagaaagaaagcattcgggctttcaccatcattaagtgtggtgtcaaccttgagtttgtcacttacaccctttatgaggctgaggaaattcccttctattcctaaaatgctcagtttttattacaaatgggtattaaattctgtcaagggccgggcgcagtggcttacgcctgtaatcccagcattttgagaggcctaggtgggcggagtttgagaccagcctggccaacatagtgaaaccccgtctctactaaaaattccaaa

SEQ ID NO: 271356 - DNA, 924 bp, Homo sapiens
gtgtatactgttggggtgttgggtgcaccaaaatctcacaaatcaccactaaagaacttactcatataaccaaataccacctgtacctcaataacttatggaaaaaaaaatgggactacggcttacttgggagaggggctggtaaatgctctagactttcgtttgagaacttgaagggctgcatcctatgagtaagagtgagcaggaaatagactagccccataaagactgaagctgagctatcagttaggtcaatccagttggattaagatagtttggaattactggtgcccttcagctacctgccagaagcaaaatttttcctctctggaggaaaatagcatcatccagagcctctaattatctctgataccttttcatttaaaatattctgtactcaagcagaaataactaggcatatgagtagacaagatgtaactgaaaaccaaaagaagaaataggtgatacaaaaagatccgtcagggttgcagataatgaatggagttatcagatatagtctttaaaataactatgattaatatgttcaagctctcagatggaggctcagagatacaggaaaggacgaagagcaataaaaagtgtaaatatgtaggtaaagttaaatgattgttggctatccaaaaataattcaaaatatatgcaacattaaaatacacaacaaaaatagttcataatttgggagggggttaaatggaggaaaagtgttctatgttccatgcattgtctaagaagtagtaaaaatatgaatttagattggatttatattagtcaaagatgcatgttttaatggctggagtaataactaaaagaatagttaaggaatgtgcaactaacaagcaaatagagggggaaaatagaataataaaaattagtgataaatccaaaataagacaagaaggagag

SEQ ID NO: 271357 - DNA, 473 bp, Homo sapiens
gcggcttgcctggcatttgatatcaagatggcggccaatgcctcacttgtagcccaaatactaagaaaaactgtggcaagaatcacgggtcctaggacctgcctaactgtggttttaggaagctgaacgtccccaaatttcatgtatctggcatctgcaggtttgcgacccagagtagctgggccaatgggcacctggcagcagctcacagacaaatgcggaatttcaaggtcctcctaagccatcgccacccacacttctcccgaggaatcttttctcccccacagcaagtcagggccgaatagaactcggttcaagaaattctcagtgtttagagctcaaaaagcacataacttgctattgctaactgtgggatgtaagccctgcactaagggtcaaacaggtacttaacaaaagtccttcaacggtggaatataatggcctccagcaaataaagcatataaatattttct

SEQ ID NO: 271358 - DNA, 448 bp, Homo sapiens
tcacatcctcctcattccaccacctctgctgggaggtacagagcagtgctccagtgccccatctgcatggaggtgactcctgagggtgtcggccccctgtcagtcatttgagagcagaacagggaaactggaccgcagaatatcctgctggaaaatgacaagctaatgagaggaaatacgtcaagatgatcaatgactttgggaggctgaggtgggaggatcacttgaagccaggtgttcaagaccagcctgggaaacattatgagacctcatgtctacagaaaataaagttgctgggcataggggtacatgcctatagtcccagctacttgtaaggctgggaagggaagatttcttgagcccaggagttcaaggctgcaatgatctatgatcgcatgactactccagcctagctagaaagcaagacctgtctcaaaaatagaaaaag

SEQ ID NO: 271359 - DNA, 382 bp, Homo sapiens
actttatttctgactctcaaacttcgccccgatcccccaacctcgtctgttttcacaacctattcctgagcccaaaatgtgtctctgaacttccaagctcgtctctgctccacaaccccgcccatatctgcctccccacaaactccatggctacaccccaaacctctctgacttaaccccatatctgaccttcaaattccacctctatctccccctaagccccatatctgccccctagaccttatatctgctcccttcagcccggtgagaccctcccttgagggctgggattggaacgttacctggggtgaggggctggggccgagggagagtggagggtgccagctgctgcctgctgccgccgttggggcaacacttactc

SEQ ID NO: 271360 - DNA, 201 bp, Homo sapiens
aagcccaagcctgtccaccagatgtgggccccggccagtctcgctcacaggagggtctccggggacagcagtcagaggccgagggttttgctgagctgaggcctgctgtaacttggagagctgcatgtttatgctactgtctccattctcagccaggccttctagggctgagcatgggccctgccccacgcaggagtgaca

SEQ ID NO: 271361 - DNA, 556 bp, Homo sapiens
gatttctgagccttcataactctaagaaattagctttttaaaaataagtcacctagtttcaggtattctgttataagcaacagaaaaatggacaaagtatgtcttaagtaaatctcacaattgcctgtacggtagatataaataaatattattactcctattttacagaagacagaatcagagaggctcagcaaatgccagaactcaaattcaagcgcaactctgcctgatggaaactcaggtgatttccactctgcctccacctgcattcctcagcaccctgcagttggtccccagactctatgctccatgctgcttgtgtttgttggttggctggtttcgtgttcatgtgttctggcttcttcattttgggtctttacatctttacatctctatagcagttcttcccatgttgtgtagcagttgtctctacgtgacagtctgtcttgtgaggtcgagttccctgaaggcagcaagcatgtaattggtaaattctcatcagttagccatgtctggaacatggtaggtattcaataaaggtttttgctcatttaat

SEQ ID NO: 271362 - DNA, 380 bp, Homo sapiens
agtcagtgtatatcaatttttttttactgtatcactgcattcagaggtatcaaattttgcttgcagcgctgtaaaagtttaccagtcagatttgtcggcccggcatggtggctcacacctgtaatcccagcactttgagaggccaaggcgggaggattgcttgaggctgaaagtttgagaccagcctgggcgacatgatgaaactccatctctactaaaaacacaaaaattggccaggcttggtgccatgcacccgtggtctcagctacttgggaggttgagtggggaggatcgtttgagcccaggagattgaggcttcagtgagtgattgcacccttgcactccaacccagacaacagagtgagagcctgtctctaaaa

SEQ ID NO: 271363 - DNA, 410 bp, Homo sapiens
gcaggttcatagatacacccttcaaggctgtccctccaaatgagaagagcatgaactatgtggttgtacagcttgggtgtgaattccagcttggccactatgtgactttggaaaaattacttaactttgtgtgcctaatttcctcatcggaaaaacaaagataataaaacatacctcttggggttgttgtacggattaaatgtgcctgtgtatacagaacccctaacacagtctctcagatgttgtaactgtttaacaagtagtgatgtgattattgttgataatgttgatggtaaggccacttaccccaccatgggttcaattttaggaagctcatcgttgctgcatggctgagccctgtctgcaataccgctagtatcagtaataaaatggatactttgatctctacc

SEQ ID NO: 271364 - DNA, 442 bp, Homo sapiens
tgggctacatcaccaaggattaactagcacatggaacttacatagcaacatggagcaaaataataaagattacgaatagtagtgctgcaaagtatggtatagctgaagtgctaattagatagtatagataatgtgtactataggaattcagtccaatgcttttgggacatttattttaattttacattataccagtggaaagtaattaaacaattatgtcattaaagaaatagtagccaaataaattcaaacatatatggtcaactaagttttgacaaagaaaataagagaacatgatgaagaaaggctagtcttttcaatgaatgatactgggaaaatggaatctccacatgcaaaagaatgaaattggactctaatgccatatgcaaaaatcagctcaatttggctaaaagacctaaacgtaaaacctaaaaccataaaa

SEQ ID NO: 271365 - DNA, 271 bp, Homo sapiens
caccaacgcggagtccacctccttcaaccctacatggtcgatcacatcattcacaccagagaagacatagacggtattaaggatgataacagtatttggaactgaagacctgatgggaaaaaaaccttcaagttctatactgtactgtggataagcggctcagttcagcagagctggagttgaacaactttgttcctctggtgtggtaaattgacctaaaggtgacctctgacgatttcctgaaataaatatgcaatgttacattttcaaa

SEQ ID NO: 271366 - DNA, 505 bp, Homo sapiens
cagagctttacatttacatatcatctatgatatggaattttattattattacctagagaagttgtcattgatcctctcactctccctgttaatgagcttaggctgccttatgtcttctggggagtgaagtatctataaacacattcacacgaaagttctgggaactcagtactgatgttacttcccagaatatttgcattaaaaaaatttctatctttgacatgaaactactactctgaatttatccaaaggaattcatgagataaatgctctaatgtctgatgcaagatactcaccaaagcattataaaaatagcatccagtgggaaacaatctcatgtccaataaaaggggactgactcagttagtggattaataggcaccacatgatgccatagaatggtctttatcgacacaacatgtgtctgtgctatatggtgaagaaacagaccaaaactatatgtaaactagctagactgtatggaatgatcacatttagtaggaaa

SEQ ID NO: 271367 - DNA, 328 bp, Homo sapiens
tgcctcccaaagtgctaggattacaggtatgagccaccatgcctggccccagccctgaatcttgtctacttcctttgcttgcttacttcgtgctgccattgcaggctccccatccaaaaatgtagccctctttaggccagcaactccagagactgttgaattcaggcacagtttgtatgagctatagcgcctcatccctgtattagagtaaatacgcacaaaaacacaaggtacttttctgtcctcttaaaattaataatggcttcatttgtaagacatttgaagttataaacgttctggaataaagttgtcagaaaatctttgcagc

SEQ ID NO: 271368 - DNA, 443 bp, Homo sapiens
actcatggtttctgcactggaaaaagcacaactgaggtggaaaactagcttccccaccatcatgggttccctggcaggagccctgttcctgcctgactctatgggaagaattgccagtgcctgaatggagtaatgttcctgatgacagcctaagacagaggaggcaagtggcactaccaaccctagtcctagaaactgtgctctgcaactcttccaaaggagatgccaaatgtcattgactgttcagcagctacttgctataggaggtacgttccacaggtccttttggcacaaatctatagctagcctccccacactgctaggaatatccaccttgggaagacccccattcagtatgagcagtactctaatcatttgctagaggcaaggcttcagtagccatctagtgccaaaaaggaggcagtgaaccaatggaatttaaa

SEQ ID NO: 271369 - DNA, 461 bp, Homo sapiens
tttctgaatattaaggggaaacaaacaaaaaactagagagaatgcatgcaattaaacagtctggcctagaatgtacacagttttgatcctagattgttctataaacacataggcactatctcatttacatgcacacttttcctattcagcaaatatctgagtgcctactatatgctgaggataggggaaaggctggcaccccatgcacttttcagatgtctacagcagaaccccaaagattggcacaacttaagtaacagaatccaccaagacaaacttcctcatccaatctattcagatccaatcctgtcggttctgatttctaaaacatcctctgtcaactgacaaaaagacctcactcttcagatgaaaccactaccatgaacaaactcctggactatggccttgtttaaaatatcaatataataaagaacattcataaaataagggctacatacaga

SEQ ID NO: 271370 - DNA, 736 bp, Homo sapiens
agtgagagaaagggtatatgaagtttgcaaatgacgatacttgttctctttattttgttacttaggttgtatttcacatgaaggatgtgagaattttatgcgtatgaaggaagcattagctttaaaaatactgagaaacatgctttttcttttgtccttcagaatgaggggcttcctttgtaaggtctggagttggttatgggttttgactctgaggatgacattgagttttaattcagcttgtcctggttctgcagtcaaaaattccatgttagcctggctcgagacttaagagacaaatagatggcacaggcacaagcgtgtgtacacatgcacccaccgtcatacaaagtgtaagggaggagtggttttaaataagatgagaatgaagtgacaaaaggtaactgtcattccttcatgttcattcttttaaggtaataatatgtgatggaagtaaaaacagcgaaaatacccaagaattagcccaggatatgcaaatttaaatgtctgcagtggacagaaaggaaacaaagaagtgaatcacactgggaataagaaaatggagactagagatggtagggagaatgagcttccctttttaaggaggcagcaatcttacagaaattgagcctaaaattgtcagtattgcaagagaagacaaaaattcagatttttatgtcaacaccactgattatagaatgttggtagctaaattgaaataaaatttaaatattat

SEQ ID NO: 271371 - DNA, 451 bp, Homo sapiens
gagtttgtaattactaagatataacaaactgcatttctagaaccccattttttcagttaatgaaaataaagctgctagctacagttttaaataatttatgtgttgcaatcatactcaaggacacaaaactatgagagctggtataagaataaaccactgcatattattatacaggtgaatgtcccctaaagactggtaactggctaccggcttgcactcagcaaagcactgcttctgcaactcaacctaaagaaaactgactgtacctctgcattcactgccaaaatctggaggttcagaacttacaaaataaagcccttcatcaactgagccctcctggacttctccaatctaagcctgggtttgcctcaaagcacgcttcctgtaccacactcctaagggtctgaaattcatgttacttcctgaagtaaaatgcccttccctctcttca

SEQ ID NO: 271372 - DNA, 317 bp, Homo sapiens
caaaaaagctagaacaggcaagttggtcttgaagaagcagtaagttgtaggagttattctgctggatttcaaaactcatttagagctacaataatttaaaaactatagtactagtgtaagtatatagaagtatatcaagataaaaagaatacagactcaaacattatgctcacatatatacagttatttaaagtttttaaaaacaaacacgccagtgcctctcattggggaaatgaaagacttttcaataaaaagttcttgagtgaaagaagtttaagaccagcctgagcaacacagcaagaccttgtctctacaaa

SEQ ID NO: 271373 - DNA, 331 bp, Homo sapiens
cgaaatggagtcttgctctgtcacccggcctgggcaacagagtgagaccttgtctcaagaaaatttttaaaaaggcagtatcttctgatattaaggaagatgggtatttctagtggaatttcaataaaaatttttctataaatagggtataggactaaaaaatgagtatcctgattttttactacttctttgaatcttggcatctttttcaattatgtttctcatctatgatagatattaaaaccaataattaagataaattgaatgtaaacccatacctcctcagcagatctgtagaacttatgtaaaaaaataaaaatacaaaataaat

SEQ ID NO: 271374 - DNA, 546 bp, Homo sapiens
gagcaataacccatccatccttcagtgattcatactgattctctgtgtcatttgccatgtgaaacattttacttcagtttgctatgaaaatttcagaaacctatttctgaagatataattacctaaaatcgcatcatccaagaagcctgttcagactggaatgcagagctgcaaaacattccaagcagtcggatttttagaggatgaagcttccaggtccaaacagagtagcttcttagtacctttgggcctttcacactttttagtcttgcagctacagtgaagaagagcagcatcattaattagctgtgtaaccctgccaccccccaccctgcattccccgcccaggaaccctcataaggcctcagggtcctcaactgtaagataggaagggtgtctgacctctaaggtttctctcaactccaaaattctgtgattctgtataggtgctttgcgcttgattttaagtttctacacaaatattactctaaaaaaagaaagtcaatgtaaaaacatttgggaataaaagaagaaattccagtattc

SEQ ID NO: 271375 - DNA, 563 bp, Homo sapiens
ggtgcgcaaacataaggcttggttctttttgagaaatgatgacaaacataactgcatgtgttctttttagatgtcaagtctgcttcaagctttgtctgcttatttttctaataaaaaggttttagaaaatcttttagctgttcctttgaatctaacaatattaatataactagagctttaatagaaatttcgtaagggctaaacaagaataaattagtcacagtgttttatgaattgcatgaattcccatcatgaagagaaatttgattaggctgtgggaagccaaaaatgtttctaaattattagcacctagttcctcaatccatttgcctataaatttggtataaaaacattgctagtgaaattttaaaaattatttttctataaaggcaggtccctgttactctcttatattaaatagaaatatcacaagatggaggaagggaatagaattctgaaccttctgtgatgtgagcagccatattggtggaatacaggccttacttagagtgggatattcattgcttggcaataaaggttaattgaactttgggtgagaggct

SEQ ID NO: 271376 - DNA, 449 bp, Homo sapiens
atcggccgagacccagaagggtgagagggggaagccgcaccctcttcgtgggtgcgatgctgtgaacgtcttccttcaaggaaagagctgcttctggattttccttgaactccaggaggtgctaagaaagcttcgtgactgtggcagatgcggctcagcggcccctcccaacccgcccgcgccagttgggaaagtgactcccccgctccccgccagttgggaaagtgactccttcctgtgggcagaaggcagcggacctggagggagccctcgggctctgagagtcacgcggggggcggcctgctctcccgcgccccctagcggagcatcggctcacacgcacctgagaggtcggaagaggcgggcgcttctctgcctcccccacccaggccccttgcagtttgtatgccctcaccctggataaaagattttggttcaactagaaaaat

SEQ ID NO: 271377 - DNA, 327 bp, Homo sapiens
ccttccttttcaaaattgtcttggatatttttgtgcatttagtcttctaaatgaactttaaaatcaatttgttgagaataaagtgttgttgttcttgttgttttccagcctgggaaacagagcaagatgcgtctcgctgtctcgaagaaaacaaaaacaaaaagaatccacaagaatctacgttgcctctgcggagggccctggtggctgggtgggggaaggggaaaagagacgaaaacttcctcttagttgtagagctcttgcattttgaatcattacttttccaaaataagtaaataattatgttgaataaatttaagttcaccc

SEQ ID NO: 271378 - DNA, 716 bp, Homo sapiens
cctgcgtggcaagggggaggcgtctgcttccgacacacatgctggggaacgccagccaggaaggggaggatccggacttagctggcaggggggatgtgaatcatctctgcaggcctgcacgggcgggcccggtgggggcagggtgctcccctttgaaaaacgctgcgccctgctcttcagcctcagtttccccatctgtaaagtgtgcattccaggcctccttgggctggcccagagctgccctgggcaggggctttcagcccttcacaccagaggctgggtcagctgagtgagtgctcctttgtcctcccgccatgccccaggctcctccctgctccccaggatccacacctaccctggccccgaccctgggccatgcctcaccacacttcctgtcttctctcacatctctcacatctgggagtcctctcccgccagcctgtgcttgcatctggggatccatgccagggataggacctgtcctccctgctggcttgggacatgccctctcccagccactctgaggagggctgactgaggaagggctcgtcaagctgggctttgcaggatgtgtaagagttctccccacgaggcgcagggcattctgagcccagggaatggcttgtataaggatgcagaggcatttgaaatggccaagtagttgcaggaatcgactggaaaccggggtggtaaggtgaagccatagaacattccag

SEQ ID NO: 271379 - DNA, 189 bp, Homo sapiens
gatctctgttaaaaataatattgttagtgtgttggatagatcaaaggtttgagctatcatgaggcagagtgtttcacctctagctcagtgatatgattctctttcaaaccgtccttaatttaaagaccgagaagtgagttttctctctgtacacttccaagtaaaaaagcaatgttagtaaatacaagt

SEQ ID NO: 271380 - DNA, 360 bp, Homo sapiens
tatgcagcaaaccaaaaaagtgaattgaaataattacatcaagacagtggaggggatattgcaaaaacaaaggggtttgtttgaatgcatcgaattgctctctactttcagactgaatccttagcatcatattatgctcctgttttttagtcaccagtatagatcctggaattgccaggtggagagaatgttaatcactgtccatggtcacagtagatcaatatttttaaatatctttacacgatttgcccaaagaaatgtcttttggcagttgtataacccccatttaatatacctttcaatgtgacaggtttagaagatttttgtatacgttttgtaataaactgatatatattagga

SEQ ID NO: 271381 - DNA, 498 bp, Homo sapiens
ataaagtattgctttattattgtattcagtgtacatggaatattgagattccatgtagcatgtcatataagagaagaattttgtcacaaaaccttagggatgtagattatcatttgttcaacaagcaaatatcctggaatttaaggaagcttttgactttcattgatagggtgtttgggtcagtgatcagcacttaaaagtgcgtcagcaatcaacatataaaagcgcatgggccagacatggtcactcactatcccagctacttgggaggctgagacaggaggtttgcttgaggccacaagttcaagaccagtctgggcaacatagcaagtctccacctcttaaaaaaaaaagttaaaaagaaaaaattgactgggaatggtggcacgcacctgtagtcccggctacttgggaggctggggtggaaggatcacttgagcccaagagttcaaggctgcagtgagctatgacagagcaagaccctgtctctcttaaaga

SEQ ID NO: 271382 - DNA, 992 bp, Homo sapiens
tgcagtgagctgagattgcaccactacactccagcctgggtgacaaagcaagattctgtgtcaaaacaaaacaaaacaaaaaaggagggactcagagagccagggaccagggaaggacatgaagcagtgttcggaggacagagagagagaagaatggggaggggaaggagcggcacatggggttgagcagaggagaaaatcagaaagatggcttagagaagccagcagtctgcaagtctggggaggatggagagtggtttggggttttgggtcggggtctaaggtgatcagatgcagaagcattacacggtggcctggtttctttactcagcccctggggtagatcccagccccccatgtaggtcccttggctggaaaaggaagagggagtggtcagatgaatctgaggaggagccggagaaggagctcgcccctgagcctgaggagacctgggtagtggagatgctgtgtgggctcaagatgaagctgaagcaacagcgagtgtcatccatcctccctgagcaccacaaggacttcaacagtcagcttggtaggaggataccccagagagcacctccaatcctgttctttctaaaaagaggaaacttccaataaccacacttttccaatgggaaagatacgcccccagtggctgagctctccacgcaggaggactcagaagtgatcactcatgagggacacttaggagacgatagaagactaggctagacttgataaaggttggcgcttgggatgagaaagcttggtttcgggccaggtgcagtggctcatgcctgagatgctagcacgttgggaggctgaggcaagaggattgcttgaactcaggactttgaggctgcagtgagctatgactgcaccactgcactccagcctgggagtacagtatgcatagactctgtctcctttacatactactgtactatatactctgtagcttgcatcagctctgtcatcagccgtgttaggtacgg

SEQ ID NO: 271383 - DNA, 1028 bp, Homo sapiens
tgcagtgagctgagattgcaccactacactccagcctgggtgacaaagcaagattctgtgtcaaaacaaaacaaaacaaaaaaggagggactcagagagccagggaccagggaaggacatgaagcagtgttcggaggacagagagagagaagaatggggaggggaaggagcggcacatggggttgagcagaggagaaaatcagaaagatggcttagagaagccagcagtctgcaagtctggggaggatggagagtggtttggggttttgggtcggggtctaaggtgatcagatgcagaagcattacacggtggcctggtttctttactcagcccctggggtagatcccagccccccatgtaggtcccttggctggaaaaggaagagggagtggtcagatgaatctgaggaggagccggagaaggagctcgcccctgagcctgaggagacctgggtagtggagatgctgtgtgggctcaagatgaagctgaagcaacagcgagtgtcatccatcctccctgagcaccacaaggacttcaacagtcagcttggtaggaggataccccagagagcacctccaatcctgttctttctaaaaagaggaaacttccaataaccacacttttccaatgggaaagatacgcccccagtggctgagctctccacgcaggaggactcagaagtgatcactcatgagggacacttaggagacgatagaagactaggctagacttgataaaggttggcgcttgggatgagaaagcttggtttcgggccaggtgcagtggctcatgcctgagatgctagcacgttgggaggctgaggcaagaggattgcttgaactcaggactttgaggctgcagtgagctatgactgcaccactgcactccagcctgggtgacagagcaaaaccctgtgtcaaaagaaaaacgaaggccgggtgtggtagctcatgcctgtaatcccattactttgggaggctgagatgggtggatcacttgaggtcagttgttcgagaccaaccagacc

SEQ ID NO: 271384 - DNA, 396 bp, Homo sapiens
ggctcatgcctgtaatcccagcattttgggaggtcaaggtggacagatcatctgaggtcaggaatttgagagcagcctgaccaacatggtaaaaccccgtctctactaaaaatacaaaaaaattagccggacatggtggtgggcgcctgtaatcccagctacttgggaggctaaggcaggagaatcgcttgaacctgggagacgcggaggttgcagtgagctgagatcatgccattgcactccagcctggcaacaagagtgagactccatctcaaaaacaaacaaacaaacaaaaagatacaaaaggcatccatattgaaaaggaaaaagtaaaactattcatacatgacataatattgtatatagaaaatcccagggaattaactaaaaaaaaaa

SEQ ID NO: 271385 - DNA, 460 bp, Homo sapiens
aaggaaatgaaatcaatctatgtattttgatacctcagttaagtttctcagtttagaaaaatgatacaaaacaaaaacttgcatacaacctccgctgtcattgctgttatgtcacaaaatatcttagactacagtttttttcagggtcaaagacgtgatggctcagagttttgtctcattcctagattattctttttgcagtgttttcctttctttgagttctttaagctttcttctctttattaatgtcaccaaaaccaggaaaaatctgagaatctatcattgatactcacttgctgtctgattacatttaatctgaagctaatttgcattttaatcatctatctgcgtttaaattctattctttgtgagttttattttttattttattattatttttttgacatggagtctcactgtgtctcccaggctggagtggagtggcgcgatctcagctcac

SEQ ID NO: 271386 - DNA, 411 bp, Homo sapiens
ctctacaaaaatacaaaagtaagccaggcatgatgatgggtgcctataatcccagctactccataggctgaggcaggagaatcgcttgaacccaagaggtggaggttgcagtgagctgagatcatgccattgcactccagcctggacaacagagtgagactccatctcaaaaaacaaagaaagaactactgtatagcataaatcatctgtgatttgtacctgtgattttttggtgtcctaagatatttccagtgatcacaagctgctgcaaagtcctgaaagaaatttcaaattaccagctacttaggaggctgaggtgggaggatcgctcaagcccaggagatcgaggctgcagtgagcttgatcactccactgcactctagcttgagtaacagaacaagaccctgtctc

SEQ ID NO: 271387 - DNA, 331 bp, Homo sapiens
acttactccagattgccagaaaagaatgtaatttgctcctctagtatactctttgctcttttgcaataagtagccatccatcctatcattccccaaatatttattgagtgcctaccttgtgtgagacactctgccaggccttttgtagacatatcccctatcctcatgctatatatgctcttctccttctaccttccagagcactttatatgtagtagatactaaacaaagaatagaagcaagtcattcatttattcagctggtgttcattgagaacatatacgccagacactgttctagatactgaagtatggcacagagtgaaatagac

SEQ ID NO: 271388 - DNA, 489 bp, Homo sapiens
aaccaagagcctgttgttagcttattaagtaaggaattgttaaggcttaacaaaaaatgtttatttgcatgtggtaacattttagtggtgtgacatgaagcaacttaaaatggtttattagattttgcgtgttgaatatttgtatgtttttaaaaggtttaagaaattgaaaatgacgaattttgccttggcattcatgtgaaaccatgtgatcattatgttccataattggtcatatcatgtcttcccagtacatttcagtattacatttttcaagaattgatgaagcatatcttgtttcattgtatactcttaaaagattttcttgaaacttaattttgcaattgatcatgaaacagtagcacatttgtttggggcagaagtttatttttaatttaccttatgtctttgcatttcatttttgtcacgaagtttggttttaaaatgacctaacggaacctttaaccaacatgttctttggaatatagg

SEQ ID NO: 271389 - DNA, 307 bp, Homo sapiens
gcacaggcatcagaagcagagctcttgccacccaaggccctgagggaccagtgaagtaggagccgtggggagagggtgcctgagaggagcagggacactcagccgagggacacagccagccaaggcggcctcacaaagaggattttcatggaaacaaatgccctgactacttcattcccacatcttcggctgaggctcccatggcaagtggagagagcagctgcaggtggcctcggtcacttgggtcagctctcctgcttaaaacaaacacagaaatcaataaaagtgttgattgtattatttaaaa

SEQ ID NO: 271390 - DNA, 230 bp, Homo sapiens
cattaggtttaagatgcttattaaacatccaagtggatgtgttgattatttatttgaatgtgaatttggaactcaggtccatatgaatttgggagatcctcagtatatagatggtatttaaagtctcaaacctagataacattgccaagggaatgttgaaggtaagatagagaagagatgaagtctgagggctgagtcttgaggcacttcagcgtttagaggttgtggag

SEQ ID NO: 271391 - DNA, 395 bp, Homo sapiens
gaagctcacaaaactgagcttcaaaatcttactctgtaatgtcacgaagccaggatagtgactggctaacgtttccagcaaccaacaccagcccaactttcttgcagctgccttctccatagaatgctggagatgaaaaagaggaagaataaaaaggagaatgagacaggtagctcttcttaccctgtgccaccttgctctagcagtggttctcagccaggggtggtttggcataccccgcaacccccaagatattgggcaatatctggaaacagggttgtcacaatgtgggggtaaggatggatgtgctactggcatctggtgggcggatcttgaggtcgggagatcgagaccatcccggtaacgcggtgaaacctcgtctctactaaaaatac

SEQ ID NO: 271392 - DNA, 434 bp, Homo sapiens
agaattttaagcacctcaaaaacacagttctataaaagtcatcttttttcagaaactttccacttatctctcaagttcaaagtagcagaggtgagtactggttttccctctgtctgactcctttaattttgtctttgtttccagagtaaactatgctctagattccctatatcataatgaaagagagaggaggaaaaacaaagtatccttttttaaggggggaccatctctaggtattatttagcctgcaatagcatggcttgctttcttatttaattatttttatttatgttcttccactatttatttctccttcatgtcttttatgcattagattgtattgaacctagttccaaatatgtttttttcataaaatttggttactgttataagtaagcaaagttgagatgagaaataaactaaatattaaatct

SEQ ID NO: 271393 - DNA, 144 bp, Homo sapiens
gccactgggaaaaaatattcaaagcaagaaagaatgtgaacagaacttatgaccatgatgattcaatgttttaccacaatgctttctaaaacagaagagtgtaaaaggatattcaaagtcaatttcctcagcgaggctttgcag

SEQ ID NO: 271394 - DNA, 354 bp, Homo sapiens
ctagccataaggttgagtgtggacagtgcaatctatcttcaagtggcattctttacaatcaattaaatgacagatcttgagcctagtttagagacggtcttgcatattatgccgataccaccgaaagtggacagctccattgttacagccttaggggtgactctgataatatgtatgtcctattgtttctgtttctttgaaccctggttaatagaatatataatattgctgtaatgtaatatactgtattatattatcaatatattgtgtattttattaaaatactaatattatatattacaatgtaatatcaattgtgcactataatatacatgtgtaataatgtaatagcaa

SEQ ID NO: 271395 - DNA, 350 bp, Homo sapiens
atcagagcctgattagctcttccgaactctgtattcacaagcatagagaaaccagaaaggaaaccatacctcatagtacaacataaaaacaaaatatcttaatcattcgttgactaaataacataataccattactgaagctaagaaaagtctgttaaggaacttttctaactgtgtcttgtacaacacactagacattccattctgagaattagttcatggatagctgaaagaaagaaattaggagaattgcttgaacctgggaggtggaggttgtggtgagccaagatcacaccactgcactccagcctgggcaacaagagtgaaactctgtctcaaaaaataaaata

SEQ ID NO: 271396 - DNA, 595 bp, Homo sapiens
ggcgcggtgtggctgtcagctgggagggatccctccgcccatgtaaacatcataaagggcaaggggagcgtctgttgtgggcgggggagcggctgccttcccggagagtcctctcggtccctaggttcccctcaagacgccggcaaccgccccgtcccttaacgtcacaccgggtctgctgggagccaaacagctgcggcctgatctgggagcgatagaatctcatcacttagggtcactaccggaaatggaggaagccggactgggagaccttgagagttgggagcgagagggaatcgtaggacgcagctgagaattgggaaagattttcttaggcttgttcttcctgtccatctcagttaaataataatcataactcatgtaagtctagaatttgtctcaaagttatgcctacctggctcgtaggatgccaacgttaggagtgaaaatagtcaacgctctcccgagagagcacatgacactacatgagcttcatcaagaccctcggaggcccagaatgcgcaccaaagagccatcgacgataattcttctacccaacttttatttagtattattaaatattcagtaaagttaa

SEQ ID NO: 271397 - DNA, 423 bp, Homo sapiens
ctctactttgtgtattccaatgcctattcaattagaaggcaaatgttcaagaaaaggaactgcttatgcttttcctctgatacctggtagtaaatgtcatggactacacggtcctttctaaaccccatgaaaatgccagcttctttaacccaaataactgcctgtgtctgtatctgtatctgtatctgcctgtttataaatgtataaaaagtgagtgattagaaattatatatatatttttatatttggtttgaagaataccttgatgacataattgagaaactgaaattggcatctgttaaatgtgtctgaaatattttcttttcccttatagaggacaatggtctcaaaactagttactgttttatgttttggaacattttctttaaaaaaataaatagcaatttaagtatctgtaaccaa

SEQ ID NO: 271398 - DNA, 822 bp, Homo sapiens
atggagcagggctatagcagtgaaccaattggttggtaagtgaaacctgtaagatgcctaattgagtaatttaatgactaattttattaggctaaacagaacagaaaccatgctaatctgtaacaaataagtggcgccagcctattacagtgaatgctattggttagactaaagcagataataaaccaagtgtaggaaaaatgacattttctgattacatccagaacaggcatagaaaaggtataataaagcttgaaacaggtggctgacaatgcagaaatcaatcactgaactgaaaaggtaaaatgaacattgttagaggaatttaggattaagatggatgtagagcttgcaaaagaaaacctagctctctaatacttaaagttctctagccctagaaaaaaatacctcagcaagaaattgcaagtaataattgcaccaagagtcagcatctattttaactgtatgtttaattaagtttctaactcaaatgagaaattttgggccatttttgtcaaatttttgcttagatggctacaaatacttagcaattcattttcatagattttgtagcatccacaaagccctccttactgcagagaatgcagaggtatttatccaataaactttcatgtaattgctgctatacagcaaaactatcattaccggtaattaaagttgtgatacctgaaaaaaaaaaaaaaaaaaaattggggggcgcgagaaatttaaaatttgggggggccagataagaaggcaagggtcagagacggagatggggttaaaaaaaggggagggttaaaccaggggggtgtaaggggg

SEQ ID NO: 271399 - DNA, 568 bp, Homo sapiens
aaggcactatttattttatactttgtgtgaacggggctcctggagtctcgaatacctgatattgcctgatcataaacaaaagtgcagcttatatgtgagaagtggtctgctttttttcttactcatgttattcttcaacaactctttctatgtttcatttagcagccttcaaattaaagctttgcaaaatgcagttgaaaaggaagtccaagcagaagacaatatctacattgagaatagtctttatgccacggactaagacccagtggtgctctttgagagtttacgcccatgagtgcagaagactgaacagacatcagcacatcagacgtcttttagaccccaagacaatttttctgtttcagtttcatctggcattccaacatgtcagtgatactgggtagagtaactctctcactccaaactgtgtatagtcaacctcatcattaatgtagtcctaattttttatgctaaaactggctcaatccttctgatcattgcagagttttctctcaaacatgaacactttagaattgtatgttctctttagaccccataaatcctgtat

SEQ ID NO: 271400 - DNA, 1917 bp, Homo sapiens
  misc_feature (1049)..(1049): n is a, c, g, or t
gagtagctgggactacaggcgccagtgaccacgcccggctaattttttgtatttttagtagagacggggtttcacccttttagccaggatggtctcgatctcctgacttcgtgatctgcccgccttggcctcccaaagtgctaggattacaggtttgagccaccgcgcccggccctgtttcctttttgtttgttcccctgataccctgtatcaggaccaggagtcagtttggcggttatgtgtggggaagaagctgggaagtcaggggctgtttctgtggacagctttccctgtcctttggaaggcacagagctctcagctgcagggaactaacagagctctgaagccgttatatgtggtcttctctcatttccagcagagcaggctcatatgaatcaaccaactgggtgaaaagataagttgcaatctgagatttaagacttgatcagataccatctggtggagggtaccaaccagcctgtctgctcattttccttcaggctgatcccataatgcatcctcaagtggtcatcttaagcctcatcctacatctggcagattctgtagctggttctgtaaaggttggtggagaggcaggtccatctgtcacactaccctgccactacagtggagctgtcacatcaatgtgctggaatagaggctcatgttctctattcacatgccaaaatggcattgtctggaccaatggaacccacgtcacctatcggaaggacacacgctataagctattgggggacctttcaagaagggatgtctctttgaccatagaaaatacagctgtgtctgacagtggcgtatattgttgccgtgttgagcaccgtgggtggttcaatgacatgaaaatcaccgtatcattggagattgtgccacccaaggtcacgactactccaattgtcacaactgttccaaccgtcacgactgttcgaacgagcaccactgttccaacgacaacgactgttccaatgaacgactgttccaacgacaactgttccaacaacaatgagcattccaacgacaacgactgttcngacgacaatgactgtttcaacgacaacgagcgttccaacgacaacgagcattccaacaacaacaagtgttccagtgacaacaactgtctctacctttgttcctccaatgcctttgcccaggcagaaccatgaaccagtagccacttcaccatcttcacctcagccagcagaaacccaccctacgacactgcagggagcaataaggagagaacccaccagctcaccattgtactcttacacaacagatgggaatgacaccgtgacagagtcttcagatggcctttggaataacaatcaaactcaactgttcctagaacatagtctactgacggccaataccactaaaggaatctatgctggagtctgtatttctgtcttggtgcttcttgctcttttgggtgtcatcattgccaaaaagtatttcttcaaaaaggaggttcaacaactaagtgtttcatttagcagccttcaaattaaagctttgcaaaatgcagttgaaaaggaagtccaagcagaagacaatatctacattgagaatagtctttatgccacggactaagacccagtggtgctctttgagagtttacgcccatgagtgcagaagactgaacagacatcagcacatcagacgtcttttagaccccaagacaatttttctgtttcagtttcatctggcattccaacatgtcagtgatactgggtagagtaactctctcactccaaactgtgtatagtcaacctcatcattaatgtagtcctaattttttatgctaaaactggctcaatccttctgatcattgcagagttttctctcaaacatgaacactttagaattgtatgttctctttagaccccataaatcctgtat

SEQ ID NO: 271401 - DNA, 1658 bp, Homo sapiens
  misc_feature (1049)..(1049): n is a, c, g, or t
gagtagctgggactacaggcgccagtgaccacgcccggctaattttttgtatttttagtagagacggggtttcacccttttagccaggatggtctcgatctcctgacttcgtgatctgcccgccttggcctcccaaagtgctaggattacaggtttgagccaccgcgcccggccctgtttcctttttgtttgttcccctgataccctgtatcaggaccaggagtcagtttggcggttatgtgtggggaagaagctgggaagtcaggggctgtttctgtggacagctttccctgtcctttggaaggcacagagctctcagctgcagggaactaacagagctctgaagccgttatatgtggtcttctctcatttccagcagagcaggctcatatgaatcaaccaactgggtgaaaagataagttgcaatctgagatttaagacttgatcagataccatctggtggagggtaccaaccagcctgtctgctcattttccttcaggctgatcccataatgcatcctcaagtggtcatcttaagcctcatcctacatctggcagattctgtagctggttctgtaaaggttggtggagaggcaggtccatctgtcacactaccctgccactacagtggagctgtcacatcaatgtgctggaatagaggctcatgttctctattcacatgccaaaatggcattgtctggaccaatggaacccacgtcacctatcggaaggacacacgctataagctattgggggacctttcaagaagggatgtctctttgaccatagaaaatacagctgtgtctgacagtggcgtatattgttgccgtgttgagcaccgtgggtggttcaatgacatgaaaatcaccgtatcattggagattgtgccacccaaggtcacgactactccaattgtcacaactgttccaaccgtcacgactgttcgaacgagcaccactgttccaacgacaacgactgttccaatgaacgactgttccaacgacaactgttccaacaacaatgagcattccaacgacaacgactgttcngacgacaatgactgtttcaacgacaacgagcgttccaacgacaacgagcattccaacaacaacaagtgttccagtgacaacaactgtctctacctttgttcctccaatgcctttgcccaggcagaaccatgaaccagtagccacttcaccatcttcacctcagccagcagaaacccaccctacgacactgcagggagcaataaggagagaacccaccagctcaccattgtactcttacacaacagatgggaatgacaccgtgacagagtcttcagatggcctttggaataacaatcaaactcaactgttcctagaacatagtctactgacggccaataccactaaaggaatctatgctggagtctgtatttctgtcttggtgcttcttgctcttttgggtgtcatcattgccaaaatgtttcatttagcagccttcaaattaaagctttgcaaaatgcagttgaaaaggaagtccaagcagaagacaatatctacattgagaatagtctttatgccaccgcgcccggccctgtttcctttttgtttgttcccctgataccctgtatcaggaccaggagtcagtttggcggttatgtgtggggaagaagc

SEQ ID NO: 271402 - DNA, 1535 bp, Homo sapiens
  misc_feature (701)..(701): n is a, c, g, or t
gagtagctgggactacaggcgccagtgaccacgcccggctaattttttgtatttttagtagagacggggtttcacccttttagccaggatggtctcgatctcctgacttcgtgatctgcccgccttggcctcccaaagtgctaggattacaggctgatcccataatgcatcctcaagtggtcatcttaagcctcatcctacatctggcagattctgtagctggttctgtaaaggttggtggagaggcaggtccatctgtcacactaccctgccactacagtggagctgtcacatcaatgtgctggaatagaggctcatgttctctattcacatgccaaaatggcattgtctggaccaatggaacccacgtcacctatcggaaggacacacgctataagctattgggggacctttcaagaagggatgtctctttgaccatagaaaatacagctgtgtctgacagtggcgtatattgttgccgtgttgagcaccgtgggtggttcaatgacatgaaaatcaccgtatcattggagattgtgccacccaaggtcacgactactccaattgtcacaactgttccaaccgtcacgactgttcgaacgagcaccactgttccaacgacaacgactgttccaatgaacgactgttccaacgacaactgttccaacaacaatgagcattccaacgacaacgactgttcngacgacaatgactgtttcaacgacaacgagcgttccaacgacaacgagcattccaacaacaacaagtgttccagtgacaacaactgtctctacctttgttcctccaatgcctttgcccaggcagaaccatgaaccagtagccacttcaccatcttcacctcagccagcagaaacccaccctacgacactgcagggagcaataaggagagaacccaccagctcaccattgtactcttacacaacagatgggaatgacaccgtgacagagtcttcagatggcctttggaataacaatcaaactcaactgttcctagaacatagtctactgacggccaataccactaaaggaatctatgctggagtctgtatttctgtcttggtgcttcttgctcttttgggtgtcatcattgccaaaatgtttcatttagcagccttcaaattaaagctttgcaaaatgcagttgaaaaggaagtccaagcagaagacaatatctacattgagaatagtctttatgccacggactaagacccagtggtgctctttgagagtttacgcccatgagtgcagaagactgaacagacatcagcacatcagacgtcttttagaccccaagacaatttttctgtttcagtttcatctggcattccaacatgtcagtgatactgggtagagtaactctctcactccaaactgtgtatagtcaacctcatcattaatgtagtcctaattttttatgctaaaactggctcaatccttctgatcattgcagagttttctctcaaacatgaacactttagaattgtatgttctctttagaccccataaatcctgtat

SEQ ID NO: 271403 - DNA, 1286 bp, Homo sapiens
  misc_feature (452)..(452): n is a, c, g, or t
taggtctaggtggaggctggccctggctaatcggccgaggctacagtggagctgtcacatcaatgtgctggaatagaggctcatgttctctattcacatgccaaaatggcattgtctggaccaatggaacccacgtcacctatcggaaggacacacgctataagctattgggggacctttcaagaagggatgtctctttgaccatagaaaatacagctgtgtctgacagtggcgtatattgttgccgtgttgagcaccgtgggtggttcaatgacatgaaaatcaccgtatcattggagattgtgccacccaaggtcacgactactccaattgtcacaactgttccaaccgtcacgactgttcgaacgagcaccactgttccaacgacaacgacttgttccaacgacaactgttccaacaacaatgagcattccaacgacaacgactgttcngacgacaatgactgtttcaacgacaacgagcgttccaacgacaacgagcattccaacaacaacaagtgttccagtgacaacaactgtctctacctttgttcctccaatgcctttgcccaggcagaaccatgaaccagtagccacttcaccatcttcacctcagccagcagaaacccaccctacgacactgcagggagcaataaggagagaacccaccagctcaccattgtactcttacacaacagatgggaatgacaccgtgacagagtcttcagatggcctttggaataacaatcaaactcaactgttcctagaacatagtctactgacggccaataccactaaaggaatctatgctggagtctgtatttctgtcttggtgcttcttgctcttttgggtgtcatcattgccaaaatgtttcatttagcagccttcaaattaaagctttgcaaaatgcagttgaaaaggaagtccaagcagaagacaatatctacattgagaatagtctttatgccacggactaagacccagtggtgctctttgagagtttacgcccatgagtgcagaagactgaacagacatcagcacatcagacgtcttttagaccccaagacaatttttctgtttcagtttcatctggcattccaacatgtcagtgatactgggtagagtaactctctcactccaaactgtgtatagtcaacctcatcattaatgtagtcctaattttttatgctaaaactggctcaatccttctgatcattgcagagttttctctcaaacatgaacactttagaattgtatgttctctttagaccccataaatcctgtat

SEQ ID NO: 271404 - DNA, 1438 bp, Homo sapiens
  misc_feature (570)..(570): n is a, c, g, or t
acccagcattgtgagtgacagagcctggatctgaacgctgatcccataatgcatcctcaagtggtcatcttaagcctcatcctacatctggcagattctgtagctggttctgtaaaggttggtggagaggcaggtccatctgtcacactaccctgccactacagtggagctgtcacatcaatgtgctggaatagaggctcatgttctctattcacatgccaaaatggcattgtctggaccaatggaacccacgtcacctatcggaaggacacacgctataagctattgggggacctttcaagaagggatgtctctttgaccatagaaaatacagctgtgtctgacagtggcgtatattgttgccgtgttgagcaccgtgggtggttcaatgacatgaaaatcaccgtatcattggagattgtgccacccaaggtcacgactactccaattgtcacaactgttccaaccgtcacgactgttcgaacgagcaccactgttccaacgacaacgacttgttccaacgacaactgttccaacaacaatgagcattccaacgacaacgactgttcngacgacaatgactgtttcaacgacaacgagcgttccaacgacaacgagcattccaacaacaacaagtgttccagtgacaacaactgtctctacctttgttcctccaatgcctttgcccaggcagaaccatgaaccagtagccacttcaccatcttcacctcagccagcagaaacccaccctacgacactgcagggagcaataaggagagaacccaccagctcaccattgtactcttacacaacagatgggaatgacaccgtgacagagtcttcagatggcctttggaataacaatcaaactcaactgttcctagaacatagtctactgacggccaataccactaaaggaatctatgctggagtctgtatttctgtcttggtgcttcttgctcttttgggtgtcatcattgccaaaaagtatttcttcaaaaaggaggttcaacaactaagtgtttcatttagcagccttcaaattaaagctttgcaaaatgcagttgaaaaggaagtccaagcagaagacaatatctacattgagaatagtctttatgccacggactaagacccagtggtgctctttgagagtttacgcccatgagtgcagaagactgaacagacatcagcacatcagacgtcttttagaccccaagacaatttttctgtttcagtttcatctggcattccaacatgtcagtgatactgggtagagtaactctctcactccaaactgtgtatagtcaacctcatcattaatgtagtcctaattttttatgctaaaactggctcaatccttctgatcattgcagagttttctctcaaacatgaacactttagaattgtatgttctctttagaccccataaatcctgtat

SEQ ID NO: 271405 - DNA, 1883 bp, Homo sapiens
  misc_feature (1049)..(1049): n is a, c, g, or t
gagtagctgggactacaggcgccagtgaccacgcccggctaattttttgtatttttagtagagacggggtttcacccttttagccaggatggtctcgatctcctgacttcgtgatctgcccgccttggcctcccaaagtgctaggattacaggtttgagccaccgcgcccggccctgtttcctttttgtttgttcccctgataccctgtatcaggaccaggagtcagtttggcggttatgtgtggggaagaagctgggaagtcaggggctgtttctgtggacagctttccctgtcctttggaaggcacagagctctcagctgcagggaactaacagagctctgaagccgttatatgtggtcttctctcatttccagcagagcaggctcatatgaatcaaccaactgggtgaaaagataagttgcaatctgagatttaagacttgatcagataccatctggtggagggtaccaaccagcctgtctgctcattttccttcaggctgatcccataatgcatcctcaagtggtcatcttaagcctcatcctacatctggcagattctgtagctggttctgtaaaggttggtggagaggcaggtccatctgtcacactaccctgccactacagtggagctgtcacatcaatgtgctggaatagaggctcatgttctctattcacatgccaaaatggcattgtctggaccaatggaacccacgtcacctatcggaaggacacacgctataagctattgggggacctttcaagaagggatgtctctttgaccatagaaaatacagctgtgtctgacagtggcgtatattgttgccgtgttgagcaccgtgggtggttcaatgacatgaaaatcaccgtatcattggagattgtgccacccaaggtcacgactactccaattgtcacaactgttccaaccgtcacgactgttcgaacgagcaccactgttccaacgacaacgactgttccaatgaacgactgttccaacgacaactgttccaacaacaatgagcattccaacgacaacgactgttcngacgacaatgactgtttcaacgacaacgagcgttccaacgacaacgagcattccaacaacaacaagtgttccagtgacaacaactgtctctacctttgttcctccaatgcctttgcccaggcagaaccatgaaccagtagccacttcaccatcttcacctcagccagcagaaacccaccctacgacactgcagggagcaataaggagagaacccaccagctcaccattgtactcttacacaacagatgggaatgacaccgtgacagagtcttcagatggcctttggaataacaatcaaactcaactgttcctagaacatagtctactgacggccaataccactaaaggaatctatgctggagtctgtatttctgtcttggtgcttcttgctcttttgggtgtcatcattgccaaaatgtttcatttagcagccttcaaattaaagctttgcaaaatgcagttgaaaaggaagtccaagcagaagacaatatctacattgagaatagtctttatgccacggactaagacccagtggtgctctttgagagtttacgcccatgagtgcagaagactgaacagacatcagcacatcagacgtcttttagaccccaagacaatttttctgtttcagtttcatctggcattccaacatgtcagtgatactgggtagagtaactctctcactccaaactgtgtatagtcaacctcatcattaatgtagtcctaattttttatgctaaaactggctcaatccttctgatcattgcagagttttctctcaaacatgaacactttagaattgtatgttctctttagaccccataaatcctgtat

SEQ ID NO: 271406 - DNA, 1798 bp, Homo sapiens
  misc_feature (964)..(964): n is a, c, g, or t
gagtagctgggactacaggcgccagtgaccacgcccggctaattttttgtatttttagtagagacggggtttcacccttttagccaggatggtctcgatctcctgacttcgtgatctgcccgccttggcctcccaaagtgctaggattacaggtttgagccaccgcgcccggccctgtttcctttttgtttgttcccctgataccctgtatcaggaccaggagtcagtttggcggttatgtgtggggaagaagctgggaagtcaggggctgtttctgtggacagctttccctgtcctttggaaggcacagagctctcagctgcagggaactaacagagctctgaagccgttatatgtggtcttctctcatttccagcagagcaggctcatatgaatcaaccaactgggtgaaaaggctgatcccataatgcatcctcaagtggtcatcttaagcctcatcctacatctggcagattctgtagctggttctgtaaaggttggtggagaggcaggtccatctgtcacactaccctgccactacagtggagctgtcacatcaatgtgctggaatagaggctcatgttctctattcacatgccaaaatggcattgtctggaccaatggaacccacgtcacctatcggaaggacacacgctataagctattgggggacctttcaagaagggatgtctctttgaccatagaaaatacagctgtgtctgacagtggcgtatattgttgccgtgttgagcaccgtgggtggttcaatgacatgaaaatcaccgtatcattggagattgtgccacccaaggtcacgactactccaattgtcacaactgttccaaccgtcacgactgttcgaacgagcaccactgttccaacgacaacgactgttccaatgaacgactgttccaacgacaactgttccaacaacaatgagcattccaacgacaacgactgttcngacgacaatgactgtttcaacgacaacgagcgttccaacgacaacgagcattccaacaacaacaagtgttccagtgacaacaactgtctctacctttgttcctccaatgcctttgcccaggcagaaccatgaaccagtagccacttcaccatcttcacctcagccagcagaaacccaccctacgacactgcagggagcaataaggagagaacccaccagctcaccattgtactcttacacaacagatgggaatgacaccgtgacagagtcttcagatggcctttggaataacaatcaaactcaactgttcctagaacatagtctactgacggccaataccactaaaggaatctatgctggagtctgtatttctgtcttggtgcttcttgctcttttgggtgtcatcattgccaaaatgtttcatttagcagccttcaaattaaagctttgcaaaatgcagttgaaaaggaagtccaagcagaagacaatatctacattgagaatagtctttatgccacggactaagacccagtggtgctctttgagagtttacgcccatgagtgcagaagactgaacagacatcagcacatcagacgtcttttagaccccaagacaatttttctgtttcagtttcatctggcattccaacatgtcagtgatactgggtagagtaactctctcactccaaactgtgtatagtcaacctcatcattaatgtagtcctaattttttatgctaaaactggctcaatccttctgatcattgcagagttttctctcaaacatgaacactttagaattgtatgttctctttagaccccataaatcctgtat

SEQ ID NO: 271407 - DNA, 343 bp, Homo sapiens
atctgtactaggggccaaaaaactttatgaaacgcagatagaaaacagtttaggcttttctgggccctatgtctccatcgtaactgttctaccttgtcattatagagtagaagaagccatatataaatgaataaacgtgaccatattccaataaaactttatttatgggcactgaaacttgaatgttatgtcacattcatgtttcacaaaatattattttagattgtttttcaacaatttagaagtgtaaagacatgtctagcctacagagtgtacaaaaacaggtggtgggccagatttagctcctatgtatagtttgctcacctatggttcatacaatgta

SEQ ID NO: 271408 - DNA, 447 bp, Homo sapiens
ttttttaacagtctcctgggagattaagatgagtgatctagaggaggaagatgttgatgaattcagctccagtggttttaagtgcccaacatgctttgcagtgcaaggaaggaaatgcgatacagaactcaaatggtgtgcagcagataaaataaagtgtattgaattctctggcatcataaacacaggtattcgtgacgtagccattgaaatgaagagatgcacacaagcagacctatgcaaagagacgataacttcttagatgggttttccaattgctaacaagagtagaaattgcaaatcagccatcagaaatggggccagaatcagacccccatctcccatcttctttgttcttttcctggggagggtacttcatggagctctggcaagagcctagccacttccatttatgaattaaacctgaatttttttgttaaaatattc

SEQ ID NO: 271409 - DNA, 403 bp, Homo sapiens
agcccattaaagcagcttggaatggggctgtaccctgcaaaggcacaggggcagaactgcccaagaccatgggagcctacttcttgcaccagtgtgacctgaatgtgagacacagggtcaaaggagattattttggagctttaaaattcaatgactaccctgctggattctggacttgcatggggcctttagcccttttgttttgtccagttctcctatttggaataggagcatcctcatccaatgcctgtaccctcattgtatcttagaagtaattaacttgcttatgattttataggccatgctaatcagcattcagttccagattccaatttattctcagtgtgcctgtataaattttctttccatatatatagaattaaatttctattacttatttgaa

SEQ ID NO: 271410 - DNA, 416 bp, Homo sapiens
agtaatgagctgagccttggcccccagaagtttcccagaaatgaagccagtcaacggaacccaccttattccacaatcaaaccatcaaaggtgtcaaagaatataagagcaaaaaccccatccaaaggacagtgatatggtttggctctgtgtccccacccaaatgtcaccttgaataaatccccatgtgtcaagggcaggaccagaaggagataacttaatcatggggtgcttccccagtgagtgagctctcatgagatctgatgattttataaatgggaattcccctgcacaagctctcttgcttgacaccacgtaagacgtaattttgctcctcatttgccatgattgttaggcctccccagcctaacaatgtggaattgtgagcaaattaaacctctttccttataaattac

SEQ ID NO: 271411 - DNA, 645 bp, Homo sapiens
aacttctgaccttaaatgatctgcccgcctcggcctcccagggtgctgggattgcaggtgtgagccaccagcctggcctctagttattttttacataatgttcagcatacaataaaaattaggagacatgtgaagagaaaggaaaatgtgaccaatggtcaagagaaaaaagaaaacagtagaagcagaaacaaatataagccaattgtttaagttcacaggcaagaactttaaaataatcacaattttatttttaaaaaatagaggaaaagatggaaagtagatgagaagaatttcaacagagaattggaatagagacaaaaacttctagaacagaaccctctgaatgggtttaacagcaaattggacacagcaggagacaagattagtgaattcaaagacagatcaataggctgggcactgtgactcacacctgtaatcccagcactttgggaggctgaggcgagtgaatcagctgaggtcaggagtttgagaccaacctgaccaacatggtgaaaccctgtctctactaaaatacaaaattagccgggcgtggtggtgggtgcctgtaatcccagctactctggaggctcaggcagaagaatcgcttgaacccgggaggcgcaggttgcagtgagccgagat

SEQ ID NO: 271412 - DNA, 496 bp, Homo sapiens
catgtggggaggaagaggaagggtaaaccctttaaaaaataataatatatagaaagtataaagtaagaaatgtcaatgtatgccaagcatacattggaaaaagatcactgcttataagtccaccacccatgggtaggtctgttcagttatttgctgcgtgccaggcactgtgctgagcaggtgccatgtactctctgatcatcataggagtgcccgtagtaggccctgtgatggttcagcagataaggaaaggagactcactgagccagggtttctttccgggcctgccatttgcccacactctgcccctcccccaggaacagtccgtcaccactggactcttggaagcataatttcagaagtcaggaagctcaggcagtttgcagagggagtaaacactttctgagagtcagaaagtgtggggatgcacctgcagaatgtctgcttaccacgccaaaaaagcctgggcttttccctgcctttgtgtgggaagggg

SEQ ID NO: 271413 - DNA, 430 bp, Homo sapiens
aataagtatttttagttgctgagaccagatcaacctatatagaaaaataaatctggttccacttttacttcctatataggatatcattaacatattttccatatgaatagggactgtcatgtaccatatgttattcatcatatggcatcatgcctgtttcaaggcacattttaatatagcacaaaggcaaagagttttaaactggaatgtctgctgtgcattatggtttagactttctggttatcatgaagcctgattaagttagctttctacatgtataccatagaatgagctctcaacaaattacctagaaaagttaacttagcaagataaattttgggcaaaataaaagtaaactcgtagaattttagctcactttaggcaaggtcacagagattttgcagttgaagcacattttattggatgaaca

SEQ ID NO: 271414 - DNA, 455 bp, Homo sapiens
gtcaacctggaaagaactcaaacgcccttcaactggtgtatcatgactgtggtgatggctccacacatttatcaaaacccatagaaatgtataccaaaagaagcagatttgactatatggaaaatttttagaaaggatttgggggggaacccaaagtggaacacaaactttaaaaaatgaacgcaactatctttggccaggcacagtggctcgcacctgtaatcccagcactttgggaggccgaggcaagcgaatcacttgaggtcaggggttcaagaccaggctggccaacatggtgaaaccccatctctaaatacaaaaattagccgggcgtggtggcgcgtgcctgtagtcccagctactcgagaggctgagacatgagaattgctagaacctgggaggcagaaattggagtgagccaagatcgtgccactgcactccagcctgggtgacag

SEQ ID NO: 271415 - DNA, 461 bp, Homo sapiens
taaagagacaaggtcttgctctgtgctggagtgcaatcaaagctttgagcaagaagccttgaagcaaactgcagtcttgaactcccgggctcaaggaatcctcctgtcttagcatcctgagtagctaagactacaggcgtgtgccaccacacctgcctaatttttcttttttttgtgtggagttcggggtctcactacattgcccaggctggtcttgaaccccttggctcaagcaatcgtcctgccatggcctcccaaagtgctgagaacaggtgtgagcaaccatgcaccacgcccagccattataacaattattaatctactgattatggcatctaacatgcttgcaaaaatttcaggttttttcctttgggattatttcctctcaacacagtcctcaagaattaccaaatcaaaggggctgatggcaacacccactgtggttggttcatttaacgttc

SEQ ID NO: 271416 - DNA, 449 bp, Homo sapiens
aggaggagaaaagcggggcagcatcaaacccctcccactggggcaacctgctgagcatctccctggccttggccctggccataccacacaagtgtccaatgagtcactgatcctgaagaacaagagaagactgaccacagaccccaaaaggaagcaggagtacaaccttcgaagttggtgggcaacaagaggtcagaggttgacaagcatccacacagctctaagactagcatcatgtggctacccaggacctgggagagtgctgcagagcaggagcaggaaagggaccggctgttcccatagaacttcatgtcacaggtctgggagccagggggccttggttctagtcccaactctccctctaagttgtcttatggccacaggtgagtgaaatagcttctctggcctcagcttcctcacgattaaaatgacacagttgtgcaaaattg

SEQ ID NO: 271417 - DNA, 322 bp, Homo sapiens
acacatatataatatatatgtataaatatataatatacataattatatataagtataattatatatatacacacccacatatatatatctatgtaattttcttagtggttgtcctggggattaacattaacatcttaatttataacaatctaatttataacaattagattaatacctactcaatttcgatggtatacaaaacctttgctcctgtatagtctcatttgcttctttgtgctcttattgccacaaattacatctttatacattgtatgtccatcaacttaaatttacaattattgcattatgcagttgtttctca

SEQ ID NO: 271418 - DNA, 421 bp, Homo sapiens
agaaagatttctccaaagtggctgtaccattttacacccctgatgataatatattagtattctggtttctccatgttctcaccaacatttggtgctgttagtcttttgatttcagccattctagtggaagtgtggtggaatgtcattgtgttttctatttgcatttctctgattactgaagatgttgaggactagatatctaccattgcaaagcatccattcaagtttgtgcccccttttacaatggatttttctttttattgttgatttgtaggagttctttatatattctggatgtaagtcctttgtcagctacatgtactatatgtatatttttccaagcctgtacattacctatccattttgttaataatgtctatggatgaacaaaacataaattttgataaagcccaactttctc

SEQ ID NO: 271419 - DNA, 161 bp, Homo sapiens
aatctattataactgataacctgctttaacttaaatttattgtgttaattatattttcttactttgcagaagaaaagcaaatcacgtattatgttttctaggtaacagctattgaacctataattaatcatggaggagccagtgcaagcactcagcattta

SEQ ID NO: 271420 - DNA, 434 bp, Homo sapiens
caggagctgagtcgatatgggaatactatttgatgtatatatttctggattggtgattgaggaaaattaatttctctgacatgaaaattaatacttttagttgagttggaattataatttttgtaagaaaatagattattatgggccgggtgcagtggctcatacctgtaatcccagcactttgggaggctgaggcgggtggatcacctgaggtcgggagttggaaaccagcctgaccaacatggcgaaaccctgtctctactaaaaatacaaaatttgctgggtgtggtggtgcatgcctgtaatcccagctacttgggaggctgaggcaggagaatcgcttgaacctgggaggcagaggttgcagagagccgagattgggccattgtactccagcctgggcaacaagagcaaaactccgtcaaaaaaaaaaa

SEQ ID NO: 271421 - DNA, 228 bp, Homo sapiens
tcgccaagtctctcacttgcctgttgaccctcagtaatttagacttgaccaaatagtcctagtgaattaactactaagccctaagacacacattacttggtttttttgttgttgttgctgttgtttttgagatggagtgtcggctgtgacgcccaggctggagtgcagtggcgtgatctcagctcactgcaagctctgcctcacgggttcatgccattctcctgcctc

SEQ ID NO: 271422 - DNA, 496 bp, Homo sapiens
cttggtctgctttgccctccattaagcctggcatgaatggaagtgtggaagaagtataacgaaactgggatccatagagggttatctgcctagaagagggtcagcagtccagactagatcttgagtgtctgacatcagcgtgagcgactgtcctatcacatcagacgtgccgtgagagagaggactacagaggctgcacatccctgagaaaagcaagaagcccggatatcaggagatgtggggatgccgggtgttcacaccaatggcagaaagaggagtgacagaggtaacaccaggattctacaagacatctgagggtaaagagagaaggaaaataaaaaaacacaaacttgatgacaactattcagtttagtgcaatacagactgtgttaagtgcaggttaataaggagcagtgaagaaaagaggaaaataattaagctatttggacctgtgactagatgttgttataattaaaattctttcatttctcacttt

SEQ ID NO: 271423 - DNA, 373 bp, Homo sapiens
tctctctagacaatctattagatgaagactaggtgaggtgcaatttcaactttaagttgtatttgctatatacagattgggcatccctaatctgaaaatccagaatccaaaatgttctcagaatccagtactttttgagtgccaacatgatgcggctcaaacaagtgaaaaattttacacgtgacctaaagtgactggtcatagtcaaaatgcagaaacataacacagaatttagtcagcatccccagagaaaaataaatgacctcaagctatgtatatgaggtatatatgaaacataaatgaattttgcatttgaacttgtgtcctcttcccaatatattgtatcatctaaatgcaaatattccaaaatctg

SEQ ID NO: 271424 - DNA, 364 bp, Homo sapiens
caataaaatcacatcatcccatgtggctagaaagggagagaaacttgaaatcatgctgaaccataataatggtaaaggcaaagtctgaaatgagtaaatgaagacagcctgcatttaaagccacaggaaaaaaaattctagaacaatactatcttagaatctaccatgaatctatttctcagataacttcagtatttgaattaagcatattgattccactgatttgttgattctgttgaggatatatccctatgatgtccctgggaagcgatggggcattcccagtcatctgggatgtgcagtttctaaatattatcaatggcgcctcattcattttacacaaataaaactcgatagaaaaata

SEQ ID NO: 271425 - DNA, 604 bp, Homo sapiens
tacagagaaaccgttatgtaactgattattaccatttttgtgtatacattttatttaaagaataatattttgaagaatatgaaacatctagttctaatggctttaaaatttacttacagcaaaaaattacttagtattttgaattaaagaaaggaaattattataatattttattagataaaacgtgaagctttaatatatagctgaattacattgaatgaatttaacatgtaaagtctcagtgcaagagtatgaaattcatatttttgttatgacattgtttatagcaattactagaaagctaatttagttgtagcatatgtgaattttaaatatagtctcatttcccatttaaatatggatcaagttcattatagttatcatatggaaactcttgccaataagtctagataaaatctgaaataaaacctaagtatcaaaaggaaaactgaaagccctttcctttagctctaattgaaagcaaataaaattttggttagtagtattttcatggacttatttattattacgcaaaatgtcattgaaatgtgaaagcaagaagaattgattagtaagttgtgtttaaattttaattccccacaaa

SEQ ID NO: 271426 - DNA, 358 bp, Homo sapiens
tgcagaaacacaatttctcctggggctgatatttgagagtcaaatttcctgcagtttagatatttccaccagcaaaatgtggataggctataaggctgacaactgtgtccaaagcaataatcgcttgagaacttttccatgtgccccatcactctgcattgtacagcatattctttaacacatttatttcatttttcaattcactaagtgcttgctgagcacttgcccattttcctttatttgcaaaatgcaggaatttaacctatctttgagtacaatttaggaatatggtctaagtttctatgatacaatgttgccatttaaaaataaatgtaacataatgctcctaccccctttt

SEQ ID NO: 271427 - DNA, 416 bp, Homo sapiens
ccacaggaattttccatctctattataaccttataggaccaccattttatatgcagtccatcattgtctgaaatgtcattatgactgtatatacaggatctatatgagaaaaaccacaaaactctgatgaaagacatcaaagaagaactaaataaaatggagagatatttcacattcacagataggaagactcaatgtgtgtgtgtgtgtgtgtgtattttgttttttttttttggtagagaccttgtgtctacaaaaaaaatacaaaaattagccaagcatgctaatgcacacttgtactctcagctactcaggaggctgaggtgggaggatcacttgagcttggtaattcaaggcttctgtgagccatgaccacaccaccgcactccagcctgggagacagagtgagaccctgt

SEQ ID NO: 271428 - DNA, 287 bp, Homo sapiens
tcttggtgactctagagccagaagtcaacagtgggatggacagatcatctccagctcctgtcttcaaaacgcacctgtgttttaacggctccccagggaaggagatccagtcactggctaacattctgcgatggtgtctgatagccctcaccagctccagaatgttcctatccctcttaggctttctttttgtatcttcatcactctgacgttggtgcgctttcaggccctgtttgctgcaaccctgactggaacctccacatttaagttcctaatgaaatcttctc

SEQ ID NO: 271429 - DNA, 229 bp, Homo sapiens
atttatagcttaaaacagtaaactttacatactgtatatactactataactttctctcctgaacctaattaggaaaaaataagttattgtacagattttcagggtcttttaaacataatcttaggtgagaggagaaagctttctaaatagggtacagaacccagaacacatatggggaaaaattgaaaatttttatcaaatgaaaattagtataacccaaaacatgact

SEQ ID NO: 271430 - DNA, 823 bp, Homo sapiens
tggtctcgaactcctgacctcatgatccacccacctcagcttcccgaagtgctgtgattacaggcatgagccacagcacacagcccatctttttttaaactatgttgtttaatcatcacaaatctattcatctatccactcctttatttatctatccacctcttatttgtacacatttcaaagtaaactatagacatctgtatacttatctttaaatatttcaatatgtacatcattaactggtgttaagtatttctttatagcttttcctcttggtggaaagtttacatacaaagaaatgtacacattttaagtacatgttcactgggttttgacaagtacatgcatcagcaaaacccaaaaccctatcaagatagagaatgtgcccgggcgtggtggctcacgcctgtttttccagcactttgggaggccaaggctggaggattgcttgaacccagaagttcgagaccaacttgggcaacatggtgaaaccccatctctaccaaaaaaacataaaaaaaaaaaaaaaaaaactttgttggggggccttgggcccttgaagaaagcttttcaaaaaccattctggtttggggcgcgcggggcccaagttaggttagcgcaacacctgcgcccaaccggtgttcccaagggagaaccgtgcggccaggaccacagcgggcttgtggtttctccacccaatataaaaaaacgcgcggcggggacacccgggccgtgtccgtaacacaactcccaagggggcgtcgagaaggcccatacgggggggctatcacacagagagtccaagcagaactgatatgactag

SEQ ID NO: 271431 - DNA, 841 bp, Homo sapiens
ttttcttcagtggtacatcctacataattacagtgcaatagcaaaatgaggcaattggcatgggtgctgttagtaccatccatagaccatattcagatctcatcactttcacatgcacccatttgtgtgtgtgtgtgtgtgtgtgtgtggtttagtgcagtttcatcatacatatgggtttatgtatccaacatcacaatcaagataactgttccactacctcacagatccctaatgctgcccattatagtcatacccatctctcttccctcctccccatccctaataccagtcagccactagtctcttctccagctctagaatttcatcatttcagtaatgctatataaatggaatcatagggcatgtaatccttgggattggctttcttcacttagcataattctccaaactcttgtgtatttcaatagtctattcctttttattgctaagtagtagtccatggtatggatggaccacggtttgtttaatccatccgaggacctttttaaaatacttgtgcccagatgcagtggctcactcctgtaatcccggcacttggtgaggtcgaggcgggaggattgcttgaccccaggaattcgagaccatactgggcaacatggcaaaaccctgtctctacccaaaatacaaaaattagctgggcgtggtggtgcacacctgtagtcccagctacttgggagactgagatcagaggatggtttgagcctgggaggcagaggttgcagtaagctgagattgtgccactgcactccagcctgggcaacagagccaggccttgtctcaacaatcaatcaatcgatcgtgtgttcctgatattaaa

SEQ ID NO: 271432 - DNA, 1223 bp, Homo sapiens
ttttcttcagtggtacatcctacataattacagtgcaatagcaaaatgaggcaattggcatgggtgctgttagtaccatccatagaccatattcagatctcatcactttcacatgcacccatttgtgtgtgtgtgtgtgtgtgtgtgtggtttagtgcagtttcatcatacatatgggtttatgtatccaacatcacaatcaagataactgttccactacctcacagatccctaatgctgcccattatagtcatacccatctctcttccctcctccccatccctaataccagtcagccactagtctcttctccagctctagaatttcatcatttcagtaatgctatataaatggaatcatagggcatgtaatccttgggattggctttcttcacttagcataattctccaaactcttgtgtatttcaatagtctattcctttttattgctaagtagtagtccatggtatggatggaccacggtttgtttaatccatccgaggacctttttaatcatcacaaatctattcatctatccactcctttatttatctatccacctcttatttgtacacatttcaaagtaaactatagacatctgtatacttatctttaaatatttcaatatgtacatcattaactggtgttaagtatttctttatagcttttcctcttggtggaaagtttacatacaaagaaatgtacacattttaagtacatgttcactgggttttgacaagtacatgcatcagcaaaacccaaaaccctatcaagatagagaatgtgcccgggcgtggtggctcacgcctgtttttccagcactttgggaggccaaggctggaggattgcttgaacccagaagttcgagaccaacttgggcaacatggtgaaaccccatctctaccaaaaaaacataaaaaaaaaaaaaaaaaaactttgttggggggccttgggcccttgaagaaagcttttcaaaaaccattctggtttggggcgcgcggggcccaagttaggttagcgcaacacctgcgcccaaccggtgttcccaagggagaaccgtgcggccaggaccacagcgggcttgtggtttctccacccaatataaaaaaacgcgcggcggggacacccgggccgtgtccgtaacacaactcccaagggggcgtcgagaaggcccatacgggggggctatcacacagagagtccaagcagaactgatatgactag

SEQ ID NO: 271433 - DNA, 261 bp, Homo sapiens
catttgttagtggcatactcagaaaataactaattagggctgagctcggtggctcatgcctgtaatcccagcactctgggaggccgacatgggaggactgcttgaatccaggaattcaagaccagcttgggcaacatagtgagacccggtctctacaaaaaaaaagtatctggctgtggtggtgcgcacttgtagttctcctacttaagaggccgagactggaggattacttgagcttcagcccaggagttcaaggctgca

SEQ ID NO: 271434 - DNA, 262 bp, Homo sapiens
aaaaaattaatgtcctaaattatatcatgaacaataagtttcagaaaaatggaagcaaatatgaggaatatttttacaaatttgttagttggggggagtcataagccaaacttttgactacataaaatcttaaagctttaatacagtgaaagacatcatgttacaaaataatggacagaagagacctgcaacaatagaagagacaaaggattaactgtgcagggacatatgtaattttacatgtatgtgcacacatctctgt

SEQ ID NO: 271435 - DNA, 501 bp, Homo sapiens
gcctccatctgggcacatgtttcagttgttttctaaataccaagagcacagattgctcagtaataatagctctcctgcaaatctggaatcacttaggcagctgcagtgcctctaagcctccttgcatccaaggctgtgatcaaggaggactggtgtctgagtgggcttgagaagggcccggagaacagcgggtttcctgatcacaaatcagcctgtcattcagcatgtgttcccttggtgactcagggcgatatctgcccttctccggaggtcaagggctcatcgtgtcaattgtggtcttgagtttgttttttttttcctcttgaaatcattgtaattaagctaaaagtatagtgttggtatccagcacatgtttgcaaagtatttaacaatgagcaaaaactttaagaataaattaaagcatctagtttactttttgccaacagccaggttcctgctagaaatgattttgaaataaatgttgtcttggaaatagaaacc

SEQ ID NO: 271436 - DNA, 345 bp, Homo sapiens
aacaatatatctgcaaaagaatagacagaccaggcaacacaaagaagaaaggattttttaaagtgaattgaaattttatttttatacaaaaacctgcgtgtgaatcttacattacagggttattcataattgtcaaaaactggaaaccaccagctgcccttcaacaggtgaatgaagaaacactactaaattagtgagtgatactttaagagaaacatgatgttttatagcctcaaaatatctcactgcaggccagtcatggtggctcgcgtctgtagtcccagcactttgagaggcaaaggtgggtggatcgcctgagcccaagagtttgagaccaacatggac

SEQ ID NO: 271437 - DNA, 453 bp, Homo sapiens
taactgatgaccagaactccagctgccaggaagtcttggaaatgtggttttcatgtttctagtttgtgaaatacagaaggacacacaagcaggagattggaaaggataccaagagcctatcaatattgtactcttccacacacccaccatactgccactccatatctgatacctcttgccacccgtatttaagtggtcacacaataacaacgtcatagtaggcatatcccacctaatgtaatgtaactatcccttgcccaaggtaacatgtacttacctgtctcaaaaaaagggagacctgagctgggcgtggtggtgcgtgcctgtgatcccagctactcgggaggctgggacaggagaattgcttgggtctgggaggtggaggttgcagtgagctgagatcacaccactgcactccagcctggtgacagagtgagactccatctcaaaaaa

SEQ ID NO: 271438 - DNA, 479 bp, Homo sapiens
tagggctactagaaaatttagctgggtgaggtggttcacacctgtaatcccagcactttgggaggccaagacatttccctacatacctagaattttgtttacgatgaacagaatgttgggtaagagtctcttgagctgaaacagttacacccccgcagctgggaaaagctattccctctgcattaggccaacgggaagcccacacctcctgatacaacccataccacggttgccttcccctcctggatgtcacagagaaggatttaaaaatgactcccggccagcatggtgtctcatgctcagcacattgggaggcctagacgggaagattgcttgagggcagcagttcaaggcaagcctgggcaacatagggagaccctgtccctattatttttttttttgatgttaaaaaaaatttaatttaattaaataaaaatggttcccaagtcaaagagaataaagaaccacagaagttaggt

SEQ ID NO: 271439 - DNA, 379 bp, Homo sapiens
ctgggtcatgaacagcatccaataatggaaagagtcaagttggtttcataaaaaaccacatggagtggaattcctgccagaagaaaggattctctgaccaacagaagggggcaacagtgcttggcaggccaaagtaacagacgtccactatacttactttctaaatttgcttgttcattgatataagtttgaacaaggccaatgacagcttctgtcacaaaactaggaaactttatcagtgtgatttcagtttattagaatagtgcttgtgatctatcatataaccaaatgtctctatattgtccacaagaaattcataagaaactatgtttaatattttttattttcccgttccattaatccaataacctctatttta

SEQ ID NO: 271440 - DNA, 815 bp, Homo sapiens
atttttacctagaaacctttctagcctctcctcatctcttgactgtcttggccttggcaagaagaatacacgtccctacccagctatcttcagctcctgtccttcctcccagctgccagagaattgtcagcaggaggaatggcaccagctgtgacccggctccttttcctccagcttgttctggggccaactctggtcatggacatcaagatgcagattggcagcaggaacttctataccttaagcattgactatcccagggttaactacccaaagggtttccggggctattgtaatggtctgatgtcctatatgcgaggcaagatgcaaaattcagattgcccaaagatccattatgtgatacatgccccttggaaggccatccagaagttctgcaagtatagtgacagcttctgtgagaattacaatgaatactgcacactcacccaggattccctccccatcacggtctgctccctgagccaccaacagccacccactagctgctactacaatagcaccctaaccaaccagaagctctacctactctgctcccgcaagtatgaagctgatccaataggtatcgctggtctctattcgggaatttaattcctgagccactccccaacctctaccaccacaggccagctgtctccatttccaacactctgatccctgtaacaagacttccttcctgacttacgaggcaggcagggtcccctcccaagagaccaggtgggtgcgaaaatgtccagggctttgatcaccatgcaaagtggtgctatcttctaggttctttccagcttgtttacccc

SEQ ID NO: 271441 - DNA, 1021 bp, Homo sapiens
atttttacctagaaacctttctagcctctcctcatctcttgactgtcttggccttggcaagaagaatacacgtccctacccagctatcttcagctcctgtccttcctcccagctgccagagaattgtcagcaggaggaatggcaccagctgtgacccggctccttttcctccagcttgttctggggccaactctggtcatggacatcaagatgcagattggcagcaggaacttctataccttaagcattgactatcccagggttaactacccaaagggtttccggggctattgtaatggtctgatgtcctatatgcgaggcaagatgcaaaattcagattgcccaaagatccattatgtgatacatgccccttggaaggccatccagaagttctgcaagtatagtgacagcttctgtgagaattacaatgaatactgcacactcacccaggattccctccccatcacggtctgctccctgagccaccaacagccacccactagctgctactacaatagcaccctaaccaaccagaagctctacctactctgctcccgcaagtatgaagctgatccaataggtatcgctggtctctattcgggaatttaattcctgagccactccccaacctctaccaccacaggccagctgtctccatttccaacactctgatccctgtaacaagacttcctttttccaacctctttttcttccagtcttcttaccttggctcactggcatttcaaggtatcttctctcacccattccccagaggttcctgcttcccttctcttccagaagctcctcccaaatcccccagactccagagtctgcccctgaccaggcagcgaatgaggcaggcccggctctaatcgaacataaatttctaaaaccacatctgagtatgtaagatgtaaccattgggggaaactgggtgaagggcacacgagccccctctgtaccattttttgtaacttcctgtcaacccataatcaattcaaaataaaaagttaataacaca

SEQ ID NO: 271442 - DNA, 329 bp, Homo sapiens
tttggagatctgacatggtttggctctgtgtccccacccaaaaatctcatcttgaattgtaatccacatgtgtcaggggagggacctcctgggaggtgattggatcgtggggggcggtttcccccatgatgtttttgtgatagggagctctcacgggatctggttgtttgataagtgtctggcatttcccctgcattctctctctcacctgccgccatgtaagatgtgccctgcttccccttcaccttccaccatgattataagtttcctgaggcctccccagccatatggaactgtgagtcaattaaacctcttttgtttataaatta

SEQ ID NO: 271443 - DNA, 2050 bp, Homo sapiens
  misc_feature (1583)..(1583): n is a, c, g, or t
  misc_feature (1612)..(1612): n is a, c, g, or t
  misc_feature (1656)..(1656): n is a, c, g, or t
  misc_feature (1836)..(1836): n is a, c, g, or t
  misc_feature (1882)..(1882): n is a, c, g, or t
ttttttttttttccaaacaacagcattctaggcagaaagtcacaaaacaggaggaagcgagtctgattcccagcatcagataaactgctaaactctactgtgggtaagaacaaaactgtgcttaccagaaaacttaatttttatttcgatgaatttctaatagtgaaataaattactttaaagcacaacaaagaagaaagtcaacacccaaacgttcttgggctcaggaagtatggtgcttgacgggagggttaaaagctgtcagccctgaagacaggcaggaaagtctctctttatgaccccctcccagcaaggctgtgttttttcaacacttctaacccttctgcatgggaatcttggaatgtttttttgttttgttttgttttaaagagacaaggtctcgctatgttgcccaggctggagtgcagtggctattcacaggcgtaatcccactactgatcagcaggggaagttttaacctgttcgtttccaacctgggccaattcacccctccttaggcaacctggtggtcccctacttctgggaggtcatcatactgatggctgaacttggtgcagacacgtctctggcacagtgtgctacagcccaggactcttgggctcaagcgatcctcgtgcctcagcctcctgagtagctgggactccaggcatgtgccactgcattgtcctggaatgtctttttttttttttttttttttttttttaagtgtctcagttctcttagtttttgacagttccccggtattctcaaggtgatcatttaacacctaattaacaagtctattactggaattaattcaaatgagccaaacctagttttaattaaacctcaatctgctcagggtagtcttttttctcctacatcagtagctgcctgcaaggacccagttcctttcaaaacaaagaagtacaaaactctataaagcgttctgacattatttaaaaatgtatctattaaaatgtacctatctagttaatttggttccataatttggtcattctggcttaacattcaactattcaagcaatgttacaataaagtacttgaagaacccactgattttctggtattgccaatcatgcgtgcattcattcagtcattcaataaatttactgaaaggatcctagatgtcacacactaagctgggtgctatgcatgttattattaactacacctttggacagaaataaaatacatcaaagcacagctctggaaaatggaaaagcaaaattttagttgatttggtcaaacactttgccttgattcgtatgtagatactacagctaaatttccattagtggacatggattagtgatgtgtaaagtaaaagttagaatttcaaatgtctagtggaatttaacagaatttcctaggcctcattttttctactccctggcctgtgctcagtattcccactccaggtacaggcatcctggcagcacaattcccattcattattatctcacctgagatcctagtgaagttgcctttcaagatctgtcaacctagtcatatgtcctgttcttccttgggaaaaggatagaaactggaggggaaatgcngaaaaagttgggaggaaggggaaaggagngctcacaaagtcgtgtggaaactggatctcaccttcccttacangctgcagcttttctgaaggctctgtactctcaccaaagagcaacatttcttcacacaaaaagatgaaaacatttaacaataagcaaccacatatacatgtttaagccttactttcaataccaggtacttaatgtactctggaatccaacaataacaaagttttaatgataaatgtaatanattcactgacatggtttggatgtttgtccatctcaggatggaatgngatccccaatgacggaggtagggcctggtgggaggtgtgtggatcatggggaggatcctcgtgaatggcttgctgccatccttgggtaatgagtgagttctcgctctgagttctcccaagatctggttgtttaaaaaagcatggtacttctccttgagactgcatctc

SEQ ID NO: 271444 - DNA, 657 bp, Homo sapiens
gttaggatgttaagtgcttcaaatgaatacttaaacctaaattacaaacaagtggcaagatttgcaagctctcctttattctctgaaatgcgtacttcctcctccttatgtctgaggaaatcataccagatacgggccttagactgtccattccaaggaacaatgagaggtcttgcagttacaaatggaattctgtaaaataggataggtgaggaaaaagcactttttgatgtctactatttgccagtaccttaagtgctaaatatatacaaatgacagagaggtccctgcccttaagcagccaagagcctgtgagagtaagacagattgctaaaccactaataagctgatgttataattagtgagggaattatggtgatatagagattacagataaaatatttcttcctgggaagttttaagaaaaacttcacagtagaatgtgttgcagacaactggagagagggatcagggaggtgaggaggaggagtcagtaaaaaataaatacatgtactcgatctaaaatcctctccaataagctgaaatgcttttgcagataagactgacacacgctgacatatacacaaaaaagagataaaaatttatgctagtacttcataaaaggtcaaagtgaacataaccaagtggcaaaaatat

SEQ ID NO: 271445 - DNA, 470 bp, Homo sapiens
tcccagacctgcccggggctccctgggctgccactgcatgccgcctgttttgtggaagagcacctcgctgtcttttctgcttgcagacctgggagtgcaggaagcatgtcatcttcctctttcaggccccaaatctgtggatgttgctggaccataataaatgattgttgaggccgggtgcggtggctcacgcctgtaatcccagcactttgggaggccgaggtgggtggatcacctgaggttgggagtttgaggccagcctgaccaacatggtgaaactccgtctctactaaatacaaagttagccatgcgtggtggcgcatgcctgtaatcccagctacttgggaggctgaggaaggagaatcacttgaacccaggaggtggaggttgcggtgagccaagattgtgccattgcactccaacctgggcaacaagagtgaaactccgtctcaataaaaaatcataataaa

SEQ ID NO: 271446 - DNA, 432 bp, Homo sapiens
aaatgtacaaatatcttttattcctcaaaggaaaaagaagagttacacatgcctgtttctcaccaataagaggggtcagggcagagtgagtctgggagagagagttctaccaccacggttcccaaagcatcgtctaggggcctgttaggggagcccgaggtctaaactatttccacagtttcactaagatatgattttccttttccatcctcacattcgttagtgtgcagtgaagtgctccagaggccccagcatgctacattacagaagactgaactcaggagagatgaggaataatcccctccatcccaccagacaccaggagggtgtgccaaggtgtgagacatacagtccttactgtttttttgttttgttttgtgagacggagtttcactcttgtcccccaggctggagtgcaatggcgcgatctcg

SEQ ID NO: 271447 - DNA, 486 bp, Homo sapiens
atattcaatatacatctgtaagtgagcaactgacttacctctctctcataattatatttctattgtgaatttggaatactttaaaaaaagtaagggctttattaaatatgcaattaaaggattccaatcctgaaaatcattaatatctggacagaaaatgaagatgctccaaaaagaggcttatatttcatgaccaacagaagtgaagtttactaatgaatatgacatttggtataataccagtggagcttgtaactgagttgggatgtcagatagagaatatcagtgaacacaggtcacctttataatcaagaaatatgcttttaagatagaacaatcaagtagtttgaagttcccaaatgtatccttgaaatttgagctctgttctccaagtgcaactggtcatttccctgaccaagccaatacagagtaagggtctaacctcctgggaactggaatgtatcagctgtcggcaaaggatctgtg

SEQ ID NO: 271448 - DNA, 531 bp, Homo sapiens
aagctgggggagattgtgcctcccgcccctacagtaaggtttctgtgtggagacagtagaatataaaaataacacctccgctgtctgggatgttggcagccacttcaaaatcagacctctgtggcagcattttttccagaacacaaaagagctatcagcttcccagtttgcacaattcatcaagaaattatgcggggtcactggcacaaatgatgaggcatctcctggaagcttaacttcttatccatcccatctcttggacagatgatgccagttaattactttgaatgctcctccaccaagccaaggccagactcctgcaatcataggatggcaacaccacctctaaagcacagaacttcaggctttgcttcggaagtggcaccatggtctcttcattttccctttcttcaaggtcagaaaactgaagctgttaggagttttagtgttaagttccttccgaggatgttaattaggcttcaaactgttttgttctgagaaataaaaactaaactccagtcattcaagcta

SEQ ID NO: 271449 - DNA, 453 bp, Homo sapiens
atcactttccgatgagtcctcaatcagagtcagcttatggggaacccaatctaaaggcacagccaagttgttttccaaaatatttcttttactttacactcttgccctcaatgtttgtggtcccatttcctcactagtatttggtaccatcggtctaactttttgtcaagtgtgttgctttaattactttgtattgactaaatttatatgttaactatgcatattaactttttggagtgatcactaaaataatgtaaatagaatgtataacttcttaatgagtagaaaaaagtaatgaattaatacaaggaacttagaacgttttaattacaaataattgcctcccagggtaaatgttcttcttctcattactttagctctgttttttcatcttcaaattagacatttatgctattgtttgtttagatttagccatgtatttgccattttctt

SEQ ID NO: 271450 - DNA, 188 bp, Homo sapiens
tcagccggcccttcacagaacaaattctgcagccatttctagcccggtcgtgaatatctatctacggaaacaagaaacatctataataactaatatagagtgaaacacagaacgttaattattcttgaaaaaaagcccccctcctcctacctttggacacctcccagaaacaaggttcttaagacaaa

SEQ ID NO: 271451 - DNA, 449 bp, Homo sapiens
cccctgggctggcctttcttctgatctttggctgcagggcccactcttttggaacctcccacccctagaggtggttccagtgtggtggggaaaggtgtgcttctttactcatttttttaagagtcatagccagagtgcttcattctgcaaggacgtgcacatgcacatgcacacagagccttgagggcagggccaagagtgaatttggaattttccaacctgatacccattcccaaaagtaggagcttctctctagtcattttatcctctgagaaactgtcagttctcctcccacaaggctcccagacagccacgggtgaccagggtctccaatcactccttaagatgcctttgactggctgggcgcagtgactcatgactgtaatcctagcactttgggtggtcaaggtgggagggttgcttgcaacatggcaagaccccgtctctac

SEQ ID NO: 271452 - DNA, 264 bp, Homo sapiens
  misc_feature (91)..(91): n is a, c, g, or t
  misc_feature (112)..(112): n is a, c, g, or t
ctgacggcttgattgtttgctttttagagccctgtgggatattaaagagccataacaaattatctgaatataattatcaataccaggctgngcacagtggctcatgcctgtnatcccagccagcactactgatgttttaggccacgttgattctttattgtgggggctgtcctgtgccctataggatgttagcaacatccttggtctctctacctactagatggcagtagcaccccctctatgtgtgacaaccaaaaatatctc

SEQ ID NO: 271453 - DNA, 453 bp, Homo sapiens
caattccagtgttaggtatttcctcaggagaaatgaaaacacgttcacacaaataattgtacatgtatgtttctacacgctttattcataatagtcataaacaacctaaatattcatcaactggttagcagagaaaagagcaaaccactgatgacatgaacgaatttcagaagcactgtgctcagtgaaagaagccagacaaaaattacatcttacataaatttcatttatatgaaattctagtgaaggcaaaacatatagccaggggccaagaggggaggatggtctgaaagaggcaggaacttcttcctggggtgatgggaatattctgtgtcatgaacatcgtgattgtggttacaagactatacttttgtcaaaactcatcaaattgtacacctaaaatggatgcattaagcctcaatacagccaataaaagatacctacgttacagta

SEQ ID NO: 271454 - DNA, 854 bp, Homo sapiens
ctctaaccccaactttccctccttcgcactccccttcatatgagggggcaatggagtagccctagacatttttaggacagagctaagggtgcttttagtcagttacagggttcctagctactccagtggaagaatggcttccaggaaaatgtgccctacacactgtgtgattctcctcatgctgaggccaaaattgtaggaccagaggtgagattgtgatatgcacacatcctgtggcttcttcgcctgaagactgtggggagtgggtgagaagcaaagttagaattgaaggaacaaaagctagtctgtggaaaagactattctgatgctcagatatgggcagttgcattccaagaggtctgttctcattgattcctcatcaaaatggaaattccttcccataagaaatacatttgacaatgcaaatatatcattataagtacaacatacatttttcctttatgacaggagtcagacaaaaccaaaacggattaaaattcctctatttgtagggcctaaacttaacagtactacaaacagtgagtccttttgttgtgtgaaatcaaatgttttgtgcatcctgattattgctcttaaaaaaacaaatttcaattaaggaaagactgaattatctttcctctctctatacaaaaaaatggttttataaagttgttgccataggaggaggtgattgaagagaatgtagagaaaaaagcactgtgttggaagttaattaataaaaatgtcattattttcctgaatttgggaatgtttgttgtagatgtcagctttttaaaatgtttactttgttgtgattttttttatcgtgcaaaataaatatgttttttacttaa

SEQ ID NO: 271455 - DNA, 325 bp, Homo sapiens
ctccctctctccatcaccagagcacacagcaagaagccagacatctgtaagccaggaagacaggcctcctcagagaccccacaggacctagatctggacgacttccagcctccagaactatgtaaataatctgctcccaggagttcatttgattagagaatgtttctgaggaggtccaaggtcatgcattcgacatcagcaaatgctttgctctcttctgtgaccgaaaactggactaaaaactgtattcatctaactcacaaattcaaactattgatggtctatagcaagtggtatgagaaaataaataacgagctaatgtaat

SEQ ID NO: 271456 - DNA, 353 bp, Homo sapiens
acaaaacaaaaaaatcatttatgactctccacacctccatgaggaaggtatatttatatgcattttatgggtaaggaaattgaggttgagccagaatgaaagacttatccaaggtcactgaatcagttaatagcagagcaaagtccactccacagcaaatctcccagcccaggaagatgccaggggttctgacttgcagggtgttctcaggcacgtggcagagcatgttcagttcagcagctgcttggccccattcagcgcaaggtagagttaatctcagctgggaggagtagctcacacctgtaatcccagcactttagaaggccagagtgggcgaatcgcttgagcccagg

SEQ ID NO: 271457 - DNA, 465 bp, Homo sapiens
gaacaccacattccaggggaggaccgtttacacaatatctcctgcttgcttcatagattttgtggagagggcagtgcaggacatcatgagaatagcaagagtgaagaaggtacattaggagggagagatgtctccacaccgaatcccttccttgggtctgcaccagcacaaacaaaggcttttatctagttactgtacagtttaggtgtgctaaactgtataggagtttgagaccagcctgggtaacatggcaaaactctgtctctacaaaaaaatacaaaaattagctgggcatggtggtgcatgcctatagtctcagctagtcaagaggctgaagcttgagcccgggaggtcgaagctgcagtgagctgtgatcacaccactgcactccagcccgggtgacagagcaagaccttgtctcaaaaaaaaataataaaataaaataaaataaaaataaaaattaag

SEQ ID NO: 271458 - DNA, 584 bp, Homo sapiens
caagctgtcatcccgctttggcttctcaaagtgctaggattataggcgtgagccaccatgcccgaccagtttctgcttttattaaaattgttcacagttttatacattcatgttcattaaaaatgctatttagaaaagagtttgataaaataaatattatacaaaattcgaagaaaaaagaaaagagtttctgtttcagtcacaaattagggttattgtgatgtgtatttatgatgaccattgaacaaatgtgaagaatactgtgaattctatgactttatcaaaatcagccacatccaggagcttgcagttgttgaccaaatgaatgatgacatagagtagttcagatctatcatgtgctcttctatctaatcagtcaatatttccttggccctcaagccaacattcattttttatgtataaccttcttcatgattttgaaattttgatagggtaactgctaatgagttcacaaatgtagcactttaaaaggaaaataaatggagagtgaaaacaacttggctacgtataattgtgggttttaatttttctgtttttaaaataaaaaatggcattgatagttt

SEQ ID NO: 271459 - DNA, 511 bp, Homo sapiens
caagctgtcatcccgctttggcttctcaaagtgctaggattataggcgtgagccaccatgcccgaccagtttctgcttttattaaaattgttcacagttttatacattcatgttcattaaaaatgctatttagaaaagagtttgataaaataaatattatacaaaattcgaagaaaaaagaaaagagtttctgtttcagtcacaaattagggttattgtgatgtgtatttatgatgaccattgaacaaatgtgaagaatactgtgaattctatgactttatcaaaatcagccacatccaggagcttgcagttgttgaccaaatgaatgatgacatagagtagttcagatctatcatgtgctcttctatctaatcagtcaatatttccttggccctcaagccaacattcattttttatgtataaccttcttcatgattttgaaattttgatagggtaactgctaatgagttcacaaatgtagcactttaaaaggaaaataaatggagagtga

SEQ ID NO: 271460 - DNA, 520 bp, Homo sapiens
caagctgtcatcccgctttggcttctcaaagtgctaggattataggcgtgagccaccatgcccgaccagtttctgcttttattaaaattgttcacagttttatacattcatgttcattaaaaatgctatttagaaaagagtttgataaaataaatattatacaaaattcgaagaaaaaagaaaagagtttctgtttcagtcacaaattagggttattgtgatgtgtatttatcatccccaccttcctgcctcccatcatgctcttcatccctccctccccctttattaccgtttttttaacttgatgcattctctgtgagcagtggctctgtggaaaggagggagccgggagcctggtggtaagccttccccacagagatggctttcaggggccttatttaaagactgtgattatggagccacgcaaggctgcacctttgtgtgttgggagacggatgatgatgtccagttctgtgtaagggctgcgtatttaatttattaaagtcaaattggaggttaa

SEQ ID NO: 271461 - DNA, 322 bp, Homo sapiens
aaagctacctccatgaattaaaatttgcaaaaaggctaagagtcttatgttggagtccttgccctgatacctcagattgtgacagtatttgaagataagacctataaaagaggtgataaagttaaattgagacatttagggtaggtcctaaacttccctaatccagtctgactggtgtcttcacaagaggagggaatttgggcacacagagacacgagagactgaggcaggagaatcatatgaacccaggaggcggaggttgcaatgagccaagatcacaccatggccctccagcctgggtgacagggcgagattccatccc

SEQ ID NO: 271462 - DNA, 404 bp, Homo sapiens
acatatcactgagaaagctatacatatggcttttaatttgaaaggataactacagaattgtcagttacatgtaaaagatataaagttggacaaaactccttagatttttcatttttaatagctctagagaaatgactatttcaagaatcagactgaataatcaaagcaaaattgaatgggtaccacagttcttgaacatggtgggactaggaatgtaggagcaaagcaataacctttgtagttatttgaaaaattcttcttaaggaatggaaaaaaagtccagaagtaaactttgccaaagccaacttggctatttgtgatagggaacaggggtcagcaaaccatggtttgtagcccaaatctagccagttacttgttttattaaacaaagttttgtatcgtgc

SEQ ID NO: 271463 - DNA, 1508 bp, Homo sapiens
tgttataatgcaaagcctatcaaacttaaaattagcttaatcctgaaagatgtatattgcataatcaacctgtcacttttttcaaacacgatttgggagggtattgaggtcccatgtaaattttaaaataaaagacaaacaggaactaatcttttagtaaaaattattttgttttcatataggaaaacaatgccttctgtcatttacggaaaacacatgggcaatatggttggttgttcattgtgcccctctatcctataggaagaatgtgatcttttaattgtgcttggtgctttgtttctggagatatatatatatatattatatatatgtatatataccatatgtatatatacatatgtatgtgtgtatgtgtgtatatatatctctctaggttgtatgtaattcaatatgttggaatttaaagatgcattattatttggatttgatgtgaaattagattgtgaataatggagattgctctccattttttgctgttctagcatagccaaaaatataaagatatagatgtacatatacatatgtatttgattaaacactttaaattttaaatggccgcatcaaattttaaatggtagatgatatcaacaattgcagtgcactcaaaatgttataaaatctttgtagcacaaatcctgaagtatatgcaaactaaatagcatatttatataaaatacctagataacatgtctaggttgagatatttaatccctcatagagctatatttgactaataaaaaacgacagctaaaaataatttccctccctataagtacaaatatgatttttaaagcatcattgtaacttgtcatgaagctatttattattaattaaggatttaactctgtacccatctgctcttacaaaaggggaaaaagatttatctatgagaatagggaagtatagcactgttttatgtttttctctttagtattctgtcaccatttaaagcttcaatatatgccttccactcaggttcctgacacagcctacattctcttttctggttataatcacaatatggtagagctataaacaaggtaaaaaggtgttaacaattgaactgcaatcctacctattatctactttactatagcagtgaagtagtccagacttatttgaaggtggtactatttttatcttacaaaaatctactataatattaataactttccatgtaaattttcatgtgctggcatgcttacaagttaatagtgttatagaatgctcagctctcaatatgaggggttgtttgtggtgaattgcataacatatgtcatctatttgctgaaagaatatgctgtttagcaaactacctgctgagcaacataataagatttttgtacaaggtacaaattactaattattgtattttatttttctatgatttcctaagaggcattatcagggtcttacagatggagtaagcctgtttattaaaatatctattggcaaataaaagttacagctttggtggttgaatttgt

SEQ ID NO: 271464 - DNA, 487 bp, Homo sapiens
ccctcgtgatctcgaggacaggtctgcctgtgtgcccaaggactactctgccacccgagggtcattctcccaaagagcagaaacccgcagactcagtgattgcctggggtgtgtgtccctctgccactgctgtatgtctggtgcgtgtgtctcccattctctcttctctctctgtcactcactctctgtctgtttctctcactttctctctctctgtgtgtgtgtgtgtgcgcccgtgtgcgtgtgtgtttatgtgcccagtgcactacaaagcgatctcatgcatgtcagagtgtctttcgtgggctcctgtctgcgtctctgcctggatcatgtgggctgctgtcaatcatttctgcggcggttccactttggctttctgaagacctcaacaatgtgaaaagcgtcggtctcagagaaaatgaaatttcatcccgatactgagctacctcttttctagaatcaagatgaccacactccaaccaaa

SEQ ID NO: 271465 - DNA, 523 bp, Homo sapiens
ggaagacggccctaaattcttgaaatctggtgatgttgccatcattgatatggttcctggtaagcccatgtgtgttgagagcttctcagactatccacctctgggttgctttgctgcttgtgatatgagacagacagttgcactgggtgtcatcaaagcagcggacaagaaggcagctggagctggcaaggtcaccaagtatccccagaaagctcagaaggctaaatgaatattatccctaatacctgccaccctggtattaagcagtggtggaagaatggtcttagaactgtttgtttcagttggctatttaagtttagtagtaaaagactggttaatgataacaatgcatagtaaaactttcagaaggaaaggagaatgttttgtggaccactttggttttctcttttgcatgtggcagttttaatttattagtgtttaaaatcagtgctttttaatggaagcaacttgaccaaaaatttgtcacagaattttgagacccattaaaaaagtttaatgagaa

SEQ ID NO: 271466 - DNA, 381 bp, Homo sapiens
tgagacagagtctcactctgttgcccaggctggagtgcagtggcacaatctaggctcactgcaaccttcaccgcctaggttcacctcccaggtttaagtgattctccttcacctcccaggtttaagtgattctcctgcctcagcctcccaagtagctgggactacacacatgcaccacagcgtccagctaatttttgtatttttagtagagttagggcttcatcatgttgggctggtctagaactcctgaccacaagtgatccacccgccccagcctcccaaagtgttgggaatacaggcgtgaatcactgtaaccggctccttatcttgtctttaacaagtgtcattaaatgattttttttttctttagcaacatgagct

SEQ ID NO: 271467 - DNA, 539 bp, Homo sapiens
gatagggtttctgacagcatgacccacacccacttttccagacctcatctccacatgaagccagcttcttagtctacctttacagaccaggtgctgtctcctggccttgattcaatgatagattgtcatttttcatcctgtctactgtggtttgaatgtatgggtccctcctagattcatgatatggtttggctctgtgtccccacccaaatctcatgttgaattgtaatccccagtgttggaggtggggcctgctgggaggtgattggatcatgggggtggtttctaatggtttagcaccatcctgctagtgctttctcgtgatagagttctcacaatatctggttgtttaaaaagtgtgtatcaccgtccccttcactgtctctctcctgctggccatgtgaaatgtgcctgcttctcctttaccttctgtcatgattgtaagtttcctgaggcctccccagaagaagacgcctgtacagcctgcagaagcatgagctgattaaacctctttttttttttcaaataaaaaaaaaaaa

SEQ ID NO: 271468 - DNA, 208 bp, Homo sapiens
tggaggccaggccaggctcttgctctttccagatgtgtgctggtcactcagcctctctgagcttcagttttcccgtcctccaaagtgggttgtgcaaatcacacatgcgaggtcctggcccagccctggaacattgtccactcacagtaaatgagatctctcgtcactgtataacccttgcttgagtaaagttcttatccaaactggc

SEQ ID NO: 271469 - DNA, 341 bp, Homo sapiens
acaaaacaataacccttctggggtttcttgtggcggttgaaatagtcccacatgtggtcatcagaaaataagccattcctcataccaatataggatcagctccttgacctctgaggggcaggagtgcttcctggtttgtgtattagaatcccttcctgccttgtttcatggcagtgaaatgcctcttggtcctgtccaagtgtatctttcactgatttctgaatcatgttctagttgcttgaccctgccacatgggtccagtgttcatctgagcataactgtactaaatcctttttccatatcagtataataaaggagtgatgtgcaatagcaaaaaaaaa

SEQ ID NO: 271470 - DNA, 580 bp, Homo sapiens
gtgttcttgaaaatattaaacagaagtcatagagctacatattggccagtcaggaaactctcttcttcttaccttccatcccacctccagactgtttgcctaatcccgctttgtgatgtctgttgtgctggtataacgatatttgaactctctgatgaaaactttggccgcaattgacccttccctaaagttgaagagatttctccaaataaggaaatgaagggagttaagagggtaagtcatacagtttggatgtgtatccccgcccaaatctcatatggaaatgtaatccccagcattggcaatgctgcctggtggaaggattgtgggagtggatttgtcatgaatggtttagcaccatctgccttggtactgtcctcctgatagttctcatgagctctgatcttttaaaagtgtttggcacctccctgctctctctcttggtcttgctctggccatgttaggtgcctgcttcccctttgtcttctgccgtgattgtaagtttcccgaggcctccccagaagccaagcagatgccagcatcatgctttctgtacagcctgcagaaccatgagccagtt

SEQ ID NO: 271471 - DNA, 462 bp, Homo sapiens
aaatgatggaaattggatggttctaaacacagctatctacatcaccatgtacccagagcaggaaaagaaaaacagcaacagcaacaaaataaacatgcaacaaactagggtcagttacatagaagcattaactcttattttaattggataattttgttaaatttgcattagaagttcaattctaactctacctccatatgcttaagtttgagttccttcactgtagaaaagaggcttaaaagttatcagtaaagcagaggtcaactcgtataaatgttactggtaagtgaaaacaattctctaaggttttttttcaaccttttctacagatgggaaaagctttaagcaacttaaaacaggcatacctacagtaattatttataccattcacattaagagaaataaatacaaccaaatagttggacaacaagtgctgcctgttacttgctaaaagagaccatg

SEQ ID NO: 271472 - DNA, 454 bp, Homo sapiens
tcaataagagggtgctagaaaggacttataggaggatttgtgcccatgttcagtgatttcagtcagggtttagggaagccaggcttctctctggcttggatgctgtcagaggtgggggtatgtctatgacggactatcttaatgagtcttgcccagaaggagagaagattagttggaggctaatgctgtaattggtaaggaaacaacagtcactctcttatgggagaaagagggatgtttcatgccttttgtggtttggacagtgttcacctttgccagcattcagatgtgacgatggagtggttctgtttctgtcttgctccctcacggtcacagagtgaccttgtccgatgctgatgttctctgaaattgtttatattcaacagaataccaaggccagctcccagatgtgcagggatgtataaattaaacgcaatttaaatctaaaattcca

SEQ ID NO: 271473 - DNA, 551 bp, Homo sapiens
agccaggggattggacggtgtcatggaaatgtcaaagaaaaagtgacacctgagagaaaatttgaaagatgaaagcagatgcactaaagaggccaatcagtcatccagacaagaatttacctcatgagagtcaactgtgcgcatctcttcccaacattgtgattggttatgtcatgttgatagcttgaaattggacatagtatgtacatttacaccccagaaatctcaggtactacaaactaaaccttcccttctctcattccccagtgctgttaatacggaaactggtctaatatggaaaacaggtgaacatggagctgctttgtttgactcagggatgagagatacccaggtcctaattacttgtctttaactttccttagggagtactaatttgggagtcattgttctaaacaattaaagtgaagtaactgtcctgtttttctcttttacccttgtgaacgaggaagctcagggttaaagtctatgtctttacttatacatttctgtgttgtaggatcttttaataaagattttctccttttaaattt

SEQ ID NO: 271474 - DNA, 418 bp, Homo sapiens
acgactgtctcttgttaattgcagtccaccacgctagggcttcggggtaatgtggttggaatttacacgtaggcctgggcagaaacctgctaatgctggcgtctgatttgatctaattagaagtgagtgaatccgagcccagtgttctatatgaaccgaatgaatgagaactttgcaacccgttgtttggttgctgatttcaaggcattgactgtaggaattgtctcgtatgtgtgaagctactttgcgttcttcatcctatagattacaaaagttacagaactacactaagtctgtcccaaaagcaaagttgctccttctacaacctccagatattccacaaagcctgcagacacacggcctcaaagaatctggaattgagtatcgcatgtatttaataaataggtcgagttttaaa

SEQ ID NO: 271475 - DNA, 365 bp, Homo sapiens
aattcctcaagaacattggctggagaatagaccagagaattggtggattcggggaggagccaggaattaaatctcagctaatgaaccgtattcaatctgtaacaactgtgatgagaatgccattgataatagtaaactcaattgcaattgtgttacttttattatttggatgaatatcaggagaggaaatggagactcagaagagatgctagcagaagttattatttaggtcattattggaataaaggctgagatgggaggatcacttgagcctgggaggctcaggaagtaagtaagtaagactgcagtaagccaagatcgggccactgcactccagcctgtgtgacaaagtgagaccctatttc

SEQ ID NO: 271476 - DNA, 477 bp, Homo sapiens
tggggaaggcagcagctctggggtctgcaggggggcacctcatggttcccaactctcctagaagcaaaaagggattcaaagaggcccacttgataacctgtcaggctgcatagcagtgaggcttcctcctttacaccgatgtcggggaaaagaaaactacctggcaagttaggatacagcaggaacggtctccaagacagccattgaaaatgctcccaaatgctggagacctcagctcctgcacaaagacaaaaccacagaggaaagcactcagaaaggagcaggatgagggaatgcaaagaaaaggcaaatgagggaagcgttgaaagatacagccttgatacaatggccacaaagaagagctcttcacaatagaagcttgttatgtttgctttgccatcatccaccataaagcctggaatacaaccttcttcccttttcagtaaacatctactgagtaaatcacaagaaggtatc

SEQ ID NO: 271477 - DNA, 402 bp, Homo sapiens
ttttgtggggaaggtccattaaaacctttctagctcctgcacaaagacaaaaccacagaggaaagcactcagaaaggagcaggatgagggaatgcaaagaaaaggcaaatgagggaagcgttgaaagatacagaacctcttccggtggcagcagggagggaggggagacagttgaagttagaagatgctttgctgtattcaccaagtcttcaaaacaagagcactgaagtgctggggactgtttctccttgactttttagccttgatacaatggccacaaagaagagctcttcacaatagaagcttgttatgtttgctttgccatcatccaccataaagcctggaatacaaccttcttcccttttcagtaaacatctactgagtaaatcacaagaaggtatc

SEQ ID NO: 271478 - DNA, 234 bp, Homo sapiens
aaaaccaagcatagagtaaatatgatggaagattactatctgattcctacctccatatgaaattgtgtgaagttatgtaattaatgttttcaaagtgtgggaattctttcttttcattggttagctatatataattatataatcataatacatcattttgaaaaaaatatgatgtgggaaaattaacttcaaggaatatacattttatattgcttaaaaagttctgtagtcagc

SEQ ID NO: 271479 - DNA, 197 bp, Homo sapiens
agaaccaatctacgagcaaatagatttacacaccaagaaatccctgcttgtcttgtaatgagatgctgattttccttgctgctaacaaacacgttttcattaacatcttgctagctaattacagctaattatgaacattaaattcataagtgatcacttacaagcactccctcttcccacctcctcaaaaaaaaaaa

SEQ ID NO: 271480 - DNA, 471 bp, Homo sapiens
cttagatcaagggtcctcaaatttggctgccagctggaatctcttgcaaacattttaatacccagatgtccagtcccccacccagaccaatcacatctgagtctctgggggggggcgggggtggaactagggcatcggtatttttttaatgcttcccaagcaacgccaacgggcagacaagtttaagaagtggtgctctggaccttatcagcactcggctgccaccctggagtggctctgggcgacagtggctgctttccgcttcgaggacgcccggcttggggattcgggcatgctctgggaggcgagggctggggaggatgcgagcgtgccagcgacctggtgctctgccttgctctaggcccagctccgaggctgcgggtctctgggtcccccccacggctacaacacgtgctgccgccccgactcctccggttatctctgcagaccgcaagcggtgcccagcggccg

SEQ ID NO: 271481 - DNA, 498 bp, Homo sapiens
taacttccttataacttttggctctaccacttctatccctatatggaagctgaagtatgttattactgctgttacatgactatttttctacattgtggttctatttctgctaaattattcttacagtctttatcaatttaagttttttaaaaaactgcctttttagaactctgaaacagtatttaaaaattaaattaaaaaaattttaagttttgttcatcatatacaatacaattctgatatatgatgttagacaaattattagccaggtaatttctgttcacctagtatcaatgctataaagagcttcaagtgaactttctttagtgagatgagtttcaatgatcctaaagatggtaaatgaaccattatttgtgtgtctaaagtgtgtactcttaagaaattatccataaatcaaaaacaaaaatttaagcaattgttaaatataatgttaacaggaacattgagcaataaattgaaacttttaaatttaactca

SEQ ID NO: 271482 - DNA, 476 bp, Homo sapiens
ttcaaagcacttcttatcaccaacaggagtaagctctgcgataggagtgaagagtgtcactaagtgagaatcagctacggtggcagctcgtcctagaaatgtcacgtctcatcctgcctccgtgtgctggcctatccaagttcaggtttcaggcaggcagctggactcagcaggaagagtctctttttctgaaagctaaaatgactcttcagcttgagagcggctgtcctccttgttttctttgaaagaagatcatttcctgaaggccgagagatccaggctctccaaaagcctctctctgtgggtgagacccgccaaagaatgcaaggatgagaaacaaaaccaaatctcagaggaatgaaagaatccttttcacatggacattagttacattcattaatggctcacacatgagttcaggcccatgttttgatctgtaggattgttttcaattgagctctagaaacagaaaaaaa

SEQ ID NO: 271483 - DNA, 2485 bp, Homo sapiens
  misc_feature (868)..(868): n is a, c, g, or t
  misc_feature (1344)..(1344): n is a, c, g, or t
  misc_feature (1513)..(1513): n is a, c, g, or t
acttaagaggagctccataaatcatctaattccaccattcatgttaccaagaagcccaagaaaaggaggcagtttaccagaagacgtataggaagtgaataacccagtggtcttttatctttgtctgtactttctctttaggtgactgtcttcctttccttggctttagctacagatgaaattttatctctatcctagaactctttcctgagttccttacatatattgccaactgactacctgacatttccacttagatttgtagtagacatctcaaacccaacatatgtgaatcagaattattgctatcccactgccactctcattctgcttctttagtctttcgcttctaagtaaaagacacctgcttcccttaccaacccccttttgtgtggctctccccagatcactgggacccagctccactggctgaattttccaccctttttgctcctgtgatctggaatggtcttcaattggctagctcattcattcttttgatcttagcttaaatgttacttccaaaaaaggaatgcttattacctattttaaagtaggttccccctctctttattttcacatggtaccctgatttttccttcatagcatttaccataatttttatgtttgtccatttgtttaaaacatgcctctctcttccgctagaccgtaagcttcaagaatgcaggcaccatgccagttttgttcacgactataaagccaggacctacacatagtaggtactcagtaatttcttgttgaatgaaaaacaggttagtgccagggcctacacatagcaggtactctgtaatttgttgctgaatgaaaaacaggttagttgtagagctagagctcatgactccctcanctcctagagcactgtactttcattaacaagtgctattaaccttcccctctttgttctttgctgacatagtacatgaaaaggctctaggaggatgtcctggcttgaaaccttaacagtcctgcctgcctcatgagaaagacatagggttagtttctagcacatcatgaaccaatcaatactttggctattcaggggtcccttggtctagttcagagcaatattccttttgcttaaaaattttttctaaattctcaaccattgctagtgaaagtataaattagtaaaaccactttggaaaataactggtcattgtctggtaagattgcacatgtacctaatccatggtccaacagtttctctcctaccatagagaaattaagttttgctcatgtgtaccaagaaacatgtgcaagattatttataggggcattgttcataatatttgaagaagaaacttaattcaaatgtccactttncaattattatataggctgagtgcagtggctcatacctgtagtcctagcactttgggaggctgaggccagaagatcatgtgagcccaggagttacagactgcagtgagctatgattgcactgatgcactccagcatgggcaagagcaagaccttgtttctaaaaaatagntagtggtatattcatattctggaatagtgtaaaaaatgaaaaactgaagataaatatatgaagacaagtcctcaaaatacttctgaatgaaaaaaattgcaaacatgaatctcaaaaacatgctgagtgggccgggcatggtagctcatgccggtaatcccagcacttagggaggccgagttgggcagataacacttgaggtcaggagttcgagaccagaccagccaacatggtgaaacccaatctctactaaaaatacaagaaaaaaatcctaactactcgggacgctgaggtaggagaatcccttgaacccaggtggcagaggttgtagtaagctgagatcaaaccactgcactccagcctgggtgacagagcgagactctgtctcaccaaaaacaaaaaaaccatgctgagtgaagaaagccaaaatgccgttcacaagagaatatgtaccatgtgcttccaccccatttatatgaaattctagaacaggcagaactgtaaaagagtacatcatgttgcctgggctgggagaggggagatttccaggtgatgaaaatattctttactttgattggcgtggtggtgaagggggtatgttcatttgtcaaactcatcaatttatatacataaaatgaatgcatttattgtatgtaaattcaacctcaataaagtatatttgaaaaattttgctgggtgcggtggctaacgcctgtaatcccagcactttgggaggctgaggcaggtggatcacctgaggtcaggagttcaagaccagcctggccaacacggtgaaaccccgactgtactaaaaatgcaaaaaaaattagctgggcgtggcggtgtgtgcctgtaatcccagctactcaggaggctgaggcaggagaatcacttgagccccggcggaggttgcagtgagcagagatcacaccattgcactccagcctgggtgacagagtgagtctctgtatc

SEQ ID NO: 271484 - DNA, 501 bp, Homo sapiens
atggattgtcttggagatgaaggggcagtgtactattccatttagcttgttcagggaacttgagtcaaatcccttgagtgttcactccatcagatagtccatgaaatgctgatgaagatataacaattatccataaagttagagtgttcactaattaagaatactgaagaatgaagtatattaaatgggtcacgttgcaccttttttgggtttgttttgttttgttttgttttgtttgagacagagtctcactctgttgcccaggctggagtgcagtggggcaatctcggctcactgcaacttctgcatcctgtgttcaagcaattcttctgccacagcctcagctacttgggaggctgagacaggagaatcccttgaacctgggaggtggaggttgcagtgagtcgagatcatgccattgcactgcacctgggcaacaagagtgaaactccgtcttaaaaaatataagaaataaaaaaataaaaacctgaaaaaaaaaaa

SEQ ID NO: 271485 - DNA, 281 bp, Homo sapiens
tcacagtcgcttgataacagtatgttgctaacagcttgctgtcatattggaaacacccatactaaagatatgtagtataatatgttttctttctacttaatatgtaactcattagtatgtatatacctcatgacttaacatggaccaaaataactgtgttccctggtgaacaataatgcaaaatagacttcccaaaatgttgatgaaaatcaatgttgtcgaattccttgtttgttaataaataaaatagcttccgtaattaaacgtttaacaacagaatg

SEQ ID NO: 271486 - DNA, 421 bp, Homo sapiens
gtctagcaatttaccattttatttttctattttgtctagagtgtattgtatctgttgagtctatatgccagtatctataattttcatattttaaatttggaattgctttttcataatcacctgtttcaattctctttgtttggcaacccttttgctacttagaaaacctctatctccttctttaacatgttcaaatttaaaaatctttgtcagaccatttcataaaacatctggtgtgaattcgtgtttttatatgattgttttttctcattaaatttcttgctatgttttggattaaaaaaactggttttaatgttggacagactcattattttgacaactcttgcattcaaatcaaaactctgaaatttaatcttatttttgaatttactaattgatcagaaatagacacccccccccc

SEQ ID NO: 271487 - DNA, 408 bp, Homo sapiens
caaagagtgtacttatcttttcatgcatgcctttaaagagaccatattttttctctgataaagtcaattatcagtgtatgtgctgctctgttcacagttttgactaaatagtgcaacatctacgtagaaaacataccccaaacttgagttttcctgggttgtgcattgtacattgtcaaagcgtaaagaacatctgagttggaactcgtacccacttcaggatatgagaagatgcaggtcagtgatttgtttcgaggcggaagaagcttaaagaaagtaccttgcgctgtgtgttcctccattagcatttgttattatgaaagcattagactatctctggatgttttccacacacctgagagtgtgaaagaatgacaggtacctcattaaagatgcataatatctagt

SEQ ID NO: 271488 - DNA, 571 bp, Homo sapiens
agttaaaaggtagtagttttattacgatttgatggatcattccctaacttcaaaattttttcatgatgtcaacaactgtctctttaatatgacatatcattgagctttaggctttgctgataatctttgaggataccttgtgaacttcaaatatattttatagaatatttctttttttatgtgatggtgctagtacatatttgttgtgttgcttagtagacgtgttaagtgtttcagaatacacataatttatatttgtttggcttaattcaacagatacttgaatacctaccaagtataaggcactatgccagcactgcatagctttccttgaagaagagcaattactgcccttcaggaatatataatctagtaggagaaataaaatatttacatgagttttacgtgtaggaaactgaatgaaaaagtttgttctaatgagttttaagaagagagatgaaggtcttttctctcttggaccttcagacacccacttgggtctctagcaagtaaatttttcatttgtttcctcttataaagccttttaaaataaacttccacttctgctctg

SEQ ID NO: 271489 - DNA, 204 bp, Homo sapiens
ttcccccactttcctttggggtacagtgagtctaagtgatccagaatttagagccagaagcacttggatcctttcacttctagtcctgtgatttgtgataagttgctcaaatttcttaagactccggtttcctatttgtaaaatgctgacaatctgtctcacaaggttgtcgtacagattaaatgatataagttatgaaaagta

SEQ ID NO: 271490 - DNA, 917 bp, Homo sapiens
cagccctccagagtgcaactctctgaatttataaaaaggaagtattcatactaaataagcatatttggcagattgctacagacacaagcactcaaaccacggcatgaacacagccttgcttgtgtagttttccaaacggcattttcaattagcattacacttgcaaaaaatgtttgcattgtaccattaaccagagtaacgtaggagaatacagcactacacctaaccgaatcatctctttgattatctgttgaaatactgatttcctaaaacaaaaacaagcaagcatatgagaggatcgaaaatatctaacaactttttaaacgtagctatgtgccgttaccaacctgctggtccccatccgtcatccgctctttctgccactgaccaccttctcagcacttcctcatcaagttcctagttccctgaagagatctaactctctggaaaaggtcacataactgaatgccaaagccccaaatggttaatttttgacagctctcacttttgcaggataaaattatgcaaataacataaaaagaacagatgaaaaaagtaatttgcatgtcttgagggtgagaaaattctcattgccagagagaaagctgacgactgtcctctcacaatgatcctgagtgatatgttcagcacttttgtttttttccagtgggtctcacttgggacatatggcatttctttgatgtgtgtgtgcgtgtgtgtgtgggtgcgtgtgcttgcgtgtgtgtgtgagaaagagagagaggaagagcgagaagctatatttacattgtgatatttatatatatcttagaaaaccctcaaatttcagtaggcgaatgcactaagtataaataatagagaatccgtttgccttatacattcccaaatatatttttaaagtatctcattaaaataca

SEQ ID NO: 271491 - DNA, 781 bp, Homo sapiens
agaaggagttgcccacagagcccccctacacagcatacgtaggaaatctacctttcaatacggttcggggcgacatagatgctatctttaaggatctcagcataaggagtgtacggctagtcagagacaaagacacagataaatttaaaggattctgctatgtagaattcgatgaagtggattcccttaaggaagccttgacatacgatggtgcactgttgggcgatcggtcacttcgtgtggacattgcagaaggcagaaaacaagataaaggtggctttggattcagaaaaggtggaccagatgacagaggcttcagggatgacttcttagggggcgtttgggctgcggtgctgcgtcatttttcctttgctttctctttactttagacactggcccaactccaggagtttcctttcattccctcagtgcttctcttctgacctgcatgttgagttctgtattgctggggcttccaacaaaaaccagagtcactgacagagggaactgcagagaccttgttggtattcagctgtgatggatatagagaatcggaggcaccttgttttcacaactaggataaaaatatctgcagggtcctttccattcctatttagagggagtcctggctccatgaccccctcccgagtggactgtccaagcagataggctcacacgagaaacagtgaggctgaaagggggggccatggaagagcggtagggagtccacggagaagatgcagtgaatgcttgcatgcattcacacgtgtgtgtgtcccag

SEQ ID NO: 271492 - DNA, 382 bp, Homo sapiens
agaaggagttgcccacagagcccccctacacagcatacgtaggaaatctacctttcaatacggttcggggcgacatagatgctatctttaaggatctcagcataaggagtgtacggctagtcagagacaaagacacagataaatttaaaggattctgctatgtagaattcgatgaagtggattcccttaaggaagccttgacatacgatggtgcactgttgggcgatcggtcacttcgtgtggacattgcagaaggcagaaaacaagataaaggtggctttggattcagaaaaggtggaccagatgacagaggcttcagggatgacttcttagggggcaggggaggtagtcgcccaggcgaccggcgaacaggcccccccat

SEQ ID NO: 271493 - DNA, 476 bp, Homo sapiens
atcattgcgaagtaaagaagtcatctattgtcagttaatatataacgagagaatttagcctaaccagaggcccatggaagccaaaatctttctattcttacactgaaccttcttgctgagaaacaattgaggtcagctgggctcatgccataatcccagccctttgggaagctgagaccagatgattgcttgagcccaggaactcgagaccatcatggacaacttaacaagaccctgtctatacaaaaaaaattttaattagctgggtgtggtggcacatgcctatggtcccagctacttgggaggctgaggtgggaggatcactggagcccgaaagttcaagcccacagtgatccatgattgcaccactgccctccaggcctgggcaacagagtgagaccctgtctctaaaaaagaagaaatgattgaaatcatatttttcaggctggacttccaataaagtagcccttaaaagg

SEQ ID NO: 271494 - DNA, 538 bp, Homo sapiens
tctaacattattgtagggtttatttcctgtgttctctccgtagaatccttctactgtctgttgattgaaccagttgaagaaatatctcattttaaattacatttgagcttagaaaacaaattaatttgatgacaatacaatgtgtgcctcctaggtatattttcatgcgatttcttagagagataggcttaaatcatttcatttgtttcaagagtaatatttttatttgattttaatatcatcaaccactgctgcagcagcaatacccaaatcgttttcttaaacaaagaaaacagtgatgcagaaatgataggcttgtctcaatataatctggtttagagagcattcttaaagccaattctattctttgtactttgagaagataatgttgagaagtattacatccagattctctcctagactcgggatggtatttagggtcttcatatctaaatctttagaatgcattacaatttaaaggtagaattttagagtttgaaagaacctagaggttttctagtttcagaacctaggaaaa

SEQ ID NO: 271495 - DNA, 1424 bp, Homo sapiens
atgcgcagagcgcgcggggcgcggttgccgtggcagcgccggctccagggagggctgctggcgccgggccgggaccgcggggcctgaggcggagaccggagagcccgcggcccggccggaggcagctcgggacaggcttgagcggcggggcgcgctgcccggccggcggggatgcgggaccggctgccagacctgacggcgtgtaggaagaatgatgatggagacacagttgttgtggttgagaaagatcatttcatggatgatttcttccatcaggtggaggagattagaaacagtattgataaaataactcaatatgttgaagaagtaaagaaaaaccacagcatcattctttctgcaccaaacccggaaggaaaaataaaagaagagcttgaagatctgaacaaagaaatcaagaaaactgcgaataaaattcgagccaagttaaaggctattgaacaaagttttgatcaggatgagagtgggaaccggacttcagtggatcttcggatacgaagaacccagcattcggtgctgtctcggaagtttgtggaagccatggcggagtacaatgaggcacagactctgtttcgggagcggagcaaaggccgcatccagcgccagctggagataactgggagaaccaccacagacgacgagctagaagagatgctggagagcgggaagccatccatcttcacttccgacattatatcagattcacaaattactagacaagctctcaatgaaatcgagtcacgtcacaaggacatcatgaagctggagaccagcatccgagagttgcatgagatgttcatggacatggctatgtttgtggagactcagggtgaaatgatcaacaacatagaaagaaatgttatgaatgccacagactatgtagaacacgctaaagaagaaacaaaaaaagctatcaaatatcagagcaaggcaagaaggaaaaagtggataattattgctgtgtcagtggttctggttgtcataatcgctctaattattggcttgtcagttggcaaatgatggtgtggataacgtcagtgtgcatgcctctctgccagggtggggaaattgatgttcattatattgaagtttgtttattgattctcacacatcaaaccaccaagattcctgctgcaatgaaccaaatcagcatcctgtcatttcgtgaatgaatctcagacgctgtaacccggcatcgagtgctgaccttgtaatgtatgagttcacggaagaagcacaaccgaacgtcttgttcagtgacagcgccgtaagcacagtgggtgtgatgcgtgaccctgaatgacacactacagaatgtgagcagtgtgagacttctctcactggccttgaaataagaaaatattgaacattttaatattaaaaatatttcagtgttaaaaaatgtg

SEQ ID NO: 271496 - DNA, 1476 bp, Homo sapiens
atgcgcagagcgcgcggggcgcggttgccgtggcagcgccggctccagggagggctgctggcgccgggccgggaccgcggggcctgaggcggagaccggagagcccgcggcccggccggaggcagctcgggacaggcttgagcggcggggcgcgctgcccggccggcggggatgcgggaccggctgccagacctgacggcgtgtaggaagaatgatgatggagacacagttgttgtggttgagaaagatcatttcatggatgatttcttccatcaggtggaggagattagaaacagtattgataaaataactcaatatgttgaagaagtaaagaaaaaccacagcatcattctttctgcaccaaacccggaaggaaaaataaaagaagagcttgaagatctgaacaaagaaatcaagaaaactgcgaataaaattcgagccaagttaaaggctattgaacaaagttttgatcaggatgagagtgggaaccggacttcagtggatcttcggatacgaagaacccagcattcggtgctgtctcggaagtttgtggaagccatggcggagtacaatgaggcacagactctgtttcgggagcggagcaaaggccgcatccagcgccagctggagataactgggagaaccaccacagacgacgagctagaagagatgctggagagcgggaagccatccatcttcacttccgacattatatcagattcacaaattactagacaagctctcaatgaaatcgagtcacgtcacaaggacatcatgaagctggagaccagcatccgagagttgcatgagatgttcatggacatggctatgtttgtggagactcagggtgaaatgatcaacaacatagaaagaaatgttatgaatgccacagactatgtagaacacgctaaagaagaaacaaaaaaagctatcaaatatcagagcaaggcaagaaggaaaaagtggataattattgctgtgtcagtggttctggttgtcataatcgctctaattattggcttgtcagttggcaaatgatggtgtggataacgtcagtgtgcatgcctctctgccagggtgggaaattgatgttcattattatttgtgtaattgttttgcttgtgatccttggaattatcctagcaacaacattgtcatagcaaccatatcccaagagccatttatccttgagactcagaccacatctgcaaccaaatcagcatcctgtcatttcgtgaatgaatctcagacgctgtaacccggcatcgagtgctgaccttgtaatgtatgagttcacggaagaagcacaaccgaacgtcttgttcagtgacagcgccgtaagcacagtgggtgtgatgcgtgaccctgaatgacacactacagaatgtgagcagtgtgagacttctctcactggccttgaaataagaaaatattgaacattttaatattaaaaatatttcagtgttaaaaaatgtg

SEQ ID NO: 271497 - DNA, 1415 bp, Homo sapiens
atgcgcagagcgcgcggggcgcggttgccgtggcagcgccggctccagggagggctgctggcgccgggccgggaccgcggggcctgaggcggagaccggagagcccgcggcccggccggaggcagctcgggacaggcttgagcggcggggcgcgctgcccggccggcggggatgcgggaccggctgccagacctgacggcgtgtaggaagaatgatgatggagacacagttgttgtggttgagaaagatcatttcatggatgatttcttccatcaggtggaggagattagaaacagtattgataaaataactcaatatgttgaagaagtaaagaaaaaccacagcatcattctttctgcaccaaacccggaaggaaaaataaaagaagagcttgaagatctgaacaaagaaatcaagaaaactgcgaataaaattcgagccaagttaaaggctattgaacaaagttttgatcaggatgagagtgggaaccggacttcagtggatcttcggatacgaagaacccagcattcggtgctgtctcggaagtttgtggaagccatggcggagtacaatgaggcacagactctgtttcgggagcggagcaaaggccgcatccagcgccagctggagataactgggagaaccaccacagacgacgagctagaagagatgctggagagcgggaagccatccatcttcacttccgacattatatcagattcacaaattactagacaagctctcaatgaaatcgagtcacgtcacaaggacatcatgaagctggagaccagcatccgagagttgcatgagatgttcatggacatggctatgtttgtggagactcagggtgaaatgatcaacaacatagaaagaaatgttatgaatgccacagactatgtagaacacgctaaagaagaaacaaaaaaagctatcaaatatcagagcaaggcaagaaggaaaaagtggataattattgctgtgtcagtggttctggttgtcataatcgctctaattattggcttgtcagttggcaaatgatggtgtggataacgtcagtgtgcatgcctctctgccagggtgggcaacaacattgtcatagcaaccatatcccaagagccatttatccttgagactcagaccacatctgcaaccaaatcagcatcctgtcatttcgtgaatgaatctcagacgctgtaacccggcatcgagtgctgaccttgtaatgtatgagttcacggaagaagcacaaccgaacgtcttgttcagtgacagcgccgtaagcacagtgggtgtgatgcgtgaccctgaatgacacactacagaatgtgagcagtgtgagacttctctcactggccttgaaataagaaaatattgaacattttaatattaaaaatatttcagtgttaaaaaatgtg

SEQ ID NO: 271498 - DNA, 345 bp, Homo sapiens
ataaaatacttttattacggcaggtttcagatgtgtgcagaagcagagagaggcgaccacaagccgaccccccagctccacagttctccatgagctcccacccgcacccgctcccagaacgctgtaacccggcatcgagtgctgaccttgtaatgtatgagttcacggaagaagcacaaccgaacgtcttgttcagtgacagcgccgtaagcacagtgggtgtgatgcgtgaccctgaatgacacactacagaatgtgagcagtgtgagacttctctcactggccttgaaataagaaaatattgaacattttaatattaaaaatatttcagtgttaaaaaatgtg

SEQ ID NO: 271499 - DNA, 1092 bp, Homo sapiens
atgcgcagagcgcgcggggcgcggttgccgtggcagcgccggctccagggagggctgctggcgccgggccgggaccgcggggcctgaggcggagaccggagagcccgcggcccggccggaggcagctcgggacaggcttgagcggcggggcgcgctgcccggccggcggggatgcgggaccggctgccagacctgacggcgtgtaggaagaatgatgatggagacacagttgttgtggttgagaaagatcatttcatggatgatttcttccatcaggtggaggagattagaaacagtattgataaaataactcaatatgttgaagaagtaaagaaaaaccacagcatcattctttctgcaccaaacccggaaggaaaaataaaagaagagcttgaagatctgaacaaagaaatcaagaaaactgcgaataaaattcgagccaagttaaaggctattgaacaaagttttgatcaggatgagagtgggaaccggacttcagtggatcttcggatacgaagaacccagcattcggtgctgtctcggaagtttgtggaagccatggcggagtacaatgaggcacagactctgtttcgggagcggagcaaaggccgcatccagcgccagctggagataactgggagaaccaccacagacgacgagctagaagagatgctggagagcgggaagccatccatcttcacttccgacattatatcagattcacaaattactagacaagctctcaatgaaatcgagtcacgtcacaaggacatcatgaagctggagaccagcatccgagagttgcatgagatgttcatggacatggctatgtttgtggagactcagggtgaaatgatcaacaacatagaaagaaatgttatgaatgccacagactatgtagaacacgctaaagaagaaacaaaaaaagctatcaaatatcagagcaaggcaagaagggtgagtttggcttcgaagaattaagctgcgtttttctcttcatttggtttcaagttgtaatacattgatgtaagcctgcctaaaaggtattccaagaaataattaattaataaatgttttattttaaaatggaaa

SEQ ID NO: 271500 - DNA, 1226 bp, Homo sapiens
atgcgcagagcgcgcggggcgcggttgccgtggcagcgccggctccagggagggctgctggcgccgggccgggaccgcggggcctgaggcggagaccggagagcccgcggcccggccggaggcagctcgggacaggcttgagcggcggggcgcgctgcccggccggcggggatgcgggaccggctgccagacctgacggcgtgtaggaagaatgatgatggagacacagttgttgtggttgagaaagatcatttcatggatgatttcttccatcaggtggaggagattagaaacagtattgataaaataactcaatatgttgaagaagtaaagaaaaaccacagcatcattctttctgcaccaaacccggaaggaaaaataaaagaagagcttgaagatctgaacaaagaaatcaagaaaactgcgaataaaattcgagccaagttaaagggtttcagatgtgtgcagaagcagagagaggcgaccacaagccgaccccccagctccacagttctccatgagctcccacccgcacccgctcccagactattctgaagcccatcccaggcatctgagatttcatcactattgaacaaagttttgatcaggatgagagtgggaaccggacttcagtggatcttcggatacgaagaacccagcattcggtgctgtctcggaagtttgtggaagccatggcggagtacaatgaggcacagactctgtttcgggagcggagcaaaggccgcatccagcgccagctggagataactgggagaaccaccacagacgacgagctagaagagatgctggagagcgggaagccatccatcttcacttccgacattatatcagattcacaaattactagacaagctctcaatgaaatcgagtcacgtcacaaggacatcatgaagctggagaccagcatccgagagttgcatgagatgttcatggacatggctatgtttgtggagactcagggtgaaatgatcaacaacatagaaagaaatgttatgaatgccacagactatgtagaacacgctaaagaagaaacaaaaaaagctatcaaatatcagagcaaggcaagaagggtgagtttggcttcgaagaattaagctgcgtttttctcttcatttggtttcaagttgtaatacattgatgtaagcctgcctaaaaggtattccaagaaataattaattaataaatgttttattttaaaatggaaa

SEQ ID NO: 271501 - DNA, 812 bp, Homo sapiens
cacagcttcctctgcggaacttcatcgcgggttccccaggactgcccaggcctccccaggactgcacaggcctcccctgggccggcggagccgctctcaccttccacacttcgccgccctcctgcgctcaggcagcattctggacacgggatgtacaagcttctcctgtacctgcagtttctcacgataatcagctcacaatagtccttatgccaaagaggcatgtgtggaggtgccatattctggtctcctacaacattcagtaatggtcaagatggttgatgcaggaaacagatggaggggcagaagttgatactcatctcattagatccaaagaagccaaatggtggccatcacctgtgacatgaagagggtatattttatggaactggacagctttcagaatcacaagcaacctcttcaaaatgtgatctactgaaacgtgcttgaaagagagaataggagtgaggcgggcaaaggaagcagaagccattgtgaactgccctagagaaaccttgggcatctttttgttgggcaaagtggtagaggctgaaacggggaatagcatgtaacattttatttgactgaaataaacagctgtttgttttttttttctttcatatgtaagatagacaaaaggtgtttgacagataaggattggggcaatgttggtatgagttcagctttttagtttgttctttaaaagtggccatcaagatgtgggtgtaaggtatttcacagtgatttgcattcattctcattgctgtcaccatcaaggcccagttactcaatatccaagtttgtttttgttg

SEQ ID NO: 271502 - DNA, 515 bp, Homo sapiens
caattttattccaaaagcatatcattttgtttttattcccactgacaagcacatacgtctttaaaaaaaaaaaagtgactattggtcaaagttacatttttcccacacatttttcaacttttgggattgtatattccaggctggatatgggcactaaccaggcgcttcctgatggatgggcttggctgttttctccatggtttcttggctcaaatttttgccaacttacatatttttgcttagttttgacatcttctttccatcaaaccagatgtttctgtttctttgcaatgtcagtttttccccatcaaaagcatgaaatttgaccaattatttactgatagttattgaaagatgaagttattgaaagatggcaagttacaagtttcaaaatccatctctggttcattcgtttgaaataattgactatatgatatggtagatatcaattatatgataaacctttcaggggttttttaaatgttaaaaataaagtgataatgctggccttagca

SEQ ID NO: 271503 - DNA, 513 bp, Homo sapiens
cttaagtttatagctcatattgtatagtttaaaaattaaattaaatacaagcaaaacttacaaaatcagtaaaattcaaatttatgacgttaatttaatgtaaaagatttttttcctgaaatgaagatgctgattgcaagatgaatttacagctaactactactgtataggttcttttgagtttggcatgcccatactgccatgtgctttgtgataacttagttctcctaccacttttctctatttgaacttcttcaaaatatcccttcaggcaatactgtctagtatcatttgaccttcacttggtgtaatcagttatttattgttaatcttgcctctgttttcattagttgtgtctgccacttgataccaatttaacagtttggggctctgaattgtcacagcattctgtatttaattataaggtgatggtcagccatgtgatctatattatgtttatgttaattattttttaggttatcatctagagggaaccacaaaattaaaaaaaaa

SEQ ID NO: 271504 - DNA, 453 bp, Homo sapiens
caaggatatgtgtttgtgccactacattctagcctgggcaacagagcaagactgtctctaaaataaaattaaaaaaaaaattaaagcttgagttcttgcatttctaaatacataaatttaaaatatgcgaaatacacttatttttaaaaatgggggtcagcgcggtggctcatgcctgtaatcccagcactttgggaggctgaggtggatggatcacctgaggtcaggagtttgagaccatcctggtcaacatggtgaaagcctgtttctaataaaactacaacaattagctgggtgtggtggcacacacctgtagtcctacgtactcgggaggctgaggcaggagaattgcttgaacctgggaagcagaggttgcagtgagcctccctcactccaggttgagattgtgctactgcacttcagcctgggtgacagaacaagactttgtctgga

SEQ ID NO: 271505 - DNA, 993 bp, Homo sapiens
tgggtgaggcttgcttcatggagagttcatcctcctgcacttctgggctgcagctaccagctcttccagcacctgcttgagaagccatatcccactcccagaagcgtgcgatctcatccaagcccaggtgcagcaacagcgccacagacgcctgaccaccagctgctcagcatcaactggaggaacctcctggtcctgcccaggaatctgtcagccacgggggcagctgaggcagagcaaatggccaagggttcagggtcaagtaaggctgagagaacctgcggttgaacttacgacctgaccaatgagcggtccttctctgttgtctgagctcattatgctccattgcaccccagagccttggctcacgtgacaccttattgcttcttcctcagatagtaaaatgggtccccaacacctcacttgccctctttccacaacgtctttcctgaggtttttgttctgattttcttctttggctagcagccaaggttgtctgtttttgaagtaggaatcacagatacattatccctaaattttccatgtacctttatttttgatggaaagattagcctagaataacattcttgagtcacatttattttcctctaatgtgtgtatatattgttctacttgaaatctggtattgagtgttcccctattttggttttactttctcaaaccttctctcatcatttggctgaatttagcccctaattagtcttatttcatgtttgtaaaagagatttttggttttctattccttgagattttcatttttgtgagtgtctgtttttttttattcttggatgagtataacatgctcaattcacattttctttttctcagaatattgcataaccatgtttcacagatttatacagctgcagagtatcctgagaccatgtgattttttttcatttttagttttttttttcctcctcaatacctaaataattatttctgtattcttggaatttaaaaacttacctg

SEQ ID NO: 271506 - DNA, 372 bp, Homo sapiens
tgagcaaaatattctcctttctctccctgtaaggggaatttgaaaatcggatttactggttaaattaacagaatgtgcattctcagttcagccccacccctgggactagtcacttacttaaaaatacatattaaaaatacagtgaatcatctccactatgtaaaaacaacaaaacgtgcatgcacctagccatggggcaaaacccataacaaaaacccccaccctggtcattggcctgtggcagggccttatggggtctcaatttccttctttgtgttcatgtatttcccacctatttcacagtgaactgattccttttaaggtaaagagaaaagataacattttaaaataaaagaataaggtatcaatatc

SEQ ID NO: 271507 - DNA, 432 bp, Homo sapiens
ggccatttagttacgtaagatgtacttctgtgaggaaaccgttccgatgctgtttttcaaacttcattcttgagatttcctggaaagtcactggagaatgtggtgtgcagaagattaggatgagtttcaccagttatagtgagctcttatggtataccagatggtggctttagcaaatcacctatttcttttagatctgctacctcctttgcaaagtgggtatcatgaccagttccttatatgctaggtcttgacagggaggtcttgctactgaatgacttcccagttaggtgtggtggctcaggcctgtagtcccagctacacaggaggctgaggtgcgaggacggtttgagccgaggagtttgaggctgcaatgagccctgattgtgtcactgcactccagcctgggtgacagagcaagacctcgtctca

SEQ ID NO: 271508 - DNA, 580 bp, Homo sapiens
cctgacctcgtgatccgcctgcctcagcctcccaaagtgctgggattacaggcatgagccaccaggccctaggtttctatactttgaaaagcagaacaacgtttcctcttcagcagtgatgcaaataggaagaaaatgttgaattagtttcatatccgggtattttcttgattttattttgtgtttattaatgaagaaacatatttggaaaatagaaataagttctatacaaaattaaacatcttgttttaggcagtcattttaaaactacactccaaatatctgactacaattcagcaggtctgtcatgatatttggagtgtcattagagtatctttctgttttttttttttttttgtaacttaaaacacaagagaggagatgagacatggatttaaacttcattgtttgttaaaaaaaacagaacagaccaggtgtggtggctcatgcctgtgatgccagcattttgggaggctgaggcaggaggattgcttgcgcccgggagtttgagaccagcctgggaagcatagtgagatcctgtctataaaaataaataaataaatgaaaccaaacaaaaaat

SEQ ID NO: 271509 - DNA, 420 bp, Homo sapiens
tgaaatctctctttcccatttctaggtttgtcaaggaggacagaaactcagagcaccctgcacttggggatcggcactaggagctgctctctggatggggagatgggagctagcagctcacaatggggtcacaagatgcatggtgaatatttgatgttttagaacaaaaatgtatttacaaatctcatttgatgcagacatctgaaaatactcagaagttacaagaattcataaaatacccaccaaagctaatagaaaacatggaaccttccaggacaagaagtaaattaaaagaacaacccagaggagtaatcaaagtgagaagccagtgccgcctccaggtactggatgatcacagggacctcaggctttggggattattcaactaccttcttggaataaacaacaaaaaaagtaaaa

SEQ ID NO: 271510 - DNA, 370 bp, Homo sapiens
tgaaatctctctttcccatttctaggtttgtcaaggaggacagaaactcagagcaccctgcacttggggatcggcactaggagctgctctctggatggggagatgggagctagcagctcacaatggggtcacaaggacccttgtgattatattaagctcaccctagtaatccaggataacctccctgctttaaagttaagtgactataacctttattctatctgcaatgttatttcccattgctgcatgacctaatatatctgcagtctggggattaggatgtggacaccgttggaaaagcattagtctgtttatcaccgatcttattcactatttttattaaatattattctggccatcttctaattta

SEQ ID NO: 271511 - DNA, 282 bp, Homo sapiens
ttcatttctcaactcgtcttcagataaagcaaaggacggcataagacagacaatagagggaaggagtttaagttgttattggtgcatacaacacaatgaagaatcaaagccatgcctccactgatcactctatcagagtgtggttagaagctgcatgcctacttcagatcactacaagagttcctgttgtcctatcaactgctgatgattttaacattaagtttttccaattgtagtcccgcatgacaaataccgcatgactggcatccaaagtttcctgtt

SEQ ID NO: 271512 - DNA, 762 bp, Homo sapiens
acttcagttgtcttttctagcgacttagtttaggggaagggaattttccccaccatatcagacttctccaggcaggccttcatctcatgaagacttttttctcttttatttggacgttctgatatccggattccttttggtcctgtcaacacagatgtgtgtgtgtctgtacaaaagatccccatattgatattaaatctccttctaacccgtgcctttgttttaaattgctgcccagacttggaggcaatgtaatctgaagaacgtagtttccttttttagtcccatctgctccatgtgcaaatgtttaaatacatttccaggtttcttttaaaagcacatatcctttgacacaatgcacaacattttatagccctgaaccattgatgccttgtaaaagcgagtctttgcaaggttatgtttatcatttcctaatgtgctgctcgttctctgtaactttgcagctaacactgaccttcctccccctgtttcctctttaattgttttatatctaactctatgcttgaagatgtgctgagagctgccatgggtttctctgtaacactatggatattgctgctaaacgaatgtctcctgttgaggcacagagcatggtaaatgcaacttatggcctcatgtcccttttgggtaaatcctatctggggcaaataagagaaagaaaaatagcaaaaaaaacccatgggccttgggcaccccctagttctcagggtgggtgctgtaccaaggctttcaacaacaaaa

SEQ ID NO: 271513 - DNA, 467 bp, Homo sapiens
tatataattttatgatttttaactacagtgatgggcattcacaaatctttcataaatcaaacatattagtattaggttttacttagtagttatatacgaaagatcgggccgggcacggtggctcatgcttgtactcccaatgtgccgggattacgggcatgagcctccatgtccggccaatcatttgtttttttaaagtggcagccataggtcctgtccgtctggatatattttgaacttttgtatgttaaatataacactaaaaaactttattatgttttaggtaatctaagattggtgtatacaaacaaactttacagattactgtagggttcaggaaatgatgtatataatatgacatttatatctctagtttcttatgtataaatcttcctttagaaaagattggctttttaaaaaatgtctccacaaatttaggcttattttataaaatgtcacaacagtaa

SEQ ID NO: 271514 - DNA, 390 bp, Homo sapiens
tacaacaaaattcaaatatctcctgtttataaaacatactttaaacataaggatagaaaagtttagaaggtcataaaaggatagactaatattttttagaagaatgctaatttatgcaaatattaatcaaatatattttcaggcaaaaagcagctataaagttgataaaaggaagagtttaataaacttcctaatggaagatgcaacaattcaaaatatgtatgtatctaactttatagtcttaaaatatatacagcataagttggcagaatacaaggataaatgaacaaatctatcaacttatacctctcaagaactggcagatcaggcagacaaaaagaagtgaggatatagaaagctaaaatgcatgattaacaagctgtaagacag

SEQ ID NO: 271515 - DNA, 602 bp, Homo sapiens
agagtaatggtctaatttcaccattaacctgtgttaatggttaataacttttttcaggatcttagccggaaatagatgattcactaaagtggggtgactgaacagcatttaatgaagggaatatttaccaaaaaagtaggattaaagaaagccaataggtacggtaaaccaccttgggaagctgcaacacacccaaagggttagaggaggtagtagtcaccgaacgtgacaagttgacctgtagctgaacatttttccatgtctgtataatactactataaagcatgattttaaatagataaccattatataaatacactgtaatttaaccaatctatattattggacatttagatgttttcagtttttcacaatgtacagtcgtgattttgatatggtttccatcctagttttaggatgtcttttaaaaatctgaattaaagcaaaaatactgataaaattttgttagtttaaatattactcataagtttaataaacttgtttccatagatacaacctatgttttatgtacaacatatctctaacctagtcttggaaatcctgtaatttggtggttcctagacagatttcacagaccagta

SEQ ID NO: 271516 - DNA, 404 bp, Homo sapiens
gtccagttgagatgcctggagagaaagggtaaatgaggcagtgagaaggttcttgcttaatttctctggctaaaacttttcagtactggattaaatagaagtggcatccttgtcttgttcctgattttaggggaaaagcttttagtctttcaccatcaagtgtgatgtaagctgtgagattttcatatatacccctttattatgttgaggatattgccttctattcctatttcattgagtattttttaatcaaaaagttatcttgaattttgttaaatgctttttctgcatcagttgggatgatcattgtttttctccttcattctagtaatgtggcatattaccttaattgatttttgttaaaccatccttgcactttgggaataaattccacttgtcatctg

SEQ ID NO: 271517 - DNA, 324 bp, Homo sapiens
gaaaaagatgccagcagccactttcacacttacagaaaacaaacactagactgtttttcagtgtgtgtgctgtggccagattccaaatccaaacaatatcatttaaaaatgctattacaggcctgtaatcctagcacttcgggaggctgaggcaggtggatcacctgaggtcaggaattcgagaccagcctggccaacacggtgaaaccccgcctctagtaaaaatacaaaattagccgagcatggtggcgcacacctgtaattcctaattccagctgctcaggaggctgaggcaggacaattgcttgaacctggaaggtggag

SEQ ID NO: 271518 - DNA, 374 bp, Homo sapiens
caagaacaaaaggacctataaaatacttaccttctcaatgtttgctgtcccctccatgtgggtgtctgggctggccattgggaagccctgggacatttttcctttggtgtgaggatggagggggtcatcaccacagttgaactgactcacttttgaacagcacttcgcactgtacaaaatattctgcattctctcatttgaccctcacagcgatcctgttttcattttaatgataagaactttaagggtcaaaggaattttaggacagactcaagccatttagatggtggaaaacaaagctaaaacacagttcaggttttctgttcccaagggcaatgccatttccatattgtcaggttggaggggagccaaga

SEQ ID NO: 271519 - DNA, 711 bp, Homo sapiens
ctctgaaagggaaggggaactagattcacagtgcttacctaagcaattggcacaatgttactcaaggtgtcatggagaagaataaatatagtgaaagataaaacattttatttcactaatcttaatttattagatgataattctgtaccccaagtttcagtaagaaaacagaatttccttcctcgtgttataaaagcaaaagcaattcatgatattttctctctcgaagcccttcctccctgacagtctttgtctaccacccactaataaattgtacttaaatgttccaacatatgtttctacttcattaacaatttttctctaaattttgttcctttgttccttcacccatcatgtaccatctgtaccatactgatttgtacgtgcattacttagtaaaactaatgcttaagtagtctatctactcaaaagtgtaaggcactggccaggtgcagtggcttacacctgtaatcccagcactttgggaggccaaagcaggcagatcacctgcggtctggagttcaagaccagcctggccaacatggtgaaaccttgtctctactaaaaatacaaaaattagctgggtgtggtggcgcacgcctgtagtcccagctactcgggaggctgaggcaggagaatggcttgaactcaggaggcggaggttgcagccaagatcatgccactgcactctagcctggtcaactctgtccc

SEQ ID NO: 271520 - DNA, 426 bp, Homo sapiens
tatttaagcacccgccgtctacaccgcatcatggttcctccaggcactgcaggaagaaatggccccatgccgggggaaagaaacaccaaaaggacagccgcgagggctgaagacgaccccgaatgacgggatgactgcctgcaacgggtggtcaggagaggagctcccaccctcaccccgcgggtcgtgacactcccagggaagggagggccccgaggggtgcaccaggcccggccttcctggagtccgccacagaccgactggcggcgttaagaggtccgcatcccaggaccgcccgagcgctcctctgccccaaggaggcgaccccgactccggatcccgggaaaacggcgagcgcgggtaccgaacctcggtaagggccggagcgggctgtcaccggcccccgcatccctcccctgcggccgc

SEQ ID NO: 271521 - DNA, 403 bp, Homo sapiens
tcaaaggtggatatgggtggggacacagccaaaccatatcagagcacttagcagaatagcaggcatgcacacaaatattcaatgcaagttatttattaccatggactgattcacagttataagttacaaacaaggacaatgaaaagtgaagagaacacttaatttcattccctatgtatatacttgacgtgaacaatgcaaaacacacagacagaaggcaacttaggtttgaaagggatgtgtgtaaagttttacttaagaaagtatgtaaagactagtaaaaagatgtattgggcccggctgaggcaggagaatggcgtgaatccgggaggcggagcttgcagcgagccgagatagcaccactacactccagagctgggcagcacagtgagaccccatctca

SEQ ID NO: 271522 - DNA, 406 bp, Homo sapiens
caataagattaacactcggttgatttagatgttatgctggtcctcaggcattcatctttagatatttttggggtggaagtggggtagggctgacttagtaaaaataacctcttagcccaaaggctttattcagacttacaccgatttgaggggtgggtttgtggaatgcaaggttaggttcttacctaatatttgatgactaatttagaattttaaatgtaattttaaattttagtgactggtttcaaatctattttaacttctagattgttcaaagaggtctcagtacatggctacaatcaaagtattagactagctatttctcagctcagtgctcagaaaaattattactgttgatacctttttctttgtttcctgttaaataaatcacctctttaaagacaga

SEQ ID NO: 271523 - DNA, 328 bp, Homo sapiens
agctaggagggggtgtccctcactgtctcccacccaccccacacagtcgtgtgcccctgccccacagccccacacgtcgagccataccccctcagctgccactgccaccaggccggtgctgagctgggggtcagtgactcagctaatcccttaggcaggtgccctgcacccccaacgccaccctgtcaccccctcagcagtaaaggcctgaggctcgaggccccagaggagctttggacctgttgggtatcttgaggtgtgggattaacgcactgagattgggcagagataagggtttcaggggacaaaaagaaacatttgtttgaaa

SEQ ID NO: 271524 - DNA, 1059 bp, Homo sapiens
gcggaagtagccgaagcggctggagcgggcggcaaggcgaggcgaaagctgcacagggccctacgcggccgcctcagcatgtcggacttcgacgagttcgagcggcagctcaacgagaataaacaagcctctagccctgcccctctcagggacgaccctggggtcaggcccctcagccctcgagggggaccaggagccagcctcctctgtcttctctggctccccagctcctcctgagcatcctcagagcgggacaaggagaaccggcatcggaagcgcagccacagccgctctcggagccgggaccgcaaacgccggagccggagccgcgaccggcgcaaccgggaccagcggagcgcctcccgggacaggcgacgacgcagcaaacctttgaccagaggcgctaaagaggagcacggtggactgattcgttccccccgccacgagaagaagaagaaggtccgtaaatactgggacgtgccacccccaggctttgagcacatcaccccaatgcagtacaaggccatgcaagctgcgggtcagattccagccactgctcttctccccaccatgaccctgacggtctggctgtgaccccaacgccggtgcccgtggtcgggagccagatgaccagacaagcccggcgcctctacgtgggcaacatcccctttggcatcactgagtgaaatattgtggggctgagatccctcgtagcaacaaaaagtttgctaccatcgtcgaaggcaaaggcatgatggatttcttcaacgcccagatgcgcctgggggggctgacccagcccctggaaccagtgttggctgtgcagattaaccaggacaagaattttgcctttttggaggtcccgtcagggacgagactacccaggtatggctttgatggatcatcttccaggcagtcactaaagatcgaaggctcacgattacagcgctcctggtgtagagaaacctcgctatttgccggggtggggtgcgggggcccgcattgcccacgtctcgggggtccccaccgcgagccagccaaagggacctgggcccgggc

SEQ ID NO: 271525 - DNA, 572 bp, Homo sapiens
gcggaagtagccgaagcggctggagcgggcggcaaggcgaggcgaaagctgcacagggccctacgcggccgcctcagcatgtcggacttcgacgagttcgagcggcagctcaacgagaataaacaagagcgggacaaggagaaccggcatcggaagcgcagccacagccgctctcggagccgggaccgcaaacgccggagccggagccgcgaccggcgcaaccgggaccagcggagcgcctcccgggacaggcgacgacgcagcaaacctttgaccagaggcgctaaagaggagcacggtggactgatgtgagcttctcttcctgccccttcctccctgatgtccactcccttcaccttcctcacgcccgtgcaccctgtcccgcccatttccagccctggcccaagcactgggaagagtccacttaccttgaaaccagcacccctttcccaggccctgccccagaccctctccttccctggagagagtggagcttacctggttgcggggagggtgaaagggtgcctgggagggggctcgcaggcccactgttggtcagactgaggttgccc

SEQ ID NO: 271526 - DNA, 875 bp, Homo sapiens
gcggaagtagccgaagcggctggagcgggcggcaaggcgaggcgaaagctgcacagggccctacgcggccgcctcagcatgtcggacttcgacgagttcgagcggcagctcaacgagaataaacaagagcgggacaaggagaaccggcatcggaagcgcagccacagccgctctcggagccgggaccgcaaacgccggagccggagccgcgaccggcgcaaccgggaccagcggagcgcctcccgggacaggcgacgacgcagcaaacctttgaccagaggcgctaaagaggagcacggtggactgattcgttccccccgccacgagaagaagaagaaggtccgtaaatactgggacgtgccacccccaggctttgagcacatcaccccaatgcagtacaaggccatgcaagctgcgggtcagattccagccactgctcttctccccaccatgaccctgacggtctggctgtgaccccaacgccggtgcccgtggtcgggagccagatgaccagacaagcccggcgcctctacgtgggcaacatcccctttggcatcactgagaggcatgatggatttcttcaacgcccagatgcgcctgggggggctgacccagcccctggaaccagtgttggctgtgcagattaaccaggacaagaattttgcctttttggaggtcccgtcagggacgagactacccaggtatggctttgatggatcatcttccaggcagtcactaaagatcgaaggctcacgattacagcgctcctggtgtagagaaacctcgctatttgccggggtggggtgcgggggcccgcattgcccacgtctcgggggtccccaccgcgagccagccaaagggacctgggcccgggc

SEQ ID NO: 271527 - DNA, 676 bp, Homo sapiens
  misc_feature (3)..(3): n is a, c, g, or t
  misc_feature (7)..(7): n is a, c, g, or t
  misc_feature (26)..(26): n is a, c, g, or t
  misc_feature (30)..(30): n is a, c, g, or t
  misc_feature (44)..(44): n is a, c, g, or t
  misc_feature (93)..(93): n is a, c, g, or t
ccntttncatcaaccgattgccagcnggancggcattttttaangtgacttgccccggagaaagcttttccccagatttaaaaggattttccnttgcagttggaagggaggtcctggccagtgaagccatccttaatgttcctgataagtctgactggaggcagtgtcagatcagcaaggaagacgaggagaccctggctcgccgcttccggaaagactttgagccctatgactttactctggatgactaaaacaaagggaagaactttttatgaactccacaggaagtagtaaagcttttttttttttttaattaaaagaattttttttgagacaaagtctcgctctgtcacccaagcaggattgcagtggcataactgtggctcactgtagcctcaacctcctgggctctagagttcctcccacctcagctactcaggaggctgaggcaggagaattgcttgagcctgggaggtggaggttgcagtgagccaagatcgctccattgcactccagcctgggtgacagtgaaactccatctcaaaaataaaagaataaaagtatgtctgtcatccagctcctatgtctgttatccagctccaagtacagcttgtgtatatcaacattttcaaaaacctttaaactaccaaatgaaatccagatgtttttccatggt

SEQ ID NO: 271528 - DNA, 557 bp, Homo sapiens
  misc_feature (3)..(3): n is a, c, g, or t
  misc_feature (7)..(7): n is a, c, g, or t
  misc_feature (26)..(26): n is a, c, g, or t
  misc_feature (30)..(30): n is a, c, g, or t
  misc_feature (44)..(44): n is a, c, g, or t
  misc_feature (93)..(93): n is a, c, g, or t
ccntttncatcaaccgattgccagcnggancggcattttttaangtgacttgccccggagaaagcttttccccagatttaaaaggattttccnttgcagttggaagggaggtcctggccagtgaagccatccttaatgttcctgataagtctgactggaggcagtgtcagatcagcaaggaagacgaggagaccctggctcgccgcttccggaaagactttgagccctatgactttactctggatgactaaaacaaagggaagaactttttatgaactccacaggaagtagtaaagcttttttttttttttaattaaaagaattttttttgagacaaagtctcgctctgtcacccaagcaggattgcatgagccaagatcgctccattgcactccagcctgggtgacagtgaaactccatctcaaaaataaaagaataaaagtatgtctgtcatccagctcctatgtctgttatccagctccaagtacagcttgtgtatatcaacattttcaaaaacctttaaactaccaaatgaaatccagatgtttttccatggt

SEQ ID NO: 271529 - DNA, 798 bp, Homo sapiens
tgcatagggcccaaccgagaggagatcaaggtctctccaccaacacccgtgaaccctgtccaaagcttttctacacacttgaaaagtaatcacagtaaaacgttagcaacaatatgatttccatcctggattactgatattgcagaaagaagatagttatacaagggtggcactgaacacacaagaaacaaatgattcacggtagcattagaggcaccagcaaaggacacacttttagagaaaggaatctgctcccctgtggctctccaaatcacactccttaggcaccacatctacagggaagacccaggtagagactgtgaggatctcaatggcctggtgggccacaagatcacttctgcttccggctggaatgctccttctccacagagtccggaaactgacatatgcagccacccacccagaaggacatgtccaagaaggaatggaaagaaaaatgatggcccagatgttctgtagcttgcagtgactgccaattcaccacagaccccagtacctgggagggcaaggcagcatcaggctcttgcttcctggtttcaggcagccagggccctgatggtgggtggcaactctgacagaatgcagactggccaggggagaaacctttagaagggcactggctgacgggacttgggggttgaacacacagcgctgatttatcacttccttactcataaaaatgtgattcgaactgctaaaaaaaaaaataggacgagcggcggcacaacaagacccacaaacggaccacagcacgaggagagaccaacaacaacaggg

SEQ ID NO: 271530 - DNA, 272 bp, Homo sapiens
tgcccttaaagcatcagatttagaaaagtgtatgttgggcgaagggagttttctatttagatattctaagtagaagagtcatagacagaacaaaaacagaactcagcagtaattttgtccaaccactggctccgccactgatttcctactggccctcaggcaagttcctccccatctctcagtctatgaagtgaacagttggactaactgattattaaggactctgtcaactctgatattctgaaagtgaataaaagaaattaacttatcca

SEQ ID NO: 271531 - DNA, 302 bp, Homo sapiens
tgcttaaaaaaaaaaaaacttctctgtccctcaaggtccaattcaaccactgacctttcccaagggatcttccctgacaaacaaggtctacaggaatctatcttcctctcctgtgtctttcgcctggcccttgtcacacagtgcaagttctcttcactttctagactgaaggaacatgaggacttgggcctcagtgtcccatctgtcaaatgaggattataatcctctgcctcctttctgctgaatgaggtgttttaaagttcccgtaacatgcttaataaatcacagcatatgtatacatt

SEQ ID NO: 271532 - DNA, 1134 bp, Homo sapiens
tggacagagtcttgctctgtcgcccaggctggagtgcagtggcatgatcttggctcactgaaatctctgcctcctgggttcaagtgattctccagcctcagcctcccgagtagctgggattacaggtgtgcgtcaccacacccgactaattttcatatttttagtagagacagggtttcaccaggttggccaggctggtctcacactcctgacctcatgatcctctttgcattattcttttagtaattactctagggcagtatttctcaaagtgcggtccccaaaccatctgcatcagtatcacctaataacttattagaaatgtaaattctttttgtttgttttggttaatttttatgcttttttgaggcaggttcttgttctgtcacccaggctgtagtgaagtgacacaagcacagctcactataaccttgaattcctgggctcaagtgatcctcccacctcagcctcccaaacagctaggactataggtgtgcatcaccacacccagctgatttttattttttatagagacagggtcttgctatgttgcccaggttggtcttgagctcctggcctcaagcaatcctcctgctctggcctcccaaagtgctgggattacagacatgaaccatagtacctcgcctagaaatgtaaatttgggagcttgatcacaagcctactggatcagaaactctggcaagggctgcatgtggtggctcacgcctgtaatctcagcactttgggaggccaaggtgggaggactgcctgacctcaggagttcaaaaccagcctgagcaacatggtgagaccctgtaccttaaaaaacaaaaaacaaacaaacaaaaaaaacacctctgggagtggggaccagtaatatgtgttttaacaagctgtccaggtcactgtgatgcacactaaagttgtgagccagtgcctctagggattatatttttaaaattataacaagctagttcaaattaatacttattcccagtaaaatataagatccttgtcctagcacagctccattccctcccccttctttatgttcctgttatcacatatattccacctatgttataaacttaatgatagtcataaattctgcttcacatacctccatcttttaaa

SEQ ID NO: 271533 - DNA, 813 bp, Homo sapiens
tggacagagtcttgctctgtcgcccaggctggagtgcagtggcatgatcttggctcactgaaatctctgcctcctgggttcaagtgattctccagcctcagcctcccgagtagctgggattacaggtgtgcgtcaccacacccgactaattttcatatttttagtagagacagggtttcaccaggttggccaggctggtctcacactcctgacctcatgatcctctttgcattattcttttagtaattactctagggcagtatttctcaaagtgcggtccccaaaccatctgcatcagtatcacctaataacttattagaaatgtaaattctttttgtttgttttggttaatttttatgcttttttgaggcaggttcttgttctgtcacccaggctgtagtgaagtgacacaagcacagctcactataaccttgaattcctgggctcaagtgatcctcccacctcagcctcccaaacagctaggactataggtgtgcatcaccacacccagctgatttttattttttatagagacagggtcttgctatgttgcccaggttggtcttgagctcctggcctcaagcaatcctcctgctctggcctcccaaagtgctgggattacagacatgtgccacgatgcctggctaatttttgtctttttagtagagaccaggctggtcttgaactcctcgtctctgcctgccttggcttcccaaagtgctgggattacagtgtgagccatctgtggccagccaaattgtgcttgttttcttattgagttttgagtgtgattctgcccgggatcctctagac

SEQ ID NO: 271534 - DNA, 453 bp, Homo sapiens
tgtcttatttgggattcctcacagcatgggctttaaggctgagaatatcactttaaaaaagcagaagtacaaggcatttttgtgatctaacctcaaaaatcacatgtctggatttctgtcattctccatcgacagagttgtcacagatcctgagcatacactcaggatcaagggaaatagacatggttaaaggcagattatcgttggaaaatagaatctgtcacaagactctgggcttttattttggattctgaaatggctgaaacatggaaatcagacatcacaaggactgaagcccagtttcaaatcagctgagtctcataatgcattaagatgccatgttccttctacaatattcttctcacagcaaagaaaatttctctctggaagaaaatattatcatccataactttctgtatgctctgcagttaatacacagtgtatgacattaaa

SEQ ID NO: 271535 - DNA, 473 bp, Homo sapiens
cattacttgatagttggttgtcctgggcaggaaaggttgcaagccaggttgttagggcctttgctatgtctcttccccaggctgttaggggaagtactgcagtgggccagttgctggaataaagtgaccgcacaggactatacctaaagccagatggttttagtaacagtgaattgaattaaatcaattggaaaagattggtagctgctgtccttatcctgcaggtctgctttaaagaagagtctggcagggagccagggacctgttcctaggaaaggcaggcaagatgctgctggagaggaacaatatgcgttcctctctgagaccatttcctttgaaacatgttctggggcaggagcttgattggctgccaaggcacatgtgagttgggaagcaccatgtcagacatgcaaaccagggagcccctgggccgtgtttattatacgtgttctgactggcccttgttgtttaaa

SEQ ID NO: 271536 - DNA, 264 bp, Homo sapiens
cacgaggagacaattccacgattcatcaaagccagaggaaagtactttggaatacattgccaattgaagtcccaaacacttccaaccatggggacttttaaatctaaactcagagctctgctgtttcatgtggcaatttcttcttttccacccaccctcgacaaactgtcttgttccagcaatggactttttttgaagaagcctttcttattccttatcagagcatcattctgacagtttctgctctttcatttggttggttgg

SEQ ID NO: 271537 - DNA, 198 bp, Homo sapiens
cattaggagatatacctaatgttaaataacgagttaatgggtgcagcacaccaacatggcacatgtatacatatgtaactaaactgcacattgtgcacatgtaccctaaaacttaaagtataataaaaaaaaatcatacctagatatatcacaataaaacttgacctcagagtttctagctctcaagaccaattcctc

SEQ ID NO: 271538 - DNA, 565 bp, Homo sapiens
tccttaggactgtaatccatagacaatttacactaccaatcaggacctcttcaacaccaaataaaacaaattctcaaccatttattggtatgtaacttatctgaacatactttcaaattgttcttattcattgccactaataaaaggtagaatttgttatattcttaccttatattttggctatgaaataagaggtgccctgcttcatcaagctcctgtgtaggtggatgtcattggaagtcttatggcacaatggtcagaaaagtcagtttagtccattgaatcttcaagttgcagatgaaaacaaatacaccttagtgagcttgagaatttagttgctcaatggccaaagagctagtaaacattggagctgggatgcagctttggggctttctgacttagaaggccataccttaactcactgtctagataggtgactgttaggggaaagctaaactctttcctctttaaaacctgtaaaataatttctcaactatttattggcatctactttatctcaatgtattttcagttacagccatccctcactattggttttaggacc

SEQ ID NO: 271539 - DNA, 467 bp, Homo sapiens
agactctgtctcaaaaaaaaaaaaaggagaaaatctgaggaagctcagaatattttagcttattgaatagtagttctaacatacagataagaaatgtcatttactgtgtactgtgtactggctaccaggttaactcagagcacgtttacaatgagggaacaagggcattgggaagagcatcattttaacagctgctaaatgatggagagaatgctcatgggagcatttcctctagaaacatatccattaagattcctgcaaacatacacacaagttttatatagagcattctttgggaatgctcttaacttcagtagagttgacctattagaattaagtcatatgatgtagtcttttagctgagagatgggaattttttaaacatggatgataaatgattcctataagcttataattcatgttcttgcaaaaagaaaaaggatttccattttattttctgcatgaac

SEQ ID NO: 271540 - DNA, 566 bp, Homo sapiens
ccttacctattgagtgtagagtttttctacattcttagccgccttcttttattcttttaatacttctgttaaccttattctcttataactatttatttcttttggtgaccattacctggatttcccataagcaactcacaatcaatatattcaaaatctaattaattatcttcttttccaaactaattctgtcttttatttttttctgttaattatattgctaccctgtggttattcaagcaagaatattgaatatatgctcattgtttttaaaagaggtaagaaagaatatagctttattctgctcccagaggtaactactgttaatagtctgatacatatctgtccaggtccaggtttttctgtctctgtgccttgttagaccccgcttccctcccttctcttttgaattttaatgttatcataccatactttgtgttctaatgtgttacttcactttagactatgtcttggaagtctttacatgttaatatgtctatagattctgtggtgtatatgggtgaacgtgtgcatacatttatttaggaatgtaagaatattatcaa

SEQ ID NO: 271541 - DNA, 394 bp, Homo sapiens
ttcttcaaaaatcagatttccaggtatttcatagcttgaacaaatatttgatgagacccctcccctgaaattttataccctagaacttaataaacatgcctggaaattttatgtagatgaaggattggggtttctagaggtcatggcataagtcattctttcctacctggcctttgtacaataccagatacaaaatgaagagtaaagatagaggccagaacgtacctactaatgataaaagtccaagtggaggtctgagtttgagagccaaatgacctgctgattgaattgcagaaccaggccaactttttcaagcactcttcaggtaatataaataagacagtgccatagagcagggatctttatggtttttgttgcaattgtagctactctg

SEQ ID NO: 271542 - DNA, 606 bp, Homo sapiens
ttcttcaaaaatcagatttccaggtatttcatagcttgaacaaatatttgatgagacccctcccctgaaattttataccctagaacttaataaacatgcctggaaattttatgtagatgaaggattggggtttctagaggtcatggcataagtcattctttcctacctggcctttgtacaataccagatacaaaatgaagagtaaagatagaggccagaacgtacctactaatgataaaagtccaagtggaggtctgagtttgagagccaaatgacctgctgattgaattgcagaaccaggccaactttttcaagcactcttcagtctaggttagaagaggcaaaaattgaagacctacatttgtactgttcaacaaagtagccatgggccaaagtggctgttgagcacttgaaaggtaaaaattggctcatgaagacttttatttaaggagtattgccaaagatagtttcttgaagcatgtacatttatttttactgaaaactgcctttttctggtttaaagctgctctttgaaaattcataaaatgtttatatttttatggtactgtacatttgtgtgtatcatttataaaaattcagaagaat

SEQ ID NO: 271543 - DNA, 449 bp, Homo sapiens
attgttttgaaatttaaatgaggtagtacatgcagcacaatcccgggcatgtaataaacattcagtaagttattattagtattagtattattagacttaagctccttgatgacatgatagcatatcatcattttatcatcctcaccatctcttgcacagggtgtggcactagcgagagcttaacatgcatttgataaatgaaaaaaagaaaggataaacgaaggaaggaccaaacaagtctcatatttttcagagaaaagggggacccaggttaagcaaggggacttggggtgctgtacaggcaggtcaggtgtattttggcccagaagggctgctggtgcacccgtgccaccttcgccctccacacccccagcaccccaccttgcaggcctgcagctgggaggcagcctgcaggcaggacatcttggctggaccttggacttgatacc

SEQ ID NO: 271544 - DNA, 524 bp, Homo sapiens
tctctgcattcctacaaacacttatccgtccttttgattatagccattctagtgtgtatctcatgattttaatttgcattttataatgactgacgatgctagatatcttttaatgtgcttattaggaatttataacgcttctttgatgtaatatatatttgtatctttttgaattaatctcttttttcaaattgagacagggtctcactgtgttacccaggctggtcttgaaccccttgggctcaggcagtcctcccacgttggcttcccgaagtgctgggattacagttatgagtcactgtgcctggccatctgtatcatttatccattttaaaatcaagttgtctttttattgttgagttgttatatattctggatacaagtacttaatgagaaatatgatttgcaaatattttctccatatttgtggcttttcttttttttcttaatggtataagaaaattttgaagtataaaagttcttaattttaataaattccaatttatgttttttctgttagcaat

SEQ ID NO: 271545 - DNA, 476 bp, Homo sapiens
gatgtactttatctatcagtggcatcatgagacctgacgacagtcactgaagtcactgtatactttttttcacctcttcctgcctcttcccttacccatctcccctgccccggtaactaacagattccttccagtcaaggagctgattattatatttttccctttacttttttggggcactgctaaagatgtatctgaagcagggcatggaggtatgcacctatagtcccagctactcgggaggccaaggcgggaggatcctaggaattcaagactagcctgggcaacatagcaagatccccatctatgcaaaaaattttaaaaaattagccgagcctggtggcatacacctgtagtcctggctactcgggaggctgaggcgggaggatggctggagcccaggagtttgaggctgcagtgagctatggttgaatcactgcactccagcctgggcaacagagagagaccctgtctgt

SEQ ID NO: 271546 - DNA, 668 bp, Homo sapiens
tcctccaaacagggaaaaacatcataggaaagcttttcataaactcacaactgctgggacatggagagttgaggcacatgagacagctttggggaaaacatgcggaaataggaaacgctgtgttatcttaacaactcagtttgtcagccaggtttgtcttgttccgcacccgcagtccttgaggtatttcaagcatttggtcattctacccttgatggccttcaggaagtgcacagatgccagccgttgtatcacaaatgctaagggacctcactccaaggccaccacttggaaggttaaaatgaggatattttctatcagtcatagcaggaagagaaagtggaaaaactcgacgtttgtgataaaggacagggacctccttttgtgcatgggaaattgaatccttgggtagcttgttggttacagtgtaactctagacttctgatggaccacctcatttgtggttgtcatactgacgatcagttttactaagtggcatactccagttttttatttaatgcagtctgctggggagtactttcttagttatctattgtgttctcagaactttgttcctctaagatttgtaggacatggcaaataaaagataccaccctttgaggaatttggttaggaaggaagacgtgagtttaggagacacatgtaga

SEQ ID NO: 271547 - DNA, 595 bp, Homo sapiens
atatgctttatctggttctaccctctcaacaactctatgaggtagataagacagacattcttatcccaaattccagaaaggagttactgattgcactctgagcccatggcaagataagcccccagtcccctgtgttcccaagtctaatgctcatgcctctggataagtatttaccaggtgatcctctgctcagatccagaatgctgggctgggctcacgtactcacgctgcaaattggagaacctcaggagaatctggccagcctaagaaagacgactcaggtgctgacatttgagttccctggtgaaacatctgggcccctcccctgcccccagttcacttaccactggaggactgggagaacacttttcgctctcactggcccactggtcagtgagtgcccacctctctctctctctcacacactcacacagacacacacgcatatgacttccaatcaactctctaatgctcctctggatagctaagcatcaccagacatttgaagaaaccctccaacatgaaaaacagagaccatgataaacaggaaataaaggaactcaatggaaacagacacaatataagaagtagaagg

SEQ ID NO: 271548 - DNA, 280 bp, Homo sapiens
aagccagattcaaaggccagtgtgctgtatgatgccattggcgtgacattctggagcaaaactatagggacccaaaacacatcagtggtggcagaggctgccagtaggacgaggggtcgactcaagggagcacagaggaatttgggagtgatcagctgttgcacaccttgacggtgctgctaggcacatgggcgtatgaattcaccaaagttcatagagaatgaaaaagggtgactctcactgcatgtgaattgtaccttaataaacctgatgttcaaga

SEQ ID NO: 271549 - DNA, 366 bp, Homo sapiens
aatgtaagcacagacaattctctctccaccctcaaccctttacacaatttctgagaacagcgattttcaacgaaggggaggaacagaaatgaagttgacaagagaagccatctaaaattaaaactctccatatggaattgctttttcttttcctccagagagtgtactcactctaagtcagctctgtctttgaacattttcttacaggatagtcattggaggctctgataactcctagcttctattattgtccagcttgtatcttttaaatgtcaaaactatgttcttccaaatgacaaatttttatttttaaaatatttttactaactttacttgtatgttgaacagataatagtacaaaattca

SEQ ID NO: 271550 - DNA, 356 bp, Homo sapiens
caataactcttgcagataacattactattgtagaacctaagattggccttttgagatgtcttttcaggtttgtgcatttctgacaaccgggtggccccacctggacccaccagtcagtcctgtggcccctacccaggaactgactcagcacaagaggacagcttcgatttcttatgatttcatctccaactcaaccagttagcatgttccctaccctaccccactgcccagcaaactatatttgaaaaacccctaacctaggagccttcagggagattgatttgagtaataactccgtctcttacactgtgtggccagacttgtgtcaattaaactttctttattgcaatgccatg

SEQ ID NO: 271551 - DNA, 396 bp, Homo sapiens
gctggtatctccaagaatgggcagacctgagattgtgccactgcactccagcctgagaaacagagcatcagcaacatcagcaacaatgaactaattgggactaatgaatgctattctcccctaaagcaacattggcctagagaactgtaatcctaatactatagtagctacctaaagctctcaagtttctggaatgtgcagaggaagtcagaaactgcctaggtataaacaaatggtgtaggggttaactcagtgcatccaaattcccagtttttatacctattctaggtaaacagaaaggaaacttaaagcctccttcctacttctatgaaataatgccaagaaatcatgtaggaaactgcaatgaaccaactattaaaccatattctacaagaa

SEQ ID NO: 271552 - DNA, 423 bp, Homo sapiens
atgttttggatctagacagaggggcattacacaacattgtcaatgtagtaaatgccactaaatttgcacctgaaaatggttaattttttgttgtgtgaatttcatctcaatttttaaaaaagattatatcgttcagtcttttattttgaagatgtgggaacaagtagtgggaggatggtatccaaagcccactcagggtgcaggcaggtccctaacacaccgatcaccctgcccagacttcaacctaatcattcccgcttcgctacatggcctgtgctgtcgtaaggcagtgagctcagggctgaatgtacccagcagagaaaattcatatcctcaaaaactctctccccagaagttttgtgattttgtttgttcatgtattttttcccacaataaggaaataaaaatgtatctagacttaca

SEQ ID NO: 271553 - DNA, 621 bp, Homo sapiens
tcatttctattttctgttttaaaatttttttcctctaaagtccatgtacaattttcataataagaaaagctaatgcatcctatttttaaactaacattgttagaattagggagaagatggttcatttataggaaaggatatcatgtttgcaagaaaatttgtaatggcatgaggaaacataataaagggagaaatctacgaaagtattaataatgcattgacaaaagtatagaagggaatacagaaacatattagtctttcttctggttctgtaatatgataaaaacatttataaagctgggcatgctggtatacacctatagtctcaactacttgggagagtgaggcaggaggatttcttgtgcccaggagtttgagtctagcctgggcaatgcaatgagaccttatctctaaaatataaaacaataaaaatataaaatttaaaaaatttttctgcttttcaatttttctggaaagaaatatatcttaattaaaggaaaagaatttaaaagcaggctgatactcgagcattttgaggtcatatttgatgtgaaatgacattcaaaatttcagggagttaatttttttctagcagcacattgaatgatgctaaaaggaaac

SEQ ID NO: 271554 - DNA, 380 bp, Homo sapiens
tcagttacaagaagcttgactataacctagaattatctgagtgatttttatgattattttgagtaattactgctatacttagaagttacctacagttggggattgtgaaatcaaatatattcataatttttattgtctgctttatttgcaaatggcattaagtttcagtccacaaagataaatacacaaaagatggaaaataatataaagtaaaatagatgagaaaggtataataaggataaaggcataatatgcaatcaggaatatgactaatacatatatgcttgccatttaagtcttctaatttcatgcaaatttggcttgaagttataacttgtttttaaacataaacctttttttgaagcataacaaaaacaaaa

SEQ ID NO: 271555 - DNA, 790 bp, Homo sapiens
tgttcaatgagagtcctgggccaaaggcctgaccctggagcccctttcagcactgactgtccatgaactaggccctacaccagactacaaccaaccttccctcctggggacccttcccttgaccccatttcataaggagggtggattgggagatcctgatggggcaggaattacaagcttgaatctccacttcggaaaacacattcctgttcaaatcaagtctgaaggttttcggtttaaaggcacactcaggagcactgccgggctccccctaaagcagcaggccccactttccaagctgagtcaactggttcaacaccgagaacctgatttatgtacagcatgggcctccaaccctgcccccacccgtgcggggggaggggacaggcttcctggaacaccatttgaataaagaaaaatccttccggtgagaataagtcagtttcctgcgctcatactgctaaaggaccaagcaaggctgtgacaatcacctctatttttaatcttttctaaatgctgttttctgtggccacaagaacagtcatttccaggcgtggggctccactttcacacttcgcttcaaggtgtctggtttttcttagctctgaactactagttttctccgctgcttcctgcaccagaagggtactggggggagccaagactcacttgttgagcgtggctgagaccaccaaggtgtccaggggaaccacagggtccccctttctcagcattaagcgggagggttagactgactgggggaagagagacacaatctcagaccccaggg

SEQ ID NO: 271556 - DNA, 313 bp, Homo sapiens
agtataaacttatcaatatgtattccaacatgaacacaacagaaaccaaactaaagatttaggttgtgttaaaatatgaccagtactgtgggctaaggagcctgttttccagtttttccagagaaactctttgacaaaaatatttgtcaccaatattgccatgagggactcaataggtctcaaacattttggtcttaggatcttgttacaatcttaatttattgatgatctcaaagagcttttgtttatgtgggttatagttatcaatatctgatacatttaatattgataactataacccacataaacagtc

SEQ ID NO: 271557 - DNA, 214 bp, Homo sapiens
ggtgatcagttttttaatgtgcacatttagtaacaccattctgagttctattaatgacctgcagtgagcagtgacaagcaggaatatgacattcagtactgctgaggacctgccaggcagcggctaacacgctcgctttcatctgcagctcgggagacactctatttgcatcctaaataggttacactacagcacccccttctgccgactgagc

SEQ ID NO: 271558 - DNA, 558 bp, Homo sapiens
tgtgtccatggtccctctgttcctgggctccctggagtccattgggaatccgagtcctcgccttcccatcatctgcctctggaatgacccttgggtttgtctttcgctctctctccgttctgccaccttcccggtgctttaatcaggcatcagtcttgtagctgtagccaggacccaccaagccactccattctcttctcagctcccggagtgtgatggttaatattgactgtcagcttgatgaaattgaaggatgcaaagtattgttcctggtgtgactgtgagggtgttgccaaaggagattcacatttgagtcagtgggctgggagaggcagacccaccctcaatctgggtgggcaccatctaatcagctgccagcatggctggaataaaagcaggcagaagaacatggaaagactagactggcttagtcttttggcctccatctttctcccgtggcttccgtgctcctcagcttgcagatgacctgctgtgggacctcatcttgtgatcgtgtgagtcaattctccttaataaactcccctttatacataaatc

SEQ ID NO: 271559 - DNA, 466 bp, Homo sapiens
gatatttaaaaccccaccatgaatcagaaattcttactagaaggaagaattaaaaggaccgactagactcagaaaagaaatggaggaaaaaggcaaaattaccttagaaatgaagacaattacaagatgcccaacagaatagattcaaaggaaaatttaataacagtcataaagacaggagaaatactaagaaaattaaaatgggaaaaagcaaagtaaaaaaggttagcgatagtggtaaaaatggaaggcaggtcagaaaaaatattcatttggtaccccagaagaaaaccaaacaacgaaacagaactaatatttaaaactgtaatccaagaaagcattccagaaacaaaaagagagctgaatctacacattgaaagagactaccaggcaccttagaatattaacacagaacaaacaacttcaagacataacctagtaaaactattagatttcaaagaaaaaa

SEQ ID NO: 271560 - DNA, 182 bp, Homo sapiens
cctaggtgtggagggggaaaacttctttaaaagtacaaaaacacaaaccatgtgggaaaagctggcagatgagagtctgcaaaatataatacctatgatatataaagagcacctacaaatcaacaagcaaaaatacacttaataggaaaatgggcaaaggatagaaatatacaattcataga

SEQ ID NO: 271561 - DNA, 338 bp, Homo sapiens
cgcccgcctcggcctcccaaagtgctgggattacaggcgtgagccaccgcgcccgggctaaataattttaaatctgatttcgagcaagttccgtaagtattttgttgctaatcagacatgaaatgtgtaaatatgtaaatttcgtactgcacttctttttatatttgattcactaagaaactcacaggttgttatagtctcagagtttcatttttattatttaccttaccaaagagctcgttttagtatgacctttacaatgaccttaaacacaagatcaaatgaaaaggaatgtccctgctatagcttaaagtttgaaaaaatatactgatcacacc

SEQ ID NO: 271562 - DNA, 398 bp, Homo sapiens
aatagacagatactggaccgggcttatgcgtgatagtcttttgattgatgttcatgcagtcaggtttctcttgagtaatcctttctttcagttctttctttattacttccttcctttctttttttttttttttgcattttattcaaaacacctacataatttttgttttaaagtttttttgttacacctgatgttcagaagccaaacaacagttagagttgatggggctggggaaggagggtttgcagatttcattcttaagaaagaagagaaggccaggagcggtggcttacacctgtaatcccagcactttgggaggccaaaatgggaggattgcttgcatccaggagttcgagaccaccctgggcaacaaagcgagacccatatctctacagaaa

SEQ ID NO: 271563 - DNA, 496 bp, Homo sapiens
ccaaagagaccccctcaaaatgatggcttccagagcacatgaataaaaatgattgcaatgagtttaaaatacttaacattattttacaaatcattaaatgctgtacaagtcataacccagtggactcacaaattaaacagggctgactgataataaaacaacaaattaagcaacacaggggagtatctgactgttgttcagaaattaaccaactctaacatgtaggagtaattaaaataattccaaaataatggagcttattaatgttggaaactggaagagacagtccaatcgtatttatttaaaatgcttatactttgtacttaaattgtgtattttttcatgtctattgtttcttgtgagcatcattacaacctctttttttacatgttgacatgagtttatttcgtggttttgatcacaaacaaaacatgttcatcatgagttactcaaagaggtataaggagagatataaaattaaaagcaaagttcacag

SEQ ID NO: 271564 - DNA, 562 bp, Homo sapiens
gccaaaaattatgcagataggagcgaaggagctgaaaggacttttaaaggccacggattccaacctctaccatacagaggccttaagtgtttcggtgaggtgcccaaggattcacagggaaggggcaaaatcagaaccccgctctcctgactctgcccactccccggtggctagggtgggcctgtctccttccttacccagctccctccctctcctcggcgcctgtggcactgattagaacagcaccccacaaagacacccatttaaaaaacaaacaaaacccaagtgtattaatagctatagtacttcatatagaatgtactcttaagacttaatatttattgctctaagtggacaccactgattgccaataaagactcatttttccccctaaaaaaaaaaaaaaaaaaaacaaaaaaacaaaaaaaaaaaaaacaaaaagaaacacacagacaacagaaaaaacagaaaaaaaggaacaacaacaagagaggagccagaaaggaacgaggtgagagaccactgatggcaggaacgcacacgaaaaacacatggagcatag

SEQ ID NO: 271565 - DNA, 391 bp, Homo sapiens
actgttgccctggccaacaacttaactgcaacctcaagagatacctaccctgagtcagaaccacccagtcaaactacccctggcatcttaactcagagtaactgccccgttgactggaggatggccatttgacaacacattatttcctgaggaaacttttgacttctggtgacttgggccccaggctggctgaatttgccaagacccggctttgcccttgcatgtgtgaaaaatggcctcaagtatgaccccatggcaagatggaaagaaactgtgctcttgaatagcttagagattcagagccccccaaccagcttgaaacgcccacctcaaaacaatgacatgagaagaaacaaacctctaatttaagccactgtctttttaagagcat

SEQ ID NO: 271566 - DNA, 168 bp, Homo sapiens
gacgcagctggaaacccaatcaggacatcggagaagaaagcagagtgaggtggggtcagaagggggcacgtgggacattcccaggagttggaactgaagaggggtgaaagggagggatgtgggcaaagtcaagctctggaagcagaggctcagggggtaccctgtgtt

SEQ ID NO: 271567 - DNA, 361 bp, Homo sapiens
ttactgattcatatctgcaggattaagaaatgttcaggatttgaatttttaatgaccttccaagcagtcatgtttctactctctagaagttagccagttgaggagaagggacagtcaagatactttcaaaacagtgtggtaaggagtgtgagctaagatggagcaccgaggagggagtcgggcatttaggccgtgctgtcgggcgtggagcctggaagggatcggggaatactttctgcatgtgtcttgaagaatgagtaacattcagactaacagggtggaatgaggggaatcaaaggagaggaggccagtaactacaaggaggtgcttatttatttatttattgagagagagggtctca

SEQ ID NO: 271568 - DNA, 517 bp, Homo sapiens
aatgaaggtgtaaatataatttgaactgaagagaagaaagttgtgttttccctatgaagtacagaataaggctaagctaagaaggctgtcttaaggaaattgtcaaagatttagaaaaacatctgtcaggaataaagaagtaactaaaccataaagagagttgcccagcaatttgaagccttaagtgaaattggtaacagtatgtatttatgattgccaagtaagaaaactcatctggccaggcgcggtggctcaagcctgtaatccctgcactttaggaaaccaaagtgggaggatcacttgaggccaggagtttgagacccacctgggcaacatagtgagagcctgtcttgcaaaaaattaaaaattagctgggcatggtggtgtacacctgtagtcccagctgcttggaacactaaggcaggaggatctcttgagcccaggaatttgaggtcacagtgagtcatgttggcaccactgcactccagcctgggcaatagtgcaagatcctatctct

SEQ ID NO: 271569 - DNA, 503 bp, Homo sapiens
actttgttttctttttgaggcagggtcttgctctgttgccttggctgtagttttgaactttgatgtgaggaaattctcctgcgtggctgctcctgcactgcatggctctgagcatctgctctatgtctatttctgtcctccattctctccttgagacccacccacactgacatggttcattttcattgctgcgtgatctcctgtctccattctctccctgagacccacccacactgacatggtccattttcattgctgcatggtctctcgttgtctgaggggagcatgggaaatgtcttcatcttcccgtggatgagtgtttggccaggttggggccctgaggactgcgttttgctgggaacattcttgggcatttcttttgtccacaagtgcaggttgcttctggtcagtagctttcaagttttaaaatttcatcccaggtaaaaaatgtaattttcctcataacccacaacacacatcctttcatatacaagcataacaaa

SEQ ID NO: 271570 - DNA, 243 bp, Homo sapiens
tacattcatatttatagcagcactggtcaccataaccaaaaggtggaaacaaccaaatgtctatcagtggacgaactgataagcaaaatgggctagatacatacaatgaaacattactaaccaataaaaggaaatgaaattctgatgcatgctacaacatggatgaaccttgcaaacattatgctaaatgaattaagttcacatattgtatggctctaattatataaaatatacagaacaagt

SEQ ID NO: 271571 - DNA, 486 bp, Homo sapiens
atattcctcttttttttttaatcatttcacttgtttccctttccctttttttccttttatacttaattttacaataaagtgtcatcgcccactagaatgtattaagtccatctataaagaagagaaagaaataaggtatgtaaatatcacaaccctacaaatcctgtgtgcttatggacatttcttttcctattctctcagagtaaatggttcttcatttggttaaagttttaatgcatcatttatttatctaccatatgatagtctagaaatcaaagggtatcacatgaaatagataattcaaaatttctgaaacattccttatatgttaaaattttatgtatgtatatctgtacccaatttctatgtgtcctgagtgtgtccaattatattcaagtactaaatgtccgcagaagtccttttcatagttctttcaaatgaaaagaatattgagacttgtgaatgggctttcaacaataatcattg

SEQ ID NO: 271572 - DNA, 363 bp, Homo sapiens
gtgtggaacccaggagctgatggtctcatctgggcccagctgcctctttgcagactttatggccttcacctgggtttgcaggaggcagatagtttctgggtctggataagcaatgggtcctggaacaaaactctagagaccgggggctattcatgacaggctccatttcttattgaacattcagttcaccatcaggtcttgtctagtctacccccagagcatccatttctccatcaccttggccaccactaccatcccctggctcctggctggtacctccatggtcccacctttgggactttgagtatgcaatgtttttgaaagactcagtccctacccattatgggtagaattagctccttc

SEQ ID NO: 271573 - DNA, 386 bp, Homo sapiens
ccaattttggccaatgacaaggaagttctgtttgtgggtatccgggagagaaatgtccagattcctaagaaagagacacaggatgaagtggtcatttcttatgcctgctattacgtctgaatgagacacttgggattgctacagccatttgcagcccttgtgaggacaaagtcatcagcaagaatgaaggatcagacagatggaaagaacttggggccttgggtacaatatttagcccttggatcaacttcccccaaagccattcctacttgacttcttgttaggtgaaaaaagatgtatctttatggttaagttgagttagagttctctcatgtatattgggagttgtcctcacttataaatactcatgctattttctttgtatg

SEQ ID NO: 271574 - DNA, 412 bp, Homo sapiens
gtgtccgtcaacagatgagtagataaatacaagtggtatatgtatacattatagaatattattcagccataaaaaggaatgacgttctgatacatactacaacatggatggaccttgaaaatactaacttaagtgaaacaagccacacacaaaaggacaaacattgatagtgatctaccagtatgaaatgtctagaataactaatagtggcataaagtagattaggggttactgggcctagaggaagaagggtttagaaagttaccatttaatggatacagcatttgtgtttgaggccacggaaaagatttggaaacaaatagtgatagtgatggtggttgcacaacagtgtgaatataattaatgctactcaatcacctagctaaaaatggttcaaatggcagtttgtcac

SEQ ID NO: 271575 - DNA, 421 bp, Homo sapiens
ctggcctgtgtaagcggatgggctcggcctcaaggacagggtgctcggctgaaaaaaaagctagcggcgatcaccggtgccagggctctccagaaacggagcccatctaaccaatgcccagcacactcgctctgctccacacacgagaccacctccgacccgcactaagttggccaactgcactctggaggcggcggcagccagcgagggagaagggaaaggctgtcccgggaccccgaggaggactgccccgcccccgggaaccgggtgcggcgtaaaacaaccccggctccgggccgacccttcctggccccttggaggcccaggcggggcggcggggggcgacgcggcaggggtctccgcgcccaggctcccgcggagcggccacacgtggaggttcccactttggggtcgcggccgc

SEQ ID NO: 271576 - DNA, 467 bp, Homo sapiens
cagagcaagactgtgtctcaaaaaaaaaaaaaaaagagtgctccaaatctcctttggttacccgggactttaaaaaatttaatgtgatagttaggccgggtgtggttgctcacgcctgtaatcctagcacttttggaagctgaggcgggtggatcatttgaggtcaggagttggagaccagcctggccaacatggcgaaaccccgtctctactaaaaatacaaaaattagccaggcgtggtggtgggcgcctgtaatcccagctcctcgggaaattgaggcactagaattgcttgaacccaggaggtggaggttgcagtgagccgagattgcgccactgcactccagcctaggcaacagagcgaggttccatctcaaaaaaaaaaattgtaataataataataacaatgtaatatttactttttcatcctttatataaggctgagtgcttcacccctgagatgaagc

SEQ ID NO: 271577 - DNA, 378 bp, Homo sapiens
cacaccctaagaacacggagggccaccggagcttctcattcagctacatgggagccaagaccttgccaggtggaatcagtcacacattttatttacaggatagcccaaatttatgtgctgattttcattcctgcccttcctgatttggggagtgctgcattcgggcaccctcggagccgttcgaaatgtcaagacggtggcttctgcctcagccagttggaatcggcctgtgtcaattcttcagggagtacatcttttatccactctggaaaattccaaatagtgccctagcattgtctcatgtgagtgaggttctctgagatcatacatcaaggggaagtgtcttatttaagattaaaaaccggaactaaactaaaa

SEQ ID NO: 271578 - DNA, 447 bp, Homo sapiens
tcttagatctcaagtaggcactatagcatctcatcaggaggaataggccaccagaattttttattcccacccctcagtttcatattgcagagaataagcttcagatgaatgaacccaagagatcaagggctctgttcttacatctatcccacactcatataatggaggtcctatccaacaaatagcagatcatcatttctgtactataatgtaaaattatgttagtttctataaaaaagtatactagaatctcaaaagtgtatctgaattgaaagaataaataatcagaaatgcagagacatattgatacagattatggaatccaaaagacaatgaggggaaaaaactaaagaagaataatcagagctttagagaaatttaggacaccattaattaagtgtgtcagtgtatgtacaatgagagtaccagaagagaaagaaaagagca

SEQ ID NO: 271579 - DNA, 465 bp, Homo sapiens
aaaacaaactatattgtgattacagactgtaatggccttcctggaggaagaaaatcagatggaacttataaagaaagataggctaataaatcaatgctttcccaaattgtgtaccacagcatgtgaatttcacaagatcctctgagagaaaagggttccttggctaaaaacgtttgggaaacaccggcgggtgtggtggctcatgcctgtaatcccagcactttgggaggccgaggtgggcggatcacgaagtcaggagatcgagaccatcctggctaatacagtgaaaccccgtctctattaaaaatacaaaaaattagccgggcgtggtggcgggcgcctgtagtcccagctactcggaaggctgaggtaggagaatggcgtgaacctgggaggcagagcttgcagtgagccgagattgcaccacggcactccagcctgggcgacagagaaagactccgtctc

SEQ ID NO: 271580 - DNA, 351 bp, Homo sapiens
ttgtagtagaattctcattctatcttatttttcataatgaatgctttcttttctgtatgatactccctggaccagggctcatttaaaaatgataaattattttaaagtaatgatatttaatcatttttatttaatgaaggaatttggattctttaaatgctgctgtgaattttaattttgcccagattttagggataatgttaatgtaaatatttttgatttaggaaattccattattcttatatatgttcagttggttagtttggggctttattgaagttaagccatctttaaattacctgttctgtggggaaccagtgctgttgaataagcagcatgtctatacttcgt

SEQ ID NO: 271581 - DNA, 1233 bp, Homo sapiens
tttcagtacctaggataatgcttggcttgaattaggcgctttaagacatatatgatgaacacatatgattctatctttaatatctccttatttgtaggtacaagcctacttatttgagaaaccctagtggttgtttaaataaacagactgggagtcctgtgatttgtcttttctcatttttaaggataataaaactcatgaatgagtaagagtatattaattgccattgattcaaatagaaatgtatactcaatttccattatgttttcttttctatctcggggctacttaatacttttgtttttattcaatgatattacctttagagtgccatttttatttccattagtttaatgagtggcctttctatagccctgacattaaaatgttctgtaaatctccaaccacttgagacctcacttctttaagatgatttgcattacatagtaaatatggacatactggcataggtaaaaaagctcttatactggcctaacctgaattttctgagtttttctctctaatgggttgtcggtgactgggattgtgaatacttgtatgtaattaatctcttcgggggtgtcttgccttaagaaaagacagtatttgagatagattcactctgagttgattatccatttctactaaaaggatttataataggagtctcttatatagcaagctgttctataatggagcatttaaggcaatatttcacttttgcacacattttcagggtcactttgattgaagtgaggtgcattattttgtatagcaatattatgcttatgacatatatttgttctgcagccttaaatcataagaagcactttcaaaactttataccctgaagtttgattagaaaattctttgttgccttctagaatttgcttaatgacttcattaataactatgcaacaatatgcagggaacatgaaaaaaagtacatttttcttctgaaaattgcatataattattacaaaataacttttaatctttcatagtcatcttttctgttttagcctctaaaatagtgtttaaaaattgattccccttttcttcatggatttatattcttgcttttttttaaaagaatgaccttaacttacttatatgtaagatttgtcttataataaagttataatagaatttttacaaatgctcatttctttgtctatccctaagacattgtaactaataaatatactttcctcaagtcatgaacagattgca

SEQ ID NO: 271582 - DNA, 429 bp, Homo sapiens
  misc_feature (387)..(387): n is a, c, g, or t
  misc_feature (411)..(411): n is a, c, g, or t
atagcacaacagtagattgtcttggtcctggaatggagccttaattgatgctgtaggacaatttggactacttctccagtatctagcttccacctaggcctcttggaacacccgctctgggagaaccaagcttcatgcaagaagcccagccactctgagactgtcatgctgtgaagaagcaccagctagccacttggagagggtgcattaagaaagagaaaaccctaatgatcagtgaggatgagatttttttcatatatttgttggccacataactgtcttcttttgagaagtgtcatatccttcttttgagaggtgtcatattctttgcccactttttgatggggtggagttttttcttgcttggtaagtccctggagtctgganatagaccttttcgatggtagatgntttctccatctggggtgc

SEQ ID NO: 271583 - DNA, 444 bp, Homo sapiens
taccttttttccccctgataccaggctggctgcacatgcagagttctgccccatccaaacatgtctgaaacatcagttggcacacctcccaagagctctattgcatgagggaatgaggtgccttctgggagagaactcattctgagagactgcgaagcagcagccaccagcttgaaagggaacaactaagagaaactgtgctgcagagaaaacctatatatagatatacaacaagaaaataaactataagattaatacatgcatgtttaatactggaaaaaaatcacagccctccaaagtttctccatatttcaagtcgacagttatttttctctcaaaactttgaggatttaattctactgtttctggtattcattgttactgataactcgtttatatttggtaaaataaaaataagctgcttttcccttgctgcttgcaaaa

SEQ ID NO: 271584 - DNA, 1878 bp, Homo sapiens
  misc_feature (1090)..(1090): n is a, c, g, or t
gtccctagagacagcctggaaagattgggtgccagctgcagagaggagagcaaggcgaccaaacgcaggctgtggctgcctgcagcccatcctgcccccagcacctagagtcatctttagaaatgcaagcctgatcgtggaatccaccttcctaacacccttcagtgccctcctcttcgttacacccttactatacaaacgatagtccatggaccagcagcatcaacataaccagggagcttgttagaaatgtagaatctggtccatcccaaacctgacgaagcagaagctgcattttgccaagatcccagggaatttgtgtgcccgttatggtttgcgaagtgcttcccaagagaacatacggcaagccagagggatctttgcagatcttgctcctttcattctctggcctcatcttgtcgctctcctccatccgtgcccacatccccactgtactggaccgcttgcagctccttgaatgcagcatagtcttgttttcttttttgcagtgattctacatctttcccatcttctccacctggatgcctccatccatcctttcagacttcccttctctagcaaacctttcttgctaattcccatgtctaacacaacacttccccatactgcatggccattatcctttctgcatcagactgtgagcaccttgaaggcagtggcagtgactcattcattgtggcatctgcagattccagtggactgccaggcatgcaatagaaaatcaaaaaagatttactgctaaataatcctcaactccagtggcagctccatgtgccatttctcttccgctctggcctcggctcttcctgtgcctacctggggcttggctttcacctaggtgtctgcatggaagggagagcgacctggaggaccatcgccaatccatcaatagcctcccggttgagatgacttcagctctgatttggaagagctatgatattgtttataggagtgaattaatatgtgtaaaggttacaaagtaaacagttaaattaaattaattgtgctggagcaggtcaaacaggcttctgagagatgaacatacacatctctattaactccacattcngtgagtgtgggtaacttgaaattggctgggtcaccatttacatcatagaaattggcaaatagtacaaattagggctccctcacccctactcgggcatagagctggtacactagcacacctctggttatacatgcatgcgtgtgccaccagaacaaaacacctaacagcaggcacgttgcctctgttgcccaccattacagctcccgcacggagcagacagactcatggcaggaattgaatgcatgtttgtcgagtggaagcatgaacaaatccacaaaatgcccaagatgaggcaaagaaggacattggctcaaatgttaaacataagttaggagctgagataatgcccagaggaaaaatgttctgtaattctaagtaaaacccatctctaaggcaggatgctgcttatgagggctccacagacagatgggggaggcctgggtcctgcccttggaaagagtctgacagctcgacttctggaaacagccatctgcacaggtcaacatcttcttagctgacagggagcagatttgcagaccacatcacatttgaaattccagaagaaacttcttggagtctgctcttgtgcaaatgagcctagaaagcccgttaactttgggtggaggcttccactgtttggctatcccaagtgggcccaaagctaaggaaaacccaccagccctttgcttcctgcttcctctatttgtttgccccaggaaatcagaggtgatgacatgatttggcttgggcacgacaggaataaacgatatttaagagacgtcaaaaac

SEQ ID NO: 271585 - DNA, 420 bp, Homo sapiens
ctcattgaggagaagctggacatcagctcatgagtgctgcatgaaacacttgcagtgattttggtaaaaagaactcacatttttatgtaccctctcttccaaaaaagaaaaaaaaccctgaagtttaaaaagtctttattcggctggacatggtggctcacacctgtaatcccagcactttgggagggcgcggtgggtggatcacgaggtcaggagatcgagaccatcctggccaatgtggtgaaactctgtctctactaaaaatacaaaaattacctgggcgtggtggcgcaggcctgtaatcccagctactcaggaggttgaggcaggagaatcgcttgaaccagggagtcggaggttgcagtgagccgagatcgcgccacagcactccagcctagtgacagagcaagacaccgtctc

SEQ ID NO: 271586 - DNA, 253 bp, Homo sapiens
cccacctatctacaggtctcagctaagcctcaggctgcagtgccaattctcaacacttgtgtgttggcccagggagctcttcttcctgagtaattccttattcagaaaagcctggatgagcaaatgttcccctgaacctgtatcaccctgctatgtccaatgctgcagtaatgaaaaggtgtcatgaactagcaatcagaaaaaaatagcaaaaattataataaattcccacaattaattagcaacagctgct

SEQ ID NO: 271587 - DNA, 407 bp, Homo sapiens
agagccatgatccaaaagcaaaaggtccaccaatggatgagtgttaaaccgaatgtgttctatccatacagtggaatatgattccaacatcaaaagcaaagaagtgctgatccatgccacaatgtggatgaaccttgaaaacatggtgctgagggaaagaagccagacacaaaaggccagagtgtaggattccattgatacaaaacatctagaacaggcaaatccatagagacaggaagcagattggcggctgccacaggtgggagtgtttccatttgaggagatgaaaatgttctggaattatagtggtgatggttacacaaccttgtgaatggactgaatgccactaagttttacgccaactttaaaatggtaaattttacgttatgcaaattttaccacacaca

SEQ ID NO: 271588 - DNA, 452 bp, Homo sapiens
aagaaaaaataattttaagagaaaaaggtagtgttgtagtcacttttatatgtgaataagtctgtagaaagacttctaatggtgaaactgaggcttaaagtatgtacatttgaagtttttatggatattagtacatttctctttaaactattgcaacaatttagtttcattgttagtatatgatagtacctgttggtttttttttccctcatcctcactaatactgggtgttatcaaactttaaaatttttgcccatctcataagtgaacaccacaaataatttttctagaaataactcaaagagcctttcttggtttctgaccaaatgcctttattttcagtgtattttcttgagcatcttctcaaaacattttacctttagatttttctgattattttaattctatgaattttcacctctgaatcaacaatctccattatacagagatac

SEQ ID NO: 271589 - DNA, 509 bp, Homo sapiens
agagaaactcaaatgtgtttgccaaattaaagcactaaggaataagcacatttcctcttaatgatcactttcaaaataaatctactattcatttaggaatactaatagctttgacccttcacttgctcacgattatggttgcctaaggttaaaaataaggtaaggtaatgaatgtaaattcatctctgtctggctctttgttattggtgatagtgaaaagtttcatggcaaaagaagatacaaatcaatgaaaaaaatggagtggggagataccttctgtctgtgctgcgtgtgttccccatgatcataaatggagaagtggaggcaatattaacgaaatgtgcacttacaaagcctgtgctcagcaacttttgataatatttaagtccattagggcctacccatacagtcatagatccgaagaggtcgattaaactttgaagagcttgtttagctttgttgcctccaggaagtccgtaggaaaaagtatcagaaaagcataaaacaaa

SEQ ID NO: 271590 - DNA, 1610 bp, Homo sapiens
agcggaggaggcaggaacagcaggcctggccagcccaaaggactctctatccaggatgtaaatgagcacactgctggcccatgcgcctcggggctgtagagggcagcctcagaggcactgggcattcctggcaccatggatgacgctgctgtcctcaagcgacgaggctacctcctggggataaatttaggagagggctcctatgcaaaagtaaaatctgcttactctgagcgcctgaagttcaatgtggcgatcaagatcatcgaccgcaagaaggcccccgcagacttcttggagaaattccttccccgggaaattgagattctggccatgttaaaccactgctccatcattaagacctacgagatctttgagacatcacatggcaaggtctacatcgtcatggagctcgcggtccagggcgacctcctcgagttaatcaaaacccggggagccctgcatgaggacgaagctcgcaagaagttccaccagctttccttggccatcaagtactgccacgacctggacgtcgtccaccgggacctcaagtgtgacaaccttctccttgacaaggacttcaacatcaagctgtccgacttcagcttctccaagcgctgcctgcgggatgacagtggtcgaatggcattaagcaagaccttctgtgggtcaccagcgtatgcggccccagaggtgctgcagggcattccctaccagcccaaggtgtacgacatctggagcctaggcgtgatcctctacatcatggtctgcggctccatgccctacgacgactccaacatcaagaagatgctgcgtatccagaaggagcaccgcgtcaacttcccacgctccaagcacctgacaggcgagtgcaaggacctcatctaccacatgctgcagcccgacgtcaaccggcggctccacatcgacgagatcctcagccactgctggatgcagcccaaggcacggggatctccctctgtggccatcaacaaggagggggagagttcccggggaactgaacccttgtggacccccgaacctggctctgacaagaagtctgccaccaagctggagcctgagggagaggcacagccccaggcacagcctgagacaaaacccgaggggacagcaatgcaaatgtccaggcagtcggagatcctgggtttccccagcaagccgtcgactatggagacagaggaagggcccccccaacagcctccagagacgcgggcccagtgagcttcttgcggcccagggaatgagatggagctcacggcttaaagcccaagctctgaagaagtcaagggtggagccagagaaggaaggcagtcccagatgagcctctattttcatcagcttcttctctctccccttgaacttggtaacccacatggttctcccgtggcccctaggtggatgaggccaaagtcaaatccaaggctgagacagtcgtgcgactcctactcccccagagcgtgacccggagcaggtgctggacacagagcctgtctcagcagagggtccccactggccgcaacggctcagtgacagcaagagcaggaagagcagcaggaaggcaccgctgtccaccttgggcaccatttatcctc

SEQ ID NO: 271591 - DNA, 447 bp, Homo sapiens
caggggaccaggctgggttgggggttgggtggggctggacggggacgaggcgcggagaggcggcgggaaagagcttcggctgggccacgggctcgcgggcactctcggcggcagcctcgggggctccgactccagctctgggcaagatccataaacttttaaagaagcctcaaaacatacttttaaagcattaagctttaaagtgctagaaatcttgtgccccatatgtgcttctttcagtattatcctagatcctcaggagtagcatggcaactggagaaaatgggaggaaagacaagaagaaatagaagctgatttaacatcaagtttattcagttttgatttttcttatctctactggctttctcctgttcaaaccttgcagcgataatatttggaaaagagcacttggaaattatattcctgtttttaactctttatatttaa

SEQ ID NO: 271592 - DNA, 485 bp, Homo sapiens
agcggaggaggcaggaacagcaggcctggccagcccaaaggactctctatccaggatgtaaatgagcacactgctggcccatgcgcctcggggctgtagagggcagcctcagaggcactgggcattcctggcaccatggatgacgctgctgtcctcgggggctccgactccagctctgggcaagatccataaacttttaaagaagcctcaaaacatacttttaaagcattaagctttaaagtgctagaaatcttgtgccccatatgtgcttctttcagtattatcctagatcctcaggagtagcatggcaactggagaaaatgggaggaaagacaagaagaaatagaagctgatttaacatcaagtttattcagttttgatttttcttatctctactggctttctcctgttcaaaccttgcagcgataatatttggaaaagagcacttggaaattatattcctgtttttaactctttatatttaa

SEQ ID NO: 271593 - DNA, 441 bp, Homo sapiens
attagataattgagatatttaataaatgaaaataatctttttgcctataaattttctaaatgcctataggatttttttctgaagctattcttcatactgaattagtcccttgtaaatattaaggttatcagcgacagttataaaaagttattaagctgggcatgttggctcacacctgtaatcacagcactttgggaggctgaggtgggagaattgcttgagcacaggaattcgattgtagcctgggcaagatggcaagacccctgtctttacaaaacattaaaaaatcagcatggcatcatggtgtgtgtctttagtcccagctacttcagaggctgaggccacagtatcccttgagtccagtaattcgaagtggcagtgagctatgatcctgccactgcacttcagcctaggtgacaaaatgagaccctgtctctaaaa

SEQ ID NO: 271594 - DNA, 209 bp, Homo sapiens
ctggaggccctgtgtggggatgctggggtagggatcccaggaaatgagttgaggggtaggtgaggtggggagggttgtaatggctagagcaggggtgttcaatcttttggcttccctgagccacattggaagaagaataattgtcttgggccacacataaaatacagtaacactaatgacagctgatgagcaaataagcaaattgcaaa

SEQ ID NO: 271595 - DNA, 946 bp, Homo sapiens
aagtgactttccaaaggtcagacccataacaacaggccagagctctactacattttgtctttattagaaggttttggctattttttttttctatcagcaatttgtacctcaaaagacctcataccatacctgtaatatttaagaagataaattttttgccgcactcttagtttttttgcccgactccagttgcaggtagctactctggaaagtctatataaaatactccttttcttcttagccaaatacttctccttttggatcacaaatgcattgataattttcgtcttagtccccttaatggtagtaggtgtgcctctctcccatgaacggatatcgctttatcagtgttaaagtctaaatgttaacagaaaaaatgaggaagattttattgccactactgtgaggtttgggttacctacctaacaagtgtagctgaacttccttagtatcatagtaagtgtgagaggaaaattatttctgattttaatttggaaagttgtgtgactttttgaggtctggtttttcaccccggacttaaatggactttcactgtgtcaagcacaagactgaccccagagacacacataggtgcacctcgtagaagcttttaatagtccttatatttacttaagaataggactaactatggaactatgcaagatgagctgcgaaatgacaggtgacctgccagccggcccgagtctgattttttttttttctccctcaatgggaggtgtccattctcccttcggttgtgagaatcagttggttcatttatgggaaggttgcagggggcatctttgaatcacagccttcagatgccagaagggcagagagaatcccacatgggctggtggatcatgtgtgtgcatttctctcccttctaacctgaggaactaagcatgaaagaatgtgagcatcagagagagctgcagtcagcgct

SEQ ID NO: 271596 - DNA, 372 bp, Homo sapiens
ctcagagtctcttccctgtggaaggccctgtgtgacctggtaacggttgggctccctgcaggcagcccctgccctccgtctgcagctgcgcccgtgtgccctcctctctggcccacctggcaccgccgcttcaaactctcccctgctttatcccaggacctgctacccccacagggcacacagctatctcctatgagataggtttgtttgttaagtcaggtttataacgattaatgtatagatggtgagattcgccctctttggggtataatttagtgagttttgacaaaggcaaccactgcaaaccagtgtagaatattctgatcaccccagagttgcaccaggccccgtgttggggttgccagatttagc

SEQ ID NO: 271597 - DNA, 463 bp, Homo sapiens
tcttactgattttgccataaccacacttatggattagttcatttactgacttcagaattgggtacccccatgcagtgtatggctctacaatcctcagcatgttaactgaagccttgttgagcttcacaaaggttctgttgaagatttgacgaagggaagaagctgcaacacctttcagacctttgggctcacaccattgatacctctgatcctgatgacaaacgccaatttgggttctgcaggtacatagaagttgccagcttttcttgccatcctcgccatttgaatttcagttctgtacatctgcctatattccttgtgatagtgcttcgctttttcatagataagcttcttccttgcctttcaaagcatcttttggacaaacttctttctcaggtgcttgatcttcagctctgcgaaattccttcgctttttcttaagcatttctggcacagcaggaacc

SEQ ID NO: 271598 - DNA, 1244 bp, Homo sapiens
tgtttaaaattggtcagtgactaatattaagcctctaagaacaaaattcattaggtttatttagcctgtttttgcattactgctacaaaatccaatagtttaaatagctaactgaatacttttgatgttaaagagcaaaatttcatgaagattttagatcaagagagctaccactgagaaaaaacaatgcagatttgtggtaaagtcccatgaatttgttgaactgccaaggcttctgatcatcactgctgaagaacttctaatggtgacttccatctcagctttctcattgccaactattaagaatgtatggattatccagatgttgcaacacagttgtgtttttggcttcaccactccctctgggctgtgattctgtttttttttcttttattgttgatgttctttgtttttaatatgagaaagatttgtgtattatacttcagttttagtttccttaatcacagactagacaaaagaaaattggcttggtttcctattaggaaaccacttagaagccattatcagaatcgtagaccatcactgtgaactatatccaggtgttgtcatgaaagtatgacatcctagagtggaaagcaacctgggtttccgagactgttttactcttttatctggaatgttgttttagctgctatggctccaacagggtgaacatagcattttatttaatctaaatatctttctgctttttttttctaagttgcaaaaagtcaatgaccacatttcatctctagcctctcgtgaggtttaaattacacaaggaagaaatatttacaatgtcaaatgctgaagattgtttggagtcagaagtgattgttcagaatctgtcttaatgacaagtcagaaattagacaaagagatgaaatgctaagcccccaatgtgttctgaaaagttaaataaccatcttacatcagttggtacgtttttgtaagagtccaggatgtaaaagtgataaataaattaatgaaaagcacttttaaaaatcaacaaaagacatggcaggaaatggaagaaaagagaagcaagggatgcattctaatagatattaagaacaagccaaagtgcagtatttgctctagggttttactgttcattgtgtcaagactcacagattttagatattttttttaattgggaaagtaaatgaggcaggtagataagtagaaaaagttgtgtgaaactcatcagtactgaaaataaatagttgtacttctcaaaaaaa

SEQ ID NO: 271599 - DNA, 403 bp, Homo sapiens
agtgttggatgtttaatttttaacatctcagagtatagtttggaaagctctttaaagtagtttgttaaatgtatgaaatatttcaaacatataaacaaatagccccattatcttccacccatatttaacaggcaattttaatatatttccacatttgcttcattttttttttaattaagtacagccttaagcaaccactggccacttcccattatcaccgtcattggtaacctgctgtccaggagttgatagagtttatcaatcccgtgaatatatgtgaacagatacctaatgcatgtgtataggtatatgttatttttattctttttacaaacagtagaaaaattagatccttgtatgtgtctgtttcttaaggacacatgagaagagtttctcaattcac

SEQ ID NO: 271600 - DNA, 542 bp, Homo sapiens
cctccagaccctattctcctgcctcagtggtagtgtagatcaggcgaggaagtagaaattctaatagacagtggtgggacagggaagtgtccatatggaaaaaaatggacctttatatcatacgtaaataaatttcaagtagattaaaggtctaaacataaaaggcaaaattaagcaatgcatatagaagtgtaaaactataaacatttgcaaggaagtgattgtcacacgtttggagagtggttacttccgggaagaggaagaggtttgttgcaggtaggggatggagtggggaaagggactctgtccatattctaactcttggactgggttgtagctatctgggtactttttaatttgctttaaattattttttaaattgtatataaatatggtggccttttgtgtattctatacagtccacactaaaaatggttaagaaaaaaagcatgacgtatttaaagataaccaccaccgtaagtcaaatcactgagtaacttaaagctcacaagtaatatttaagagtacccagaaacttgttc

SEQ ID NO: 271601 - DNA, 415 bp, Homo sapiens
tccttccatcaaatattacttctcaagtagacccgtctgcttgtgacatggtagttcctggaagaactgcaaatgttctcccagtccaggttattttgaaacccagtgttaattatctatgggaaaaaaaatatccttttaagtgtggtggcccatgcttttaatctctgcactttcggaggccaaggtgggcatatcactggaagctaggagtttgagaccagcctggccaacaaggcaaaaccccatctctactaaaaacacaaaaattagctaggtatggtggtgtacatctgtaatcccaactactcagaaggctgtggcaggagaattgcttgaacccggaaggcagaggtagcagtgagccttgcgccgccgcactccagcctggataacagagcaagactctgactca

SEQ ID NO: 271602 - DNA, 365 bp, Homo sapiens
aagcataaatatacaggtacttcagaaagaataacttaatggagaaaaaatgggaggaactttgagattatataagaaatgctggctgggcgtggtgactcatgcctgtaatcccagcactttgggaggccgaggcaggaggatcatgaggcaaagagatcgagaccatcctggccaacatggtgaaaccccatctctactaaaaatacaaaaaaatttagctaggtgtggtggcacgcgcccatagtcccagctactcgggaggctgaggcaggagaatcgcttgaacctgggaggcagaggttgcaatgagctgagattgtgccactgcactccatcctggcgactgagcgagactccatctc

SEQ ID NO: 271603 - DNA, 750 bp, Homo sapiens
tagaggccaaggcgggcggatcacgagatcaggagatagagaccatcctggctaacacggtgaaaccccgtctctactaaaaatacaaaaaaaaaaaaattagctgggcatggctggcgggcgcctgtagtcccagctactcaggaggctgaggcaggagaatggcgtgaacccgggaggcggagcttgcagtgagccgagaacacgccactgcactccagcatgggcgacagagcgagactccgcctcaataaataaataaataaataaataaataaataaataaataaataaaatgtctgaggtctagactttggaaaagatctttttccttccgataccagaaccaaggacttttatttaaaagagaagcagcaggaattcctctttgtaaatgttaaatgaagggagtttgcttgtccaaactccaaactaaatgtgtcaataggaggtaaagtgaaacacttatcgacaagttgctcagggctccaaccctcagccctcactattgccctgccccagcccaacctctgccaggtttaagctgaagcctgcagaggtcagaagacaagcaggttcttcctcttgtcacagcttcctcccctaccagcattactccaggctaacaagccttgggagtatatcgttccttgtggctaaggggttactgacatcctctggacctttctccagtagctccccatcatgaaagctttgttgaaaaaccttccttatccccaccccccacaa

SEQ ID NO: 271604 - DNA, 347 bp, Homo sapiens
attttcagctgtataggacagttgtgtaggacagtgttctatataggacaatatctgaagatacattcctccatccattcttgtctagactgtaagttccatgggttgttacaacccagccctcagcacattgctagatacagcaacaaacattttcatgaattaatgacaagtgtctacaattccaactctttatcctgttgccctttcctaactccattgtctttataaatatcattctgtttacatattcacagattctaaacctatagtcatatattaaaaactgggatttttaatatatgactataggtttagaagtcgacgcggccgcgaatttagtagta

SEQ ID NO: 271605 - DNA, 224 bp, Homo sapiens
tagcagagagtggcattgtttagtattttttgcaaatctcttaatagtacgatctggattctcattttctgtttctacattcaaccggtttgtgatatgctgttttagttgaaatatatgaagaaaaactcagcctcctacattcaatatttgaagagagttaaggtatgtaacagctttttcagatattatcaatactgtatttttctttaatgtcaaacccc

SEQ ID NO: 271606 - DNA, 425 bp, Homo sapiens
ggcaacctgcagaatcttctttcccacctcccctttcatgattgccagtctctaccttcaaaaaaaaaccatacttcttgcccatcccaaaagttagtatggagcatggccacagggtgtgaaaacctccagagatataaataggacaatccaacatattggtgttggtgctgagaaaattagtgatactctgataatggggtagcatatctttttgccagtcaagtggtttctaatttattgctttcagtaacattgaaggaggacataattgccagctaatcattaaaaataactttgatcatagaatacttttttatatgtaacttggaaagggttcaaagaaatgggtggcattgctataaaaaaattccattctcgtctatttaaatttgtgaatgaggttcctcaatgcttatatctat

SEQ ID NO: 271607 - DNA, 245 bp, Homo sapiens
gtgagctgccacctggccccatatccacctaatttaaaaaaatttttttgcagagatgtgatcttgatatattgcccagcctggtctcaagctcctggcctcaagtgattctcctgtgtaggtttcccaaagcatgtggctaacattttttaatcctatacaatgttagcactggcctcatctagtcctaagaagtttgctcctaatcatgtattcattagaattgaggaggagaatatttccca

SEQ ID NO: 271608 - DNA, 710 bp, Homo sapiens
gtcagtggatgggtgcctataatttctaagggaaatagaatataatccaagaattttatagccagctaaattattgcccaatcaaaataggcaaaagacatgatcacatgttgaagaacttaaagaacacagtatttctgagctcttttaaaaaaagtcttcataataaaatttagtcagccaagaaattaaaaaataagcaactcgtgaattgaatgaccatgacaaaaggctaattatgagaggtgaatccatttaaaaataggactattattgcagaacagaaagagaaggtggtcaaccttaacaacataaaacaacctagaaataactagtttccagaggtaaagggagggactgtaggaagtagaagtgctgatgccctttattaagtcaattaatcaggtctaaaattgaaatgtggttttaaatatataacttcttgtttattttcctccctaactacctgaggatcaaccaccatgatgaacgacacagtaactatctggaccaggaagttcatgaccaatcgaccactccaggggaaacacatggtcaccaatgtccttcaccccggaaaggcaacaaaatgtacaagaccacaataggtgtcatcttcatattaatcgttggactcagaacccatgttggtggtggttaaacaatgagctttggcatgctatctgtttctttgaattatgcaaagaaaa

SEQ ID NO: 271609 - DNA, 681 bp, Homo sapiens
ctgtgggcacaggctgtgtgtgctttttttcttcacatctgtggtgtcaacatgtttgaaagagaaatagctctgtggcttcaagtgtttctcaaaatgtatcacagggtacctctagccggctatcacagtaagacagtttgtgtctataatggtgcatacctcaaacctactcattgaaaatcttggatggtttcccttccacattagtacagcacaagttgggtcctcatggacaaagggggctctcagtttagtagctattcctttttggcagattacactgcagtgtggctgagggttcagttgcagtaaatggcaaagggtagggagcagcatgacatgtagttcttggaaataatcccctccaaagctgtatcaaagacatgcagtttcagagtaaataggctgcccttatggctttgggtgaaatgtgagaatgcagcaaagaccttgagaatgctcagaaggagtggaaaccttttttatccgcttttacaaaagtcactgcctgaggggaattcaccaactctagaaacaaatcgcagctgttcattgctgaatgagactgtagtcctttgaaattaactataggcctctgtatttctagacactaatgttctcctctgtctgcagccttgacgttgtggcctaatgttcttgatcatattatatgtttta

SEQ ID NO: 271610 - DNA, 363 bp, Homo sapiens
ttgcctgggatgaggaataatttataatggtaactgttgctggttaaaatttggctcctacccacattcatgcaaactcagtgttctagattaaaagagatttaagagacttgccaggcaaatgcatggcatccttagatgtatcctgatttgaataaaacagctataaataataatatttttgggattattgaaaaatttgactatagattagttttcaggtgatattggagaattaatgttattattgttaggtatgttagcacggtcatgcagcaatgtgtctttctttttaagagatgcatacaaaaatatttgggtgtgaaatgttcttgtgctataatttgctttaaaattcttcag

SEQ ID NO: 271611 - DNA, 447 bp, Homo sapiens
gcaactttattaaaatacacaaaagtagaccacactatttttaaaatggaaagaagctactacctagtaaaaataaataaatagtggtttgtctgtaatcaaatacttaatagcataacaacagggataaaattcaaaacctgttacattaaggggaaaaaaattgtgtataaatttgaaaacaataccatgtagtattaatgcataagttgtaaaattataaagctacgcatggtaatttaaccacctttttaattgttggtgggggtagggaaaattctgtttttagtctgtaacatatttcttttaagcaaaaaacaaacatggcaaaatatgacattcactaaacctaagtaataggttcataagtttgttataatggtgtctttacttttctgtatgtttgaaatagtttaagtaaaaacagaccaacttaaaaaaaaaagc

SEQ ID NO: 271612 - DNA, 296 bp, Homo sapiens
tgtggagcattttggattggccctttaacacctggtatgggcttgtttttatcctctctaccaaacttttgttcaccacaaaagcaatgaccagaattccagcagctatttttttttcttaccttgaaaattacatccattagatggaaatgccagggcagaaagtaagaagatggtggatctcttatgttttgagaaatgatgccctacaagacttggaatgctactggtggacttctcttacttgaacaagaaagaaacattgaataaacagtggtcttgtttaatccactgta

SEQ ID NO: 271613 - DNA, 336 bp, Homo sapiens
actctcctgcaatacagcaatggcttgtgttttggcataaaattccatcaggcagaggaggtatcaaatcattcaacctgccactagctccagagcagtgtcaaattcactaatgtacagagcagtgtcacctcgacagagaatgcctgccaacagagccagcatgaatgatcccggctaggagctgagaactccatgctaagtgccagacagaatgtggaaagagaagatgccagtacttcccatgaagcttagagtccacgtaaagacaatgcatgtgcaaggagaattccacagtagtgttatcattaagtaaaaataaaagtcaaaggcagg

SEQ ID NO: 271614 - DNA, 157 bp, Homo sapiens
ctggtcttgaactcctgacctcaagtgatccgcctgcctcggcctcccaaagtgctgggattacaggcgtgagccaccgcgcccggctgaagagcagaatttctttccttctttagtttcctcatccgtaaaatggaaaaagggctcctgtccttga

SEQ ID NO: 271615 - DNA, 625 bp, Homo sapiens
  misc_feature (48)..(48): n is a, c, g, or t
cgcgctgactctggctcaggactctggagatctcagagtggacaagcnagcacacacgctatttttattgagggggtcttgctatgttgccagggctggtcttgaactcttgggctcaagccatcttcctcctgccttggcctcccaaggtgcctggccagctacagtgatccttaaaactatatcgagaagatgctactcttgcttaaaatgctccaattgctgtgtactgcacttagataaaatataaactatgtggcccataaagccttacaccttctggtgcctgcctctctcttcagccttccctccttcctcttccccgacagctccaactgcagtggctcttgaaagatggctaagctcattcctctcaaggtcaatgcacctgtatacagtgcatttctctagcattctgtccttcttaaagacacatggtctttgtttttatttctacactgtcttttctatgctgtaatctaacaggcagggacatttcttaggtatcatccacagaggcctgcccttagtaggtactgtcaacgtaaattaagattgcatcagtataaactttagaactaagaataaaagccaaatttgtcatttactcctacaggtatgaatt

SEQ ID NO: 271616 - DNA, 778 bp, Homo sapiens
gggaagaggaatgtcagagagtgggcaaaatacaacaggaaaggtccaaattcaccctctgagggcccggggcacgggggcagcctgctctcctcctggggccctgttccctgtggggactggaagagaggctttgagtctagggcctggggcagccaggactgacgggggtgcagtcctagaagggtcggcagtcacggtggcccaccatggcatctccgtatccttgctgcatgctgcacccactccagctgccagagcacggaggcagagacgtgggagccgatgaaggtcgcacgccagcctcccacctgtgagacaaagggccctgtcactggaagccacgtccagcctggccccgcaggagccagggctctgcgcctaacggaggactgatgggaaagggaaggctggcagcagtgaggttttttgaccttggcaatgttcccgtcagactgcagaagaattgactattcccgttcaggtagatgatgaccggccccataaacagccaccaagggtcaccctctccctccccagccctgaaggccaagaaatgggactgggctccttggatttatgaccttctggctcctgcagagagaggaggactggggcttgacaaggacacggggctaaggactgtccttggatctcagtaggacagctgaccttccctccacccaatgactgctccagtctgatcgttcctggccacctgataatctctttgtgcaaacaccaggaagccctggttagaggtgtggacaccaggtgt

SEQ ID NO: 271617 - DNA, 727 bp, Homo sapiens
gggaagaggaatgtcagagagtgggcaaaatacaacaggaaaggtccaaattcaccctctgagggcccggggcacgggggcagcctgctctcctcctggggccctgttccctgtggggactggaagagaggctttgagtctagggcctggggcagccaggactgacgggggtgcagtcctagaagggtcggcagtcacggtggcccaccatggcatctccgtatccttgctgcatgctgcacccactccagctgccagagcacggaggcagagacgtgggagccgatgaaggtcgcacgccagcctcccacctgtgagacaaagggccctgtcactggaagccacgtccagcctggccccgcaggagccagggctctgcgcctaacggaggactgatgggaaagggaaggctggcagcagtgaggggccaatcatctgaatcacgttcctgtattcaggatttgcccctccaaaacagttttgatgggagacaccagccacctactattatgcagccatgcaccacataacgacgtttcaggcaacaatgactgcacataccacagtggtcccgtaaaattacaatggagctgaaaaattcctattgcctagtgacgtcacagccattgtaaggtcagagtgcaacacatcactcatgtgtttgtgttgatgctgctgtaaacaaacctaccgcactgccagtcatataaaagtatagcccatacaa

SEQ ID NO: 271618 - DNA, 436 bp, Homo sapiens
tatgctaagtgaagcaagccagacacagaaagacaaacaccacataatctcacttatatgtgagatctaaaagagttgaactcagaattagagtagaatggttaccagggactgtggcttggagggagtgggaaatggggagaagttgaccaaagggtacaaagttccagttagacaagaggaataagtttttaagacctattttgcagcatgctcaccatagttgataataatgtatgtgcatttcaaaactgctaaaagcataagattttagtctacacattgggtacagtgtacactgttcgggtaatgggggcaccaaaatctcagaaatcaccactaatgaacttatccacgtaaccaaacatcacctgttccccaaaaaagtattcaaaaaaataatagattttaaatgttcctgctatgaaaaaaacaa

SEQ ID NO: 271619 - DNA, 630 bp, Homo sapiens
ccactgcactccagcctggtgacagaacaaggctctgtcttaaaataaaaaaataagtgtaaagatcagaaataaaaattaaccaatttcgcatgtataattttaaaaaatgcatcagaacttttaggcactttgtctgggatgaggagtgttttattcttcgagtctgttatttcactgcagcaggcagaatgctgcctctccaaacaggctggggatacgcagagtcccgcacaacccaaattctcttgtatgctgattattaacgaaagggaagcaaagaggggcagacacagaaatagagggccatatatgctacttaaaaaaaataaataaactcttggcccggcattttacaggtggttcacacctgtaatcccagcacttcaggagccaaggtgggtgaatcacatgaggcaaggagttcaagaccagcctggtcaacatagtgaaacccccatctctactaaaaataaaaaaattagctggtcatggtggtgcgcacctgtaatcccagctacttaaggctgaggcacgagaattgcttgaacctgagagttggaggttgcagtaagccaagatcccaccacagcactccagcctaggtgacagtgatactctatcttaaca

SEQ ID NO: 271620 - DNA, 275 bp, Homo sapiens
cacccatttccatggctcccaggaccccctctacgagagcagccccatatcccttcagcccactctgttcacagctaacccagtctttcaaaaatggaggtgcctgtcctaaatcctcatctcctcctgcacggtcccctgtgcccctgatgggtgaccctgagccctccttcccttcatcccaatccacatgaggtctggtcacttctgacgcccatgtccacacccactgccacgatcccaacatttgccaccacctactccccagctcctgc

SEQ ID NO: 271621 - DNA, 899 bp, Homo sapiens
tggaaaccttgttttttctcttttttattgtggtaaaatatatataacaaattttctactttaatcattttaagtatataattcagtggcaataattacattcataatgttgtgcaaccatcaccactatttccaaatgtatttgtcaccccaaacaaaagctctgtagccattaagtaatagctaccttcatcttctggtaacctctaatctattttctgtctgtatgaattttactactctagaaatttcatgtaagtggaatcatacaatgtttatccttttgtgtctgtcttactttacttagcataatgttttcaaggctcatccaagttgctgcatgtatcagaacttcattccttgctatagctgaataatattgttttgtatggatataccacattttgtttattaattaatctgttgggcagttgggtcatttccacccttttttggtttaatgtgagtaatgctgctatgaacactggcatggaagtttctgttagaggccctgttttcagtttttttggggtgtacacctaagagtggaatttttaggtcccgtggtaattctgtttggaattctgtttttgaggaaccaccaaacttcttggaagcccttgtggattagagcacgatttgtggtattttctgaacaatgccaatgtgcaggcatagttcagtcaacaagaagagcaaagggagctcacgcttagcatagcagcacctgtgtgccgagcacctgagcagctctgtggtgaggcagaggtctgaagttcattgtttaactctagctttattttctgtgatacttaccaatggtttattgaaacaagttatgtttcactgatatgtttgtgacaaaaagattacaaatcaggctatttaagaaagaagag

SEQ ID NO: 271622 - DNA, 945 bp, Homo sapiens
tcatgagcatctgtagctcttgcctgagcctctgagcctgccagggcagagcagaagcaaatgcatgaaggcccctcccccaggggctgctcttagccagtgactgatgaaaatgggtgtgtaaacagcttagccacatgaccccacacaggtgggacaaccatgggtttccacattctgtactgcctcccagaggtccccaccaggtttaagctcaattgcccacactggtaactggtaacttccttgatagcactcatttcttttttcattcttttggtgtttttttagatggagttttgctcttgtcgcccaagcactgcactgcagcctgggtaacagagcaagactctgtctaaataaataaataaataaagaaataaaatcatgcagacctcatccccaggaggcagtctgaaatggctcaggaaaaaaaaaacagcaggtgaaatttgtgcagggggatctcacctgaacaaggatcagaaagacaaggggttgtccccaaacctacccaccctcctagtggcagctggaccctggaccccctcaccaccaccagcctaccccatgctatccatcaccggccagctcatgtcctaaacatctctgcatccctcctctctctccatccacgctgctgcctcactggtcctggccaccacggctctctcagctaggctgcagtcacttccaggctggattccccacccctgcccttgacctcctcctgtcctctactccacaaggcagccagaagaatctgccaatgtatccagtcttctcttgggctagagccttctggtggcttccaatctgcacccatccaagccctttgtgtcaggcaccatctcatcttcataaatcctgtttctattgcctggaggactcccccagccctaacttcccctgttcctaaatgacatttcaccacccttcagatct

SEQ ID NO: 271623 - DNA, 968 bp, Homo sapiens
tcatgagcatctgtagctcttgcctgagcctctgagcctgccagggcagagcagaagcaaatgcatgaaggcccctcccccaggggctgctcttagccagtgactgatgaaaatgggtgtgtaaacagcttagccacatgaccccacacaggtgggacaaccatgggtttccacattctgtactgcctcccagaggtccccaccaggtttaagctcaattgcccacactggtaactggtaacttccttgatagcactcatttcttttttcattcttttggtgtttttttagatggagttttgctcttgtcgcccaaggttgcagtgagccgagatcacaccactgcactgcagcctgggtaacagagcaagactctgtctaaataaataaataaataaagaaataaaatcatgcagacctcatccccaggaggcagtctgaaatggctcaggaaaaaaaaaacagcaggtgaaatttgtgcagggggatctcacctgaacaaggatcagaaagacaaggggttgtccccaaacctacccaccctcctagtggcagctggaccctggaccccctcaccaccaccagcctaccccatgctatccatcaccggccagctcatgtcctaaacatctctgcatccctcctctctctccatccacgctgctgcctcactggtcctggccaccacggctctctcagctaggctgcagtcacttccaggctggattccccacccctgcccttgacctcctcctgtcctctactccacaaggcagccagaagaatctgccaatgtatccagtcttctcttgggctagagccttctggtggcttccaatctgcacccatccaagccctttgtgtcaggcaccatctcatcttcataaatcctgtttctattgcctggaggactcccccagccctaacttcccctgttcctaaatgacatttcaccacccttcagatct

SEQ ID NO: 271624 - DNA, 507 bp, Homo sapiens
tctttaaagtatcagaccccatttagttgaaatgagttttgtctgaagtttccaagtatgacctatgctttttcttagctaatttttagcaggagatgatgagggctaaaaattgagacattagggcatttagttacatctctcaatttgtgactggtttataaaaaatactaagatgtgtctgctaactcacacctgatttatctactccttttatgtatatataattttttttgagttgtgtaccaaaagttggaacatttcaagtattttttctttctgtcactgagtgatttcatgtagaacatttactgttttgtgtattttgaataaatggcaaaaatcttattaaacattagctgttaataattagaaaaatacagtaagtcttcaaatatttataattgatatttgtctttgtttttatatgtatttatattgatgttatatgctcatctttttctttgattaaagataatcgcttgcttgaatctattacctgaaaaa

SEQ ID NO: 271625 - DNA, 371 bp, Homo sapiens
ccaaaccttcgtggttctttcgatccacgcgtgagccaccgaccctccgggcttgtagctttgtgtcgggctgtgagctgcggcaaagaccccatagttaaccgggaagtcctgatttccttaactacgcagctgaaatttcccctaacagaaatttcgtgctggcccctcacttttcttttagtgttgtattgagattttgggtgtatttgagacgtggaacgtcttttgctgaatcccagtaggtccttagatccctttaaccagacactagaagaatcatttttaccccagaactcgactaaaatgtttaagtttttgtttactccaggtttattaaaagtgaccgaaacttttaacaacaaatggaa

SEQ ID NO: 271626 - DNA, 551 bp, Homo sapiens
tctgactttaaagactacataattaactactatgtctgaagggtttaagctgtggcttacaaataaaaatattaaactaccaagttatgattagtaagacaaaccatttctaaaatcccttctaaatatatctggctatttttcaaaagtcaaatccacacgacaaagagtgaggaggctgggcacagtgactcacacctgtaatcccaaaactttcggaagtagatagaggtgagatgactgcttgagcccagttgtttgagaccagcctgcggaatatagggagaccctgtctccacaaaaaaataaaaaaattagttgggtgtggtggcatatgcctgtggtcccagctacaaaggaggctgaggtgggaggattacttgagcctgggagggtgaggatgcagtgacccatgattttgtcaatgcgccccagcctgggtgacaaagcaaaagcctatcttttctctccctcccccaacaaaacccaaagagtgaagaaaatgtgatgctttacaccttaaaagaaattaccaaaaaaaaaaaaaagag

SEQ ID NO: 271627 - DNA, 265 bp, Homo sapiens
ttaagaggcagacactgggtaccgctggctttatatcaagggcctccccttctctttcaccccagacacaggaagctccagtgcagagaggaagtgctaagtcagcacattctaatctcctccccacctactgaacagaaaatcagagctggggctgggcacagtggctcatgcctgtaatcccaggccaaggcaggagaattgcttgaggccagaagttcgagaccagcctggcctaacatagcgagacccccatctctattta

SEQ ID NO: 271628 - DNA, 512 bp, Homo sapiens
tgcataggaatctcttgtgtggctgtaccatggttttgcttttactgttaaccaatttcctattaatggacatttaggtgttgaccagttttttgccactataaacaactcttctactttgacatatattgtgaagttgaccaaacatctctttagaatcaattccctgggctaggatttacaagtcagagagtattccatggccctgcatcagggaacttgggtttatccttcatgttctcaccaactcttgtattagctttttttcatcttttccaatctaattggcaacaagtaatatctcattctacatatattttctttgtttactagtgagattcaggagtctttcacatggatagtaaccataattttttttcctcttatgaatggcctttatactattaaagcaaaatgttttatactattagatagccttactaaaggaacgtgcttattttgtggtttacaaaaccccaaaaaaccccaaagcaaaacaacaacataccaaa

SEQ ID NO: 271629 - DNA, 445 bp, Homo sapiens
tcactgacacataaactttaacaatatattatttttatttaatataagacaataatgatgtacatattgatctgccactagtgtttgtcccttcataaaatggatatgggatctttccacaacagcacatatatacatctatctctcttttgataccactttctataattctgaagtacgcatgcaccataattaattaaactctttcttcctagtaaacacattatttaccatttggtgtatgataaaccgaataaaatcaatatctttgaatatgaattattgagcaaacatgaatgttttcttataagaaatgtattaacatggacattgggttaaaatgaaaaggttgtaaatagtttaacattttataaatattttttaatttcattacaaaaaatgctgtaccaattcacattctaataaaaatcacagattatttaaa

SEQ ID NO: 271630 - DNA, 452 bp, Homo sapiens
tgatgatctgcccacctcggcctcccaaagtgctgggattacaggcgtgagccaccgcgcccgtcccacaagcaatatttttttaaaagtgcttggcaacctcttcacagattactttccactggcaccatcttcaagtaagggactataagtaaggaaaaatagatgagggcaaataacctaaggatataaacttcattctttttgcatcagggtgttgttgaaggctcctgagcaaagagataataaccacagttgggctttaggaggaacatctgccgtggggcagagaatagggaggaagggactgaaagcagaggccaatcaggctgtgactgcagtggtcagggcagctggtggctcatgaaggctgaagcaggtgaatgctgtggggagagagaaagggactgtgtcacaaaggcctagtgctggctctttgtggagatgaagga

SEQ ID NO: 271631 - DNA, 501 bp, Homo sapiens
acactcgatgaactataaatagaaggaaactacctcaacatagtaaagaccatctatgaaactcccatagtttacatcacataaaatctgaacaaccagagacattttctgtaatatcaggaacaaaccaaggatgcatactttcacatcttcaattccaaatattattggaagacctaggcagagcatttagcctagaaaaagaaataaacagaataaaaactagaaataaaagtataaaattatctctgttttcagatgacataatgtcatatgtagaacgccattaaaagacccagaaaataattctgaaagaatgattaagtgaatttggtaatgtttcaggatacaaaatcaccacttaagaacatctcatggctaggcatggtggctgacgcctataatcccaacactagggaggctgaggtgggagaattgcttggggtcaacagttcaagaacagcatgagcaacaaagcaagaacctgtctctaccaaaaat

SEQ ID NO: 271632 - DNA, 623 bp, Homo sapiens
ctggaattagggttcaggtaccatccatctgttacgtgctttgaagatgccactccatctgtgggattcaatttacataaactgaagactattcttctgagttgaagtgaggagaggcatcaatcacactggaaaattatttgatctcctggaagcaaaaagtccaccatgaagttgttcttgccatggacttctagaggagctgactgtcctttgggaagctacaaatacagccttaaaatctgttagcagggaagagaggctttttctgagtgatcaggaatgaagaagcagagatcatgcaaggtgtttccatccaaaagtaggcatctcatgtcatctgctctggccagtatttaaccttgagaaaagaagaagtgtagagatgatgtacttgcctgagggatggattaaaaagtctttggtcttctctgaacggtactactgaatttatcctcatcaccgtcatcattgtcattgtcatcatcatcatgaaaacagaccatgtacaaatccaagcctgccatagaagttgttaccctacatagagtccatgcctgtttgtccagagtttgggaaaagtcagagcacaacctagaataaatgcgataatgtatcacatg

SEQ ID NO: 271633 - DNA, 323 bp, Homo sapiens
gcagcctctcggcatatcactcacaccttctaggctgtcctgttgagacttgtgcctgctcctgcagagcgctggggcctctgaatgttatttctcctgcctgacaaatccagactttcccaaattcaaaagcacacctcaaaagagagattactttatcgatgccctggcaagtacattttccacccccaccatcctgccaagtcccccatattctgctatggatttggcttttcacagacttatttatttagtccatttagaaaaactgtacctttggagataaaaggtagtgtaaagagaggaaataacagtgggaatac

SEQ ID NO: 271634 - DNA, 410 bp, Homo sapiens
ggtgcagcaggagacactgggagtaaagcctggcctttggctctgccaaagaccacccaggggactggagaaaagagtggttggtggctggagctacaggcctgttgcgtgacaagggtgccctggacaggctggcagaaagtcaagccagagacctaaaagagaaggtcctggggaaagcaaagttaccttgattgcctttgacaacactcaagtacttcattggcccttctgctgcagaacttgaacacgtggttcttcaaatacagtactttcctcccaactcccaccactccactttcctactatgactatttcactcctctatcaactcagctgaatcatcatttccttgggtcagctttccttgtcccccctgactagcaataaatgtcctcctcaatcaaatg

SEQ ID NO: 271635 - DNA, 307 bp, Homo sapiens
ccgtacactcacgaataatattatcccacaaccgccacaagaactcacagccaccctcacaagcgaaaaagcgataccacagttaccttgattgcctttgacaacactcaagtacttcattggcccttctgctgcagaacttgaacacgtggttcttcaaatacagtactttcctcccaactcccaccactccactttcctactatgactatttcactcctctatcaactcagctgaatcatcatttccttgggtcagctttccttgtcccccctgactagcaataaatgtcctcctcaatcaaatg

SEQ ID NO: 271636 - DNA, 518 bp, Homo sapiens
tattaaatcaaattagaatttttctccttatatatttttatgtgtatttttcaattactgagattcctgttaagatcccctactgtgaaaatagatttgtttttcagttcttgcaattctgtcaattttgtgttatatattgtaaggctatattattacaactgttgttacgcattgctagtagatgaagaattattatatgatccatgctgtggtctaaatatatgtgtcctctccaaattcatacattgaaacttaacccctaagatgatggtaataggtggtagggtctttgggaggtgattaggtcatgcagagatctcatgaatggggttagtgccctcataaaagagacactaaagagctagttacccccttcaccatgtaaggacatagtgagaaggtaccatctctgaaacagaaagcaagttctcaccagacactgaatctgtgggtgctttgatcttagactttccagcctccaactgtgaaaaataaatttctgttgtttataagtt

SEQ ID NO: 271637 - DNA, 559 bp, Homo sapiens
accggaatcatcaactaaagtctacactgctatatcggctatctattgctgtgtaacaaattattccaaaactcagtggcttaaaacaacacatttattatctcacagtttctgtgggttaggaattcgaagatgggccccctgcttcagggtctcccatgggttgctatctaggtgtaagctaggtctcatctcaagactcaactggggcaggatccacttccaagtgcacccacatgattattggcaggattcgtttcccatgaactgttgtcagaagccgctttcagatccttgccacgtgggcctctccgaagggcagctcacaacacaacagcttgatttatcagagcaagcaggcaatgaggcagaacagggacctctcttagggacatgcagcactcccaccctcaaacatagaaataaagaaaaatcttaagttcctttaagaaaaattccaggcacttagctagcccttaaaaaataaataaggccgggcacgggggctcatgcctgtaatcctagcactttgggaagccgaggcagttggatcacttga

SEQ ID NO: 271638 - DNA, 292 bp, Homo sapiens
aggtgaaagtgtgaagagaacaagaaaagctgatgcatgccccagtaggagagcattcctcctgcctgactaccttctaattggcatatcagctttttcctgccttcagactgatattgaaacatcggctcttcctgcctctccagcctgccagacttcagactggaactacgccattggctctcctgggtctccaagttgctgcctcaccctgcacaccttgagacttgtcacctccacaatcttgtgagccaattatttgtaataaatctctctcaggtaaagaacaaaa

SEQ ID NO: 271639 - DNA, 564 bp, Homo sapiens
acaacacaaaaaccttttaaggcctgtctaggtaatacagccctaatcttagagttagggaacatagaaaagttaaactccttggtagactaaaatcaaattcgctgtgaaaaactaaaatactggactgattccagagttttaccatcacttacaagaatagaagaaatttggccaggcacggtggctcatgccttatactaccatatgtggaatgaatccagtagccataccaagttattgaccagttatcttaagcagacattcttctgatcacatccaaaattgatgtctacatcagctaactttcctacaagattatcaaattttacacagtatttttctgtatttaatgactgccatggtctgcaaaattatgtgattagacaatgaatgacgcttaaagaatgatgacctattttctaaagtacactcaaaatattaaactttagagacaaagcaaaatctatcataaagttggcttctgttgatagaaacagagaggtaggttaataatcactgtcctaagataagcaagaatgcttagaaataaaagttgagacc

SEQ ID NO: 271640 - DNA, 412 bp, Homo sapiens
aacccagttcaacagcagagtttgggatttctgaaagaccactgtgatagcactgtaaacagctgggagagaggaaatgaagtcagggtgacaagtcagggggcaaatgcaagtgacagagccagagaaaaggatgacagagaggagaggatggagtcaaggtaaagctcagaagcacagcagccaggacgttgtgacctcccaagatgaaacttgtttctaaaagaaaattaccaaggacttaattaaattaactagccaggttactattttcacattctagaaacactgccctgcttaattaacttatattctaattcatttacatacatgcattttaaaaagctagcaaaacatgaccaaacagactagcactcttgaccaataaacaatctctttaaagagccaaaca

SEQ ID NO: 271641 - DNA, 428 bp, Homo sapiens
ttttttttttcaaagacgaggtctcactgtgtggcccaggctggaatgcagtggctattctccggtctgatcatggctcactacagtctcagactaatctcctgcactcaagagatccttccatgaagttggaactataggacacatccgtagaagtatttggcatcacgctgctgctcttcactgatgagaagtgactcaccaggatgacagaggttctgagtagggcatctgccaaccaatggggcaagatggctcagaatggaccctcaagatgtacaagccctgcagagccagcagagtggccggtgccatctggccaatgtctggaattgaagcacaaaggatgttctccagaaatgaaagcttattttaaggtcacttcttgggagaaatagattacaattatagaagtctttatataaaaa

SEQ ID NO: 271642 - DNA, 603 bp, Homo sapiens
gagatgatattttggtttcctacctgctttattcattcttaattggttgagaccctgggcaagaaagacagatgctagcaaagaactcagtataaatatttaaattaaaattatggaaaaataaagacaataagaaatgaggtgagggaaatggaaagataaaaacaagtaaggaacattttatacagtagaatttttaaaaatgccataaagtcatgggttgagagggaggaaaaatgggagaagagtcaggggaagaggtcttggaaaagaactgataaatagtaacttcagctatcacattatttgctcaaggacacatccgtagaagtatttggcatcacgctgctgctcttcactgatgagaagtgactcaccaggatgacagaggttctgagtagggcatctgccaaccaatggggcaagatggctcagaatggaccctcaagatgtacaagccctgcagagccagcagagtggccggtgccatctggccaatgtctggaattgaagcacaaaggatgttctccagaaatgaaagcttattttaaggtcacttcttgggagaaatagattacaattatagaagtctttatataaaaa

SEQ ID NO: 271643 - DNA, 323 bp, Homo sapiens
tacattcaattggccgctgttacactcacagctttggtggagttagtcctcagatctgagctgcgtcttccccatggggctgcagccctcagaaggcctcttgctgcccagggccacagcgtgacttctgtgggcacttcgccctcatgagtcctacccctggagaaaaatattaaaatttatactttatgactacattggcataaaaacaaatgtaattccggctggattcatgattgtatactcatttgtattctattcattttttcttctgatttttgaaagacaactaaaataaaaacatttttgagggcccctagaaa

SEQ ID NO: 271644 - DNA, 290 bp, Homo sapiens
attaatggggacaaatatactgtctgataggagaaataacacacagtgtttaatagctcagtagggtgactgtagttgacagcaatctattttatatttcaaaatagctggaagaagataatttgaatgtttttaccatacagaaaagacaaatattaaggtggtggatatctgaattacactgatgcaatctttacaaattatatgaatgtatttatcacatgtatcccagaaatacgtgcctctattatctgtcaataataaaacataattttatttgaaaaagaaaa

SEQ ID NO: 271645 - DNA, 301 bp, Homo sapiens
tggacttagaaaatgagggatgaggacgaggtgattgacggcaccagttttcaggcttgggcttttaggtggtgccatttattgggatagaatcttgcttcggtcaagttgagtttaggctgcctgtgagacattgaggtggagatatacagtaggcagatgtatgggtctggagtctaggagagaagtctggaggaacatagagatttgtgggcccaccatctactgtggtagttaaagccttgggtataactcagattgcttagtgagaatgtttagttgagaggaacagatggtccag

SEQ ID NO: 271646 - DNA, 869 bp, Homo sapiens
cgtttgtttcctcaaatccggtcatgggatttttctcttcctcagagaggcagcgggatccattacttccagttcaccgctttcccagcaccatttcaaatgcgctttggtaaggagaacaaagacaatgagacctcttggtatgcctgcgtctccaggttggggtgtctgtgaaaaaatctcggggttctgtggactctccagtcagtttctgtggagtcagagttaggggtaaccctcgccctggatctttgcaattaatttagaaacttggagagatttttttgcttttggattttctttttttcccctggggccaccattctgggagtttattgccttcaattaagtctctctgcttgttgtaggtgaattacttttgctcatttttaccgtaatttactcttcagaccctggggaaacaatcggctccaggcagccattttcatcacagcatcattcacaagagaaataacatcatcatgtgcctgataaagtacaataatatcatctcttgtatccattttgtgaactatccacaacatttttaatccttttatgtaacttactgtgactcaagctaccacctatgggaatgtaagctcactgggggctcgctggggacctcctcttatttgccactttttcccagcagtatgtacagtgcctggaatgtgtgggcagttcacaagttggtcgaattaataatagacaagtattcgggttacattactaattatttttaaatcatatggagtatgaaatttgagaagagaagtaagtggtctggtgatttggcttacacatttcaccactcacctttactaagatggaaaattaaatgctatctgtaggtccacagtcagaaa

SEQ ID NO: 271647 - DNA, 472 bp, Homo sapiens
tgatcctggtccccaaaaccagagtgaatcaaaagagcttcctcccctgaggcaaagtggatttgtaagcagttctgaaacatcacttactcagaagagggaacgatgtattttgatgagcgcaaattgggaagagctggaggcctactgcttgggacagtttttttttttttttttttttttaaatatgagtggtagcttattctgtaattgcggcaactttgaaaattgtattttactggaaatctgccagccatcaccacccgattttgattgtatccttcctcccatcctttaatctgttcactgctttgtctgggggagctggggtcgttggctcagacgttggcgtttgttctttgatggatgaacgaacactccagttttctttcccgtggaggttgtttcagccacaaaccacttcattttgctgtttcaatttcaaaataaaatgaaacatattgaaaaaaaa

SEQ ID NO: 271648 - DNA, 349 bp, Homo sapiens
tagctgggcatggtggtgtgtgcctgtaatctcagctatgcaggaggctgaggcaggagaattgctttaatctgggaggcagaggttgcagtgagctgagattgggccactgcactccagcccgagggacagagcaagactttgtctttaaaaaaaaaaaaaagaatgctaaaagaaaatgtctaaaaagctagatctctgtatttaactaaacaataactatgagtacagttgaaatatagaccagtccagacaggctgggtgctgtggctctcacctgtaatcctagcactttgggaggccaagggaggattgcttgagtccaggattttgagacaagcctgggcaa

SEQ ID NO: 271649 - DNA, 409 bp, Homo sapiens
cagtccaggaactcttcaacacctccaggacagcagattccacataggccaatggaacaggatagaaagcccagaaataatgtcacacacctacaaccatgtgatcttcagcaaagtctacaaaaaacaaacatttggaaaaagactcatcattcaataaatggtgctgggataactggctgggccatatgcagaagattgaaactggacaccttccttttaccatctacataaatcacctaaatatggtttaaatatttaaatatatatcccaaaactattaaaactcttgaaggtaacctaggaaataccatgcccaacataggaacgggcaaatatttcatgacaaaaggccaaaagcaattgtaacaaaaatgtaaattaataaatcagacctaattaaactaaa

SEQ ID NO: 271650 - DNA, 411 bp, Homo sapiens
cagtccaagtagatgtttgagtgacattcagtctcttaagaaatatttacatcacagatctcaaaatgaaggcaagtcaggcagctctcaagacagaattgcagctatgtgagaaggggaaagaaataaatagttaaaattttaactatacatattctgttttcagcctgtgaatgtagtagtttctaaaagcaatgaagatttccctgaatatcacttttgtgcctcaagctagttcttattcctctgttaatgtcattggttgctcacccctccagaggtattttcatataagagtcagagtttcaggaaaaaggtcttatttgtttaaaccaaatctgtttttctccaagtgacatatagtttttaagaatatgcacacaatccctcatcaatctctgaaccaccaaa

SEQ ID NO: 271651 - DNA, 490 bp, Homo sapiens
gtgggaatttagaaagagaggaccatttaggtcttcccagggactcccacaatcttcctcattctcaagtttagggatttagagaccacagaactcctgtctccaaacatgcctaacagctaccaactacttgatgaatcttggatgaaggccagttatatttgacacctatggtttgtatccctgcaaggattaaatccaggtcaaccaaaatcagaagtgtccattcctcaagttacagaagactgtgctaagcaaataaaaagaaaacctatttttccagaccagagtaatccaagctagcttggagctcatatttaagagccaataatatcctgttctgtaatagtcatttgctgtgttgttcaaaaatattccattctactgtagaagacaggaaaacaaagggatacatgaaattcctatgatgtgttaaacaacaaagcgacccttaagacagaaaagctaagtacagcatgtgagtgtgaac

SEQ ID NO: 271652 - DNA, 495 bp, Homo sapiens
aaagaaggaaaaaataacaaagagaagagcagaaatcaaagaaaaagctggctctttgaaaatatcagtaaaaatgacaaaattatctcaagactggcaacaataaagacagtttatttttatttgtttttttattgtatttgttttatttgtctttatcattttatgataaaaaccctcagcaaactaggtatgaaggggaacctcctaaacttgagtaagatcatctacagaaaatcctacagttgacatcatctcaatggtgaaagctcacgtttttcttgtaagatatggaacaagataaggatgtgtcctgtcaagttttcagtcagtaaaataaggcaagaaaagaaaataaaaagcatacagctcaaaaaggaagaaataaaactgtccatattttcagatgacctgattaggtaaaaaatgctaagtaagatactgtattagtctgttctcctgctgctaataaagacatactcaagattgggtaat

SEQ ID NO: 271653 - DNA, 429 bp, Homo sapiens
catcaggtgaaagccttggctgcttccattcatggcagaaggtaaaggaaaaccagtgtgtgcagagatcacatggtgagagaggaagcatgagagagaggaggtgccagcctctaacaaccagctctccagggaactaacagagcgagtacccactcacaccccacttcctccagagagggcattcatctattcatgaaagatccatcccatgacccaagttctcaagttcttaaatcactccctttagaccctacctctcaatactgccgcactggggattaaatttcaacaggggatttggtgggaacaaatatccaaatgatagcacaaagtgtattagcagggtttacttatgtagatataaattgtgtacattttgcttaatggcccaaagaaacagcttatcaataatctaaccaatgaata

SEQ ID NO: 271654 - DNA, 319 bp, Homo sapiens
tcagaatgttgaaatatatgggtttctaattacatgtgcctgatatctgatcagtatgtactgcagaaggtatctatcatactaaatcttttccagatctgaaattggtcaccagcatctacataaaattgaatatttccctctctccacccgatttccattgggctaaaccaccaaagctggtggagctttatataaacaaggcctacaacccatgctgggtttttcaaaccagtcaataaagacctgaacaatatcttgatccccttttgttcttcccacaagtccataaactctctcaagcaagtatgggcctgcc

SEQ ID NO: 271655 - DNA, 304 bp, Homo sapiens
ccattactcacagtgccagcacatgtttccttaaaaagcttcatcaccatcctcctgcaatgcgaccttcaccggctccccgttgcctgcccaggaggataaagtccaagttctcctgtggaaagaagacccttcacacgctagtcccagcctgtcttcagcccagccccctgtgtttcctttcctgccttatcctaagacatccttaccttccaatcacactcactttccgagcatttttgaaggtattgagggagttgatgagtctacacttgaataaaatacagactttacactccagact

SEQ ID NO: 271656 - DNA, 180 bp, Homo sapiens
ggggcagagagccatcatgtgtctctacatgtaataatcaaaaacacttataatgtcactgatagtattttgtctggtctaacctgcgtctaatcatgaagaaacatctgacaaaccaaaattaaggaacatattataaaataagtggcctcggttcttcaaaaacatcaatatcataaa

SEQ ID NO: 271657 - DNA, 390 bp, Homo sapiens
aatttaggcttttcctcattattccttgcctgtgtctgctgcagcttctggagttcttatttccattcctgcatacctggctttcccataaagtgatgatacaatgtgatcccattctcctgcttaacccctctgagcttctcattatcctcagagtgaagggtgatctgtagttgagcaagcaggttcagttcattgaggcctctttattttcaaagcttttctccaattatcttcattgcattttggccatcaggctgctccatgttctccaaaggttctttgaactttctcccacctctgccttagatttggaagctcacaccaccttcaatgcctttccttcattttctgccagggaattctgcttatcctccaaggcttgactgc

SEQ ID NO: 271658 - DNA, 478 bp, Homo sapiens
tcccacgcatgcccccagagcctctacattacccgccctttcccttgacttccaggcgacccttccccctctctgaaagagcaaaaaaaaaacaaaatagaactaaaacacatcaaaggcaaacagaagaagttaaaaggagatagggacccattcaattcagcttatactccctcccctaaactagggtggcactgggtccagcaactgaactcaggagtactttaaacctaaaagtatcttttgtgggatgctcatgaaagggaaaaaatctggctggaagaatcaatatttgagtttgtccagctaatcatagcattactgctaggttctctcacaaaccagatttctggacttgttttggttagactaaagtagtttgtgctactgggcacacacacatggaaatggaatgtgtcctggaaaaaaaagagttaaaaaaaaaaaacagggctcaattcacacgccaacctgacag

SEQ ID NO: 271659 - DNA, 577 bp, Homo sapiens
tatttaaatccctgtaattcttaacaatgaattctcaaaataagtaatctaggactatgcaggaaccaagacatctgaatcaacaagttaaaaaaaaaatgtctgtatacacacacacacacacacacacacacacaccacctttcggtggaagggacccggaccatcctccttgcagctcccgcagctggctgggggctggggggaagtcccgggacaggtgcatgtcatcaacacgactgtcggtcgtaggaggatgaagccggcccaggtagggaggtgtccagaagcccgtggaccctgcctcaagaggcaagacgtgccaaggggtgccctgcctgcctgtggcagggagtggggtgggcacgtgtggctcccaggccggctgctctgggcctgagtctgtgggagcagcaggcggctggttttaggaccttcctcttccttcccaccaggtgtttcggctctgcacccttctcagtcactttgctttcctatctccctggtaacctggagctccttggagctccttgtcgaaggctgacttgagggggatggtggcttgccggaagagaga

SEQ ID NO: 271660 - DNA, 519 bp, Homo sapiens
gagaagagtgggtccccaccatttactcaaagagtagttccccaccatttactcgtttttctcacaaaataccagagatttagtgtgaacaaaacgagaatctgccatctgcccccatgttttggaagacctcttctcagagagacaaacataagcttcctggacaaaagccagcttataaagaacccaagcgtggcacaaataatctcttagactcttgaaaaatcataagaatgggaacagcccagggaaatcagaaagctgaaaccaaggcctccaagcaaggatgaagctgctagagccacagagcctccccttcctgatgaggtttgaccacaagcacccaggtgacaacacctgaaccactgggtggcacttcagaatcaacctgcctgcacaggccaaccatggcagctgcatctgtttaaattcttcccaagtcttgaacaatctcttcatcttcatattgttgtaatacttctgagtgtggaaaagcagatgaaatttcatgcgctgata

SEQ ID NO: 271661 - DNA, 435 bp, Homo sapiens
taaggctctgttttggatcagctaacctgagcaatccattcccatagactttaattaccaccagtgaagtggatgactcactaatctgtatctttagccatatctctctccccagcagtattgcgactgacagctccacctggatgctctgcaagattctcgaacttgacttgttgtccttgactcctccctaatccttatatccaactgggcaccaaatcctattcatttactttggaaatggcacactaatcctgatctgtgtattcactgccacctgtcatgaattcaggtcctcctcatctctgaatcataggaatagtctcttccttgttctccttataaactttcttgttctactagttaaccctcaaagctggtaccaaagtaatcttcccccaaaattaatctaataaagccattcctttgcttaaa

SEQ ID NO: 271662 - DNA, 354 bp, Homo sapiens
aaaacaaaagtttgcttgtttaaaatgacagttgtgatgtaaaaagtttaagaaatatgaatgtgagtggtaagtatatctcagtttaaatggtaaagaagaaatgtagtttacatttgtatttttccagaattcttttgtcctatgcagtattgctaaagtcgagaatatattccttgcctgtgttagacatgaagggaaaaagaggtcacatattgtgatttccagctgtagcattcaaaaaaaaaattggtgttcatgactctgtggtcggtgccagaggaaaataggaacgactctaattaataggctttctgtgtatataattaaatttagctgctgcaaccattgttc

SEQ ID NO: 271663 - DNA, 258 bp, Homo sapiens
tggttctcagggcttcagactcaggctagaactgcaccatcagctatcctgggtcttcagcttgccaactgcagctcttgagccttcttagcctccataattgcatgaaccaattccttataatactttctctctctccttccttcctccttccttccttccttccttcatgcattccttttcttcttctttttcttttgagacggagtttcaaagcaaaactccaggctggagtgcaatgttgcaatctcggctcac

SEQ ID NO: 271664 - DNA, 545 bp, Homo sapiens
ctatgttgtccaggctagtgttgaactcctggcctcaagcaatcctcccatctcagcctaccaaagcactcatattataggtgtgagccaccatgctaaaataggtttcactattttagattccatatataaatgaaatcatacagtagagtttcattaatagtaaagtaacaatgtgggttgatatggtttgactctgtgtcccccaaccaaatctcatgtcaaattgtaattcccagtgttgaaggatgaaggaggggcctggtggaaggtgactggatcatcggggtggatttcccccttgctgttcttgtgatagtgaatgagttctcatgagaccttgttgtttgaaagtgtgtggtacttctccccgccctctggctccaccatggtaagatgtgcttgcttcacctttgccttccaccataatcctaagtttcctgaggcctcccagccatgcttcctgtatagcgtgcagaactgtaagtcaatgaaatgtcttttcttcataaactacccagtctcaggtagatctttagagcagt

SEQ ID NO: 271665 - DNA, 377 bp, Homo sapiens
aggggaagagcagctcagcagcatctggaactgttaacctgagacttggttcacccagagagaagttgagagaaccttgagctcttccgggatctgttgcaaagctgtttttgttactttttttgagtggagtacacatacacgggtcaaaccccaaaacgcctaaaaacgtctatagtgaaaggattcccgcccctcccgcccccacctttgtacacctggttcttacccttctccccacagtgaaaccccatctctacttaaaaaaaaaaaaattagccaggcgtggtggcgggcacctgtagtcccagctactcaggaggctgagacaggagaatggcgtgaacctgggaggcggagcttacagtgagccaaga

SEQ ID NO: 271666 - DNA, 342 bp, Homo sapiens
aaggccttcccccatggcctggattgccaggttacctggtggtgtatatcctggaggcagtccatcccccctcatactctgaaaaactctgttttctgcctggctcacagtgtaggttgcagcctgcagcttctttcaaaggatgtatggggttttgtttttttgtgtgtggggtctttttttttttttcagttttcctgttaagttcctgcattacttcctgggaaaaagttcacagtgtggatctctacacactattttgtctttccaagtgagagaggcatgctaacaatgtctccaatccactatcttggaaaaataaaaacaaacttcactcagaat

SEQ ID NO: 271667 - DNA, 294 bp, Homo sapiens
gtccctacagaaccgaactcccggggttgttgcgatgacaaggtgtgtaaatgcatgtgaaacaccgacaggcaggaaaccgacagccgtcacgtgtcatcacctgcctgttagttaccgtgctcggcacctttgggttccatgactgtgcagtgaaaggaaatttatttggaaatgtgagaaatgctggaataacattattttgctgtagttgtctaatataaatcattaaaaagggcttaacaacctggtgatttgtatccgcttatgtcagtacttctgagattaaaaaaa

SEQ ID NO: 271668 - DNA, 338 bp, Homo sapiens
tggtttgtagagaaagtctgaatgcaactaaaagctttctttaacacttacatggccacttaagctagttctcggtaattcaaaatatacaaatcaacaataatatttggggccgggtgcagtggctcacgcctgtaatctcagcactttgggaggccgaggcgggtggatcacttgaggtcaagagttcaagaccagcctggcaacatggcaaaatcctgtctctactaaaaatacaaaaaattagcctgacatggaacccagaaggtggaggttgccgcaagctgagatcgcgccactgcaccactccagcctgggcaacagcaagactctgtctc

SEQ ID NO: 271669 - DNA, 362 bp, Homo sapiens
aggataactgtctatgcagccccatcacctggtatgtcactgaggtaggggcattctacctacattctacctatgggagtgtattcatggttcctttgacgtgtcatgtaaccatcgcaagtctgcagttttgcacacactattccctttccctggaacatttttcccctccgtacgaaagaaataattcttatttttcaagactcagctcagacttcacctctgcagcacaggtgttcttgccctctgctgcctccttagccccaagaatcagaggctctcctctctgtgctcccaggggacttctcacccacagtaggtcacttctctgtcttctacactgcaagtgagccccttgagag

SEQ ID NO: 271670 - DNA, 403 bp, Homo sapiens
cagtcggacccttcatgctggtctgaatccaaccaggcttgactgaatcacaggcaaagaaatgactcaaagaccagcaccaactccaaagacagaggttctgctgcaaggacaggtgagcccgtggctgaaccccaggcagaagccagaacacagccgggcgagtctgagacagagtggaggctgtcccgagctgcaggttaaagcatcactggggtttgcctggcttgtcttcattgttcagagggcacaaaggtgcaggatcagggcagacatgtagggaacctttgtctgcagcagaaagtctttccccaccccccattgctctacttccccaaatcgttcaaagctcatttcatctaagacactgctcttccaataaaaggtttacctcagactcacc

SEQ ID NO: 271671 - DNA, 656 bp, Homo sapiens
accaaacaatctgttaccaaaaagacttccaaagacagttaatcttttatatataggaaggaaaatcatttttttcccataatccttattttttggcaccaatccagtcatattttttaaatcactctctctgatcacctaggccaaacaatttcttagacaacaggtcagggcaccactaacaacactcatagcattcattcttttattcaacaattatttattggacacttagtatatacgaggtagcattgtccaacagaattttgtgatgatagtaatgtttatgtctacactgtccaatatggtacccattagccacatgtggctatggagcacttgaaatgtggtgtgactgaggaactgaattttaaattctacttgattttgattaaatttaaatgtagacacctgcatgtggctggtggctactgtgttggacagagcaagtctaagtaaatttttggctctacgactttattaagtcagtaccttaatgcagctgaacaatcctgccaaaaatagtgtctatttagaaagtggctaacatatggatattttgttttattcagtctaacactatattaaaattaacttttcagagaatcacagaattctggagggacaagacaaaaattatttaatccagccccatt

SEQ ID NO: 271672 - DNA, 453 bp, Homo sapiens
ccataaaagatggcattctgcaagactgagaagatgcccacctccattcccagagtccaggccttcattaactcacacgagaactacagaagcatcacccctagttctcctattagtcactcctcctcaactgcctctaatccatccatccatctatccggcatgggtcatgtaaagttacagctgagaagggctggatacagtgaactggaggaatagcggggagaattgccaatactcaggagtcaggcttcacattgatcatgcagctaataagaaagaaggcaaaggtaccaagccccttgccatatgagagcttccagcaactttggcagaagatagaaaggaaaatactactactatttagaaactgcactgatatttcttgacttctcctgaatcgactactgttttcccctcagtgattcaaatacaagagaaatttttctcatc

SEQ ID NO: 271673 - DNA, 415 bp, Homo sapiens
ggccctcagtggattgatgatgcctactcatattggggagggcagtcttctttactgaatccagcaattcaaatgctaattctatccagaaacaccctcatagacatacctggaaatgatgtttagccaaatgcctggcaccctgtgactcagggctggatacagtgaactggaggaatagcggggagaattgccaatactcaggagtcaggcttcacattgatcatgcagctaataagaaagaaggcaaaggtaccaagccccttgccatatgagagcttccagcaactttggcagaagatagaaaggaaaatactactactatttagaaactgcactgatatttcttgacttctcctgaatcgactactgttttcccctcagtgattcaaatacaagagaaatttttctcatc

SEQ ID NO: 271674 - DNA, 432 bp, Homo sapiens
cacttctcctctgatgaatgtgaacaggaaagcgtattgtccccacgtgctgctgggtgttatcttgtgaacctcagagaagtcaacctgactttctggttacatgcaaaaatatattatttccttagtgtttaggttagtttgatttgggcttccaatttttacagtgagaagctgtcagaaccctttctctttatgggatttttggagttttttatttggtttttgccaattcctattaggcattatcagtgtttttattgttgatgtggtaagaactctattgagggtgtaatcttgttgtctatttattatgactatgtctccaagtttatcacttgttcattatttgctatgtagtcttatttaattcagagaagaatatagtcttaatgtaattaaatataccagtatttttctttgtgatatatt

SEQ ID NO: 271675 - DNA, 473 bp, Homo sapiens
gttagcacagcagccctaagggtcagtctataaatatccctattttacagatttggaaactgaggcttggcttagtctcttgcccaggatgccagaactagtaagtgacagaaccaagattcagaaaccaaggctctgactgcagagcctgagtgtttaacctgccccagtgaggcaggatagcttcacagaggagaggggtggggaggagccccttgggctcagggaggctggagatctgtttggagctccctgcaggcccaagaagtccaacaagccagtgtgttgagccctttcgaggctcatttcatcatacatctttcatgtcaccaagattgaattaaggaaatacggcaagagacccagtgtttgaatgcagggaggaacttctgactgtggaggagagggaacctggtggtgggaccatggaggcagggtgcagaggtgcacaataaaattgattatcatcgttt

SEQ ID NO: 271676 - DNA, 418 bp, Homo sapiens
agcatgtaaacatctgcagaaaccaaacgtttcctggaactaagcttgagcagaaatctatcacgtggacctttgtttaaagaaccttgtgaaaaaccacagttacgtaaaagatccaggagcgcagttcatgtggattagattctctaggaggcagagagtctaaggagatcaaagaaaacaacgacttgggaagtgcatgtgctgagcactggagccaaactagcagaaaggagttttagaggcactgaatccagggcctctggtttttggggactgtagtaaagaaaggagttgaggcctggtgcagtggctcatacctttggtcccattactttgggaggctgaggctggaggatggtttgaggctggaagttcaagaccagcctgggcaacaaagcaagaccccttttctaaa

SEQ ID NO: 271677 - DNA, 501 bp, Homo sapiens
ggcaggagggcagaggagtcctgctgatataagacccataatccaaaggactgagaaccaggaagctttgatgtccaagagaaggagaagatggatattcttgctcatgcttctgccttttattcctatttgagcccacaacagattggatgatgtctgcccactttagtgagggaagatcttttttacccagtctatttattcaaatgttaatatcttctggagaacctcatacagacacacccagaaataatgttttaccagcaatctgggcatcctcagcccagtcaaggtgacacataaaattagccattacaacattactgccattttacaatacagtggcaatgtatgagaacgccaggtcccctacattcttggcaatacttggtatggtcagtctttttcattttaatcattctaatgggaatgctgtaatatctccctgtggtttaatttgtattttctcatgataatgataaagaatatccttacatgtgc

SEQ ID NO: 271678 - DNA, 485 bp, Homo sapiens
tgccactttgataatttgatgataactgggtgtggtggcttgagcctgtagtcccagctattcaggaggctgaggtgggaggatttgcttgagcctaggagtttaagaccagcctgggctatatatagcgaaaccctcatctcaaaaaaacattttgatgatatgaaatctaaaattatgaacttgcttgtgaaaatagaatttggcagggcgtggtggctcacacctgtcatcccagcactttgggaagccaaggcgggtggatctcttgagcccaggagttcaagaccagcctgagcatcacagcaaaaccctgtctctacaaaatacaaaaaagttaaccaggcacggtggcacgtgcctgtagtcccagctactcaggttaggatggagaatcgcttgggcctggggaggtcgaggctgcagtgagccatgattgtgccactgcactctagcctgggtgacagtgagaccctgcctcaaaa

SEQ ID NO: 271679 - DNA, 322 bp, Homo sapiens
atttatgtatttttttaaaagcaatagacatattttttatgaatacaaacatatatggtattacattttagaaacataaataagaaaagtaaacgtcaatttcagcacggtggccagaagttacctctgagaagggaggggagtaaatatgatttttatttttaataaatagggagaaagacttcagttataaagatctgaaacaacaatattaactcttctaaatctagagagtaggtatgtgttataatggtctctgcatacagaatatgtttgaagtacttcgtgatttaaaaaatttatatgcccagaaaaacaattt

SEQ ID NO: 271680 - DNA, 452 bp, Homo sapiens
ccagggtccttttctttcttatggatttataaatatgatacttaaggatattaacctttgtcattataagtattttttcccagtttgaaattagccttttatttttccttatactttggatttttttggcggcagtttgaggggagcatgttttaaaaatacgtagccctacgctgggcatgatggctcacgcctgtaatcccagcactttggcaggccgaggtggacggatcacctgaggtcaggaggttgagaccagcctggccaacatggagaaaccccatctctattaaaaatacagaaattagatgggtgtggtggctggcacctataatcccagctacttgggatgctgaggcaggagaattgcttgaacccaggaggcggaggttgcagtgaccctagattgtgccactgcactcccacctggatgacagagcgagactccgtct

SEQ ID NO: 271681 - DNA, 565 bp, Homo sapiens
gtataacgagctcattaaaatgattacagttccctggaacatgaacttgactccacctacccccactccttgctcctcaggggactacagctcttgctcaaaaaacaggatgcctttctcaacacatttcctttctgcatttttccccgtttagttctctttgaagcaggagtgtaggcaacccttttctgctggatgcaattgactttttttcttgcaatgctcagcgttagagcaccaatgacactagtaaaaagtggcactggcgtgccccggcaaaccagtttggcatgaaaactgactcttggtccagcccgggccagcaggtgggctgactgctggagctgtgcccttcctccaggcacaaggtgctgtggcaagtgcttggcagagccaggcacgcagctgggggcccctcagactgctttgggggatgtgtatgtcctcatcgtgggaaggtttgactgctgatcagaacacatccagttcactgtgttttgttctgggggcccagctgtaagacaggctatctgtccatcatcattcaaatgtatctactttctgg

SEQ ID NO: 271682 - DNA, 358 bp, Homo sapiens
agaatctgctaacaatttggggggtatctttccttcctttttaattaatacacaaacatatatacgtgtgttacataaggggtgtttatttgcttttttcacttaatacgtggaagaccttttctctatcgtttgaacctaaagcctagaaggcaagaaagcaactcgttagagagttgataaagtatcactgcagtggccagtgatttggatagaaataagctgaattcagggtaagaactggtttctataaaatatggtttactctgcataataattggaggcagtgttttttcaaactgagtttttttcagccggttcgtgaatggtgaaattaatttagtcatgactagcattt

SEQ ID NO: 271683 - DNA, 464 bp, Homo sapiens
gcataggccctttctctcatctgtgtttatctacccccatgtagaagccatactaagatcaaaatcaaagatccaactgagacccacttttctgatggtagatcgtcttctctgggttgctttccttttggtttgtcttcctcttgtctttcttggtggctgctttctgctgttttctgctatcagtcttgataattgtcttattgggtacagcaagaaacacttgggcagaaacacctcccccaaacagagcaatctggtggagtctaggggaaagtgggtggaataaactgtttcaacttttaatctaggcctaaatgtagatacaagaactgattttccaatataggtcagccaagatcactacgtaagagaatccgtggatatttgggacctagctactggtgatatatgtgtaacagggcctggatcctcatgccccactcctcccaacactcttgaaa

SEQ ID NO: 271684 - DNA, 98 bp, Homo sapiens
gcatcctccaaacttggaagagttaatttcccaagccttagactggttggcttaagattgaactcagggcaaaagcacctggaagcttgacatgctgg

SEQ ID NO: 271685 - DNA, 385 bp, Homo sapiens
cctcagtgggaagctgtggcttgaagatgactgtaaactctctttccgcctcttcaatcttgacaggccccagggctgctaagctaatatggcagaagggacactgtgccagttgcaggcccaggccttaagagactggcagcttcccctctctgtctctggaaacctacctgcccttctgtaaggaagcccaagcagctctggagaagcccttatggaggggcccactctcagcccacagccagcaccagttgggcagccacgcagacccccaacctgcaagccaggcccgctgaggcctcagtacacacaggcagtcccatcagccctgcccagatggcagttttgtgatcaaaatatagacgatagatgattgttttttaag

SEQ ID NO: 271686 - DNA, 514 bp, Homo sapiens
agaattttattatcctagaaaatttccatttaccattttataattaccctatcccattgccagcccctgataattactgatctcttttctgtctctacagttaagaatgctggcttcttttacttagcataatgcatttgagatttatccatgtattagtagtttattcctttttactgtattacagtactccattatgcattttatatatttatcagtggaattatttacagttttggagattgtgaataaacctgctataagcatttgcctatagatttctgtgggaaaataaatttttatttatcttggataaatacataggaatgggatttactgagtcaaaggttaagtgtatatttaactttggaagaaactgtcagattcttttccaaaaattgcctctcattgttgtgagtactttgtattgtgagtctctttattattgttagccattctaatagatacatagtagtatctcattgtggtggttctattttgcattcccatgaca

SEQ ID NO: 271687 - DNA, 225 bp, Homo sapiens
gaggaaggaggtgggaactggaaggtgggaggtgggagctgggaggtggaaactggaaggagggaggtgggagctgggagctggaagatgggagctgggaggtgggaactgtgaggaaagaagtgggaactagaaggtgggaggaggaagctgggaggtgggaactgggaggagggaagagggagctgggaggtgggagctgggaggtgggaactgagaggaggg

SEQ ID NO: 271688 - DNA, 297 bp, Homo sapiens
gccatcatgtccttgggtaggggaaatcctgctcacaccaagaatggctatcctcattctggggtggtggtctcctgctatctctgagagcccccagaactctgtggcttctggggatgtcctgggagggaggattctgtctatctagattgagaaggtctggtccctaaaagcctgtagagaaaggcagccccttgcccccctggagggatgctgctggcatcctgccagccagctgtcttctccctgcattacttcataggaactaggaactgagagccagatctaatcccggcc

SEQ ID NO: 271689 - DNA, 415 bp, Homo sapiens
gtttcttttctgaactcgtctccgtcctccgtgctactcgcttctcttctcgaattctcggcgtttctaattgctatttttaatatattccaaaagaggggtggttctgctagcaatgagatgtgggaagggcttccagaatctcatctcgccttcctgcatctcatggaccggaggaggggttaaaagggaggaaggtcagatgagattgggtatgagatgttggaaggcccttcctctgtcaacgccatgagatgttggaaggccttccaacatctcatcccacaggtacctttttttgttttgttttgttttttttgagacggagtctcgctctgtcacccaggttggagtgcagtggcgcgatctcagtttacttcaagctccgcctcccaggttcacgccattttcctgc

SEQ ID NO: 271690 - DNA, 425 bp, Homo sapiens
gagtagaggagcacgggaacaggatgatggcttggaaggggcatcatttaagagttaaagaaaccaggggtgcaggcaaagcaccccacacacccagctgcagtcctacaggctgcaacctgaaaccttcacatctactctatcaagccccctgggctagagggctgttgttgcacggaaggtgggaggcaggagggtaagggaagaaggcagagaccccaggccgtgtaatcagcagcaaggtgattgtgtgatgtgtcttttcacagttgagttagatgtgccccaccagttatgatgggaatcaatttaaatacactttcttgatcccagaagttcaactacatggacagtggttacacttgacaggatgatttattatagcacaacttatatatttcaaatggacaaaaaaaagtaacatt

SEQ ID NO: 271691 - DNA, 347 bp, Homo sapiens
acctagttgagttggatttctgtcacttacagttaaaattcctgagtaatacacaggagaactagttaacaaattattaaaatagcccacccctaatttaatcaccatgtgcaaggacagtgcttgtatgtacacccaggtatgtctaattctaatagctagaggtagcaaatatggtaaaaattgagccaagtttgcactagcctcttccattaagcaggaattcccaccttagctctgaagccatgtaggacagggctggagaaactactattcctaccaatgtttctaatgtgtgcagtaggctggggtgctggcaggggaaaattaaaaatgtagtttgggtt

SEQ ID NO: 271692 - DNA, 184 bp, Homo sapiens
ctccccagccattccatttcttcagtgggccctttattgatatctgtgagatattagagaaagtgtctcagagaggctggaattttctgtctgggtgcagtgtcatatttatgtgaacagtggcaaccataaatggccacacaatgactctatttaggttccctcaggtagaaagtactacggc

SEQ ID NO: 271693 - DNA, 335 bp, Homo sapiens
gtttgaatgtgttatatgacttattcaatttttccttttctgcaagcacagtaaaaattctcttggtaaggactgagactcacttactctattatcatatatccaggactaaacagtgtctagcatatgtgaagaatagtaaataaatatttattgaataaatgttaccatgtgatctttcttgagagaagcagtgacacaaaaattgaaaacgtggtccaaatccaatttggactctattttcatggagaatttgaggtcaacttattaaatgaatattcaacatattctgcagaatgaaaaataaatcattgttatttttcaaactgtttcag

SEQ ID NO: 271694 - DNA, 464 bp, Homo sapiens
aggctttcaactttgaaaacttcatgaagtgttttttggcataatttcccaaatggctgtggaatatgtgaaatattccttatttctctatggtgacaaactataaagtagtccttttacctttaaagacagagggacatggtgtctatagctttgccttgacgttctgcagagcaattactataatagtttcaggtattgaagatattttaaagaataaatttcaaatttgtaacctaaatttaggagactacttggttcactggtcatctgtatatttgaagaaatttttaatattgttatatttgttttcttattttaaaatatttaattgtcagccaggcatggtggctcattcctgtaatctcagagctttggaaggtcaaggcaggaggatcacttgaggacaggatttcaaaaccagcctgggaaatatagcgagactgtctacacacacacacaca

SEQ ID NO: 271695 - DNA, 374 bp, Homo sapiens
attcgggaaagtccataattggccatggttacatccccactctgggcctcagcaggaaggatggtcttaacaaatcccacggcaaagtcaggtttgatggaaaagtgaccatgtggacagctgtccttggttgggtaagtgtgagtccaaccacagcatgcatatggcaccctcattaacatgggatgagaggcacagctgctgataaggaggaatgcccacagcatcctattatgagaaaaaggcaagtccacccaaaatacgtcaggcctcaaaaatagacaaaagtaccaggaagagaggttgattattggttacaaatatacagtttgacagaagaaataagacctagtgtttgacaggtcagtagttaa

SEQ ID NO: 271696 - DNA, 566 bp, Homo sapiens
agtggagtatttgcagggttggcctggagcccagcatgcgccccctcccacacatccaggacagggatctggacggctgtgggttcagatcccctggaaagtgagagccgtttcttcactagatactttccctccagtgtcccagtattggtggccacagtgggagccccttacagctggctcttgagtcttgttgacacatcccatcattctttgtggccggtgtctccacaggcaccagtgctatgattgatggctgcacggaatacccttactggcccaaaccaaaggcccatccagcttagtctgcctgagaaggaccaaagctgacgtagctttccatgttttctgcctgagagaacctgtgcagctctccactggcacagtgaaagcatctcctaggggtgagttcaaaacagttccctgacatgtcttggaaatagtgctactggggacaaaatcaaaactaatgttacctggggcaatgggaagtgcgttctgcatgtaatttacactggaacttgatatgactactgtaaaaactataaatgaatatgatccataat

SEQ ID NO: 271697 - DNA, 374 bp, Homo sapiens
agtggagtatttgcagggttggcctggagcccagcatgcgccccctcccacacatccaggacagggatctggacggctgtgggttcaggtcaacaaatgtccatggagtcacccatcaatccaaggctcccagcagaaggcagacagtgtgacttggctacaggctttgccattcgctgcctgtgagacacaagcaagtaggcgaagatatccaagcctcagttctcatgaagcatcagaatgatggtatgattgagcatggggctgttggaaggataatgagtaccgctggcaggagccaaaggttcaccatcacgctgctttgggggctgagcaacctttactgataggcaagatcactgacatagacatat

SEQ ID NO: 271698 - DNA, 614 bp, Homo sapiens
agtggagtatttgcagggttggcctggagcccagcatgcgccccctcccacacatccaggacagggatctggacggctgtgggttcaggtcaacaaatgtccatggagtcacccatcaatccaaggctcccagcagaaggcagacagtgtgacttggctacaggctttgccattcgctgcctgtgagacacaagcaagtaggcgaagatatccaagcctcagttctcatgaagcatcagaatgatgatcccctggaaagtgagagccgtttcttcactagatactttccctccagtgtcccagtattggtggccacagtgggagccccttacagctggctcttgagtcttgttgacacatcccatcattctttgctgacgtagctttccatgttttctgcctgagagaacctgtgcagctctccactggcacagtgaaagcatctcctaggggtgagttcaaaacagttccctgacatgtcttggaaatagtgctactggggacaaaatcaaaactaatgttacctggggcaatgggaagtgcgttctgcatgtaatttacactggaacttgatatgactactgtaaaaactataaatgaatatgatccataat

SEQ ID NO: 271699 - DNA, 406 bp, Homo sapiens
aatgaaccaagtgccacgagagaggattatgtattcagctctgtgagaggatggttgaggggccatgagttcagcttggacggttagtcttcctgggcctgaccattcagaatttccaacagtcactacttgccattagtagttgcctcagcactgcttggagggagtcaccttagatgtggtatttatagcatcatggttaagaatttatcctctcaagccaaactgctgtctttacaaagagtaaacaaataagctccctagcacctgtgctcccagctactagggaggttgagatgggaggatcacctcaagcccaggagttcaaggctgcagtgagctgtgattgcgccactgcactccagcctgggtgacagagtgagaccctgtctctagaaaacaaaac

SEQ ID NO: 271700 - DNA, 470 bp, Homo sapiens
cagtcaaaaggaagtgaagagacacagaagggaagcaagatactgagatgctgccaagtatcccagagtccatgatggagtagagatgaaacaatagacccaggtcattcctctgctggaggttctgaggcaagcagtagtgctctgcagatgaacattcatgacaacttgcctttcaactggaggtgtgtgacagccagaaaaataccatcgaggtaaagcttttttctcctagaggagcaactgactcaccgcagcatgttgttatgtggacctcgagtctgtggactagtgaccttcacctccttcagtgtgtgggtctgtccagggcttccatccctccagtaagaaccctaacccacattcctgcatttgataactttgagttaaatcaagaaaagcttggaaatttggacatagttgtttataagtcactcatattatctattaaagtctaaaaatgttgtagt

SEQ ID NO: 271701 - DNA, 476 bp, Homo sapiens
gcacatgaaacaataaaatataagtttcagctatcaatttggtaaaggttaaaaaaatcaaactatatcgtattctcagcagtagtacaggtggtataggtgagatgcttatgtattaattatttgcttctctatataaattattgattatcacaaaatcccatacataactatttggagattaacatgtgaaataggccgggcttggtggctcacgcctgtaatccagcactttgggagggtgaggcgggtggatcacgaggtcaggagttcaagaccagcctgaccaacatggtaaaaccccgtctctacgaaaaatacaaaaattagccgggtgtggtggcacccacctgtaatcccagctactcaggaggctgaggcaggagaatcacttgaacccgggaggcagaggttgcagtgagccgagattgcaccactgcactccagtctgggtgacagagaaagactctgtctca

SEQ ID NO: 271702 - DNA, 263 bp, Homo sapiens
cgccagtttgatattgggtgctaagcagagtggctaatgtctgttttatcacatgtattttgctctggccagaacgaaaaaaaagaattttcctttatgatgaggcttgcccgaggtcaattgtgccacaagccagatcactagggtcgctcagggaaagggaacccagaagcctggcatgctggcaaaagggtaagaatttcttacaagtcagatttctggcttctacctctgtgtgaaaatggttgaatgaatagttaaaa

SEQ ID NO: 271703 - DNA, 421 bp, Homo sapiens
ttgtgcggtgtgtgtttgtggttttggagggggctactctgatggagaagttcagtgccatgcatgtggagtccttgtcaacccctctgctaccactgggcccagacagtggggagcagatagagccataaaaggcctcatgttatgaagaggatcgtggttctggctccaggtggagtccggcagactcaggtccttcgggcagcagcttgccttctgagggccgcgtccgttctcctccactcagagtgacaactgtggcagcgagccaggatctggagagtgctgtcccctgagcacaggaagccctctgatgacaaaggtctagcagtgacagcaacctattgtatcatcactgtaataacccagggctcatagcccagtgtctggcacatggtaggtgccaaggaaatgctaagaa

SEQ ID NO: 271704 - DNA, 590 bp, Homo sapiens
tctcgccagagtgcaggcgctggtgctggcgcagctcggagctgccgcggaaggccttgccgcattctgcgcaggcgaagggtcgctctcccgtgtgcgaaagccggtggtgcgccaggccggaactgccgcggaaggccttgccgcagtcggcgcaggcgaagggcttggcgcccgagtgcgtgcgccggtggctcagtaggttggagcgctggctgaaggccttgccgcactgggcgcacgcatgaggcttctcgcccgtgtgcacgcgccggtgctccgccaggtaggagcccatgacgaaagcctggccgcactcggcgcactcgaagggccgctcaccagtgtgcgtgcgctggtgctgcaggagctgcgagctctcgcggaaagcctttccgcactcggcgcaggggaagggcttctcgctgctgtgcgtgcgccggtgctgccgcagccccgccacacgcacgaaggccttgccgcagtcgggacaggcgtgtggccgtgcgcccgcgtggatcttcaggtgctcggccaggttggagctctggctgaaggccttgccacagtcccggcaggcgtgcggccgc

SEQ ID NO: 271705 - DNA, 353 bp, Homo sapiens
agccactcctacctgcctctctcttccccactctcaataccctgttcccaaacccattcattcccatccctgtcaccagtcccagctccacttctgcgcctcaaccctaacccaccctctttaccaacccctttctcctcattgcctgtgtacctcagcccatctttaatgtcctctgaatctacagccccaaagagctccatcctcaacctcagccacagccctgtgtccatccccacaaagaaccgcattggccccacatacccagacacctgtgactccccaccccactgcctgctcttcaggtagaaagccctggttgaacaataaacgcatgactctccctgaatctt

SEQ ID NO: 271706 - DNA, 404 bp, Homo sapiens
caaaaatagaacttcttgtaataactggtgatcatctgtgatatgattcttatagtggctcaaagccttgcctccacaaaatatatttccaaagcagcaggtaaaattcctaccattacagaaataagttaatttggagtaaatcaattctagagtaactttaaatcatgcatgctttaatatattccagtggcacattagcagagatcaagatccaaatacaagattaattatctacactgcactccccaatctggaggtcactagccacatgtggctattcagcacttggaatttggccagttctggaaatggaaaacacacagatttcaaagacattaagatgaaaaatggtctgtaaacgatcccatttattaatatattaaagttattttagatgtatt

SEQ ID NO: 271707 - DNA, 497 bp, Homo sapiens
caatatcaagtatttcctgatgtagaataatattatttaaattttatatataaaacacattttgactccttacactataggcttcatgactgctttttagttctcacctgacattaaacttgtgggtaaaaaatacacacttctagcgatgaataaatttgatgtagtgaaaacagacaaattttttatattatgttatacctctagcataagtaacagatgttattctcttcattttacatatacggttctcttgagccttgtttcgtacagcgtacacaactttgataatagattatttgagcatttatcataaatgaagcagaaaagaatactgattttgttaactgcattttatcagaatatctcccaagagaaaagtttctaaagtttttaataggctattaaactgggggacatgaatacccattaattaacatgcattattcttgttactatgtagtaggacaatttgacgaagggcataacttaaaaaa

SEQ ID NO: 271708 - DNA, 636 bp, Homo sapiens
aaggcattttcttatttatcatttaggcatttgcagtgtaagacaaactcccttgtttgattacgcattcacctgttcattcattcattcattcaaggatttattaggaaattatttgtgctggctgtgggtacaatgatgaacaaaagcttataccctggcctcatatttatgggtgcagtagacactaatcaaatggtcacaaaatgtgtatcttatttcactgattataaaatacagatttttcacattttatcagggttcatgttataattgatgatctactatatattatagtttaattgatagcgtattttgtgattcataaaatgagttttataatagaattctataattaataaaatatagatatttacataaatttatagtgtatctatgccttttttttcttttttagagatgggatcttgctattttgcccaggctggacttgaactcccagtctccagaatagctgggactataggtgcacaccaccacacctgacagagtatctatgcttttgagtgactacgtgtgctacaagaatgatttaattgaatccttcgtttatttaacttaagagcagtcaatcttgctacattatttttgtctgagagcgaatattgtggtata

SEQ ID NO: 271709 - DNA, 399 bp, Homo sapiens
caggagatgtttcacagagccgctgaatgaacaacacagtcaattctgatcaactttccagtgctatctggggggatttgtaaactcggcgaggagagcatttgtaaaagggttaagtaccccagttttctaactgaattactacaccattaaaatgagctccgcacaacatggcagcaaataggcttctgtctgagagacagagaagggtgtatatggcttctttaccaaatcggagagctgaaaacccaagcagagtcacgtcctaggagtaggcactgaccgccacagtcacctgcccgtcctgtcaagcaacttttcccagctaacctgagttcccatcctaattctttaaagcactgaaaagtttttgaaaagaaagacacaagaaatatttct

SEQ ID NO: 271710 - DNA, 194 bp, Homo sapiens
ctgcagtaatgctgagtaataaccctaaaatgtggacaacaacccaaaacataacatggccaaaatcccttcctgcatggagctcacacactcctcatacctctgctaaatcacttgtcacattgctttaacctcttcgtgggtttcccttccccaataaacagcgagagctggtgcaaaatggaggcccagaa

SEQ ID NO: 271711 - DNA, 410 bp, Homo sapiens
tacagcagaaggtatctgctgagatcacataatttgcctcagattatgagatctaaaataaaagccttgttttgtttttgtttttttttacttttttatttccagtgactatcttccatcgctgttttttttttcatagtgtgcgcatggtcacccatcccactcgccagcgtgttgccacgtaatgctcacctagctccgtggttttaggtttctcttaagacgtcgtgtgtgttgttttgtttcttggttagatttagtagtagaatttcatcatgacattaaacctctattttcatcccatttcattttatatctaggtcgatggatttgaaaagagagttttatcaaaaatatttggataatattaataggatagaaacttttgtttcattaggctttgtgtttgt

SEQ ID NO: 271712 - DNA, 521 bp, Homo sapiens
tcagcctggaaggaatgggagtttctgcctcaagactgatcctaggttcattcccattttctcacccaacaaagtcctggcatcttggctccctgatgttgatgactgaagacacaggttgttacctgtttccattttttaggtggagtacttcttttttcttcttgaatgtttagaaagcatggtcaagttagacttatcttgcaaatgtcaatatagatcaaacaaaagattgaatatgaaaaaggatttatgatttggaggtttggtttggtgattctgttggaggaattctgatgtgaagattaagaagcttgctataggcaggatacttaatggaaggacaagaggtagatggagcaaaagaaaaaaaaaatccttaaatcccagagttaaaacaaggtggtgcttataaaaatcatacttgctttgtataaaattttatcatctataatttattaatcagtaaaactgtaggtatccttgatgccaaaaaagattaaaattctatttttcctaaa

SEQ ID NO: 271713 - DNA, 186 bp, Homo sapiens
tgtgtgtgtgtaaggggtggagtggggtgggggtgggtaagggattctactctcatctggaccttggatttaagagaacgtctctatcccctttcttgtacaaagaccttaaaaagcatccacctaacacctactccatcctcatctctctattggtgttaggaatacagagatagatctgatatc

SEQ ID NO: 271714 - DNA, 701 bp, Homo sapiens
ctcaagtgatccttctacctcagcctctcagtagctaggactataggtgtgcaccaccatgcccagttaatttttgaattttttgtagaattggggtctcattatgttgcccaggctggtcttgaactcctggtttcaagcaatacttctacctcggcctcccaaagcattgggattacaggtgtgagtcactgtgcccaaacttagaaaatatttgaataaataaatgaatgaataaaacttcttggaatgaggtaggaaagatggtgaaggatgtaaaggttgttcagtgtcaggcaggggagaaatgtttcaggagcagggaataacaggtagaactgaacaagctgtattcaaggggtccaggcaagctagctcaaaagaagacctgtgtaattcagatgtgggatagataggctggctgtgatgggaggatggttgtagcagtccttgaaagtttggctgacatagtaaaagtaaaattctttagtgctcattgagtcgttatagatacttggacaggggggctacaaattcaagctttaggaaagcttttcaaataagaatctaatctggattgagtttgtaaagccttggggcagaagaccagttagggaggtacagcagtggcccagagaagagataataaaatagtcaagggaaaattaagacacgaaatcaacagtacggcaatgacaatt

SEQ ID NO: 271715 - DNA, 509 bp, Homo sapiens
aattcataactagtaggagtgagtgtaaattgatattaaatttggagtctaatttgataatatctagtaaaatttaaaaggaaacatgaataaagatgttcactgtgtcactgattataattgtaaaaaataacccaaatatatatatcaataagtaaaaggaaactttggtgtattcactacatggaattttgtagctgttaaaagaaccggacttgggctgggcggagtggctcacgcctgtaatcccagcactttgagaggccgaggcaggtattttgcctgaggtcaggagtttgagaccagcctggccaacatggtgaaaccgcgtttctactaaaaatacaaaaattagccgggcttggtggcatgcgcctgtaatcccagctactcaggaggctgagacaggagacttgcttgagcccaggaggcggaagttgcaatgagccgagatcgcgccattgcactccagcttgggtgacagagggagactccgtctcaagaaaaga

SEQ ID NO: 271716 - DNA, 387 bp, Homo sapiens
ctcttaaacgatagtctacaagttacaataacacttaagacttctgaagtttcaatgataaatctctgtccaaaatagtaacacttaaggcaggtacagttgctcatgcctgtaatcccagcactttgggaagccgaggcgggaagatcacttgaggccaggaatttgtgacaaacctaggcaacataacaagacctcatttctaccaaaaaaaaaaaatttttttttaattagctgggcatggtggcatgtgcctatagtcccagttacccaggaggctgaggtaagaggattgcttgagcacaggagtcaaggctgcagtgagccatgatggcagcactgcactccagcctggatgacagaacaagaccctgtctcaaaaaaaaa

SEQ ID NO: 271717 - DNA, 634 bp, Homo sapiens
agattacattcttattcactctctgaaagtttattgccagtctctgagtagttacaaatgcattattaataatccttagaaaagcaatacattgttgcatggcttaagctttgctcgtgtctagaaatttggaacagttgaacctgacttcatttcactgcctcttaaaacttgatccccctgaaacaaaacctaaagaagtattgtgtttctccctctaaattcagtgaatctacttgtcatttattcagtggtatttgaaagcttaagttggcaaattagactaatattaaaaacttagatatgcctctcttccttccccatctttgagagctgttactgagtaaaggagcaaatgaaaagggatgaaactctctggtagttaagtagtgtatctaaactaagtggagtagatactgcctagttgtaaacttcagccagttgtctgttgagaaagacaggtgcaggggcttttcttttttatttttcatgcaacaacttacttagtgtataacactgagctatccctgtttggaagaagccagaggcccagaaaatttttgctaaaggaggggttgctttatgtatctcctttaaagggagatgggtaggacaggattcagatgctcctgag

SEQ ID NO: 271718 - DNA, 211 bp, Homo sapiens
gttaatgtcgtctttgaccacacacctccttttgtgggttggcgatacttttatttatgagctcgaaattctccacttagcacactattaaggtggaaattggaaggctgatatcagtggcccagattcttaacaaggtattcatgcctactaacgtacgagaacttcaggtttaggccacgtcgacgcggccgcgaatttagtagtagta

SEQ ID NO: 271719 - DNA, 126 bp, Homo sapiens
tccttgattttaaagatacctagcaggggagaaaaaaaggttggctggagaaaattaagtttcacaaaactcagaacagatagcagatagtgggagtggagatcccacattgaatgtggacattgc

SEQ ID NO: 271720 - DNA, 296 bp, Homo sapiens
ccttagtgttctaatagtttggatattttaatattccattctgtcattggcctggatcctgcttatgaatgtggcggttgttacaaggaaaacttgggactgtaatgtccgcctaaactgggaaggcgtcaagagaccaaagaataatttgggcaagtccagcttgatgaatagatgagtttactagaacttacattacatactggacattcctgagcagctctagagtcaccctgcctcccatctctaagcagcctttcagctaatgttttgtttgcctactctgtgtgcgcgat

SEQ ID NO: 271721 - DNA, 224 bp, Homo sapiens
aagaggacttgacagcaacatttgtcataaacacttcatcataaatttgcctggctattagggtggccatcagtgttagttaattgattatatacgagggaaaactaaacctcacatttcttaatgacaggagatagttttgcaacttacagtgaggtgcctacttagttacccttccactaaaatctgaagataatagcactatcttctttgactacatttca

SEQ ID NO: 271722 - DNA, 249 bp, Homo sapiens
tcttacatgcattttcttttcctagtgccttatttccctagatagaaaaagtactattgatgattttaaatacctttgagttagttaatttatgttaatttgggttttttggagaacatgtttcctgaaagtatacaagatttaacatcaaaatctatttgctaagtttactaggagaagtctgttaggttttgaaattatcatggaagtttaatagatgctgtcgatcattcacatgtttagatgctt

SEQ ID NO: 271723 - DNA, 482 bp, Homo sapiens
acagactaggaaaatcagcatgactacagcgggaggtttttggacagtttaaaaaatttttttgaaatagtattagatttacgcaaaagttgcaaaaattgtacagacagttcccatgtgcccttcccctacctgtctggtgtcagcatcctgcatggccatgggaggactgtagaattaaaaaattagtatttgcataatgctgttgactaagtggcaagctttactctgatttcaccagttttcccaacaaggtcctttttctgtttcaggatccaacccagtgcctcccattgcatccactcctcacaccaccgtctccatggcgtgacagttcctcagtttttctttgttgttcatgaccttcaccttttggaaaggtactggccagtcactttgcaaaatgttcctcaatttgtgtttgcttgatgttttctcctgattaaagtgatgcattttgggcaagaacatcataaaagcaa

SEQ ID NO: 271724 - DNA, 403 bp, Homo sapiens
ttttttttcttttgcctctagcccagttttagaaaggactatgtcttggtccttcttaatggtataaaagatatcctcagcccgccagatgctcctgcatttgagtgacgacacgcttctctggctgtgaccaacttttctccctttctttttaaatgacaggacttcttgttcaatacttgctggatatgaagatccaacccagtgcctcccattgcatccactcctcacaccaccgtctccatggcgtgacagttcctcagtttttctttgttgttcatgaccttcaccttttggaaaggtactggccagtcactttgcaaaatgttcctcaatttgtgtttgcttgatgttttctcctgattaaagtgatgcattttgggcaagaacatcataaaagcaa

SEQ ID NO: 271725 - DNA, 452 bp, Homo sapiens
aatagcctttgggggagaaaacagcattcgtttatttctgctttatattaaaataggggtagtagagggatttcttacttgaaggaaaactttatgtttgctttttgctgttaacgtttttcttaaaaaaggggtagaattagcattttaaagcatgtatctattctacaagcatgaatattgacttattttagcatgaattgctgcagtgtaattaatttactttgaaactcagctgcctttttcagccagttagggggatttgagggtggaagggtcctcttccagtaagaacttcaatattttcttgtaaaatcacccataagattgcatattgtttagttggagtatgagctggttgtctttcttaaggaaaaggaaatagaaatatccctcataagatatccaaagcaaaatcctgaaaatggatttgttgtattgtctttttacag

SEQ ID NO: 271726 - DNA, 528 bp, Homo sapiens
cgatgctaaggccactctgggagagcagggcacacgggcaggtcccagcgcaggactggaacgggactgggctctctgctgccctctgctgccgagccagggaacacccccaggacccagggcttgtgcccagctcggcaggacaggtggtgctccccggtatcagagctaaggtagaagacgccactggagggtttcactcctacttccccaatcttgcctgagtccagatattgtccctgccatttcttagctgtgtgacctggggcaagtcgctttccctctctgtgcttcagttccctcatctgtagagtgggaatgataacaggatctaactcatgagattgctgagggaattaaatggcttaatcctcccgagtatgcagcacagcgcctgtgcagcagcagtctctaaccattagctattattattatttagttagttagtatttttgaggtggaggttgcggtgagccgagatcaagccattgcactccagcctgggcaacaagagcaaaactccatctc

SEQ ID NO: 271727 - DNA, 547 bp, Homo sapiens
caggctacgtgaaatatttgtaggaaagattctcatacttatagttacttttgcaacccaaacagtgttttacttgacttctatctgatgattaagtctttccacagatgtaaggagtaacttgcttggttgcctcctttttaacaatactcctcatataaagtacttaatgtcaggtctctgactttgaagaaggaacagtgatgttaattttagtagtttatatagggaagaggaacaatcactggtagccaaacaagtacctatattatgaggaaggaaaaatacatgactactaccaggtttagagatcaatccagagatgctaatgaaagtaacccccaaaaattcaatcttcaggcaaaattatttactcacatgcattttgaattaggtagtaaggtttctatgtttgaatgactgttttttgctatttaataaaactttgtattataaattttattcagcaagtaccaaaattacaggttctgaaaatattctggatattttaatgcattaaattttagtatatgaagcattctgaaaa

SEQ ID NO: 271728 - DNA, 438 bp, Homo sapiens
tcaagtaggaaaaaagtcacaagtacttgcagacaagccaatcaaaattgaaggaaaaatagaatcagcacctagtgtaaattaacttcagaaatatgcagtcaggactgtccttgcggacttgcattctagcttctgagctgaaatttgtgtcattaaactgatatctagatgatgtacatttcttgacttactacaattcaaaaaaaatgaaacaaattacatgaacacagtggctatcatttcccccttgtgaatggcatagtaccagtctatacaattttggatgttgtctttctgttgactgttagttactttagactacaaatctcagaacatttaaataatgatttgttacattactctaaacctaattattttatattcactcacaccatcccctctgttggttctgaaataaactattcaaaggagtgc

SEQ ID NO: 271729 - DNA, 423 bp, Homo sapiens
ccagggacttttcactgctaagtttaagtaacttgattcggatctgttgtggttcccacagccttcaaatactgtggaagttttaatttaaatcttcagataaactcttaatttttgagaactccttgatttaaataaaacatgtcggctgggcgcgttggctcacacctgtaatcccagcattttgggaggccaaagcgggcggatgaggtcaagagattgagatcagcctggccaacatggtgaaaccccgtttctactaaaattacaaaaattagctgggcatggtggcacgcacctgtagtctcagctactcaggaggctgaggcaggagaattgcttgaacccggaagccagagcttgcagtgagccaagatcgtgccactgcactccagcctcgtgacagagtgagaccccatctca

SEQ ID NO: 271730 - DNA, 524 bp, Homo sapiens
acaattgtatagacttttattgtttttgagatacttttacatatagtgtctcatcaaacctcagatttctctgagagaggttttattatctctgtttaataacatacaactaatacacagactaacaggcttgcccagggtgtcacagctagcaaattgtgaggccattgcttgaacccaagtctccagacttcaagtgtaatatctatggatatcagacttctatttataggattcactaggaagtctttacctctagaaaaagtatggtaatgggggaagctttaactattttagtttcaaccttcagttcttccaccctgtcaaccctcaatttatctgtgaatggattgctttcagatgatgattttttaatttttctttcagcagcctcttcaaaatctcttctcccacctcaaacaaaacctaatatgtaattctaagaaaatgtaaaatagatcaatggtatttattattactgtcaacaatataatgtcagataaaaagtatccaaaacttttgtt

SEQ ID NO: 271731 - DNA, 220 bp, Homo sapiens
gaaggcggaggcagcacccacgccaggtgagccgtcgtttctttgcgtggatcttttaggatcgctcgtctaggccgggcgtggtggctcacgcctgtaatcccagcactttgggaggccgaggcgggcggatcacaaggtcaggagatcgagaccatcctggctaacacggtgaaaccccgtctctactaaaaatacaaaagattagcagggcgcggtg

SEQ ID NO: 271732 - DNA, 467 bp, Homo sapiens
aacatactggtaacatgtcctgcaggctttaactcctattcttttttcatgattgttccacagtcttctttcctaaggactattatcagatccatatacccatgttagttagagtaaatgttaggcttctgtaacaaataaacccaaaatataatggcttaaacttaagtttatctctctcacataaaattccaggtgagtggttcagagctggtacaccacaaaatgtcttgctcagctcctatcatcacatcttgcatccctaccatcaagatggaggagaacatgcaacttctttttaagagtctggccttgaggattgcacatatcacctctacttatatctcatgttgtcccaaacaatgacatgaacaattgtagctgcaagggaagttgggaaatagagtctttatctgagtttccatgtacacagtaaaaaaacttctgttgctatagaaaagagaaaa

SEQ ID NO: 271733 - DNA, 439 bp, Homo sapiens
tctctttaaaaagcagatgatttggcagcaaaaagccctagattcccacgtggcacccagagctggagttgcgctcagagaacataagctccctgaagacagtactttgcttttctcaccctgtggccccagcacttggcacagtccaaggcaaggagaagggttaaatgcatggttgaatgaacgaggtaggctttaaatctaatgagaatttctataagaggaagagaggacacagagactcagggagaaggcgagctgaaggcagctgcagtgactggagtgatacagctacaagccaaaggatgccgataattgcccctggaaactaagagagaccctcaggtcctccaaaaggaaccaaccctgtcaacacctcactttcaaacttccagactccacaatgatgagaataaatttctgttgttgtaaaccaaaa

SEQ ID NO: 271734 - DNA, 405 bp, Homo sapiens
tctctttaaaaagcagatgatttggcagcaaaaagccctagattcccacgtggcacccagagctggagttgcgctcagagaacataagctccctgaagacagtactttgcttttctcaccctgtggccccagcacttggcacagtccaaggcaaggagaagggttaaatgcatggttgaatgaacgaaggaagagaggacacagagactcagggagaaggcgagctgaaggcagctgcagtgactggagtgatacagctacaagccaaaggatgccgataattgcccctggaaactaagagagaccctcaggtcctccaaaaggaaccaaccctgtcaacacctcactttcaaacttccagactccacaatgatgagaataaatttctgttgttgtaaaccaaaa

SEQ ID NO: 271735 - DNA, 518 bp, Homo sapiens
ggggcctgggctgccctgatagaggcttcctcttatgggtatgtacgggtagtcgggagaaagcctgttgggaagagaatgcaggcgtcgtccagaggcaccatgtcagtgacagaaggaagcattagaggtgcatatttattgatttattttttattgtggtaaaatatttataatataaaatttaccatctcaaccattttttaagtgtacagcctacagcattaagcacattcacactgtcatccagccatcaccaccatccatctccagatttcttttcctcttcccaaaccaaaactccgtccccatcaaaaactccgaattccccttctccagccctgcacccaccattctcctttctgtctctgagtgtgcctactatagggacccatgtaggtggaatcatgcggtatttatagtcacatcgtgactggcttatttcacttagcataatgcctcagggttcatccatattgtagcatgggtcagaatttccttcctttttaggctgatac

SEQ ID NO: 271736 - DNA, 596 bp, Homo sapiens
ggggcctgggctgccctgatagaggcttcctcttatgggtatgtacgggtagtcgggagaaagcctgttgggaagagaatgcaggcgtcgtccagaggcaccatgtcagtgacagaaggaagcattagaggtgcatatttattgatttattttttattgtggtaaaatatttataaattttttataataatttataatatttataaattatatatatttatatatataaataaatttataatatttataaatattataaaatttaccatctcaaccattttttaagtgtacagcctacagcattaagcacattcacactgtcatccagccatcaccaccatccatctccagatttcttttcctcttcccaaaccaaaactccgtccccatcaaaaactccgaattccccttctccagccctgcacccaccattctcctttctgtctctgagtgtgcctactatagggacccatgtaggtggaatcatgcggtatttatagtcacatcgtgactggcttatttcacttagcataatgcctcagggttcatccatattgtagcatgggtcagaatttccttcctttttaggctgatac

SEQ ID NO: 271737 - DNA, 407 bp, Homo sapiens
cagtccctgaatgagtgtttaaacaccattgctcaacccctcgacccttatctgagtttgatacttctacatactcccaaggactgtttccacttgttaccctgactttgtgtttcctcttcgtttctgacaccatagtatttgtctttatttcaagttttgctatcgtattagaaaaagatggtagtctgaaattggagtttatgagaatttagtaaaaggtcaaagatgttaactgggaagggaaatctcagttaacaggagatgattgagtatgctggagcagttggtgacaccagtaggcttaaagggcaggagagagagtttatcagaacagggaataaatacccagacttcattctccacttcctctgtctcctgccactgtttctcattgaccgaaacca

SEQ ID NO: 271738 - DNA, 476 bp, Homo sapiens
ataggggcggcactgtaccttatggaagtggtaaataagaataaataataaattctaacacaggcaagcattcattaacaggcacttggtagaaacttctttcttaaggcacttcagccacctatttattccctgatccagtaatcccactcaagataattaatccagaaaaatcattcagaaagagaaaaaaaattatgtgtacaaacaagcttataggcgtcttattcacagctgtgaaacactagaaatgatgtgaacatagaaaaaaaattcaagtaaattatatcaaaatcttgttatactgtgtagccattaaattgataagggccacgcccgtgtagaaacataggagagtatttttaatgtaaataaagctaaaatttaaaaattgtgagtcatatgattatagtctattcaaactatgcctgtgagaatcaaaacaagaaaagaataaaaaaatagattttgttgaa

SEQ ID NO: 271739 - DNA, 315 bp, Homo sapiens
actaatgtggagcttgagaaaaatagaggcatcagaaatgatgcccagattttgacctgagctcttcagtgaatgttggtgacattttctaagatgtggaagaaatcaagaaattaaaagttattctggacatgctgaatttgagatatcaactagatactcaaatggagacatcaggaaatcagagaccaggaaacagtttggggctgaagatggaatttgggaatcttcagccataaagaccagggactgggatgaggtctcctaaagagttagtattatgaacactcacataaactgtggaccctgagtgat

SEQ ID NO: 271740 - DNA, 1189 bp, Homo sapiens
gggttcgtgatcttttcctaccactgctcttcttttccccaagaactgacaacttgaggtttcatctttcatagaagggtgcctcattgtcagaccaccacagcaatgggctttccagccagatcctatcagcaacagacaggatttcatgctgtacaatgagtcactgccatttttcttgcattattgctcccgactctttccatgcccagctgagggctgtgcgtctcagtggggcagataaggaggctgcaatatcctgttgtggccctgcccttggagataagagcctttctctccggttggcaggaggaaaatatcactgctgggtaatgagagaagtttaaacagatcagccccataggagggaactcataagactcctagcaaacagagctcctctttaaccttttgtctccttttatcaacaaatgaaacttgctgtaatttcctgtccttttctcaaaattacttttattaaaacctagaaggaaatgaacctgggtctccagagcagtggaaagttgtcatccaccaaccaaatgcctcccaggacgccccccaggtccctcaagcttctgctgcctcctcggtgcacatccctgaaaccaagtagacaggaggtgccctagggccttgggaagactgaaaagtttcccagtaggagagtcggccagactggcgcctcactgcaacagccacctttatttcggtatcaattatgaatccagccgcatggccaaatccctggccattaaggtggaccctgttcctgttcaccagtcaggtgataaaccaggacatgcatttgaaaaagaaagcaccatttatgacagctcagggaaaatgcagagtgtcctcctctgccactcttggtggtttaaacctcttattttctccttgaaaataaggtagcccctaacactgatgcatgcagccagagccggttgttcacagtttttacccaggatcttccagctacgggagcctgtagctgttaggaatacaatgaactttaaaaataaaggagctggtcggggtgcagtggctcacacctgtaatcccagtactttgggaggctgaggcaagaggacggcttaagcccaagagttcgagatcagcctgggcaacgtaatgagacacactgtctctacaaacaaaattttaaaaattagctgtgtgtggtggc

SEQ ID NO: 271741 - DNA, 439 bp, Homo sapiens
cttcaaacaacatttcattgaactcccacgactcaatgaattcatttctattgcagatgaagcctctgagaagttaggtaatttttctctaggttacagtgcaagtaagtacaagagccaggactaaaactcaggcttgttagaagtgtccaaaatccatgttcctaatgacttgtagcatgagggttcccagaagctagctctgagatggagatttgtatgcaggagatttacgaggaatgtgcttcggatcaacacctgtggaaagaatgagttggaagcaggatggggcagatgaagaagctgagcactgatgaagtcccagtgaaagcctcagctagcccccagggaactctgaagctgggatggccctttagaatcatcctgttgtgatatagaagctggaaagaggagaaacctataaaataattaagaaaca

SEQ ID NO: 271742 - DNA, 339 bp, Homo sapiens
aaaggcatagaggactttttagggtgatgtaaatattctgtgtcttgattgcaatagtggttatatgactctacgtgcttgccaaaattcaggtaactctacaatgtaagaagggctaatttcagtgtacataaattaacttcactaaatctaaccagaaatatgcattaaaatatcagtaatgtcataatcatatgcagaaaaagtaaagtatgatcaatcaaattgtttaatttttcaaaatgatccttgagggttttttattccttgctcatattaagagtatagcaccctagagatataaagcttgccctctgttgttaatcttgaaattaaaaa

SEQ ID NO: 271743 - DNA, 178 bp, Homo sapiens
ggaggggggatcttttgctacatggcaggttatatatattttttaaaagctacaatgcaagctaatgctttttaacaacaaaatgtttactagttgattatatatgtaacttgaagctgcttagtagtgctatcacttcttggttaaaacaatcacttcacatttgttcttgtcatga

SEQ ID NO: 271744 - DNA, 179 bp, Homo sapiens
tttttcttcatagcttccttctttataggactctgccctaaaaatttcagccatatcctcaacttattgaggccagttccccctccctgtacatatttgcagtccaaaaactatccccaggcagaaatcctctctctcacttgtttccctgatttcaagaatcataatcctgtactacc

SEQ ID NO: 271745 - DNA, 330 bp, Homo sapiens
gacggaatgctcatctcaagatgtgtccagttttatttatgttttgtatgttagatattttatcaataaattctagcttcacaactaagttagaaggccctttcacaccttttcatgtacatagtgcccttctgtgacgtggaggttgaatagcaattggttaagataggatagtgaggcccaagtttcacagatggaaatctggggctcaaagagattagtacctctactgatgacaggacttctcccagtcctcatgactaacagagtttctatgaacccaggaacaaatatatcattaaaacttgggcctcactatcctatcttaac

SEQ ID NO: 271746 - DNA, 1191 bp, Homo sapiens
gtaacagtaattgaatattctatttatttttgcctttgaatactaagatatataagtcaagggtggactattccttgtcataaagctgaaagtttaatttcaaactgacatctgctgccagttctgtgtttcagtattttatttatatttaaaattccaccttccctatatttgtaatatcatttttttgtggtaattgtgtctttgtgttcttcctttcagtaggtgttatttattaggctcacttttattctgcgggcaacttcagagatcccttgttcctcagaacatgctagaattccttctcttcttcagtgtcctaagtagatgatatgaatgtgcataattaactacgttctgcagttctcagctcaggaatacttttcagctcttacagatagacacttaggcgtaacagttgttacttatgagctcattttaaaagtagataaatgtctgaattttcaaagacaaagggtttcagagttcttgatagtttcttatagaggtgggtttagagcctgtgagaaagccactacttcagaatcttaacaaatagtaattgacacccagtggcaaaaatcagaatccgcttttctttcaacagcagatatttaaggcttaattgctgactgaaagtgcagttcgccctcctgcttctggagacagtgatgcccccagcccagctcactggacaatcagccagggtcaaggtgtggtccccatacccagagacgtcatcttctcctcttccgatctccacgtgtaccccagcttaccccagcttcatcttccctatgcacagaaaattaggataattctaagaattgtttttcttggaaacaatgttttcaatatggcaaagtgaaaattgtttttctaaacaagatattggctggatgtggtggcttacgcctgtggtcccagctacttgggaggctgagatgggaggatcacttgagcccaggagttggagggtgcagcgagctgttattgtgatactcctactccagcctgggtgacacagtgagaccttgtctcaaaaataataataatagtaaataaataaaaatttaaaaagttaaaaaagtaagatgttgatgccagcaaaacttattggtgatgattgaaagccaaaaatatattataaaacacacaagcagtatatcaatattatattatatataaata

SEQ ID NO: 271747 - DNA, 591 bp, Homo sapiens
taaatttagaacttgcatatccccaaatacctgaaagccataactgaactacaggataaccttcagaccttcacacttgtcacttcttcattgcactgtgatttttgttttcgtatttttttttggccccaagtacctatcatattccccagatggcttagccatcatcactggcagattatgaataatgttttacattgaacagatgtaagcaatttgtaatttttcccctttctgaaccagctttgttttgatgaatcaactggaaattgaaacttaagtagaacttctgtttgaaaaggagcaatgttttcccacattggcatatgtagtcagctcttaaatatagagaagaaacaacgaataggggaactggccagggtgtgtggcaagaaatactggaagatcattatttagcattgccatatagttccaatttctttattctatagaaccacataataataaaaaaaaaattaagttgctccaaaccaaccaaaagttcatcaggttgcctgtgtttctatccagtaagaacattcttcaaaagaactagaattctggaaatacagtaagagctggtgaaatgtt

SEQ ID NO: 271748 - DNA, 443 bp, Homo sapiens
tgtcatataagcaaattatgtggcacagaagtttggtgtatggattatttcatcacccagaaacacataaaacagtggtcttctcctctgatgtgattttactaagtattccttcactcttcagtttagaaagagctgaattactcaaagaaataaacaacaaaacattctgtacttcatcaggtcagaaaagctgacttttgagaagataaaatttgaagtaagaagatatggaataatttttcattattcatttcaaactttcaaatgtaattgtctttcaagtttcttacacttaacctgaggcactttttctgcatttttgtaattgattatgagactcgctacttgtatcttcctttctgatttgtttattctaggatacttttacaagaaaaattaatcttcagtgtttaaaaataaaatatctcaacatttgcaat

SEQ ID NO: 271749 - DNA, 482 bp, Homo sapiens
tctgcgtcgctcacgctgggagctgttcctgttcagccatcttagctccacccaccccatgagagaatattcttaaaaccaaatacgtcatagaagcattatgatacatttattgtggaagagaggggtagtttaaacttgtttcatccactgatgttcttattgtagctatgatatttcttaatctgataaaacaatacttataggcaaacgtttctcacttatgtatagatgaaagtatgatttatataaccttgccatacaatagggacccattaattactgaagtaattaatgttttttgagatgtctataatatgttgcagttggtgaagattttagaaagttttatttcggccgggtgtggtcgttcatgcctgtaatccagcacttcgggaggctgaggcgggtggatcacgaggtctggagatcaagaccatcgtggctaatatggtgaaaccctgtgtctactaaaaaaaaaa

SEQ ID NO: 271750 - DNA, 443 bp, Homo sapiens
atgaggagcggccaagtgcggtggctcacatctgtaatcccagtactttaggtggtggaagtggtaagatcgcatgaggccaggagttcaagacgagcctgagcaatatagacctcatctctacaaagtaaaaacattagttagccaggcatggtggtgtgcaccaggaggctgaagtgggaggattgcttaggtccaggagttcaaggctgcagtgagctgattgcaccactgcactccagtctgggtgacagagagaccctggcttttaaaattaattaattaaaaacaaaaagaatattaactaaaatttattgaggctgggcaaggtggctcatgcatataatcccagagctttcagaggctgatgctagaggattgtttgagctcaggagttcaagaccaacctggtcgacatagcaagatcctgtctacagaaaaaa

SEQ ID NO: 271751 - DNA, 392 bp, Homo sapiens
tcgggttcaagcgattcttctgcctcagcctcccaagtagctgggactacaggcatgcactaccatacctggctaattttgcatttttagtagagacagagtttcaccgtgttgatcaggctggtcttgaattcctaacctcaggtgatccaccctcctcggcctcccaaagtgctgggattacaggcatgagccaccgcgcctggcctgcccttctactcttaaggcaggtaggtgggcagatgtcattgtgggagtgtggtatacacaatgtcttctctagacttaaaaaaaattctctttggctccctggataaactttgatttctctagatttagtcattctgtttattcctattggtccttctctttcaatcactaattttgggaaa

SEQ ID NO: 271752 - DNA, 335 bp, Homo sapiens
tcaaaataataatgatatatattttttctatttgaaggttgttaaagatggctaagtgcgatggctcacgcctgtaatcccagcgctttgggaggtcaaggcaggagaattgcttgaggctaggagttcaagaccagcctagacaatatagacagcctctgtacaaaaaatttaaaaattagctgggcatggtggcatgcagctctagtcctagctattcaggaggccgaggcaggaggatcacttgagcccagaaatccaggtcaaggctgcatacgattgtgccactacactccagcctggcctgggtgatggagtgagaccctgtcttgaaa

SEQ ID NO: 271753 - DNA, 306 bp, Homo sapiens
agatggagttggtcagaattttctcttacaatttttgcaaaggcagttttatatatattggttttcatccatggctcctggctcttaactctcgtagctcttgttacagtcttttgttataatgttgggtgtgttgggccccaagggcaggcctcaggaaacagaatctgtctcctgccctcatttcacctgccccagggcatgactgtaatcttcctgtgaaaagtaaagtagaggtttctcttcaaagactttcttccctgtctaattaggaataaatagtaacttctcttagaagcaaaattt

SEQ ID NO: 271754 - DNA, 437 bp, Homo sapiens
tatattcatacacatatcttctggttagttgaaatgatttctttttgagaaaggcttagaaaggagatttctgtgattaatgtttgaaaaccatggctagaacagcatggtttagggcagaggagcccatcaataaggaaaggccctcctttcagcttcatctcgtctctccaccaacgtgtgacctcaactaattatttagctttttcaacttcagtgttcttcttattaaagtgggtgcagacacaactctctaataggaatgttattaggacagtttataaataaaatatttggtttagtgtcaatatatggtaagtgcccaattgattatgttcaatgttttctttatggttcttaaaatatttctttccaaaactgttatggcattttcctctcccactatccccctgaaatatatctctttttaaaatatt

SEQ ID NO: 271755 - DNA, 581 bp, Homo sapiens
gtaccttttcagttacatttgttatatatgagtgtatgtctgtgatctatacttatgtgaattcaataaaagattatacccttctttaatgggattaatgtttttagtgcattttatgcttctaaaagtattcatatatagttatatgcatctttctgacaagaaaattccttaaatgtagtttttgtacaaaatatatttaaaggatgtgctttgagagctgggttcagtggctcgtgcctgtagtcccaggtatttgggaagatgagactggaagattgtctgagctcaggggtttgaggccagcttgggcagcatagcaaggctctgtctctcaagaaaaaaacaaaaacaaaaagaaaatatgtgctttggatatctgcaatgtgaaaacttgtagagaacatttttcaggacctgagatgtctcctccacacagtagggatcagatttactccaacaggacttcacagtttagtaatagcttttttaaagctctgttaatctgaaaccacatttctgtatatctgaagtctgcccagttttggaacagtttgtgaaataaaaagtgttaactcagt

SEQ ID NO: 271756 - DNA, 335 bp, Homo sapiens
gatgtttgagtacagatgatggattggaggatgtgaggctgaggcaggtagataaagcatggaatattgcagcagaatggctagcagaatggctaatatcatgtaaatgataagggaataaaacaaagcaaggtcaatgggttggaggaaaggtaagtatttaggagatatacccagctaatggtaatcatcaccctgaaaatattgtctctagttttttgttacaatatttagtattatttctaaaagcttagctatcatcagttttcattctaagcctttccccacaatatcaaaataaatatcaaaatcaaataaaaagtatcagaatatca

SEQ ID NO: 271757 - DNA, 563 bp, Homo sapiens
acaggtgaccaccgactgcagactgtattaactgaaactggccacagcaatgtttcctatgtgcttttccagaatcctgccacttttcatcaagagctgaagtctattccccttccttctcaacctaggtgagactttgtgactatctccaacctgtagaatgaggtagaaataatgctgcataacttcagagactatgtcataaaaggccgtatggtttctgcctggttctttttctcttgtgacacttgcccttggagactctgcccactgtgctgtgaggaagcctaaactagcacacatggaaaaggccacatggaggagcccacctggagaggaactgaggcatccttggataatggccagcatcatctggctgagccagacatgtgcgaacaagccttcagaacctaagtttaggtatttccagtgcctagacttgaagctttcagctgaggcagcagacactgtagagcagagccaagccatttccactgtgccctgttcaaattcttggccacagaatgtataagcagaataaatgactgttttacccataaagg

SEQ ID NO: 271758 - DNA, 1510 bp, Homo sapiens
gtgctttgttaaacagatgcttgaaggcagcatgctcgttaagagtcatcaccactccctaatctcaagtacccagggacacaaacactgcggaaggctgcagggtcctctgcctaggaaaaccagagacccttgttcacatgtttatctgctgaccttccctccactattgtcctatgaccctgccaaatccccctctccaaaaaacacccaagaatgatcaataaatactaaaaaaaaaaaaaacaaaaaaacaaccatagtcttttaggctaagtgttggaagatagtaatagatttccggctggtgtgactaaataaatcttactttactaacgtaagtccaagataactattcaagctcatcactctcactgtcccttcacgtggtcatcgtgcccacctacgaggtatccaaagccaaaagcccatccccatttagaacctttttggctcccatgactctcttttccatttggcttgtctattaccctggctattatttacacactaaagttcattctttgagttcatgagagaacagtttctggggtctttaaattttaagagaggaacttatgatattctgctcaactataaggatacacacaactaataaacgtgaaaggtcccctccctttcttaaaaagattgtgcttactatttttatctgataaagaggatcactctataaatatattatttgtctcaaattatgactcacctctggataaagatggaagcattttactgcattaattccaagaggatttcagtaagcctgtcattcattatcgtccccagtccttccaaaaatgaaggtgcttcaatattggtctcgaagtaggaataaaagtccctttaaaaaaaaaaaaaaaaaaagaaggcacatgttgtcaatgtaattaaaactttaaaatatttatttttatcacttctttagaacatttttttctgaaaaaaaaggtcaataataagacttcctaattacgcctcgctattttgcattcttggactttaaaaagcacgtattttcaggtgatcactgtactattctttcaagttttctataggctttcaaactaaagagttggagggatggtcgaatgatttaaagagtttctctaataatgtcttaaaatgtgtagacagtatatgttcaattttcccaaatctggttttatcccccacatttgagatgcttgaaggttgacatctgattaattctgtcataaacagggatgccttcatgcctctgtacaactttgcatatagaaaattacttctttttttcccatgctcttaggaaataaaatataatgaccataagcatcatgagcaaggaatccagtgcttctagcttaattcatagctccatctaatcctctgtgctaagtgaaagctcaatgttgattgactattgttgctcacaaatactatgtactaaaaagcagattattttagtgtcttacacttcagcatataaaataaaggcttcattaggatagta

SEQ ID NO: 271759 - DNA, 1105 bp, Homo sapiens
ggatcgacccatgactctcttttccatttggcttgtctattactatcttccaacacttagcctaaaagactatggttgtctattaccctggctattatttacacactaaagttcattctttgagttcatgagagaacagtttctggggtctttaaattttaagagaggaacttatgatattctgctcaactataaggatacacacaactaataaacgtgaaaggtcccctccctttcttaaaaagattgtgcttactatttttatctgataaagaggatcactctataaatatattatttgtctcaaattatgactcacctctggataaagatggaagcattttactgcattaattccaagaggatttcagtaagcctgtcattcattatcgtccccagtccttccaaaaatgaaggtgcttcaatattggtctcgaagtaggaataaaagtccctttaaaaaaaaaaaaaaaaaaagaaggcacatgttgtcaatgtaattaaaactttaaaatatttatttttatcacttctttagaacatttttttctgaaaaaaaaggtcaataataagacttcctaattacgcctcgctattttgcattcttggactttaaaaagcacgtattttcaggtgatcactgtactattctttcaagttttctataggctttcaaactaaagagttggagggatggtcgaatgatttaaagagtttctctaataatgtcttaaaatgtgtagacagtatatgttcaattttcccaaatctggttttatcccccacatttgagatgcttgaaggttgacatctgattaattctgtcataaacagggatgccttcatgcctctgtacaactttgcatatagaaaattacttctttttttcccatgctcttaggaaataaaatataatgaccataagcatcatgagcaaggaatccagtgcttctagcttaattcatagctccatctaatcctctgtgctaagtgaaagctcaatgttgattgactattgttgctcacaaatactatgtactaaaaagcagattattttagtgtcttacacttcagcatataaaataaaggcttcattaggatagta

SEQ ID NO: 271760 - DNA, 419 bp, Homo sapiens
tacacccacacaagaacttgcagcttcccagcctagcctaacaattggtgctgttctcttatgcagagactctttcataatatttttctagctcttgatttaaagatatgaagtcaagatcaaaagaagcattattctgctgagcactgccatattccttgggctcagccacgcctacctcttcacagggcctttcttatttccttaacccacactcattgccctagtgcagtgattctgcaaggcctctactgaggttcctgcttttagcatcttttataggtttccattacttcagggaaaaccgtcccatgactgctctccacctgcccttcccagtccaccacatcacacagatgtggagtgatcattttctttccttagtcattaaagcttgcggtaaaccaaaaggtatctaa

SEQ ID NO: 271761 - DNA, 513 bp, Homo sapiens
actgcactccagtcgacctccagcctcctttctgctcccaaagtatttttttggtttgatttcttatttttttgtgtatcactaaccctctctgttattttgtgggcttcatgaaggcaggggtcttgactattttatttaccaacaaatactcaacacttagtccagtgcctgtcacacagtaggtgactgatagatgtcattgaatgaatgagccctctctgtggatagtaaataaactaggaggtacatagacgatttactgtagacagcttctgatttcagaatgtggggtgcctcttagggcctgtctcttcctttggaaggggagtatcatgtatggaaggctttcttctctgcattggggttcttcagatgtcctcaaccactgcagtaaaggctggtggctggtgtggacgacttggttctaggaggttccttaaggtgtaagtgcttcgctaaggagctacagaaacatgcattatctgggactatttatggggctggttattt

SEQ ID NO: 271762 - DNA, 508 bp, Homo sapiens
caattccagagatgccccggcaatccatttttccgatgacaagtgaggtttagcatctccttgtgggggtgtcagcctttccgtctcttttctgtggcttgccagtttgtgtttttgtctagtactgggtaggagttccaacaagcagaagggctgagtgggcaatgacaggatctcaggggagaacctcccgctggcagaaagatgcatccacatccagaggtccaggaagggctttcttgcaaaagtgaccaggccttttttcatcatcttcactgaggccagaatttactgggaattgtttgaactgctgcctaaggatgtgtattaggttcctgatgataaaagacaggaatactctgcaattattcccagggaaaactacagacctccttccatgagccccactagatcctgaggccacgcagcagggccaggacagggcaggccatgaaggttaacccgaaaaggttttagaaaccctccagacactcacatcctgtgttta

SEQ ID NO: 271763 - DNA, 604 bp, Homo sapiens
gtattactattccagaaagaaaggacaaatgggatgtgaagaactaaagtgacatagttaaaaatttaaccaaatttaagtgcttcctaaaatttggtgaatgtcttattttttaaaatgataataccaataaggaatgttggcacataattcccatttcattataaaacctctttaatagaatagaatcaaataattggaaatggcctatagattaaaaagctgagaaagtatatggtaggtagcaaactccccagaagtatgaactctggattagacatctcagaatacatgagcactcatgttggcttgctttgtagctatgaacttaccctgtattattgaaatgtcagcataatgactggaaggtgaaattggtccattttagagcattactattatgctatctgtccatttaaattaataattgcattaaattcattttagaaggtgctattacattagtagtaagaaagtaaattcatatataaatatttgattatcagatggtttacttacagatacttattttcctgtaaaataggagagtttacctgaagaaaaataaaacttttaacttttctgggaaaatcaaaaaacttat

SEQ ID NO: 271764 - DNA, 458 bp, Homo sapiens
cactgaagtcttctttgttaattgttgagggtgagggaatagggtgtgtaatttttccacagtcagttatatacacacacatgtctataaatgtatttacatatatttcctaggcctaaccagtgagaaggtcttggtgcagcaacaccacattagccaagagaacacctaacacctagctctaaacacctttctccatgaaaaggaaccagggcgctttagagaaatggctgattttagggttgggccagagaaagtatagtatgagactggaacatcttgtgctagaaagtgtggaaatgctcaagaaatggtggagacagttcaaaaggacaaagcaatcagcttgaaagggctcctgttggccaaatctgggacaatttgaacatcaaaataaatcacagtagcaggagattatatcccatgggttaaaatggaatctatgagtccacactttc

SEQ ID NO: 271765 - DNA, 617 bp, Homo sapiens
atcaacaattaccaacatttttgcaaatatagttatctatcttacccttcccctactgatttttggagggaggagtattttaaaacaaattccaataaattggacacatttctagaagtttacaatttttcaaaatggactcaagaagatacagagaatctaaatagacctatataataaggaaataaattagtaattaaaaatctccccatcaaagaaaaaagaccaggccatttggcttctctggtgagttttatcaaatatttaaagaagaaatgataccaatattccacaagctcttctagaaaatagagaaggatggaacacttcccaactcctatgaggccagtatcaccctgataccaaagccaaacacaaggttatacatcattatgaatgcaaaagtcctcaacaaaatattagaggactgatttaaacaatatagcaaagagattatgcaccataaccaaatgggatttatcttaggaaagcaaggttggtttaagatctatcggccaagctcatgcctatgaccccagcactttgggaggctgaggtgggtggatcaccggaggtcaaggagttcaagaccagcctgaccaatatggtgaaacccc

SEQ ID NO: 271766 - DNA, 356 bp, Homo sapiens
ttagttttatggtacgtttgtcattccagcttgttaggcatgagtgtgttgttactgacagagcccctggaggacaggcagacactgtggttctccatggtctctcagtaccaggcacagagcaagcacccaatacatattataggaataaatgatctcaaatcttcacagtgcctcttatagatggcttttatgatatatatctgcagagaaactgaattcagggattttaagtgccttttttgcaaggcccttaaagtttgggaaagtaggtgcatggaattagaactcagattatcctgacttctaagatcacactcttcattgtagcacactgccttcttgccaaaaaaaaa

SEQ ID NO: 271767 - DNA, 458 bp, Homo sapiens
tggttctctgcagggaccactttggccagccttaggacaggaacactgacagaacactggtgccaggcccatgcacgggcacagaagcagaggaagctgccatgtgtggagggtgtacaaacagccaggaagaagccagtcctgctgcctggacagcatggttgggcagctggggacagggtcatgagatggcacaggaaaggtaagtcctacttgggtcctggctgtgacactggccttggcaccaacgaggtcatgtccaccatggggttcctcaacttgctccctctgtaggggtttaaaacaaggtccccatttcttaggtgataaaaccaaagccttcagaggagcagtttgctgagcaattactgacttgggtcccggaactcaagcctcagctctttgactcccaatccagcaagcctttgtgaataaaaaaatgttgcttttctctagtt

SEQ ID NO: 271768 - DNA, 436 bp, Homo sapiens
tttttttttttcttggtcagtgtagctaaagttttgtcaattttttgacctttttgaagaactaacttttgggtttgttgattttttttttctactttttttcctcccccatttcatttatttctattcacctttattactttctttctctttcgtgtgtgtgtgtgtgtgtgtttgtgtgtgtgtgtgtgtgtgtgtttgaggcagagtctcgctctgttgcccaggctggagtgtagtggcatgatcttggctcactgaagcctccacctcccgggttccagcaattttcctgcctcagcctcccaggtagctgggattacaggcatgcgccaccacgcctggcaaatttttgtatttttagtagagatggggtttcaccatgttggccaggctggtctggaactcctgacttcatgtgatgcacccgcctcag

SEQ ID NO: 271769 - DNA, 264 bp, Homo sapiens
agttaaatagggagaatgagttaagaatacaaatgtctgtaatttgaagttctatgtacatgtcataggagaagaagaagaaaactttgttctgagttcaatgattcactgggtgtggtagctaatgcctataatcccagcactttgggaggctgaggtaggaggattgcttgagcccaggagttcaagaccagcctgggcaacaaagtgggactccttctctatgaaagaaaagaaaagaaaagagaaaagaaaagaaagaga

SEQ ID NO: 271770 - DNA, 414 bp, Homo sapiens
cgtttttaacccccttagtctcaagggtctgagtctctgagcctctgggctcctgggttaggtgagaagggtctttggatccttctgtttagagtctgggtctccagcacgcgcatcacgacagcccccgcgtgcgcgcggagttccactccaatcctcgaagtctgctctacgcatgcgctatctgcgccttttacactagcgaccaacccctgcagttccaccttcaattcccacccgcaaccccgcctcaaagggcagaaatcataggccctgtaatccccttaaaatcctataataatcccacaaaatcagttaatcagaatacaactacttcgcccatccagcaacctgccgggtgacagcgcgctgccatgacaacagtacacgcagctccgccgctccctgcggccg

SEQ ID NO: 271771 - DNA, 374 bp, Homo sapiens
gacagaggtctggacctgggccctgcaggtggctggaccgctgacgatgaggtccgagaggcacacaggagtaccatctaaggatgagacagaagtgatggatgtaccagttctgggagtggtttcagttggtctcttttgctgttgagaagaaaattcttatgctacccactggtctcaggaggtggatgagggatatgcagaattaagtcaccagccaagaccagccccaatcagccaaccctaagccaattcccaaaggaatgagtaagcccagccaagatcagcagaggcatccactgagcccagcctccgtcagccaaactatgacaatctgcagctcataaaaacacatgattgtttgaagccactaa

SEQ ID NO: 271772 - DNA, 458 bp, Homo sapiens
ggcggggttgcaaggcgcaagcagcctgctgaatattcatgagcctgaggctggcgtgggttattgtgttcaaagctgcggggtttcatttcctgttcctgaacaacaaatcagtgcagctagatgctcacgtccctgaaggggaggtggccctccgtgcctgagtagcctggccctagccgacctctccagtccccgcgggcgtcttcgtgccaccgagcagccccgctgatgctctcggcacctcctccccgtcggctctcctcgcctcccggctttgtccgggcacttccttggatctggtgccccctcctccatttctgacaatctcctgtttacataagacagcgcaaacatgtcactgagcttcctgaagactgggacattcctcctttgtccgccttgaattactctatacctggccccccgcaaatacacctctgccaatgaatgaccgt

SEQ ID NO: 271773 - DNA, 451 bp, Homo sapiens
ctcttggtttggttcagccaggaaaacagccaattaagtattatagaaataaacagtttaatataagaattagcgcttacatttatgtgcatgtaagcaaaaaaaatgaaagtttttttctgcctacagaaagtcagaaacacaatcacaaatgacatcagctgaaaacactgatataggagcgaaagcagtagctcatcaaggagtccaggaaacttctgtattcaccaggattatgaagtacacgcttgtgtgatgtctatgatgggcctatatctggatactagaattgctgagaagaaccttgttaaaaaaaactctgggctgggtgcagtggctcatgcctgtaatcgcagcactttgggaggccaaagcaggaagatcatgaggtcaggagatcgagaccatcctggctaacatggtgaaaccctgtctctactaaaaaaaaaaa

SEQ ID NO: 271774 - DNA, 125 bp, Homo sapiens
gacattactgtaattgttttcttgagccatgataacctatattaaataatctggagcaacattttattcctgattatttaaacaaggaccagtttttcctactgacttgcatctttttagacagg

SEQ ID NO: 271775 - DNA, 426 bp, Homo sapiens
acctattgaatctcaaattctggggcttaaacaagcacattccaaattaagaaccaatgacctaagggaatgtctggttacctcctagttatacaagcaaaatctgcatagtatgtagtcttttttatttatttatttattttttttgaggcggagtctcgctctgtcacccaggctggagtgcagtggcgcgatgtcggctcactgcaagctccgcctcctgggttcacgccattctcctgcctcagcctccccagcagctgggactacaggcacacatcgccacacccggctaatttttagtatttttagtagagacggggtttcaccgtgttagccaggatggtctctatctcctgaccttgtgatccgcccccctccacctcccaaagtgctgggattacaggcgtgagccaccgtgtccgg

SEQ ID NO: 271776 - DNA, 304 bp, Homo sapiens
atttgtttctttttgagacagggtctcacttttcacccaggctggagtacggtggggaaaacagctcactgtagcctgggctcaagctatcctcccacctctgccttctgagtagctgggattacaggtgcacactaccatgcctggctaatttttgtattttttgtagaaatggggtcttgctatggagtgggagtgttgtattttttatatttaattaaaaaaaaacagagatagggtctcacttgagctcaggagtgtgaggctgtagtgagccatgggcgtaccactttcaaaaagcgag

SEQ ID NO: 271777 - DNA, 421 bp, Homo sapiens
tctccccaccctgatgcacccctattcctatttaaatgacatcactgcttctgggaactgcagtggatggccacagttgttgactaaactcttcatttctttacaccaaactgcccaaacctcatttccagcaggaggctcaaaccagggtagttctccagcaaaagtagggaggaaagtgtcacctttctcaaagctaagatttttccttattaaatgggagatcccagagtacgcacgttagagctgaatcgctgagtgtgtctgcagagagaaaggaaaacaccgtgagcctcagaccatgctgtgtcctgtgttcatgggtcttttcttcacttggtgacattagaaaactggttgggagatagtgctcgaggcaatggcccccaaataaagcctagaagacacttgaggaaatgta

SEQ ID NO: 271778 - DNA, 1041 bp, Homo sapiens
catgttttctttttatggttatatttttttaaactaatctctctgagatacatgctgaagtgttataggccttgaaagctaatcaaggaacttataatttctgaccaactggatttaagaattgctatgaatctttggcctttgtcactctcattcccttcttttttgaatagaaacttttacacctgttatatgtattttcctgtcctactattttattagatgtggggggccaataacttttcttttttgtttcacaggttagcagatcaaaagtaactgtactcgaggagctggactgaagaattacttccaaaaagcctcacccatatctggacatgatgcagaagatgaaattctagactttgagatgatgctatgatgatgatgtgagacctctgaggaccttgcaagaaaatgactgtattttgcatgtgggaattatttgagtcattaggggctggagggcaatctaaggttaactttaagatggcccaattgatcccctcctcctggaattcatggccttgtgaaaccccctccctttgagtttgggctggcctggtgacttgcttccaaccaacagaataccacaaggtgatgggatgtcacttccatgattaagttctaagctgttgtggcttttgtcttgctagcagactttctgcatcatattctcagtttccatgctttgatgaagttagcagttcattggacaagcccatatcatgatgagctgagggtggcttccagacaacggctagcaaagaactgaggccctcaacccaacaccctcaacaaatggagttttgccagcaacactagggagcacggaagcagagccttctctagttgagctttcagatgagccagccctcgttgatgacggtagacctgtgagagcttctgaagcaaagaatctgcctgagccatgcctggactcttgacccacacaaaccataaaacaacgaatgtgtgctattttaagctgttagtttgtggtcgttatgtatcactaaataattaaaacatgcagtaact

SEQ ID NO: 271779 - DNA, 270 bp, Homo sapiens
tagagaaaatggatacattcctagccacatacaacctaccaacattgaaccaagaagaaatagaaaacatgaacagaacaataaatagtaatgatccctcaacaaaaactcaggaccagatggctttactgccaaatcctatcaaatttataaaggagaattaacgtcagttcttctgaaactatttcaaaaaatgaaagaagagagaattctttctaactcattctaccagacccaaattattccaatattaaaaccagacaagggcac

SEQ ID NO: 271780 - DNA, 239 bp, Homo sapiens
gaggtggtgatgatgatgatgatgatgatgatggtgacggtgatgatgacaaggacaataatgagctcagccagacacagcggctgcttgacgttcaccctggcaccacatgggaggcctttcttcacagtgagcttcgtggtgatgagcacagcacagcccagcgtagtgtaggatttattttaggtgcagcgtggggtagagataaaaagactacctgggttccaaatctgggtcca

SEQ ID NO: 271781 - DNA, 226 bp, Homo sapiens
gtgaacagcaagtttggcctggtttccttaggtccctctgggcccatttcttttctttcatcatctttcctaaagctgatatgacaattccatggggaagaaacaaatagtacacttggatgaactttgcgaaacacaaagacctttcctcttatccctgattctaaagggatttttctgtatttaataagtaaataaatgagaacagttttagactgaatagtaa

SEQ ID NO: 271782 - DNA, 291 bp, Homo sapiens
ttcttttttccccgttttaaaaatgaatttggttcatttgctttctgcttctggatttgcctgttctggacatttcatataaatggaatcatataatacatggacttttgtgactggcttctttggcttgtttcacttagtgtaatgttttcaaggctcatccataccacagcatgcagcagtgctttattcctttttatggctgaatattattccattggatagagatacaatattttgtttatccaataataaattgggcacttagattgttttcacatttggtcgacg

SEQ ID NO: 271783 - DNA, 320 bp, Homo sapiens
gtcaggaggaagagatatggtagcttggactaatctggtagctgaaaaaaattacaaaatgaatgactgaatttagggtgacctaaatcactccctgccaaggagggggagttccagacagagtccaaacgtagaagaggagggtgctaagaaaagggtgcagtttctacgtgagatcccctactgtccaaaggcaccaaggaggcttctgagatagagtcagaggtctaaggtgcctcttatctgagccactgaattgacctccccgagggagcagcactcctgtcatggcccatgtgaatggcagctctggtgctgtg

SEQ ID NO: 271784 - DNA, 327 bp, Homo sapiens
gagttcaaaacacctaccctgcctttctgaggatcatgagacagactatatcaaagtgccccaaagcacatttgtaaaatacttaacaagaataaataagactgggttaaatgtatacatcaacttgggagagaactgccatctttataatactgaacctttcaatctacacaaatgatatattattctatttggttatttaatttttgccaaaaatattttgtgtatttcagatgtacatctctacgttatctctccttagatttcctaagtatttgatgttttgatgttattttaaataatatcatttcataaattccatttcct

SEQ ID NO: 271785 - DNA, 157 bp, Homo sapiens
ctaagactacatgtgtactactatagttagggagttggcaaccttctcagttttgtgctaatcccaaacaagattttttttatccctagcgcgcgatataccttatattttgatgccaatcaatctttgttgttgtatgaggtgtgatagatggaag

SEQ ID NO: 271786 - DNA, 468 bp, Homo sapiens
agagtactcatgcagaagagcaaagatatatctatggggatttaaacagcgttatttgtaatatggacaattttttaaaaaaagttaatatccatcaatagggaacagttaaaagtctagccaggcttggtggcacacagctgtagtcccagctacttgagatgctgaggcaggtcgatggcttgagcccaggagtttgaggctgtagtgcacaatgattgtgggcaggaaacaggacctcgactttggaccagattcaagactggctgaaacagggaagaggcacagaaagaacttctccgtaagacacgcccaccagcacgacagtttaccattgccatggcgacacccagacgttactgcctttttccataacaacctggaagttaccaccccttttctggaaatttctgaatagcccactctttaatttgcatgtaattaaaagtcaatataaatgtgactgca

SEQ ID NO: 271787 - DNA, 1001 bp, Homo sapiens
agcagaggagcggaaagcatggtccggggggcggcggacgcctggtaggcgctcgggccgttgttgtggggctgcgcgctggcgctgcagggcgggatgctgtacccaagagagaggccgtcgcgggagcggaagaagctggaccgcctctggagcttccgcgccgacttcttcgacaaactgtgccttggcttctaggagtagtggtatcggcgtctgctgcgagagtcgggctccaccatggacataccggttccctccagcttcaacgacgttggccaggactggcggctgcggcattttgtagaccagatgtggtacgaacgggaggtgaccttcctggagcaatggacccaggacctgcacacaagagtggtactgaggattgtcagtgcccactcctatgccatcgtgtgggtgaatggggtcgacgcgctagagcatgagggatctacctcccctttgacaccgacatcagtagcctgttccaggtggggcccctgccctcccgcctccgcatcactatcaccatcggcaacatgctcatctcctccaccctgccaccagggagcatcctcgacatggccgacacctccacgtgggtaccatcctgcttccaccgcagacacccaccttcctgtcccaccccgtggggcattacattagggtaattacattagtgtcaagatatgccataatactgagaatggaggagtctgaggccctggtccatcaactgacagcatgaacttcacgtcaagaagtgagattggtgaataagtgaagacagaaggaaaattggagatacagctggatgtatgaaccctgctctgaaaacactctttaacgcttgtacacgagagtccagcaggactgtggcccacctcaacagaagaggaactgtgtgctccgtgaggatgtcatagattctgccttaccagtatggaaatcctgaaaacaccatcaactcttcatcatcactaaattctcctttgtcacac

SEQ ID NO: 271788 - DNA, 999 bp, Homo sapiens
agcagaggagcggaaagcatggtccggggggcggcggacgcctggtaggcgctcgggccgttgttgtggggctgcgcgctggcgctgcagggcgggatgctgtacccaagagagaggccgtcgcgggagcggaagaagctggaccgcctctggagcttccgcgccgacttcttcgacaaactgtgccttggcttctaggagtagtggtatcggcgtctgctgcgagagtcgggctccaccatggacataccggttccctccagcttcaacgacgttggccaggactggcggctgcggcattttgtagaccagatgtggtacgaacgggaggtgaccttcctggagcaatggacccaggacctgcacacaagagtggtactgaggattgtcagtgcccactcctatgccatcgtgtgggtgaatggggtcgacgcgctagagcatgagggatctacctcccctttgacaccgacatcagtagcctgttccaggtggggcccctgccctcccgcctccgcatcactatcaccatcggcaacatgctcatctcctccaccctgccaccagggagcatcctcgacatggccgacacctccacgtgggtaccatcctgcttccaccgcagacacccaccttcctgtcccaccccgtggggcattacattagggtaattacattagtgtcaagatatgccataatactgagaatggaggagtctgaggccctggtccatcaactgacagcatgaacttcacgtcaagaagtgagattggtgaataagtgaagacagaaggaaaattggagatacagctggatgtatgaaccctgctctgaaaacactctttaacggtataaggattcttattaacgaattttatttcttttttatctgatcattattttattttgatttatagaggaatatatagagggggatatctatagagacacacacgtttgtgtgtgtatatataaatatatatgtatgtgtatgtgtgt

SEQ ID NO: 271789 - DNA, 1162 bp, Homo sapiens
agcagaggagcggaaagcatggtccggggggcggcggacgcctggtaggcgctcgggccgttgttgtggggctgcgcgctggcgctgcagggcgggatgctgtacccaagagagaggccgtcgcgggagcggaagaagctggaccgcctctggagcttccgcgccgacttcttcgacaaactgtgccttggcttctaggagtagtggtatcggcgtctgctgcgagagtcgggctccaccatggacataccggttccctccagcttcaacgacgttggccaggactggcggctgcggcattttgtagaccagatgtggtacgaacgggaggtgaccttcctggagcaatggacccaggacctgcacacaagagtggtactgaggattgtcagtgcccactcctatgccatcgtgtgggtgaatggggtcgacgcgctagagcatgagggatctacctcccctttgacaccgacatcagtagcctgttccaggtggggcccctgccctcccgcctccgcatcactatcaccatcggcaacatgctcatctcctccaccctgccaccagggagcatcctcgacatggccgacacctccacgtgggtaccatcctgcttccaccgcagacacccaccttcctgtcccaccccgtggggcattacattagggtaattacattagtgtcaagatatgccataatactgagaatggaggagtctgaggccctggtccatcaactgacagcatgaacttcacgtcaagaagtgagattggtgaataagtgaagacagaaggaaaattggagatacagctggatgtatgaaccctgctctgaaaacactctttaacggctggagtgcaatggcgcaatgttggctcactgcaacctctgcctcctgggttcaaatgattctcctgcctcagcgtcccgcatagctgggattacaggcacgtgccgccacacccggctaatttttgtatttttactagagacagggtttcaccatgttggccaggctggtctcaaactcctgacctcaagtggtctacccaccttggcctcccaaagttctgggattacaggtgtaagacactgagcctggcccatctggctgttcatttctatctattataatatcctttataataaaccagtaatagta

SEQ ID NO: 271790 - DNA, 175 bp, Homo sapiens
ctcaaggatgtaaaggctctgcagatttcgggaggcctgtctcccagcacctgatgggacactttttgccccactgtaaattctgggtgtatcctccactgtatgctgtcaccccaagggcaagcactgcatctgcttagtgaaggatttattgttcggaagatacattttcccc

SEQ ID NO: 271791 - DNA, 802 bp, Homo sapiens
gtatttagtagagacggggcttcaccatgttggccaggctggtctcgaactcctgacctcaggtgatccacctgccttggccttccaaagtgctgggattacaggcgtgagccactgcacctggccaaagtttttttttcttctttttttttagtattaacaactttgaccaggaaaaacaaaccctgcttttcctttacagtctctcgtcaggtcttcgccgcaaatctctctccagaggatcgtggctgaggcaccatggaatgctgctgttctactggagatgaaatttcatccaaaagaaaaagggaaaagtatccaaaagtctttctagtctccaggcatttagaaaagctttagaacaagatctgcactggcacaagaatttgagtggaaatcaccctgcccagctgtgagccccggggcgggtgagccacacacttggatctcactgcagttgtggcctctgggaagaaggctttgaatgcagattttaaacaggtactcaactcatactgagccacggctactttcaacttaacaatatgtgagaaacccatctgatcactgcagacctgctgaaatctgttacaactaatccttcaatcctcaccagaatgctggctgtcctgcctctgccatcgcgagagaagataaaagctactgggtggccacagggcagttatgtccccttctctaggttttgtgattctggcagttagaatgggtttccagacttttacaagcagaaacccttatacatgtgattatatgctgtccgtcaacatgtaaaacaggccaa

SEQ ID NO: 271792 - DNA, 124 bp, Homo sapiens
aggtgtcatgtatgtggcctagggtattggcttgtttttaaaaccttcctgtcaattatgctgcatatagaaaagtacacaaatggtaaattttcataaaccgcacttacccaaccagcgcctt

SEQ ID NO: 271793 - DNA, 1340 bp, Homo sapiens
agtctttgaaatctggcatgctttttacacttacagaaaccctcaatttggacactaagttttcattggtaatatttgatgtatttagatttcataaaatttacagataaaaagtagattcaacaatctaagttgtctaagcacacttaaaagttttccagtaactgaaacaacggtaaacctttaaacttaaaattaattaaagttaaaaattcagttcttcagttgcactagtcacatttcaagtatccagtagctcgaggttaccactcagaacagtacagctctagagtatatacaaaacttatcattcaccttatatgaaatgtttaaaaataaatactgtttccctaaaatgtttttatagtgatgttcacacagcagaattttagagtgatgaatactaaaaatcacacctaaatgtcctgttctgtatgctcagaagagaatgaatatgaaatgtgtaacatacatttttaaattaagttgagttgcatgtgttaatattcaggaaatgaaactttttaaaacaattatgggtaatcacaaactgcctcatatggcttaacaaaaattttgaagtcaattataaggcttcgatttgtgaataagggaacaatttgtaacgtgctctggcaagattacaagaaagttaatgaatatagaaatttttcaagtgatgaaggcaggcttatgtgaaaaactgagaatcccctaaatgctactgcttattgatattaaaaactttcaaaaatcttatagccatttatttttaaatgtctatgctgtgtcctgtctccaaattagttttgctgcttatatcccattgcttatctgatagatatgattacttggacttccagaccctctcttaattctaattatgaatgaatagacatcttcaactaaatattatacatttggttataagtatataattttcatttatattgacattgcttcctatacagtcaactctttgcatactaaaggtattaacccaaaaataactttttcataatcctgtgcaatacttagtcatataagcagttccttcatgaagttattggttcacaactatggaatggatggaaccatttagggaaattcctgccatgactgttttttccttcatcaaaaagaaagataatcatgatgaaataatcgattgattatttagtttggaaacatccaaacacaatcataattagaatcatttctctagaaaaatatttctgagattcgttctgacactaaaactgcaccaccaatgtggtctaaatacagaacactagcaagctgattatgtagttaattcctaagagtgcatcaatattaaa

SEQ ID NO: 271794 - DNA, 465 bp, Homo sapiens
aaaagataaggggcattaacagatttggattaatcatgttaaatgggttattactatccaaaagaaactgaggggttttttgttggtattctcacagatttacatttctgtaacatatcttcaagtagttttctaatctagctatttccttccaaagccattcatagaaatagaactctcttaccttcaggcaaaccttacataaagccagtcttgaattttctctggagcttgtaggcaatgaagagttttgctaagtgtctttatcagaacagctttctgtgttccagaagacatttggtgaagacagttaatttgttttcctttccagaggagaatgttccattaatcattctaagaagccaagctgattgctctgttacgttaaggtcacagtattcttgttaacatgacccacacaatacttctgtgtcttagaacaggggtttttttttttcttatggc

SEQ ID NO: 271795 - DNA, 342 bp, Homo sapiens
ttttagaaaacttaattatataacttcagtttacatgtcttatgctttatactttttttcctggaaacttagggtaagtactgttgttccagttttcatttttactatttaaagagtttcctgcctaaatatgtcattttttaaaaaaagctttgaaaaggtgatagagattcttgtagtactgttaattagcccacagtgcatcattcttacaaagagagatttccttatataatttgtatcagaatttatggctatataaatgtccaggctaacattggagaaagacactttaggatgtaggcatattacaataaagaaaagagtattggtgttttttaa

SEQ ID NO: 271796 - DNA, 542 bp, Homo sapiens
ccttcctctgccatcatggctccactgaagatggcctcactgtgattaatgaagaactaactgccaaattcaccggacgctttttaatccttatattataaaaatcaaacaattgtaagcattgtcaaactcttcctcctacttgaaattcctcttgctgaattctgcagtggcatacggcagtttctcaaataatattgtttaattcaacaatgtttcattataatgtttatgaaaaaaaatttgatgcccagctggggccactgtctgtgtggagtttgcaagtcctccccatgtctgtgtctgcctgtgttttctctgagtactccagtttcctcccacacatcaaagctgtgcacattaggtttgttggtgtgtctcagtggtcctagtctgaatgagtgtggatgtgggcatgagtgtgtgctgtgatgggacagcatcctggccagggtcgggtcccacttggctcctgagctgctaggacaggctccagccacccaagatcctgcactagaataaataagtaaataattatctaa

SEQ ID NO: 271797 - DNA, 719 bp, Homo sapiens
aattgttggcatttgagcgggtccttgaagaatggacaagacttaaatgtgcaaagaaaatggaagagtaggacctgagcccaaggcacagaagtgggaatgtgggtgtcatatgaagagaccttcctggatgaattgcagagtttggaaaagcgtaaataagccacatttgcctacaaagcaagcttcaatccatatgcaatgtgcagaagagttaaagtaaaaaataaaagtcctcatccccccaacaatcccattcactagaggtaactactagtaagaatttcatgtacatatttttccagaaattgtatcatactctgcatacagttctgcatcttgattttagtcacttagcagttcagtgttttaagacatctcgtatcagtacctcttgctgtaccccactgggtttttcttctgtgattgggtagttgtcaatcacagtgaatgaatatatcataattttgcattttccaattacttggttggcttcaagttttgttgattacaaaaaaaaattctgaaaacctatgcacatcctcctattcgcttatgcgaatatatctatgggatgtatttttagaaattgctctgccaaattacattttaaatttaagcattaccagttgctcatcaggagggttatatcatttttaagttctctccaacagtataggaaaatacctgtttacatgaatgcttataaacctgtattc

SEQ ID NO: 271798 - DNA, 704 bp, Homo sapiens
tattgcagaaatgacagtgtgactccaagactaggccataaaagaccttgtggcttctgccttgctctctcttgctttgctcattttgagggaagctagccactatgtcataacgacacttggtaaccatgtgtagaggctcacatggcaagaaactgaaacctgccaacaaccagcaccagtttgccagctatgtgagagaagcaccttggaagttggtcatccagccctggtcaagccttcagatggctgcaaccccatgaaagaccctgagtcagaaccacccagctaagccactctcaaattcctaccaaaagaaattatgtgagataatgtttactggtgttgcaagctgctacgtttggaggtaattgttatactgcaatagataacatgtaggtactcattaattatttgttaatgacaaatgaataaatgaatgatgaaggctgtggtttctccccttactgtgttttgcggatatttaatttccagataaacaccccgagcctaaggaacctcatgttccagctttccatataaggatagagtcttcacgaattcttgaaagataagtagggtagaaaccatctgtaagaaacatttagagggaaatcaaattgctaatctcagctgatctgggttctcaattctgccaagttaaggacaccatatatatttttgggacaaaatgcaaaataaga

SEQ ID NO: 271799 - DNA, 635 bp, Homo sapiens
ggggtttcaccatgttagccaggacggtctcgatctcctgaccttgtgatccgcccaccttggcctcccaaagtgctgggattataggcgtgagccactgcgcccggccaatattcacaatttcaaaaggactatctgggagttttagtagtctgggcaagctgattgctctaacaaacaacccttacactgagcagcttaacacaataaaactttatttctcactcatgtcacattttaatgtgggtcaatggggcactctactccatgcagtcatgcagggatccaactctaccttgtggctccaccctcctttaggttcttggatcttctccttccagccagcagatgggaaaagaaaaggagcatcccatgtagaatgttttaataggccaggtctggacgtaatgtttccaatgggtagaatttagtcccttgtccacacctaacctcaaaggagactggaaaatgcagtctagcagtgtgcccaggaagaagtgaggagcacagatgttggtgattactagtggtttctgccataggactcatttctttctttctttttctttttctttttttttttttgagatggagtttcactcttgtcacccaggctggagtgcaatggcacggtc

SEQ ID NO: 271800 - DNA, 1014 bp, Homo sapiens
gaagaccacaaccactcttcaaatacaagtgcaacaggtgtttcgaagatcatagacgtagtgaagacagacaaaaactacaagaaatctcttctgccaaattattcagtcctataagacttctgcccattcacacatagcgccagtttgctatgctatatatttagtcttcacatcatattcaatactggtggtataagttgtatatattgtttttgttttatgcgttttttgcacatttgactccacaaaagtacatttttagtgttgactttgtgtgtaagcgttgtacatatgtgtaaaacagttgaaacttcctcagtaaatgaagagatgtccttttttgtatatctgcatttgtgaaagataaaattaaagatcttagctctctgagcaactgcatatgtgatgttgatccatcgtggtttttggtagatctcatcaaaagacataggttgtagatgactgcagttgtaaagctgattgcatacaattaccacccgtagttatacgcattttaatgtatgtacgaatgaatgaatgaaacaaggtcttgctttgtcacccaggctggagtgcagtggcgtgatcatatctctctgtaacctcaaactcctgggccttaagtgaccctcctgccttagcctgttgagtagctaggactgcaggtgcttgctccaaagtccagctaatgaaaaaaactttttttttgtaggggtgggatctcactgtgttgcccagctggtcttgaactggccttaagcattccacccgtcagagcctcccaaagctctgggatctcaagcctgagccaccatgctggctgttatatgcatttatgcattttgctttttttttaacctatttctttatgaatgtagtttgtctgctcatgactgttagtctacccatgtgactgtcattattagacttgaattataccttgtatccttgcaaaaatatgcatgtgattattgcctattttattgtgtaaagtgacctatgacgtattct

SEQ ID NO: 271801 - DNA, 650 bp, Homo sapiens
ttaaatatgagcaggcatcccaggatcactggacacttatggaaagcctctaatgaaagagccctgacagccacatggaagaagacagcatgaaatgaagagagactatggacactaagcaaatacataagacatgtataactccaggaaaaacaagaagacactgtgaaaggaagagacactgtggacactaagcaaatacataagacatttataactccaggaaaacaaaaagaaaaaaaattaatactagtcacagcgtactacatagcctagttggggatagcatttacaaagtcacaatattgtaagcacataatactgatctgatgaaaattgtaatgtaactaaactgggaaagagaaagtaagcttggaaacagtgatgtgttatggagaggtaggcccatcttctgtagcagtcagaaaatagatacatcctaaatctgaaagctgagaaatggcaacgtgaatgtgtcatgtggagatatggagatgaaaaccaagagtcagctaaatgagttgagggtgcttacctctggggagtagaaatgcgggtggggaaaaggtgggttagaggtttgctcatttccccaaccagacttagatttttcaaactatgtgcaagcatgatgtttaaaaataaaccct

SEQ ID NO: 271802 - DNA, 948 bp, Homo sapiens
taccaaagtgctaggattactggcatgaattaccatgcctggcccagaatagtatattgagtgcccatttacttgccacacagtttcaatgattatcagcttgtggccagacttgtttatctctatttgcatccgctctctgactccttgattattttaatgcaagtcgcagaccataaatgatttcattcataagtatttgagtatgtggcctggctcctgcccacttctccatccccatctggtgccactgcccttctggatttcactggcacggggcaggcaggactggctgataagtgccctgtccctcccttctaggacaataacggtgtgattggactgttggagcccatgaagaagagcatggtgcctgtgcaggtgcagctggatgtacctgtggtaaaggtggcctcaggtgggtctgggggcacttgctcagggcaggagttggaggaccttgttctggggctggcctagccttgggccttacagttgtggcctgcatcccttaccttttcatccttaggaaacgaccacttggtgatgctgacagctgatggtgacctctacaccttgggctgcggggaacagggccagctaggccgtgtgcctgagttatttgccaaccgtggtggccggcaaggcctcggtaagtggccttggtacctccagcagggcaaattggcaggccacccccacagtgaaggccaaaggcaggaaggatttgctgtggtcaggcttgcatcagatgggcttgtggtgttggttaggactttggagacagactgctctggtagttttgccacctactgtctatgggactctgaacatagtttcttcatcactaagtctacctacctgtaaacctacttcattaggttgctgtgaagttaaatgagttaatgagaagaatatcaggcagatggtaagttccacgtaaatgat

SEQ ID NO: 271803 - DNA, 457 bp, Homo sapiens
ccactcccccttttggagtgtgtttttgctgggggtaagtgggcaactacagtgacggttagttgacaaaagcaaaacaaaaacaaaaacgattagatggctttctacatagaaaaagaaagactacacaggttctaaagagtgaaatggtgttcagtggcatttgttttacagcctctgaactgtaagcagaactgtcaagctcccaaggctcgtcctctctcagcaaccccgaagcccccttggctgcaagcactcagcgcccgtaacctctcctgcatgccccagccccaaggtgtccttttgcactccggaccccttggcctttgtcagaaaacgctctgcactgcactgtcccctcttgctgcacaagagtagcggccacagcaatgctcaccaggcttggttgcacacagccccctgccccaggtccaggcctacacacacatacaaaaaa

SEQ ID NO: 271804 - DNA, 752 bp, Homo sapiens
tctcccaattttcctaaattaattgttcatgtttcctacatacccttaatgtttaatatttttttattattttgtgaattttccattctgctttctttaattatacaactgggtttggacattacccttaagtctacagtaaaaattaactttttaaatttttttcttaggataaatttctagggcattattactgggttagagaacctaatcatttgtaggacttcgatgtgttggcccaggttacttttatttgtattcttatattcaagttattagcaagtttattattgtgtctctgtcatactcagagactatacttttaacttcttcctttttttttttttttttgagacaaaatttttctctgctctgtcacccctgctggagtgcaatggccccatcatggctccctgcagccttaaattcctgggcttaagcaatcctcccacgtcagcttccccagtagctgggaccacaggcaagcactgccacgtctggctaattttttaaaaattttttgtagaaacactatctctttattttgttcaagactagactgggcagtatagtgatactccatctctacaaaaaaatacattagctgggtgtggtggtacgtgcatgtagtcccagctactcaggaggctaaggcaggacgatcgcttgagcccaggagttgaaggctgcagtgagctatgaatgcaccactaccctccagcctgggtgacagagtgagactctgtctccca

SEQ ID NO: 271805 - DNA, 400 bp, Homo sapiens
tggcatgcaggagtctctgctacactttcctggaggcctcattctcattgaaaaggagttggcagaactgggctggaagtttctcaatctgatgcatcataatcagcaggtatttggcccatactatgctgagatcctaaaacacatcatccatccagctcaagcacaagaaacagatgtggagcctaactgatagtgctggaccccagctatggcaacagggactcaggagagagaggtcagcatgtttctgggaggacatcacctgtggttagtcgaacagtcagccctcttcctcgctatagccaggacacagggatgcaggggtcaagcatgtaagcaccaactggcccaatccccttcactaataaacctctgagctgcaagaaaatttcagttc

SEQ ID NO: 271806 - DNA, 251 bp, Homo sapiens
gaatcccgtttgtaatgactttcactcttggtgtcagtagttttactgcttgggacttttatttgtgaattacagttgaaagctgcatttttacctatgtcaggctttcatctggccttaccagtctttcctctgtaggatggcagtcactgttggatattacaccatcctgtccagggctagcactgtggtggtgtgctgcttatagcttgctcttgtattgtaataaaagatatctttccctgtcgtga

SEQ ID NO: 271807 - DNA, 173 bp, Homo sapiens
tccattttcctgcttgtgtgtgcgtgtgtctgtatgtacgtgcacatgcacgtgaggatgtgtttttcctgcttgtatatgtgtgtgcacacacatcagcatgtttttcctgcgtgtatatgcatgtgcatgcacatcagcatgtgtgcttttcctgcatgtgtgtacacaaa

SEQ ID NO: 271808 - DNA, 602 bp, Homo sapiens
atcctgtgcctcctgtagagcccagacactgcttgtcgaacaaagaatgcagaggaccgtagagagcagtctacagcctgagacccatcattatggcctggcacatgatgattacacagtcttttaaatttaaaaaaatgaagatgttgaatggcacagatgaattctcttcaattctctgacattatttctcagaaagaaaccaagatgaagactggagctcagattgcctaagtcttggagagaccactggagaaaatggctggtatagagagaatttttcccactaatggaaatgaatgcacatgcatcttataactgacaacagagtacttcaactcccaccatagcccagaatattgttttcttaatattattttcttggtcgttgaagaggatgcagctacctttgcgtctcaacagttctataaaggatgctggtttactgaggggaagtgccttaaaagttggcttaaaggcatctgctgactctgacctcattttgcccaggagttgggggagggaggaagcaacaggctctgaaacagtggccacagctataaaaatcaacagataaagtctttactgtgtctagtccagaa

SEQ ID NO: 271809 - DNA, 528 bp, Homo sapiens
ggtggacctatgtatctctcaataatggcttgaaagaacaacaaatgcctgctgttgctaaggacaacacagtgcaaccccacattatattgatactcgtaaaataaccaaatatcaatattctgatttatagatgaagactggagctcagattgcctaagtcttggagagaccactggagaaaatggctggtatagagagaatttttcccactaatggaaatgaatgcacatgcatcttataactgacaacagagtacttcaactcccaccatagcccagaatattgttttcttaatattattttcttggtcgttgaagaggatgcagctacctttgcgtctcaacagttctataaaggatgctggtttactgaggggaagtgccttaaaagttggcttaaaggcatctgctgactctgacctcattttgcccaggagttgggggagggaggaagcaacaggctctgaaacagtggccacagctataaaaatcaacagataaagtctttactgtgtctagtccagaa

SEQ ID NO: 271810 - DNA, 973 bp, Homo sapiens
agaccccaggcccggacctgcctcgtagttatattaaaagtctagggattaaccagcttgtgcccgtcatttggctttcaatctaatctgcaactattactaggaggcttttagatcaagttccatacccatgtgtctctggaattctacagtgagaagcaaaagtgctcaggagttaagagaagcagacgtccgaaattatctccatgcattaccaaaaaccgtgggcaccacggcacggggaaaacttaccaggtacaatgagccagtgactgttactgaatttcttaagattacacttttcccaactactgcagactgcttcagaatagaagaaggtaagtaagcagggtgattacaagcaatcctcctcggaagtgaaactcactcttctaagtttacctctgttttgaattatttcagacaactctcatgccatcaagccgacggactttcaaaaaaataaaagatgcatttctttacttgtaagtatttgtctttgcaaagggctctctgatatggtagcacagaagtttgcacattctaaggatctgatgttttgccctcttcgggtatcccggctggaaggagctatggtgaaagggcacctaaggtgaatggacagattgtagatgggtgcacacaggaaaatgtacagctcctacaatgtattctgaggaaaaaaaaacatacaaatgggggaataaaagaaggcaaagagataatggagaaacttcccagtctattcaggcctgaatccaagaagggacaagaagaagggcactggcttttcctcgaagtgaaggatgtaactgtcttacacacaatctcctcccatagatctagggcttttcagcctcagtcgttctcagggggaaaggatggggacctgcaacaactttcacttaggctgcatcaattttagttcatattaataattttcaagcacttaaaactgtagccgacactcaaa

SEQ ID NO: 271811 - DNA, 574 bp, Homo sapiens
agaccccaggcccggacctgcctcgtagttatattaaaagtctagggattaaccagcttgtgcccgtcatttggctttcaatctaatctgcaactattactaggaggcttttagatcaagttccatacccatgtgtctctggaattctacagtgagaagcaaaagtgctcaggagttaagagaagcagacgtccgaaattatctccatgcattaccaaaaaccgtgggcaccacggcacggggaaaacttaccagacaactctcatgccatcaagccgacggactttcaaaaaaataaaagatgcatttctttacttctttactaagggaattaattatctggaagaacaggaacatacatgacggctagaatatggtcttagcccaaccttaaatagaacaagctctcttcaccccaatcctgccgccagctcatttccctctctttagagactatcatgatgaagcaagtagagaatggaatctcctggaccattgtctcttgccttctttgcagaattttacatttgttctgtcagaaaaataacaataaaagatttagaatctcatttcc

SEQ ID NO: 271812 - DNA, 903 bp, Homo sapiens
ctctgactcaaaataaataaataaataaataaaagtaatgtgtcctacatcgcatggggcctgagaggacaggcaggcactcctaggaccatcatagcagcgacccagccctggtggccagtgcccctcccctcttttctaggacttttctccaagccagtccttcccctgtccccccttgtaagggctgtctggattagaagcctggccccaggggactgcatcctccaagatgctctccccagcctctgtgtgagaaggatggaggtagggaggctttcatgctgcctgccccctgaagctgaatgaccatccctgctgaatgaagtgttggggggaacccttaggtgtttggccttcaagtttgtcagctccagcagctcgtttttctggcagggcctggtatgacacatttggctgtgttctttgctctggagtggacctattgattcttatcgagctaccagctgagggggaaggggaggacaaatagtagggcagacctgggagagaagggaccctggaaaagcctggccagtggacctgccaggtgggaggcagagcacagataaagagcctgagcctggattgttcctgatctgtcacctaatggtggggagagccccacagtgctcaatgggagccagccagggggcagtcagggtggaagctggccaggggagggtcggggcctgctgaaggctgggaggcaaacgggatgcaaaataacatacaaatgaatgcccactggttttgcatacaaggcttctgggaggtaagaggttccagtcagaggggtctctcctgctttcacctttatattcccccactggattccagaactgtcaagttgggcagtattttataataaagtatgtggagtcaacaagctaaaaaaaacct

SEQ ID NO: 271813 - DNA, 451 bp, Homo sapiens
atagctggaacattttgctaagtgtgtggaagggaagagtgacagcaggaaaggaggggagcttcattctatcagtattatcaggaaattgatttaatatgcttccaagtctctttaaatagagcttcaagtttgaaagggactgaagatatggcttagaggaatccaaaacagatgccaagaaagaagtgcccatgtcccacgcccaccaagacccctctcatcaggaagggatacctagcacatcacatcagaagacatggcatctaatgacaagcgctttgggtatctacccctcagcaccacgtttcagaagtagtcaagaggtcatttttccaaagtattagggcaagctcattttttgttttccctgttcccaagaagtttaatgctaatcaaagcagaatgcctaatcagtccaagatgttctgtcaacttgaattatctattt

SEQ ID NO: 271814 - DNA, 581 bp, Homo sapiens
agtgtcagaaaccctgagggagaaggcagctgtgccgggctgaggagatgacagggtttattaggtttaaggctgtttacaaaatgggttatatatttgagaaaaaaagaacagtagaaacaagtacatactcctctaattttaagataaatattccattcaagagtcgtaatataagccaaattcacagagtggaaaaggccacactctataaagttgatacaaacattccatgaaggtgctactgtgaacaagttttcaaattggatgaatacatgatttggagcaaggttatttgatcatgtggtgagactaagaatgattcttaaaaagtggcaaaagtttccttcaaatgtttctgtcactccttatcataaagtttattttacagcagttttaggattacaaagaaattgcacaggaggcgtgagaattcccatgactccctgccctacacagcacagcctcctccactacgaccatcctgcaccgcagtcacaaatcagttacaatggaggaatctccaaggacgcttggttctttctttttctggtgatctcctaatataacaagcctaagta

SEQ ID NO: 271815 - DNA, 409 bp, Homo sapiens
agagagaagacccaaataaataaaatcagagatgaaaacgttacaactgataaccacagaaatacaaaggatcattatagaatctcatgaacaactatatgccaacaaattgaaaaacttagacgaaatgaataaattcctatatacataacctatcagaattgaaccatgaagaaataggaaacctgaacagactaatagtgagttatgagattgaagcagcaatcagaagttccccaacaaagctcaggacccaatgtcttcactactgaattctaacaaatgtgtaaaggaaagctaataccatttgtattcaaactatttcagaaaattgaggagggaatactccaaactcgttctacaaggctagcatcactctcacaccaaaaccaggcaaagccataacaaa

SEQ ID NO: 271816 - DNA, 547 bp, Homo sapiens
aaagaacctcaaggcacctcccccagaaagctggaacacagtgtcagggaagaagatgaaaaaaccttccacttctggacaaaatttccattctgatgtggattacagagggccaaagaatccaagcaagccaataaaagccccatcagcactacctcctcgactgcagcatccttcaggagtaagacaacatgcgttctctagtcattcttcagggtcacagtctcagaaattctccagtgagcacaaaaatcttagccggacaccttcacagatcataagaaaacctgatcgtgaaagagttgaggattttgatcacacaagtcgagaatctaactatttcggcctttccccagaagagcgcagagagaagcaagctatagaagaatcccgtttactctatgagattcagaacagagatgaacaggctttcccagccctttccagctcatcagtcaatcagtcagcttctcagagtagcaatccatgtgtccagagaaaatcatcacatgtaggtgatagaaaaggaagcaggcggagaatggat

SEQ ID NO: 271817 - DNA, 534 bp, Homo sapiens
aaagaacctcaaggcacctcccccagaaagctggaacacagtgtcagggaagaagatgaaaaaaccttccacttctggacaaaatttccattctgatgtggattacagagggccaaagaatccaagcaagccaataaaagccccatcagcactacctcctcgactgcagcatccttcaggagtaagacaacatgcgttctctagtcattcttcagggtcacagtctcagaaattctccagtgagcacaaaaatcttagccggacaccttcacagatcataagaaaacctgatcgtgaaagagttgaggattttgatcacacaagtcgagaatctaactatttcggcctttccccagaagagcgcagagagaagcaagctatagaagaatcccgtttactctatgagattcagaacagagatgaacaggctttcccagccctttccagctcatcagtcaatcagtcagcttctcagagtagcaatccatgtgtccagaggacactttgcatccagagctctggatgcaaagtgtc

SEQ ID NO: 271818 - DNA, 429 bp, Homo sapiens
cacttctcccactgacagtacctgctaagaattagcatccagctcaaaatgcatatctatctgctgaagtccgacatcaccatcagctccacccagaggatctcacagtaaaaccacaggaaccagagagcgatatgacatctctgctgacgtgaacacaacaggaggctctcctcccctcctctacctccccaggcagtgaccttgcaagctcatcagcacagactggtccagcgtatgggagaactggagcaaggaggctggcagctggcagggttggggtagaggggagggcagggaaaggtggaagaaggtagatacacgaggatggggaggagagcgattgcagaaagatgaaatggtgttctctctccagcaagtcaattttgaaacatcaagttaaaaaaaaaatttcttgagaaaaaaaaa

SEQ ID NO: 271819 - DNA, 511 bp, Homo sapiens
tgctaatgtgaaagtccagtctatattattgaatgaacaataacccaaaggagagctacattttattaggttaagaaaatggaaatgactttgtgcttttctcaatatgaatattaaatatatacatatatatataaatccctttcaccaatttggttatatgatcaaacttaacaaccaaccactaaaagatactgccagcacatgggcatccaaatcttaggattattttgtgaaattgtacgggacacagagaaagagaggaagaaattttcaatcaagcaaatttagcaagatttggcagactcagttgcgcagatcggttgaaatttggtcttccattattactgtatcatttactcttgtgtcatctaaggacaaccttctaactaagactctcttatgctgcaaatgattataatttaaagaccgtgagtgtataaaataagctattatatatgtatatataaaatatactctaataaatacaaaataaagagtgtatgcatta

SEQ ID NO: 271820 - DNA, 272 bp, Homo sapiens
acctcattggtaatcaggaaaatgcagagtaagaccaaagggaaagtccatttcataatcactaagttggtttaaaaaaaaaaaaaaaagcctgatccagcctgggcaacatggcaaaacccaaaattagccgggcatggtggcaggtacctgtaatccagctactcaggtggctgaggcaggagaatcgcttgaacccggaagatggaggttgcagtgggccaagatcgcaccactgcattcaagcctgagtgacagcaagactctgcctc

SEQ ID NO: 271821 - DNA, 640 bp, Homo sapiens
aagtgtcttagccacggtccttcctaggagggcctccaaatggaggtacccaggctaggaaagaagttatgggatttgcatatctagcaggaggggcagggcaagtccttgactgcaaccccctccagaaaactgcaatgcaccggcccatatcgagtatggtgtgggaggacagcttggcccttgaggccagtcaggcaaagcctggtaattgtccaatgtcaggactgaatgatcacacaggattttggtataaagccagattcaattccttttgtatgtttcttcttccctttaataaatgctttcgtggaacacgcctaaaagaaaaaaatcacacaccacaactacctctgattaaaacagggattggctacctacagctcctgtaccaaaaaggagctacggttaatcatccattgttagcactaagattggataactgttgtcacttgcctcccaccacgtggaaaagcacttactgggagccctagattgttagaaccattagtggcaagtggtgatcctatctcctgtttatgagagtcaggttagggatcctcacctcacgcactcatggagctccaaatcccatttcaaccgatttttgttgataacataaaaataaaaaagactgtaa

SEQ ID NO: 271822 - DNA, 328 bp, Homo sapiens
ccatgtacaaataaaaaaaaaactagttttgtttaaaggaggtaattttataaagtgcttagctgaataccagatgcaaagtgcaaggtaaatgttagctggtgctgtgttagtgatactcatttctgtttttttttaaaaatgtatagtatgtatatatgtacatgcacacatatatatgtacacatgtatatacatatatttcacctatattttttttaaaatataaaattaaaatttctgcataaaaatataaaataaaaaaatttctctcatatatatatatgagaggtctcttacagaattgattaaagatctcaaaagaaca

SEQ ID NO: 271823 - DNA, 395 bp, Homo sapiens
tagccttgaagagtaatagacccattttcccctgacactggaggaagacagataagcatatgtatatggttatagagtaaatgtttacgctctactcatgataatactgatgaaaagagatgtatctttaacttctctgttgatgttagaagagaagcaactccacagaagaaagacctgaagagggcaagacccaaagtatggtcacagaggtaaggtgctgaagtgggaaagaagaaatgaatgccatttcagacctgccaggcaggaactgtgtggctaaaggtgtagaaagggctattcaaataacaacaataaccagcaatagcttccacattgagcatttgttataaaatgtgctatgaaaaaaaatactagtatgtaaaactatttgt

SEQ ID NO: 271824 - DNA, 1023 bp, Homo sapiens
  misc_feature (75)..(75): n is a, c, g, or t
ctctctctctctctctctctcttaccttggacttccctattccctgcgtctcagggaatagggaagtccaaggtnagagagagagagagagagagagagagagagagagatgcagcaatattgaaattaggccaattaataaccctgcagagggttctgtgtgttcaagtgagaggaagggtcacatgtctctcactttcaatgaaaagatagaagtgattaagcttagtgagcaagatatgtcaaaaaccaaaataggcaaaagctagacctcttgtgccaaacagccaagttgtgaatgcagaggaaaagttcttaaaggaaattaaaagtgttgctccaatgaacacatgaatgttaagaaagcaaaacagcctgattgctgctatggagaaagttttagtggtctggatagatcgaagaagcaagaacaatcccttaaaccaaagcctaactttctttaatcctatgaaggctgagaaaggtgaggaagctacagaagaaaattctaaagctaacaaaggttggttcatgaaatgtaaggaaggatgccatttccgtaacgtaaagtgcaaggtgaagcagcaagggctgatgtggaagcttcagcaagatctaccaagatattgatgaaggtggctactctgaacacagatttttcaatgtagatgaaacatccgtctattggaaggagatgccatctaggattttcatagccagaaagaagtcagccacttatggtagctcacacctctcattccaggattttgggaggctgaggcaggcagatagcttgagcccaagagttcgagagcagcctgggcaacatggcaaaaaatacaaaaattagctaggcatggtgatgggaggtagctactcaggaggctgaggtgggagaatcacctgagcctggggaggttgaggctgcagtgagccatgatcatgtcactgtactccagcctgggtgaccctgagctggagtgtagtgatgtgatacagtgagagcctgtctcaaaaaaaaaa

SEQ ID NO: 271825 - DNA, 406 bp, Homo sapiens
aacaaacaccattgattagaaaatcttcctgtaatattacctccaacccttcagaattgccagaccagaccttcatctgcacagcacaggatccacttatccacaatggtcaagaggcctgtctttaagatttccagtcacattcccccgaccctgtcatacttccaaccaagctatcctcaaattatcaccagccctgtacaaaaatgtaacaataatacgagacctatacaatgcctgtaatgaaaagtggcagctggtgatactgattgatctaggggttccatgaaaatataagcagaaaactactagataggacagaaaaatcagcaggtgaagattaagctaccaactcaggaccctaccaaacttttcagaaacacaaaaccttggtgccaaattttaa

SEQ ID NO: 271826 - DNA, 489 bp, Homo sapiens
tgaagctggggctggggtctctcagtcctaggtttgggttccaggttccaggtctgagatctctcaatccaaactcaagctccaagttccggatgtgcctaggtttgggttttaggtccgaacggagtccggggtcctggaccctcaattttgggtcctcgggccggctaggggacccaccaggccgtcctcaccgcgcagcctcctcgtggcgacccccgcagccggcgcagccgcatcgcgctgcgacccagtggcacgcgcgcaggggcgcgtagcagcagaggcagggcactgccagggagagcgcggccagcgcggcccagcgcgcggcggggcgcgggtggcccggctcgcaggcgcacgggtccgagaagtcgccctcggcgtccgacaggcagtggtagagcaagctctcggcgcaccacaggcagcttagacggcgcaccaggaggcgacccgggtccggggcctctgcgcagcggccgc

SEQ ID NO: 271827 - DNA, 260 bp, Homo sapiens
actcagctgcagttttcgtaacagtagtgatctgggagaatggccagtcatctccagtcatgggctgggcctcttagagaaactcccaggctggcagctcagagatgtgtgactcctgacctgtccataaacagttgtgggaagggaactttttaaagcaggactcgtagggagaatttcttttcattgttttcttttttgctgttaacttcctttaaatagtttgattcttttcattattaaatgttttcccctgatta

SEQ ID NO: 271828 - DNA, 279 bp, Homo sapiens
atgcatagcgtcgacagaaaaatcagacattagaagcaagcccagaaatgacagatgataaattagcagataaggacattaaaacagctattataaataacttagcagatttaaagaaaaacaacataatgaggataatggaagaaaaacaaccgaataccatttctaaagaagaaaaatacaatatctgaaatgagaatttagctggataggattaatagtttaggcactgcagaagaaaaaaaaaaagtcgacgcggccgcgaatttagtggtagta

SEQ ID NO: 271829 - DNA, 496 bp, Homo sapiens
gccctgatggtcccacttaccgcacctcgccgggaagagctcgtcctgctggtcgggcctccgagcggactgggcagcaccatgctcaagcctagggttcgatccccgcctccggaagcctcagtatccatccctcccctctgcctccctcttcgcgtgcctgaatatttatacaagatacaggcgtcatcacagccgccctcggcttccagagcagctggcttcgttcataaatattataaccactcagaattcatcatcatcacagttaatgataaaattccacagtgccagaactaaaagtcatccgggttcacgaacttggtgcatttccttccagacttttaaaaagaagatatttagggaatttttttttcaagatttttccccccagtccgcttacaaagtaataccatgttcgctgtaaaaaatttggaaataatggaaatgtataaagaaggaaataaaattctgctgtatctccacccaaagatta

SEQ ID NO: 271830 - DNA, 438 bp, Homo sapiens
cattactccctacctttctttacaaactctcctcctccaggatgtattttgtaaagtcagccacagaaaatatagcagctttcaggaaggacaaatcttatggtctgaattcaattgggtgggttgatatcactgtctcacatcatgagattattttaattgtaagaatataggctggtagcggtggctcacacctgtaatccgagcactttgggaggccgaggcaggcggatcatgaggtcaggagattgagaccatcttggctgacgcggtgaaaccccgtctctactaaaaatacaaaaaattagccgggcgtggtagcgggcacctgtagtcccagctactcgggaggctgaggcaggagaatggcgtgaacccaggaggcagagcttgcagtgagccgagattgcgcctgggcaacagagcaagaccccgtct

SEQ ID NO: 271831 - DNA, 534 bp, Homo sapiens
catcacgagagaccaatatgggaaccatcatcaccacgctgtgggaaaaggactatgtggaggcaagaagaaggcgatgtgggaacaggagggaaagtgtctacatctctcccaggtaaccccagggagctgcacagagtcacatccgtgcatgtatgttacatcccctgccaggtcactgccacagccacagctcgctgttgccatttctgacccattaagtgttaacacaagctaaaatcctcactgcattctcagaacggctccacgagaaagaaactgaggctcaaagagagaaaacagcctgcctcggtcccacagagttgacggtggattcagaatcccaccagatctgtgtctgtctctaaaagcccactcaaatccagaatcttatactgcaatacttttgaaggaaagaactatttcttgtcttccctctatctgctgtagacctagcacagtttcctgaatagatgagatgctcggtaaacagctgttgaataaatgaatgtattttgtagtcataaaaaaata

SEQ ID NO: 271832 - DNA, 694 bp, Homo sapiens
tgcaatttgaaaactacaggcttaggactctgtgccaaaaatctctattttaaatgaaaatatttatataaaaatacatttattctgcttaacacaaattaaaactgacataaaattttatgataataacatgattcaagaaatgtgatgtagatttttgagaatgccaaaaatcaggtttcagaaaagctacagtatgaaatctgaaaagcaacagaaattgaaagtgaccttaaagaataaatttcctaatttttcccagtttcctatgtttataactattataaagagtttaactttctggaactgaaggagaaaacatgaaaatgtttatattgcttcttgttaagcaggtagaccaaattccgctttcagtaattcatccatacagaatttggatgactatgtataaaggaaaacttaaatcttaattattatcagtttaaattttttttgtttgttgaatgacaaaggcaataaaaataaatttgactttagctttttttctatactttcctctttttgtaattcttaaattctagtcactagtcattatgagagtattgactaaatattttcacaatctaaatattgtcacaatctaaatttctgtagtagagagagccgtagccctttgtaaaggctttcgttcgtccaaacaacacttgatccaaccaaagttccaatgtgactg

SEQ ID NO: 271833 - DNA, 440 bp, Homo sapiens
cctcaggctccacattttccctccatactttgcacctgttcagggcacagccctcatcatgcccctcaggactccacttgaggcctcttacttcagggagagaccaagaagaggggcctgaagcacttcctgcagaaaggagacccagcccctgccagaggcctgtgtggcttcttatctccttagaccggagcagttggaggctgggtcagaaaggcagaaaggaacagaaaccaacaatgggcaggaatgtcctccagctacaacctataggcgcagctacagccaacaggtgcaattttagggacatttaaaagggtcataattccataaacaaaatgcggtgtatgcacacagcctttaaaaggaaggaaattataagagatgcatgataacatggatgaacccaaaagacactctgctaagtgaaataaaccagt

SEQ ID NO: 271834 - DNA, 452 bp, Homo sapiens
ggtaatatgaaaaagttatttaaatttcatttcacgttgtccttttgaatcctcgcattaataaaatcgttttcagtggaaatatcagcagcaagaaatagaaaatactaacagcaagattttttaatgcccataagaagcagcttggaaattgacactcggttgccaggcacgttttacagctttgctctttaccatggaccagagataattttccttatggagaatttacaagtttccagatgcattatgctgaagatagccaggatccagtacaaggttggtatcccactacaaagcaagggcctgccacaaccagatgcatgtttcaacgacatcgaaagactcaccttggactcatcgctgacttgtcaaccagaactccaatatctgagtttgtcaagatctcaaaggacgtggagtgcatttgtattatcatataaagcacgtga

SEQ ID NO: 271835 - DNA, 496 bp, Homo sapiens
atgttccaagtaataaagaagaaaggtaaagatggcaacgtaattatgaccaagttctgttcagagccctcgaagatcaatttactttttttgctcttaagtacagtactttaatatgagctttagtgagcatatttatattcattttgaggcggtcatacaatgaaattaaaaatcattctccattcagtgacttttaatttagattttgcataccaattacaactctgcctctgcccccgccccccaaaaaaccctacatttcatcttaagttcatttcttgaaagtatctttgtcacaaactaaaaaactaatgatacaatactggaatttaaaaaacaagatgtaattgggccataatgacaggattattgcctggtaattttcccactattttaagctttgtgtttgacctgcatgctagttggatatttatttgtgtacatcgggttttgaggagttcatagtttttctaacagaaatcactgaatgtta

SEQ ID NO: 271836 - DNA, 553 bp, Homo sapiens
agtctatctctgtcatggttcatttatgtgtgagcatgacggactgaagcccgtattatccacagctgacaagtgtcaggccgacagttcaatcagcccttcctcgagatgatgcccagggccccgtgtttgaagtaggacaataaagcaggcaacacaatccgggcaaactgatccgatccctgtatgtaaaggggattctgcttaataacacagtgtggtttttttccctctccaaacacattagtccttaaacagtgagttggcccttaagaaaatctgtgactgacatgaaaatgctgaagttttaaggtggttggtttatccgtaacctcatggggctgcttctttgtgcagactagttttgtcaaagtcagaaaaataatgtattcagtgtctgatcatttttagggagttattcgaatgggattttaagtcagacatcctgatgttgacacagggatcattttcttgtccttttgttttacatttgtggaacagatcatttgcattggctaataaaattaaatctctgaaatgcaaaaaaaaatga

SEQ ID NO: 271837 - DNA, 551 bp, Homo sapiens
gagttctttgtgtcgacctaagaacttatcaaagaactcagcagtatgagaatagatcaatacatagagggtttcctttaagtcttgtagaaactcattactctccagtctctttttccacttatagtagagagaatcagacttgcggatatccagttaactatcaatacctttaaaaaatgtgaacaagcagtccatctgaataattataccaaatgtcaaggcttttaaaagtgcttaactttaaaggtcctttgcagttgttcagacctagattctcagttcagttagcacagagagagacaaggaaaaaatgaggaacacttttctcacgcataaatattcactggtttttgaaatactattgattccttggataagaaaataggtcaactttatagctttttgtctccaaattgatttcccgccacaaacagtggcttgtgcctataatcccagctacctgggaggctgaggtgggaggatcgcttgagcccagaaagtcaaagctgcagtgagctgtgattgtgccactgtatcccaacctcagt

SEQ ID NO: 271838 - DNA, 422 bp, Homo sapiens
gacctaagccagcagtctctggaagaaacccgggataacttttaaataccagctcaggaaatcagttgtacttaaaagagcagcttttttgaagaggggctctgttttaatgacattactgtaaaaagaatggaactgacccctaagttgctttctatttgcggtgggcaggagtgcagatttagtatgcactggcaatgtgatgtattcttagaagtcattctaaaaagtggaatttgttctctattataagacatgaacgttccagaattcattacagaatgaaatactcaggatagcatatgcaggtttcagattccttgatcaggcatctgtttacatcatgctgtcctcatttctactactttttccatttacactaccatgtataatataggtatgtacatatcaaaggaccaaaa

SEQ ID NO: 271839 - DNA, 586 bp, Homo sapiens
  misc_feature (556)..(556): n is a, c, g, or t
ggaatttatctaaggactgtgattgattttaaaaggtatgtcttcactgttttataaacaactacaaacagaaatacttacctgctgagccaaattttcacgatttggaaattggggaagggcatttttctatatatcctcatgttatttgcagtcatttgaagatctttaacttcagggaaatggaaaacttctctgaggggatctacatctttgaatgtgcttccctcgaatggtcacagccctgtggaacaggttccttttttctctaaaccatctaccacactgaccaattttaggaggtactggtgtcacatgacagtttctttatatggaacattaactaactgcaaaacagaagacaacaagaaattaatgaactactctactgtgtgacctgatggtgaatacagaaaaagtaactcggagagtactcattcaacaatatttataaataggtcctatataaaaaatctagattgctgtcatatcttacgaaagtctgtctctcaccttgcgctggtaagttacactaagctctaactgattttttttntgcggcgcaagtgagagtctccgtcgaact

SEQ ID NO: 271840 - DNA, 454 bp, Homo sapiens
ttttttttttgagacagagtctgtctctgttacccaggcgggagtgcagttgcgtgatcttggctcactgcaacctctgtctctcaggttcaagtgattcttgtgcctccgcctcccaagtagccgggagtacaggaatgagttactgcacaaggccaattattcttattttttataaaaaggaaatatagttttataaaaatacttcaagagatgaagtagtttgacatttaaaattctgaacagcaggctgggttagggtgtacaaaatttcaagcccagtctagtcactggggcatatttcttctgcttcagaagtgtcatttagtatacaaagactgcagccccaaggagtttctcacttttagattacttcacactcaaattcaagcaatgaatcaaaattatcatgtaaatattagcaccagtttatggctctagcaccttctgttcc

SEQ ID NO: 271841 - DNA, 125 bp, Homo sapiens
catacagtatatgttcagaacttattcactaattctaactgaaacttcgtactctttaactaacatctccccattatgaacagatacattatgttttcttgtacttctgagcctctacacgtgct

SEQ ID NO: 271842 - DNA, 359 bp, Homo sapiens
gaacaacagccagccatgcgcaactgcacctgagagctgttttaaattcagggatactgtccttgactttgagaaaatatcagatccctctttttcattccacgatgactttctttttttctttttttctggtgaacagggtgaaaacaaagtaacataacactgcatcaagatgcgcagcttgtgaaagaaagagccaataaatcagatgatttgctgtatctacacaaggtcaaattgcaaaacagattgacttttctccactaaaccgtccagcttgggacttataacagctgaacgcttggggagttattttcagtctttacaacagaaaataattaaaacattaaatctccaaa

SEQ ID NO: 271843 - DNA, 442 bp, Homo sapiens
gcagcctgcatccccaaatcaggagcactgggtgctgctgtgttacagtgagtgtaggagcatgccgttctgggcttcactctgcccaaatatgtcttgctcattttcaccgccatatggctgctcgtcccggtctgtttgaggttccttcctgttccctctctgcctctaagtccttcaaaaagccaactggaagtgcctcttccaggctttccttagcctttctttattcccttgaacttctattatgttaattgttcaaaagattagttctgacacttaccctatgctgctttgtattactattggaaaacaacagtagctctctcaacccattgggtggatggtacatgccatgctttatacattcccgtggccctgctgtacctggcacacacaaaaggggattaataaatatgcatatgttgaatgaaaaaaaaaa

SEQ ID NO: 271844 - DNA, 344 bp, Homo sapiens
cattagcatcccagtttactctattccgtcttctccctgtggtttatcaacttgtaggttaagcaccgccaatagttgaatctagggttgacttattcttgctacttggcaggcatttgggctactttttttttctttcatccatttttgtatagttttgataaaaactaaaaaggaaaacaaaaaagcaagttagttttgatattaagtcaaatactactaaaaaggtaaatctgcagctcctcatcatacaatttagtgaatttttaccttcacttattactttaataaggacataagttcaaaatgtgtcctttatttcaagccatattcattacaggaaa

SEQ ID NO: 271845 - DNA, 291 bp, Homo sapiens
gaatgacaactatctcaagctcattttttctagtctacggtaaatacaaggatgctgctgatgatggtaatgatgatcatgatgatgatagcagtgatggtaacctattagtctggcacttaaaatactttcacaaacattatcttatttgatcctccctacacccctttcattaagtggagcaggagagcaacaaaccatcacttcaaaataagaatatgaaaaagattgattgaaacaatcaaacatcaatttccaataaaattttaattgcctttgaggccaactaaa

SEQ ID NO: 271846 - DNA, 260 bp, Homo sapiens
gttgttgatgagatatttggaggtggggatcaatagaggggaaataaaatgatcagtactgcggcgggagaggcccatgccccaggaccagcctgacacctggatggccacaggggtggagggaacggccaagcttggctgctgccatcaggggcccgacctcctaagccctgtccagggggaacctggtccccatcagcaacaccgcacaggtccacccagcacctcgggaccaggacagcactcaccaccctcatcgg

SEQ ID NO: 271847 - DNA, 469 bp, Homo sapiens
aagacctgaggaactaaggggaggagaaaaccagaagatggaaggaacctgggtctctgaatgactgcctggagcataactcccttgccaacctgtattgtgctgggaagtggttaactcctggaagatacacagggatttcccaatgattgcaaagcaggcgtggcaaaatcacagtcttggattcagaatgggaagcccaggtttgagtcctagctctaccaccttgctgggacaaatcattccaccttagtttgtctctaaaataagaaaaatatgaactctgtctttccagactttcaaattccataaggacaggggtcatgtccatttttttaaaaattgtctccatacacctatcctagcacctggtatgttgtagccctcagtaaagatcattgagtgactgaatgatgattgtggagaccaaataaggtaatagacattaaaatgctctataaatcctgta

SEQ ID NO: 271848 - DNA, 408 bp, Homo sapiens
ggttgagtaaatcttagggatttgctgttaatggtaaattagtctacaaaaatagaaatagtccaaaggattttgagagggtgtgggctcagctgcaacccctcctcccaaggccgttggtcaacaacatctccagccctgtggaaagacagaagcagtgaagaaaatgtcagataaacatttggtatgtgtgtacacttctcccagaaatcctaaatgctttgcatgtttcagctaataattcattaaaatggatggattatgctgagcattttataacctacttcactgctctcctgtctgtctaaatccatccctttgtgacaaattttttatacgtggctcattttttctattgtgtttggtgtcttacccccatgtaaagaataaaagcgcatgttcatgttg

SEQ ID NO: 271849 - DNA, 395 bp, Homo sapiens
tttattctcaattttgcagataagaaaattgaagctcaggaaagttctccaatcttttccaaagttttgtgctagtaggtggttaaaatcagaaggaatttacacccactttttctgaggcaaaaaccagtatgctttctgctctactaggttgcctttcaagtcgttaggaaacaaatatgtttggcttaacctgaggaagccatcatggaacagaagatatttgagtaataaatgagatgttcaccaaagtggaggaaagatggaaggatactcaccctctgtataaacttctcagctcactacaactcacagaacgctctcccttctgactttcattcacttctataatgtaatacattgattcaataaatatttatcaaatacctactata

SEQ ID NO: 271850 - DNA, 465 bp, Homo sapiens
gcttgaagatttccgattcatgtacacataataaacactcaggtttgtcatctggaggtgcaaatctgaaagatattccgacaaatgaagtgctggcagagagaggaataaagagatcggtgcctgtcaggggtcaggcagcctgagattgcttctagagatcttttgaaaatttcacacgattgaaggcttaggggcttcactgcgttcgcatttcaaactcagatcagtgggatcacaatcaaaaatagaggtctggaaaattttgatgcaaagatggccacgcgcatcagggcttctctcactagctctctctctctctctctctcttttttttctttctaagacagacaccctgacatggctgtgatcctttggatgacagagttgtcagtaaagaaagagaaaattgcatcttgtctgataacttcctttcagtcaaaaggaatttagggtcttattttc

SEQ ID NO: 271851 - DNA, 594 bp, Homo sapiens
atttgggcaaaaatgtattaataatattcaatctggtgggtgaagaatgatacctttttaaaattggcattccctgttactgttccagtcaagtattattttatatgatcgtcttcttgggtgaatggcttatttattctttgcccagtcttaaattgccctatttgctgtttgtatcttttaatttagtgaataactaagagttatttatatattatggaaggattattacactttggtagatatgctgtgcatatattttctactttgccattacctgttgacttcattttataactacttgacaagtggaagttttgtatattttcttaccttgtttaggaaggctttctctatccccaagaatataaaaatacacacacgtaaatttgcatatttaatccatctggaatttttaacatggaatgtgaagtagaaatttaccatctttagaatttgcaggcattcatcctcaagcttactgtctcacagtcaaaagatggcaggtactttttcaggcctcgtaactgcattcatacaagaaggaagaagcagcagcaaaaggctgaaatgagcatgccaggagagtcttta

SEQ ID NO: 271852 - DNA, 847 bp, Homo sapiens
gggagactgaagtgtgaggaggatcgcttgagcccaggagttcaaggctgcagtgagccatgatcatgccactgcactccaggctgggtgacagagcaagaccttgtcccttaaaaaattttttttcaaagaatctaaaaggaaaaagggaagactactgagttcatgtacagctcaaagaagtggaatagggaagtttaaaagaaaagggaaaagaaaacacacacacaagaatagacactgttggcaaccctacagagtcagagtttgaaagtgagagttggaaacttgacctctgagtttgctggaggaagccagcaacatgatttagaaaggataatataatcataatggcaggaagtgagcacagtcttcttggctggagaatctcagttgcagtgtttggggcagactgactggaaatgatgctatgtcggggaccatgtttgaaagcctaaaatctgagttgacaaggagatgttccatggaggctctgggaaagagggactcgaaggcagacccccacacagcggactagtaaggtctcgctctgtcacccaggctggagtgcagtggcaccatttcggctcgctgcagcctcaacctcctgggctcaagcaatctttccacctcagcctcctgaacagctgggaccacaggtacatgccaccatgcccaggtaatttttgtactttttgtacagacagggttttaacatgttgcccacgctggtctcgaactcctgagctcaagcggtctgcctgcctcagcttcccgaagtgctggaggtgttttatggattgagtactgttcagttgtaccctatgaaagtgacccaccacaatgg

SEQ ID NO: 271853 - DNA, 3013 bp, Homo sapiens
cgggagaaagccccgcccccggcgcccgctcccactcctgattggccgggccagcccggggaggcccggcgggaccccggcccgcgtctcagctataaagatagccccggcatgacagccgcggcgaagctcttctagttcatctgctggccggctctcagtccccgtggcgccccctttcctcttgtcccagagcgctctcgactccaccatgccaaggggattcctggtgaagcgaactaaacggacaggcggcttgtaccgagttcgccttgcggagcgtgtcttccctctgctggggccccagggggcgccgcccttcttggaggaggctcccagcgcctccttgcccggcgcggagcgggcgacaccccccacccgagaggaaccaggaaaggggttgacggcggaggcggcccgggaacagtcggggtcgccatgtcgggcggctggggtgagcccggggacgggcgggcgggaaggcgcggagtggcgggcgggtggcagggaaggtcccgggcccagccccagccccagccccagtccagcgaagccggcaggcgcagagctgcgtcgggcgttcctggagcgctgcctcagctcgcccgtctccgccgagtctttccccgggggcgccgccgccgtggccgctttctcctgctccgtggcgccagcagccgcaccgaccccgggggagcagtttctgctgccgcttcgggcgccgttcccagagcccgcgcttcagccggaccctgcgcccctctcggccgcccttcagagtctgaagcgggcggccggcggcgagcgccgcggcaaggcacccacgggctgcgcgtctggacccgcggccgcgggaatcaagaagccaaaggccatgaggaagttgagctttgccgatgaggtgaccacatcccctgtcctgggcctgaagatcaaggaggaggagcccggagcgccgtcccggggcttggggggcagccgcacgccactgggggagttcatctgccagctgtgcaaggagcagtacgcagaccccttcgcgctggcccagcaccgctgctcccgcatcgtgcgcgtagagtaccgctgccctgagtgcgacaaggtgttcagctgtcctgcgaacctggcctcccatcgccgctggcataagccgcgtcctgcggctgcaaacgccgccacagtctcctccgccgacgggaagccgccttcttcgtcgtcttcgtcctcccgggactccggggccattgcatcttttctggcggagggaaaggagaacagccgaatagagcggactgcggatcagcacccgcaggccagggacagctccggggcggatcagcacccggacagcgccccgaggcagggcctccaggtggtgacgcatccagagccaccgctgcctcagggcccctacacggagggggtgttggggcgccgggtacctgtgccgggcagtaccagtggtggcaggggatccgagattttcgtgtgcccatattgccacaaaaagtttcgtcgccaagcctatctgcgcaagcacctgagcactcacgaggcgggctcggcccgtgcgctagcgccgggctttggctccgaacgcggtgccccacttgccttcgcttgcccattgtgcggagcgcacttccctacagcagatatcagggagaagcaccggctgtggcatgctgtccgcgaggagctgctcctgcccgctctggcgggggctcctcccgaaacgtcgggccctagcgggccatctgacgggagtgcccagcaaattttctcgtgcaagcactgcccgtccactttttttagctctccagggctgacccggcacatcaataagtgccacccctcagaaagccggcaagtgctgctgctgcagatgccactgcggcctggctgctgagggacgagagaccaggatgatttcgaggttggccttagaggaaacagatcatgggaatttctgtggggctttcttcaacttgcaagtttactttcattccttcctatgttttaatcccctaaaattctccctgtagtcaatgttccaccagaggagcggacagtgaaatgtaatatccctctctagagcaggtatgtatatggtataaaccttgagatcaaagactgtcagctttaaatccttctcactttccccactaaaataggatttttccccttaaaactctggagaccctaacgaatcctatatgatttgtaattcctatggaaagtcgcggtgaatgcgtgcatgtctcaatgtccacaaaggattctggctaccctttggtagccaatgttttttttgtcttgtcatcacaggcgcctatacagcttctgtctcaatagggtcagatattttgcactgtatattctgtgaattaaaagttatgtgattggtgtcaaacttaaggagattcaagacctggcagaaaatgtaagaggatttttgctgcttttggggtgcatggggatctcccctgtaaactttcctttgcccaattatatgtacatgtccattcttaagttggtgtttggaggtggggaggatgctactttactggagttgagacaccccctaaaattctcaccctcagctattttgtgggcagtattcaggaagagctacttcaaacctttctttaaatggctttttggaaatacagaagtcgtttcctcaagtttgactgttttaatggggtttcacccaaattgtttaatgcttctgctgtaaatgtcatactgtgtattcattatgaaaatatgtacagcttaaggaagatgttaacacctgtaatccactaaggaactgaatggcaatttgctcaatattcagtattttcttttcagcggcaacttgtttttgatttttttaaaaaaccatttcagtgtacattgtgtactaattccctactagccagtttgggacattggctgagcactgcctgacagaaagcccgtatttgtaagatgcttaccaccaaataaatgtacatagactgtg

SEQ ID NO: 271854 - DNA, 450 bp, Homo sapiens
ggaaaaggagggctcacaaagccacgcattaccctcgaaaagctttgcacgttgcccagggctctcagagtgtcagtctataaggaatgaggaaagactcaggcagtgctggggccacagagacagtggcagctccccttggtctgccgcagaggttggcctgcttcctcttctgggcgttaagaaaagagtggattcagggaaaggggatcaggaggaaaaaaggggtctcggagaatttaaggattagtaggtcaaacagcagaactagcagaggacattggaatcacaaagacagcagtcctttcttatctgggggatacttcccaagacccccagtggatgcctgaaacctgggttagtgcagctctcggttgccatcaatcagagcccatttctcttcatgtcttctacctacgaatgtaatgccttttccatcttcactgagca

SEQ ID NO: 271855 - DNA, 1124 bp, Homo sapiens
aggttggtcttgaactcctgagatcaaataatccagccttttgggcctcccaaagtgctgagattacagtcatgagccaatataccctgctggatctgtgcatttccaatagagtgttgttgaaatctccaactatgataatgaattcatcgatttctccttgcagttctgttaatttttgcctcacgtagttaaatactctcttgttaggtgcgtgcacatttaggtttgttatgcggaaacataacatagtttcttggaaagctaattcttataccattatgcaatgcttttcttcattcctgataaatttccttgctttgaggtttgttctgtttgaaatttgtatagcttctcctgctttcttttgtttgtgccagtatgatataatacatatatatattcatgatccatttacttttaatttgtgtgtctttatatttaaagtgcatttcctgcagacatcatatagtttaatctctgatttttaattggtgcatttagatcattgatattaaaatgattattaatataggtggattaaatatctaccatatttctttctgttttctatttgttgcctttgttctttgtttctatttttgtttttcattctcttcttttcagagactgagtctcattctgttcattaggctagagtgtggtggtataatcatagctccctgtacccttgaaatcctaggctcaagtgattctcctacctgagccctgagtacctggtattacgggcatgtgccacaaagcctggctaatttttatttaatttttgtagcgacagagtctttgctacgttgcccaggctggtcttgaacttctggcctcaaatgatcctcctgcctcagtgtctcaaagggttgggattataagtgtaagctacaacacccagccatgtcttccatttttttcctgcatttttagtttttaacttagcatttataaagttccatattttctcattcttagtatatcaattatactttaaaaatgtgattttagtggttaccctagtgtttgcaatatacactcacaactaacataagtttgctttcaaataatactataccatttcacaggtactgtgagtaccttataataaaaaaatc

SEQ ID NO: 271856 - DNA, 766 bp, Homo sapiens
gatggggagaaattattttcaacttgtctttcaggtagatgtctcatacttgaatgtaaacaggtcatactaattttaaagttgcccaatagaagaatgggcaaaggaaacaataagaagtttaccaaaatagatatatatggttcttaaacaattaaaacgataaaacatctgaattaaaagtacactgagatgcgttttttcacttatcagattgacagagaccaaaaaacttgataaagcacttgatcaggctgtgggggaaaggtctccacatacattacagataggagggtgcattggattgtaggtatcaaatgtacacccacaaaatggaatagtatgtatctacgtaaaagcataaggaagctcctttttgatttagaaatatatgaatttattacctatttgaataaataaattagtttttaaaatagttgaatggctttgctgatgtactattgaagttgactaaatttaagtagtacagcatagagaaaagacaaaaattcttaagtgtcaatcatttggttttaagagactttagagacagacacctggattcatttgctagatctggctatttatggtttgattttaaggcaagttatttaagcttttcttgcctcagttttctcttctggcagtggagtaatagtacatagttcatagtattgctgggaagattaaatgaaccatgtaaaatgtttataatagtgcctggcacatagtgaacactcaataaatgtcagctgtttttacctaa

SEQ ID NO: 271857 - DNA, 219 bp, Homo sapiens
cgggcgaggtgccgcccgcccgcgcccgctctagctctcaccctgcgcggcctaacgggcaccgcggcccagccaggggaggcggcgccggggctgtgaggggaaatgcagaagcttgtggaagccccatcccctccgctgcttagccccgcgcctccgctgcaggctctgggaacgtaacgcgagcagcggcggccctgcccccgccctgccaatgcc

SEQ ID NO: 271858 - DNA, 441 bp, Homo sapiens
gtcaggtggttaaaacactacagataggcattgttaaacaaaacaatggactaagcccctgcactaggctccaacagaacagacaaaatcaaaatggagtcactcatgctaaatgtcatataatcaaactgaaactctaaggaagctgataaatcctaaaacagacctttttttttcctgaaaacaggaaatttcagtctaccagagtcaacctagtaagaaagttgcctcttctttgacctttatgagaaagtaacctgaagtaacctgacattaatgaatcagcttctcttctactattctgtttccttactcccaccttacaaagctcactgctctgcttgccctagtgagagaactcattctattgtgtagagtagagtcagccatgattcatgaattatgaataaaagacaattagatctataactaaaaaaaaaa

SEQ ID NO: 271859 - DNA, 234 bp, Homo sapiens
agacctgggcttgaacttactggacttgccaggctgaccttcctgcatgtggtttatctgcaaagtgggggtggggggtggcggggaccatgccctcctcaccaagctggtgcaaaggaatgtcgttcagggtttttaagccacactctcattgtgctttcttggactctctgatatggttcactgcctatgaagatttttgtcctgttttacttttcactggtttattattat

SEQ ID NO: 271860 - DNA, 462 bp, Homo sapiens
aatatatatgatttacctaaatttacacagctgatttacagtggagcctaggttaaaatttgagtctctttctaccttgccatgtttatcattatgtgtttaataacataatataacctaacaaataaataatacgcttttacaaacaaattatggctgctcaccccatctgggaactgaggagtgcctctgcccggccgccaccccgtctgggaagtcgggagcacctctgcccggccaccaccccgtctgggaagtggggagcgcctctgcccggctgccccatttgggaagtggggagcgcctctgcccggccgccccatctgggaagtgaggggcacctctgcccagccgccctgtctgggaggaagtgaggagcgcctctgcccagcccccccgtctgggaggtgaggaacgtctctgcccggccgccccatctgggaattgaggagcgcctctgcc

SEQ ID NO: 271861 - DNA, 199 bp, Homo sapiens
tcccaagcctacccatgctctcctgccctgacccttctctgaccactacgatccacaccaatgctctccagaccaagagctctcaaaccttcatgtgttaaaggtcttacagattcttgggtcccacccttagagattctgactcagtaggttaggctgggctctaagaatttgcatttcaaacaagtccccagataat

SEQ ID NO: 271862 - DNA, 639 bp, Homo sapiens
attattccacctcccacaccttcccaaccctggctgtgctggccctgactgagaggagggggtttccacttccgtcacctggcaagggaacctccacagcccaagaatattaacatttatcaggtgccgggcatgggcctcatgtgttttatgtaattcaatcctcccaacaaaagtatgagagccagccctgcagcacagccttcaacatgagcaactcctgctctctgtagctccagccccagcctggacctatctttcagagccataatgctgagacagtccctgagtcttggatgaacacaggactcacagtgtctacaccggacagtttctgtttgcacgacgttgagtaaacttcacatccatcggggaagttaccctttgggattactgatgaaggtgaggagaagatgctgttctgagagctgctgataatacgtggatccaaacccacaggcttgagctgcttaattgaaattcacgtcaaaatgaaattctggtttagctcaacttgactactatggatgatgaaaataaatccctgggtcacacaaggatagtgattgagtagagcttgtttgctggcacaggaatgacatttcaactggaattaaattgtcgtcagttaacagaact

SEQ ID NO: 271863 - DNA, 754 bp, Homo sapiens
attattccacctcccacaccttcccaaccctggctgtgctggccctgactgagaggagggggtttccacttccgtcacctggcaagggaacctccacagcccaagaatattaacatttatcaggtgccgggcatgggcctcatgtgttttatgtaattcaatcctcccaacaaaagtatgagaaagaccacactcaggccaagcactgtggttcccgcctgaaatcccagcgctttgggaggtggaggcaagaggattgcttgagctcagaagttcaagaccaccctgggcaacacaagccagccctgcagcacagccttcaacatgagcaactcctgctctctgtagctccagccccagcctggacctatctttcagagccataatgctgagacagtccctgagtcttggatgaacacaggactcacagtgtctacaccggacagtttctgtttgcacgacgttgagtaaacttcacatccatcggggaagttaccctttgggattactgatgaaggtgaggagaagatgctgttctgagagctgctgataatacgtggatccaaacccacaggcttgagctgcttaattgaaattcacgtcaaaatgaaattctggtttagctcaacttgactactatggatgatgaaaataaatccctgggtcacacaaggatagtgattgagtagagcttgtttgctggcacaggaatgacatttcaactggaattaaattgtcgtcagttaacagaact

SEQ ID NO: 271864 - DNA, 541 bp, Homo sapiens
attattccacctcccacaccttcccaaccctggctgtgctggccctgactgagaggagggggtttccacttccgtcacctggcaagggaacctccacagcccaagaatattaacatttatcaggtgccgggcatgggcctcatgtgttttatgtaattcaatcctcccaacaaaagtatgagagccagccctgcagcacagccttcaacatgagcaactcctgctctctgtagctccagccccagcctggacctatctttcagagccataatgctgagacagtccctgagtcttggatgaacacgtgaggagaagatgctgttctgagagctgctgataatacgtggatccaaacccacaggcttgagctgcttaattgaaattcacgtcaaaatgaaattctggtttagctcaacttgactactatggatgatgaaaataaatccctgggtcacacaaggatagtgattgagtagagcttgtttgctggcacaggaatgacatttcaactggaattaaattgtcgtcagttaacagaact

SEQ ID NO: 271865 - DNA, 455 bp, Homo sapiens
agtcccccttgtcctccccttgacctttgaccccttgggcctgctgccgaccagaataccaggcagatgttctctcttttaccttttgttcctggtctttccctctaaggctggaactcagagataccccaaacccccagcttccagctcatccttccccatgctctcagtgcggaccagctggagcctccactgggccgctctccatgtgagccagtgtggatccttggccacagccggcaggacgcttgcaagtgccccgactccagacatcctcccaggtgtccttcccgactagctccctgtcccaggccccagcaggtgaagcaggaacagcagacagagcctccttccctccccggcatcctctgaacagtcaaagttggaagaaccctagatattgttccacattaaactatgcacgcctcgtggcactcagtttcacaatcaaataa

SEQ ID NO: 271866 - DNA, 194 bp, Homo sapiens
attatgacaagaagtgctagtaaaaattagatatttcacgtagatttgtgtagatttttcatttctcagaacatatcctcatcatcaagtgaagtatgactgtatatgcatttgttgatcattggtaaattttgtttcacagtttgatattagcaacaatattggtataactatctttttattgtctacatcag

SEQ ID NO: 271867 - DNA, 199 bp, Homo sapiens
ccctgggtccatagtccaacaggacagagtttatagaacaaaggaaaagtgagcagtgacaccaacatcagtcttctaagcaaacatttcatggagagagcagaatttttaccttaggtgaattcatctgaagctgtttcaacaaattaaaagagcaattagagctccctttcaaaggcttagaccccacagctatatg

SEQ ID NO: 271868 - DNA, 462 bp, Homo sapiens
gaaactaaaagccatatatcgccctgtcagcagaagtaataccatttaacatgcatcatgtttatctagtcgagatcatgctgtgtggtggtcattgtccatctactcagatccatttcctgtccatggttccattggcaattggcttccagctggatatggccggtgggagacaccagcaagagacagggtagtgaaaagaagggataaggcagggtacttgaccatctctctccttcaggaagcagttttgcatcagtagctgcatctcctccatgattctagctgccaccaagtgcccatcctctgccctctcccaatgccactttctgcagccctgatggtggagtggcttcctgctgtgactcatctctgggctgcttccatgatgattgggtctctgctgttcatcacctgtgaagcatttcccacaataaattccctttgtttaaaatgtccagg

SEQ ID NO: 271869 - DNA, 2846 bp, Homo sapiens
atttaaaagactccttggaatctgattcagaaagcctcacgcaagagattatgtgccattctgagtttgatgatcgaatccggggcaacggtatggagcccgacagcttagacgaggaggaaagccctcgatggggaagcctacacgagatggaagaggaagcaagtggaaaagcagctcagatggctcgcgagcaaaaccaccatacctgggaccagggcgccaataacaggcaacaaccaatagaagacaaatattcagacctccgctatgacccgaactggaagagtaagaaggaggaagggcagctgctgtctgtggaagcgttgccggagtccacggacagctctttagaaaatctgcctttggctcccctctacccttcccaggagacgtcaatggaactctccgggggaaaaggcgagcagaaagagagtccacagagtgcagcttctttacttggtagtgaatttttaagcccaaactatgagcatggtgcccgtcgcagcaagccgttttcagagctgagcgacagtgacctggaggagaagtcgagcagcctttctccgtacgtgaagagctcaagttcacataacgaggttttcctgccgggatcacgtggccctcggcgaaggaaatccaaacaacattttgtggaaaaaaacaagctcactttgggattacccaccccgaaaacggactcttatcttcaacttcacaataaaaaaagaggggaatctcatccagaacagatctcctaccccgtcagagctacagacaagacgtctattcagaatgccaaggaaatggaaaatgctgccatcgatcctgaagataaatggcatcaaagagcacaacagctaaagaattaccaggaacactggtctcaatatgaaagtacaaaatcaagcaatgtaccaagagggcaaccttctgacatggtgaatgaccatcaaccttccagaagaccagccaagctcaagattcgaaagcagtgtaaacaccagaatggcctgaagtcttccacaacggaagaggtgactgccagtcaggggaaccagaataaccctcccaggcagcaacaaaaccaaaataagcctcttgatacttcaacaaagcctgaatcgattgtgattatgcatgcctctaacaatgatgtacaagcctcaagggcacttagaagccacaatctcaaagaaacctccaatacatttgctccaccaaaacaggcttttgacaaggtcttatctaaaaactctactggatgtgactctgggctgaatgttaataaagaaagaggacacaaagaccaagaagagaaaagattttcatatcagcagctacacaccctttctgacatggatttgaacaaccttaatgaactttctaagagacacgtgctcctgagccagaaaggctctcagtttgtttatcacataaatactcatggatcaaccaaaaataagaaacaactcaaacagccttatacagagacaaaatacaggaacttagaaatgttatggaaattccattcttcttctgacagccagacggttagagcttctccagattcatggctcacccagataatggagcagcatcagcaagccttggtgcagctgaccgacgtgcagcccagtgaaggggccttatccagcgtcacgcttccacctatactgtcaagggtagaaagtgaatcccaactcagttcagagagaagccaaagaaaccaagtgaaaattagccgtagcaattctgaaggctatctgtttcaactggaaaagggaaaaaagcataagaaaagaagcagcagtaagaacaccaagctgaaaggttatcagaaaagagacgtgaagcttggaggcctcggacctgactttgagtccatcagagacaaaacgcaaaaattaatacagcaaaaggaatatgcaaaacaagtcaaggagtacaacatgaagacactatccattctatcaaaaccacaaacagaaaaaactcaaaagaaatctgctatccctcggcagaaggctttggaatacgctaagaccatccccaaacccaaaccatcaaatctgactcatcaagcatcaaaggaacaaaaaaatccaacctatgctgggaaagaagaaagtttacctgaaatctcactgctggaaatactgcagaacagacacgaaagggaaaaacaggctgtggctgctttcaaagtccttcacatcgtatagacaacatttgataggaaggagaccaaaaatggtccaggaatgaacgtggagaaaagaaacgccaaccaccttctctgcgttgagagtaatggcctattattatcatctatctgccgtccatgtttgctttctgcaggatttaaaatatgaggcccaattggattatggtgccatattttactttctaggaagaaaattttttaaattatttattttcaaatcagttagaattggagctgaataataactagagaataaagcttttggttttattttgaaaaaaaaaacaaaagagaaacatatgaaatattcacttagaaacaaaagaggtggtattggaagaccgaatttctcttgtggctcgggtgcccccagtggggtgtctttgggcgcccgtcctcttgttgagaggggaatctagaaacctagttatatgacatctgcgtgcttcggtggttgacgtagtgggagaccatttatgctaatataaaggaggtattgtgtgtttccaacacagtggtgagatcaccggaaaaaaatatgatgcaccaagggccttatgaggttgatcactgataaagggcggttgtttggtgtttttaatagctctcccccttgtca

SEQ ID NO: 271870 - DNA, 641 bp, Homo sapiens
agcagagaagtagaacctatgcttccacctagtggcctagccagacaaatcaggtagcatactggagaaaaaggtcatagtcccgacaatctggttacactatccattctatcaaaaccacaaacagaaaaaactcaaaagaaatctgctatccctcggcagaaggctttggaatacgctaagaccatccccaaacccaaaccatcaaatctgactcatcaagcatcaaaggaacaaaaaaatccaacctatgctgggaaagaagaaagtttacctgaaatctcactgctggaaatactgcagaacagacacgaaagggaaaaacaggctgtggctgctttcaaagtccttcacatcgtatagacaacatttgataggaaggagaccaaaaatggtccaggaatgaacgtggagaaaagaaacgccaaccaccttctctgcgttgagagtaatggcctattattatcatctatctgccgtccatgtttgctttctgcaggatttaaaatatgaggcccaattggattatggtgccatattttactttctaggaagaaaattttttaaattatttattttcaaatcagttagaattggagctgaataataactagagaataaagcttttggttttattttga

SEQ ID NO: 271871 - DNA, 2503 bp, Homo sapiens
atttaaaagactccttggaatctgattcagaaagcctcacgcaagagattatgtgccattctgagtttgatgatcgaatccggggcaacggtatggagcccgacagcttagacgaggaggaaagccctcgatggggaagcctacacgagatggaagaggaagcaagtggaaaagcagctcagatggctcgcgagcaaaaccaccatacctgggaccagggcgccaataacaggcaacaaccaatagaagacaaatattcagacctccgctatgacccgaactggaagagtaagaaggaggaagggcagctgctgtctgtggaagcgttgccggagtccacggacagctctttagaaaatctgcctttggctcccctctacccttcccaggagacgtcaatggaactctccgggggaaaaggcgagcagaaagagagtccacagagtgcagcttctttacttggtagtgaatttttaagcccaaactatgagcatggtgcccgtcgcagcaagccgttttcagagctgagcgacagtgacctggaggagaagtcgagcagcctttctccgtacgtgaagagctcaagttcacataacgaggttttcctgccgggatcacgtggccctcggcgaaggaaatccaaacaacattttgtggaaaaaaacaagctcactttgggattacccaccccgaaaacggactcttatcttcaacttcacaataaaaaaagaggggaatctcatccagaacagatctcctaccccgtcagagctacagacaagacgtctattcagaatgccaaggaaatggaaaatgctgccatcgatcctgaagataaatggcatcaaagagcacaacagctaaagaattaccaggaacactggtctcaatatgaaagtacaaaatcaagcaatgtaccaagagggcaaccttctgacatggtgaatgaccatcaaccttccagaagaccagccaagctcaagattcgaaagcagtgtaaacaccagaatggcctgaagtcttccacaacggaagaggtgactgccagtcaggggaaccagaataaccctcccaggcagcaacaaaaccaaaataagcctcttgatacttcaacaaagcctgaatcgattgtgattatgcatgcctctaacaatgatgtacaagcctcaagggcacttagaagccacaatctcaaagaaacctccaatacatttgctccaccaaaacaggcttttgacaaggtcttatctaaaaactctactggatgtgactctgggctgaatgttaataaagaaagaggacacaaagaccaagaagagaaaagattttcatatcagcagctacacaccctttctgacatggatttgaacaaccttaatgaactttctaagagacacgtgctcctgagccagaaaggctctcagtttgtttatcacataaatactcatggatcaaccaaaaataagaaacaactcaaacagccttatacagagacaaaatacaggaacttagaaatgttatggaaattccattcttcttctgacagccagacggttagagcttctccagattcatggctcacccagataatggagcagcatcagcaagccttggtgcagctgaccgacgtgcagcccagtgaaggggccttatccagcgtcacgcttccacctatactgtcaagggtagaaagtgaatcccaactcagttcagagagaagccaaagaaaccaagtgaaaattagccgtagcaattctgaaggctatctgtttcaactggaaaagggaaaaaagcataagaaaagaagcagcagtaagaacaccaagctgaaaggttatcagaaaagagacgtgaagcttggaggcctcggacctgactttgagtccatcagagacaaaacgcaaaaattaatacagcaaaaggaatatgcaaaacaagtcaaggagtacaacatgaagacactatccattctatcaaaaccacaaacagaaaaaactcaaaagaaatctgctatccctcggcagaaggctttggaatacgctaagaccatccccaaacccaaaccatcaaatctgactcatcaagcatcaaaggaacaaaaaaatccaacctatgctgggaaagaagaaagtttacctgaaatctcactgctggaaatactgcagaacagacacgaaagggaaaaacaggctgtggctgctttcaaagtccttcacatcgtatagacaacatttgataggaaggagaccaaaaatggtccaggaatgaacgtggagaaaagaaacgccaaccaccttctctgcgttgagagtaatggcctattattatcatctatctgccgtccatgtttgctttctgcaggatttaaaatatgaggcccaattggattatggtgccatattttactttctaggaagaaaattttttaaattatttattttcaaatcagttagaattggagctgaataataactagagaataaagcttttggttttattttga

SEQ ID NO: 271872 - DNA, 2330 bp, Homo sapiens
atttaaaagactccttggaatctgattcagaaagcctcacgcaagagattatgtgccattctgagtttgatgatcgaatccggggcaacggtatggagcccgacagcttagacgaggaggaaagccctcgatggggaagcctacacgagatggaagaggaagcaagtggaaaagcagctcagatggctcgcgagcaaaaccaccatacctgggaccagggcgccaataacaggcaacaaccaatagaagacaaatattcagacctccgctatgacccgaactggaagagtaagaaggaggaagggcagctgctgtctgtggaagcgttgccggagtccacggacagctctttagaaaatctgcctttggctcccctctacccttcccaggagacgtcaatggaactctccgggggaaaaggcgagcagaaagagagtccacagagtgcagcttctttacttggtagtgaatttttaagcccaaactatgagcatggtgcccgtcgcagcaagccgttttcagagctgagcgacagtgacctggaggagaagtcgagcagcctttctccgtacgtgaagagctcaagttcacataacgaggttttcctgccgggatcacgtggccctcggcgaaggaaatccaaacaacattttgtggaaaaaaacaagctcactttgggattacccaccccgaaaacggactcttatcttcaacttcacaataaaaaaagaggggaatctcatccagaacagatctcctaccccgtcagagctacagacaagacgtctattcagaatgccaaggaaatggaaaatgctgccatcgatcctgaagataaatggcatcaaagagcacaacagctaaagaattaccaggaacactggtctcaatatgaaagtacaaaatcaagcaatgtaccaagagggcaaccttctgacatggtgaatgaccatcaaccttccagaagaccagccaagctcaagattcgaaagcagtgtaaacaccagaatggcctgaagtcttccacaacggaagaggtgactgccagtcaggggaaccagaataaccctcccaggcagcaacaaaaccaaaataagcctcttgatacttcaacaaagcctgaatcgattgtgattatgcatgcctctaacaatgatgtacaagcctcaagggcacttagaagccacaatctcaaagaaacctccaatacatttgctccaccaaaacaggcttttgacaaggtcttatctaaaaactctactggatgtgactctgggctgaatgttaataaagaaagaggacacaaagaccaagaagagaaaagattttcatatcagcagctacacaccctttctgacatggatttgaacaaccttaatgaactttctaagagacacgtgctcctgagccagaaaggctctcagtttgtttatcacataaatactcatggatcaaccaaaaataagaaacaactcaaacagccttatacagagacaaaatacaggaacttagaaatgttatggaaattccattcttcttctgacagccagacggttagagcttctccagattcatggctcacccagataatggagcagcatcagcaagccttggtgcagctgaccgacgtgcagcccagtgaaggggccttatccagcgtcacgcttccacctatactgtcaagggtagaaagtgaatcccaactcagttcagagagaagccaaagaaaccaagtgaaaattagccgtagcaattctgaaggctatctgtttcaactggaaaagggaaaaaagcataagaaaagaagcagcagtaagaacaccaagctgaaaggttatcagaaaagagacgtgaagcttggaggcctcggacctgactttgagtccatcagagacaaaacgcaaaaattaatacagcaaaaggaatatgcaaaacaagtcaaggagtacaacatgaagacactatccattctatcaaaaccacaaacagaaaaaactcaaaagaaatctgctatccctcggcagaaggctttggaatacgctaagaccatccccaaacccaaaccatcaaatctgactcatcaagcatcaaaggaacaaaaaaatccaacctatgctgggaaagaagaaagtttacctgaaatctcactgctggaaatactgcagaacagacacgaaagggaaaaacaggctgtggctgctttcaaagtccttcacatcgtatagacaacatttgataggaaggagaccaaaaatggtccaggaatgaacgtggagaaaagaaacgccaaccaccttctctgctggataccttgggttccgagctcgaat

SEQ ID NO: 271873 - DNA, 461 bp, Homo sapiens
tgccatctaagaagccagcagtagaagggagccctggtcgctgtgaaaggaatatttaaaagaacagccgttggacacagctgtgctgtgacaccttcttgctaaacacgtgccctgttatctttcttgagatgctcgcctgccgtttggtaaaagctgtatgcgttgtggtgtatttgagttcaccaaccattatcaagatcaatttgggcagagtagagagacgcttggttgaatggaggccaagctgaaattctgattcttgagcatgtgataatccatgcaaaatgttagccaatttacatttcaatttttaatcttattagcaagtatccttgccacctgatacacttttcagcagctgtgaaactccaaactatattgaattcaatgagaattgcatacatgaaatttaaagactcaggttagaattatgtgtcctttaataaaagttctttgct

SEQ ID NO: 271874 - DNA, 446 bp, Homo sapiens
gcttataatctgctagctttctgatcccactggcatgagatactcttgcctaatagttacagctaaagtccaggagctcactgttactggtctgccttggattatgtgcacattcctgaaccagccactatagctaggggatggaaaatactgttcctggttacttaaatgtaggtgatgctcctcccatataccacatgaacctaaaggagtcctggaggaggccgttcaccacaggaaactgaggtgttcttagaagggtggatgctggcagatctctactagttagagtctacatttgccttactcatttcaaaagtccacattgcagtctcattttaccagtgatctagcttgataaggacattcataagtaactggatgattctttaacattgcagatttgaaaggattaaataaagtcaacaaaattgttatatcaacaa

SEQ ID NO: 271875 - DNA, 391 bp, Homo sapiens
gtatttcttaaataataaaactagaaagtcaaaattactccttgatttgcaagaattactgcctggctgcaagaatggatgttgtgttagcaggcatgaaaacaacattcatctccttatacatcttcatcagagctctgggtgacttaggtgcattgtcagtgagcagatttttgggtttttttgtttgtttgtttgttttgagacagtctccctctgttgcccaggctggagcacagtggtgcaatctcagctcaccacaacctctgcctcccaggctgaggcaggagaatggcgtgaaccgaggaggcagagcttgcagtgagccaagatcgcaccactgcactccagcctgggcgacagagcaagactccatctcaaaaaaaaaaaa

SEQ ID NO: 271876 - DNA, 340 bp, Homo sapiens
aatattaaatatcaagacagatgctgtgctgctatgtgtttaaaaaccatctctctgggaagaaagagccttgatttgtaggattttccgacctccatggtgtaaattgtaccaccacatccaatttctaacagtcaacatgatatcctagaatgtcaacttgggaagaaatgtgtataggctgtcattatcattgaattcatgccagttctattgagagccacctagccttcttttcctaaggcttcagaatgctggcagctctccagagacacagttgaaatattctcctcagaggaatctgactagtctaaagaaatatattgatgctggacttcct

SEQ ID NO: 271877 - DNA, 869 bp, Homo sapiens
caataataaaaacctaaaaaaaaaaaaagactgctatgtaatcttgtgtcttttctttctctctctctctttttttttgagacagggtcttgtcctgtcacccaggctggagtgcagtagtgtgatcttggctcactgcagtctttccttgctgggcttaagcgatcctcccaccttggtctcccacagtggtgggattacaggtgtgagccaccatgcctggcccaaactattttttaatacagtaaaatgcatttattatcatggcttagatttagtgaatgtgtaggagtgaaagtctactgagagaataaatctagtaatttaatgaactttcttcatagcttcataagagttagttaattatgatttcttaattcattgcccaaagaatgaattactggaattcattatattttttttttgaaaaaaaaaaactaagttagctgcctgtgtgtgtgtgtgtgtgtgtgtatgtatgtatctatgtattctagagaaatatatattatatgcatccagagatgtgtaaaatattctctatcagtaggagaatagattaataaattgtggtgtaatcatatgctagaatactatacagcagtaaaaaaatgaactagagctgtacacaataacatggatatatcccacagacatgatgttgaaagacagatatggcctgggtttgttagctcatgcctgtaataccagccctttgggaggccaaggctggggggttgtttgagcccaggagttcaagaccagcctggggaacatggtgaatctcttttctacaaatacaaaaaaaaaacaccttagctgggtgtggtggtgtgtgcctgtagtcccagctgtttgggaggctgagg

SEQ ID NO: 271878 - DNA, 206 bp, Homo sapiens
gtactcaataagcttgttaaaatatttgttgagtgaataaaataatctaaatcatttcctaagtttctttaatgatcaaagaaattaaaccactatgaatctggtttcaggtattaaacacagattaaatattcatttttaggatacatttgttttaaatttaacacatggattcatgaataatgctatagagaatccattattta

SEQ ID NO: 271879 - DNA, 501 bp, Homo sapiens
gattcccttatttgatgagcccttcaggacaggggtctggggttgactcttctccatgcagacctacacagactgctcccctaagcagcagctacatgaattgagtgggcctggttccggtcccctctcttgatccagagtcctcagcacaggttggaagcctgggcgcctccttgccttgagagcatgagtggacacttcctggtgggaaagcagcatgccccttttctagtgttaagggacacctcagcatgattattaaagacagttgcagcaggaggtcacagagggtcacagaggcagggcgcaaattacagtgagctgatttcacaaagtacctggactccaggcccagctctgcagccttgcacaaagctggttcagccctccaaagctgaacaacagtgcaaaagaaggtgcattggtatcaagtgattttcctggatcctttcagcactgaaagcctgtattattaaagtcagattttcacaaaaaggaata

SEQ ID NO: 271880 - DNA, 373 bp, Homo sapiens
aagattttgggggtaatatttcatctgggaagatctctgtagtaaggtaacatttgaacacagacctgggctcgatacatgcaaactataatatacatttagtattcagatattttagaatcacagattctcagatttcaaaaggactttgaaatacatgaattttgtatcacttctatttgtgatcatctagtgtttgcttgaacatctttagtgaaaatagcacattttcaaaagcttatttcattgttggatgactcaaatcctcagaaaattacttttattgctttgaaactagtctcttgaaaaatccacatattttaaattttctcattggaacaacccagaataaatatcatctcacatggatttc

SEQ ID NO: 271881 - DNA, 381 bp, Homo sapiens
caataacttgaatttgacctaaaatgacagaactcacctttgtagaatatatctctcaacacaagatttggatactgtttaactcttgatgacctcttaattgatgactatctatttggaattagtaatgctcagaaattcttggagtaaaagaactactagtatcaacatcattgcttaacaattttgtaccttatatttgtgaagtttatttcctataacttttgccaaaaccagcagaattacaacatttcatggaagacagcaaagtatgatgttagtgatgtgctcactgataatgaacaaagtagagctcagaaatggaacttttagtgctagatttttaaacaaacacttctcatggtgctgatcaattcagct

SEQ ID NO: 271882 - DNA, 493 bp, Homo sapiens
gttataaataagaggggtgctttggagttgatgaaggaagagacaaagcctatgttttgagcagagtgggaggtccaattgaagacaccagcataaatctgggacaactgaaaggtgacactgacagtgtcccttggtgtagggatgtagggatgtcccaaaagagacttgcttatttaaataaaccctggttctgggtagtgcatgagaaaataaaaagaaaaatttcattaagagtttctagtcgcaatctcacagtcgtttaagtttggaattcataatgcatgtggaatatggagtaatcttagctgaaaattttaaaatgattctggccagacacagtgtctgatgtgctcctcaaaatgtccattctaaatcaggaacagtggctcccgcctgtaatcccagccacccaggagggtgaggtgggaggattgcttgagtctggaagttcgagtacggattgggcaacatagtgagacccccatctccg

SEQ ID NO: 271883 - DNA, 152 bp, Homo sapiens
ctccggggtaaaggcagaatattggggtctattttggaaatccgaggaacccaattgcttgatccggcttcaagcctgggcaacgtggcgagatcccctctccacaaaaatacaaaaattagccaggcgatgtgggacgcatctctactccc

SEQ ID NO: 271884 - DNA, 230 bp, Homo sapiens
gaagtaggatcaacaatttttaagcatgacttttgctctataaacagaagtgtcaatgaatgtaaaactggcttttcattggcaaggctgacaaagccttaagtaacaccagaggcttggcagtggtataatcataaattacttttgtatgatataactttttataaaaacataatgtaatgtgcccagttctattactattgctacagaagacaaaacaagcatttgag

SEQ ID NO: 271885 - DNA, 292 bp, Homo sapiens
ctcgggctcccagatcctgtaggtctttcttttctctggctggatttgaaatgcttcgtttctttaaaatcacaatgttgctatctgatttcaaaactgggtgcataggtgtctgttttagttattttttacaatttacatttgaaatgttttataactaaaatgtttaaaacatctctgtaaaaccatgaagggacagggcagagactctatctctcctccttcacaaggaccccaggtcaagcccagaacctgggcgacccctcaaagagcaggggagagggctgccctg

SEQ ID NO: 271886 - DNA, 468 bp, Homo sapiens
ctgcatgactctaattcatggacctcttttcaatttctatgaaatcacaaaatattagaagtgaggaataccatagaatcactattcatggttttcaacaacggtacgcagaagtagtaactctgcagtgatcatgtagaaccaattttctctcatctccatatccacctgcattttgatgtacagctctccctcagtgtctatggggcatttgttcaagatccacttccaccctaaataccaaaattcatggatgctcaagtcctttatgtaaaatggcatagtctttgcatataacctacacacatcctcccgtatactttagatcatcactagattacttatacataatacaatgtaaatgctatgtaaataattgttacaatgtattttaagacttgtattatttttattgtttttttaattttttaaaaataaattcaatctgagattggttgaattcgtgga

SEQ ID NO: 271887 - DNA, 334 bp, Homo sapiens
attgctggtttgagtgagcaccagagcggccactatgttggagagcaatttggtactgcttaggataagtacgtttagtttaagtacactgcggcctggtaattttttttacctgcgattaatctgaaaacattctcacgcaattccacaagggaaaatatatgaggttgcttattagagtatcacagtcataatgagttgccgactacctgggtgtcaatcactgggagactggaggaaaagaatgtggtggatacttattgtggaatattatgggacaagtagaaataagaatttagaacatgtatggatcctaaaaacatagtgtaaagtg

SEQ ID NO: 271888 - DNA, 372 bp, Homo sapiens
ctgagaccaatactcctgagactactatgccaccatctgaggccactactcccgagactactatgccaccatctgagactgctacttccgagactatgccaccaccttctcagacagctcttactcataattaattaacatttacttctggtatggaacaactagaaatactgctggaaataatatccaaagagctgattctaccaatccaatttcaccaggaaaattccatcagggattggatgaccatggggatggacataattgctactaccaacacaacagccaagagagttgccttacaattagaaatgtgtagacagaaatgtatagaagatacaaggattctcttaattggacttaaattcttta

SEQ ID NO: 271889 - DNA, 477 bp, Homo sapiens
tatgccttggtagcttccaaacttgccccccttttatgttttgaaaccctgaaggtcggagcgtaaagccgtggtagagtcaacttctgtctgagccgaggatttctgggacttgccagcctcgtctccgtgtgtctgattggacacctggcaggtccgggcgctccccctccttgagccggcgacaccaggacgggtcagactgtcctggcctagaggaggtcaccgctggggaggaaaagggggtaacggagattctgccgcacagacgggtgtctgtgtacaggctgttttggtggaagcgtctactgtgtcaggagctgcgggtgcctgcgtgtgcacgtgtgtgtttagttgctgagacctgaaatatatatgtcttagtaacaatccgtttgctcgcattttctaaccctttcctctttggggagggggctgctaacaagatgttaactgctggcgcttaaaggtatagct

SEQ ID NO: 271890 - DNA, 496 bp, Homo sapiens
gattatgcctcaggtgtattttgtgatgaggtttctccatgtcctgccatttgattattccttttcttaaatttctgcaacatagacccaatctgatctctgtttttcaaagtagtttatacctaaatattggtttgtgtgtttgtatacatatgtctgtaatagaatggggtggttatgagctgtttaatttgcattaataagaattagtcttgttggccaggcacggtggctgtaatcccagcactttgggagccgaggcagacagatcacctgaggtcagaagttcaagaacagcctggccaacatggtgaaatgccatctctactaaaaatacaaaaattaactgagcgtggtggtgcatgtctgcattcccagctacttgggacgttgaggcaggactatcacttgaacccaggaggtggaggttgcagtgagccgtgatcacaccactgcactccagcctgggtgacagcaagactccatctcaaaaatt

SEQ ID NO: 271891 - DNA, 438 bp, Homo sapiens
tgacaggttaagtaacttaaccttcaggaccaatggctggtaaacagctgactgattccagacttaaaactaggttgttctaactgtaccacaatatttcttaaagcgtattaaagtatctttccttagcttactctgtataaatgaaatatgatataatttagtaaaatttcataaataatacagtaggaatacatttgccataaagatctcaaaatgcctgcttgtaatcagaaattcagcatcgtctagtgagtgttgtctcttgattgctaaagaattaaaagaaatatgtctggctgttacaccttaagatggatctttccaggtaaggtgggaaggaacttacttgtcataacctttgaaatattcatcttggaatttttcttaactgtttaatattgtatttgaggctttagccaggttttgcaaaagttt

SEQ ID NO: 271892 - DNA, 252 bp, Homo sapiens
tccgggtagaggtgcggctgggccctttacgaggttcggtcttggagctccgtcttcggcagcgggctcgggggcctcggactctgcataaggccccggaaaagatgaccggccccgggctgggcgcggtggctcatgcctgtaaccctggagctttgggaggccttggcgggcggatcgcttgagtccaggagttcgagatcagcctgggcaacaaagcgagacaccaccccccacccccagtcgctacag

SEQ ID NO: 271893 - DNA, 493 bp, Homo sapiens
cctcgtcaggacctggctctgccctcggagtcagtctggatccaggagtgattcatcttacacagatgagagggggataaaaggaaaagaacagtcaggacaaatgtgttttcaatggtgcttagcagcaggagaccactgggacttcagagaaacgctactggagtgtgacatcataatacgccaaataccagagtctctcgcctcttggagtttatgggccaatttctcccaagatgtgtgagcttgttgtgccgccgccagtggactcgccagcggctgagcagctcagagtgacagcgactcagcgtctggaagccccactgggttgtgaaatgaagaaggccttctttgcccctgatgcagcccgggcgagccccgaggctccagaagcgagcatctcccagctcctaaagagcagacatatatcctgcctttaagacaagactacaattgcaaatctgagaatataaattacactttcatctttatt

SEQ ID NO: 271894 - DNA, 358 bp, Homo sapiens
ttttaaacctgcttgccaccgttaatgttcctgcggtgacatgaagagccaaataccagagtctctcgcctcttggagtttatgggccaatttctcccaagatgtgtgagcttgttgtgccgccgccagtggactcgccagcggctgagcagctcagagtgacagcgactcagcgtctggaagccccactgggttgtgaaatgaagaaggccttctttgcccctgatgcagcccgggcgagccccgaggctccagaagcgagcatctcccagctcctaaagagcagacatatatcctgcctttaagacaagactacaattgcaaatctgagaatataaattacactttcatctttatt

SEQ ID NO: 271895 - DNA, 503 bp, Homo sapiens
  misc_feature (56)..(56): n is a, c, g, or t
taccgcatgctaacctatattcttcgtcgaaacaacaacacaacaagaaaccctangcacaggcatcacatttacgataggatctttcaagagcctcaaaagcaggactacttcatgagccaactcgtggtgacaagccctgcccctgcaagtgagaaggggggcgcttccaaatcaagcaccatttgtcaagccaaataccagagtctctcgcctcttggagtttatgggccaatttctcccaagatgtgtgagcttgttgtgccgccgccagtggactcgccagcggctgagcagctcagagtgacagcgactcagcgtctggaagccccactgggttgtgaaatgaagaaggccttctttgcccctgatgcagcccgggcgagccccgaggctccagaagcgagcatctcccagctcctaaagagcagacatatatcctgcctttaagacaagactacaattgcaaatctgagaatataaattacactttcatctttatt

SEQ ID NO: 271896 - DNA, 433 bp, Homo sapiens
ctttcctgccctattcatgtttgcctagctacgcactctaacaatatctctatttgcataagcctcgtaactgggaacaactatacccagaagtctctgtcaccaggtatcttgatatcccctcagtaattctcttttcattctggtggaggcaggaacttttccatcatggggatggatggaaaaagagacagataatggcccgggaggcaaagtacttcaattttctagctgtttaggcacctgtgtgcccatacttgcgttggatgctctgaactaattctacgccttgaaaatgacccttgtgaccaggcatggtggatcactccctgtaatcccggcactttgggaggctgaggaggaggatcactgaaacctaggagttagagaccagcctggaaaacatagcatagtgagactctgtctctacaaa

SEQ ID NO: 271897 - DNA, 712 bp, Homo sapiens
gatggcaagattgttttaccaggcaactttctgtattgtacattctatggacgaccgtacaagctgcaagtattgcgagtgaaaggggcagatggcatgatattgggagggcctcagagtgactctgacactgatgcccaaagaatggcctttgaacagtccagcatggaaaccagtagcctggagttatccttacagctaagccagttagatctggaggatacccagatcccaacatcaagaagtactccttataaaccaattgatgacagaattacaaataaagccagtgatgttttgctggatgttacacagagccctggagatggcagtggacttatgctagaggaagtcacaggtcttaaatgtaattttgaatctgccagagaaggaaatgagcaacttactgaagaagagagactgctaaagttcagcataggagcaaagtgcaatactgatactttttattttatttcttcaacaacaagagtcaattttacagagattgataaaaattcaaaagagcaagacaaccaattcaaagtaacttatgacatgataggaggattaagtagccagctgaaagcaattagagaaataattgaattgcccctcaaacagcctgagcttttcaagagttatggtatgatgtcttcagtttattgcacccaaaaatgttaaattcaaattaaaagacagttgacacttaaaa

SEQ ID NO: 271898 - DNA, 948 bp, Homo sapiens
gatggcaagattgttttaccaggcaactttctgtattgtacattctatggacgaccgtacaagctgcaagtattgcgagtgaaaggggcagatggcatgatattgggagggcctcagagtgactctgacactgatgcccaaagaatggcctttgaacagtccagcatggaaaccagtagcctggagttatccttacagctaagccagttagatctggaggatacccagatcccaacatcaagaagtactccttataaaccaattgatgacagaattacaaataaagccagtgatgttttgctggatgttacacagagccctggagatggcagtggacttatgctagaggaagtcacaggtcttaaatgtaattttgaatctgccagagaaggaaatgagcaacttactgaagaagagagactgctaaagttcagcataggagcaaagtgcaatactgatactttttattttatttcttcaacaacaagagtcaattttacagagattgataaaaattcaaaagagcaagacaaccaattcaaagtaacttatgacatgataggaggattaagtagccagctgaaagcaattagagaaataattgaattgcccctcaaacagcctgagcttttcaagagttatggaattcctgcccctagaggagtgttactttatggtcctccaggtactggaaaaacaatgatcgccagggctgttgctaatgaagttggagcctatgtttctgtaattaatggtcctgaaattataagcaaattctatggtgagactgaagcaaagttacgtcagatatttgctgaagccactctacgacacccatcaattatttttattgatgagctggatgcactttgtccgaaaagagagggggcccagaatgaagtggaaaaaagagttgtggcttcactcttaacactgatggatggcatt

SEQ ID NO: 271899 - DNA, 450 bp, Homo sapiens
cagtctacagaagctatactcagatgtaggtattagcaatggtgattttgaaggaagtaactgaagagtaagtatatttactttatattttatagtaaaggccacacacaacaggattattgttgtagatgtataaatattcattttaagagagtctaggccaggtgcattggctcacgcctgtaatcctagcagtttgggaggtcgaggagggcggatcacaaggtcaggagttctagactagcctggccaatgtggtgaaaccccgtcgctactaagaatacaaaagttagccaggcgtggtggcacgtgcctgtagtcccagctactcgggaggctgaggcagaagaatcgcttgaacctgggaggtggaggttgcagtaagccgagattacgccactgcactccagcctgggcaacagagggagattctatctcaaaaaaaaaaaa

SEQ ID NO: 271900 - DNA, 314 bp, Homo sapiens
tgtactgttttcccagctgccttcaggatttgatctatatcattggttttgagcaatttgattatgtgacttgttacagttttctttgtatttcttgtacttgatgttgagctttgggtctgtgggtttatatttttcattatgtttggaaaatgtttggccattatttcttctaatatttttctatgtctcagctttgtaaacatgtgggatatagttaaaattaatgttaatgtctttctctgcttattttaatatgtgtcagtttggggttagtttggatcaaaataaggattgattggttgttcttatta

SEQ ID NO: 271901 - DNA, 420 bp, Homo sapiens
cggatctttcttctttagcttgttgatttgattaattacatcaattgatttttgaatgttaaaccagctttgcatacctgtgataaattccacttactcatggcatataattttctttacacattgttggatttaacttgctagtattttgttgaggatttttgcttgtatgttcatgagagatattggtctatagttttcttttaatgtctttgtctggtttgggtattagagttatgctggcctcatagaatgagtcaggaaatattcccttcagttctatcttctggaagagattatagagaatttaaaacaatttatttcctaaatgtttgctagaattcaacaatgaacacatcagggcttccaaaaatattttaacttgtttctttaaaaattaaagttttccttttgcgataa

SEQ ID NO: 271902 - DNA, 504 bp, Homo sapiens
agtttatcaggtcatatgaaattcaagtttggaaaaatttgaaagtacattgcatgtcaataaacgcatcttggtgtctgattctgcatacatctgtagagaatttgaaaacaagcagtcaatttagaacttctgcttggtcttcggaagcaaaaagaggaaattcaaaagtaattttacacgtccttccaccagaagctgaaaggatggctttttcgcggctgaataacgaaagccccctgcttcgccccggactctgagcagctcaacctgcggaaaggatgtgtaataaaacgcctttccagggagacaaaaaaaaaaaaggccacccaaaggaagggcaactcgggagtgcctggtttctactgcggtacccgggcactttggaagaaagtgcgtgcagattcaagcttttgaaatggtttcagctctgttcaattgggcataggctatttttccttttctgtttttttctttaaatacattatattcattcctctcaat

SEQ ID NO: 271903 - DNA, 632 bp, Homo sapiens
tgaacaaaatacaagggcaagagtatcaggaaaggttacttttttttccctctgcctctgattacccagagagcaacagtgaaaaatatggaggagaagagcagagggctcttttggtccaataacagaattcagaagtaggacacactggggaggcttctgcctcctgcagtggttttctccaggattttttaccctcacttaggtgtagccttgacaggaaaggatgggggccaggagcctggaccatcattcccagcaatctgacctgcttgagggagggaagggtccccatccatcttttcttcattctgggcacctcactttaaaaaatagattttgcggccgggcgcggtggctcacgcctgtaatcccagcactttgggaggctgaggcgggtggatcatgaggtcaggagatcgagaccatctggctaacaaggtgaaaccccgtctctactaaaaaatacaaaaaattagccgggcgcggtggcgggcgcctgtagtcccagctactcgggaggctgaggcaggagaatggcgtgaacccgggaagtggagcttgcagtgagccgagattgtgccactgcagtccgcagtccggcctgggcgacagagcgagactccgtctca

SEQ ID NO: 271904 - DNA, 314 bp, Homo sapiens
agccactccccatgctgcaagcaggggccaaaacaaacagggcccctcccagaaccctgcacccttcattgttctgtcaagttccagttccccattagtacataccatgtttgtgtgcacatgtgtgtgcaaatgtgtccacattacatttgtgcacaactgtgtacgacaaatgtaacgtttttgtgggatcctctcatgacacataattcactatccactttttgtaagtttttctcttcactcctcatctaccaagattgtgccactgcagtccgcagtccggcctgggcgacagagcgagactccgtctc

SEQ ID NO: 271905 - DNA, 372 bp, Homo sapiens
cataagaggaagtagcaacatacccctaagtggccccaggggtagatggcagaggtgtgtatcctaacaagtctttgcagaactggtatcatcaaatctctcagacagttttgacaaatggtatttactatcttttcattaactcattacctcaccctacccccacgtctccccagcagctgagaggctcctgtaaataaatttgtctgtgcattccacaaataggtcatcatgattctggatccacacttgtatcttaacccctctaggaaaagaattgttacaagaatcaacgtgcaaaaatataaacagtttatataggtgttttgacttttaggtcccccgaaataaaaaaattgtgaaccataagaa

SEQ ID NO: 271906 - DNA, 399 bp, Homo sapiens
tgagacagagtcttgttctgtcgcccaggctggagtacaatggcacgatctttggccactgcaacctctgtctcctgggttcaagcaattctcacacctcagcctcccaagtagctgggattacaggtgcatgccaccacgactggctaatttttgtatttttgtagtgatggggtttcaccttgtttgccaggctgttcttgaactcctgacctcaggtgatctgcccacctcggcctcccaaagtactgggattacaggcgtgagctaccccacccagccaagtatttatctatacagatggagagcaagacagagtaaaaaaacaaatgaggcaaaatattgacaattaatgaatcaaagtgaagtttatgggataattctttgtaagatttttgt

SEQ ID NO: 271907 - DNA, 484 bp, Homo sapiens
agcttcttcaaggaaataattttttctttttttagacaaagtttcactcttttgcccaggctggatgcagtggtgcgacctcagctcactgcaaccttcacctactgggttcaagcgattctcccacctcagcctcccaaaaagcggggagtacagacgtgtaccatcacacccagctaatttttgtatttttaatagagacagagtttatccatgttggccaggctggtctcgaactcctggactcaagtgatccagccacctcagcctcccaaagtgctgggattataggtgtgagccacagcacctggcctctgcctcttattttagattacttatgtcaaccacttaactccagtctctatcatatctcacacttggctgaatagccaccatcagcattaatagttgttacagctttctcagcacctggactcctactaccaatgtttctacgaataaaatgtcagaatgaatccaagaa

SEQ ID NO: 271908 - DNA, 528 bp, Homo sapiens
ttctctgactcatgtttttctcacatgagctgagaataaaatgtcttgagattgggagtgtccatgacttgcgatgcatcttactctgtttaatgaatagtagatgcatgtctgttttttgacggcatctaaaatatcataattattatcttgccatttgtgcattttacacaaatatttaataaaactgttattagccaggaagggcaattcccttttctgatattgctagctgtgtttcttgggttgccactattgccactgaatgaaaaaaaccttttcttcacctaaccaggtaatctgcagttctcataatcgctttgtgctattgatgagcagtcatatgtttttcaatgctatttataaagtacggtaaaatcgatgaggaatatgatgctttcgattgttatactaataaaacacaggatattttgtgatatatagctatacttaaatatgtcaggaagaatgcaagtaactattaaaataatattgttaataaaatgatgttgtagaattccaaatcct

SEQ ID NO: 271909 - DNA, 1246 bp, Homo sapiens
tgctatttagtagcttaggcccttctgtgctctaacagaatgaacttgcttactatatgatcttaggcaagccgccctcctccttccaagcctcagtttcctcttctgtgaaatgagggagaatccctactcctcttatctcattgtcttatcattgcattattcttacctgttgggatggtcaggtgagaggtctgcatgagggccctgcagactgtaacattttaagagtgtggggaaagcatggaaaaagtcactctagagatataaagggtgattactgctgttgttatatttattctgctacttgttaacacattctgcctaactcagaagattcagtttggggctgagggttgaaaacaggactcctagggtttgtcccagctgctcacttgctgtgtcactcttgttgtgttgtcgaatctctctgcctttgtttccctatctattcctgccaagatgatgtgtatattccacttagcttatcctggaggaaaagggggcggagctctatccacacaaggtggtgttattattattagcgtgacacataaaaatattcatgtctacatccaggaactaatctgcatttatcattctgtgcccgagtggacagatggtgaaagatatttttagattctgaaatggtaacttcctattcttggtaggaagcttcatcccccttttccttcagcctaaagtgggccagatgcccctcgactcactggctatccccccattcagaatccacttacaagaaactaatacttctcttctttgttaagcataaactgagtttccctcaaatagggcaaaaatggccatgggtgtggggtcccaggggagtagctagaattgctaaggatcccctcagctctatggtttcttggatatggataaaaggactagctatttctactatctcccatttgcaaaatgaggaggctgggatgagataagtttgtagggataacaatctaatagctcttaggttgaatgtggcttgtggaagtgttttgtgtggcttgcatagtattttaaaaacccagagtcgtagcttccctttaaaaaaattggatctagcagtatcaatcctgtaacaatttagaaagagtctatgtgctctaatttgtccatctttccctttgatcatatctgtactatttcacttagacatgaaagccctaatttacagttctataacaattattttattaaacactgactttgtgccaagcctact

SEQ ID NO: 271910 - DNA, 354 bp, Homo sapiens
cagtaaaagagaagtgatttgtcccatacaaggaatcctcaataagattaacagccaatttctcaacagaaatcatgaaagccagagggcagtgagacattaaaagccctgagagaaaaataaaactgccaacaaagaattctatatcctgcaaaactatccttcaaaaataaaggagaaatggagacattcctagataaacaaaagctgagggagttccttgctagtagatctgccctacaacaaatgctaaagggatacattcaggctgaaatgaaaaaacagtagacagtaacacaaggccatgaaggattaatgaactctgataaaggtaaatacataagtaaatataaa

SEQ ID NO: 271911 - DNA, 461 bp, Homo sapiens
aagaacaaatattataaacaacatctattcaattctgagttttttctcatttctttagatattcttaatgtacagtattagtaggttagtgtctctgctggtattgggtaaaaggcacactttatcaagccaatgagagaccattgtgttttaattcctatgttgggttaacatatataagaggtctcacagaaatctccaatgcaacacgttccaaaactgaaatcttgactttcctccacaaatcttttccaccctcatctcttcccttgcctgttgatgcaactctatcttaagagttgcacaagaccaaaactttagaatctttgactcctctccttctctcagacctcttatccaagcttccaggagatcctgtttactctacattcaaaatgcccagaataaacacaagcttgggcaacacagcaagaccctgtctctatttttaaaataataaa

SEQ ID NO: 271912 - DNA, 539 bp, Homo sapiens
ccaccctgtgagcccatgagtgagctcactgcacttgttatagacatcctaccaccagcagcctgattttgctgagtccgtagcttacaactccaatctcatggccctgcctttcacctcacttgctgccttaaaaacctgcagactgaggtggcgtagaagctgtgacatcccagtacccagaagttcatctcacacccagatcttggtttctaaatgtcattctctactaaaagggaccagggctggtacaggagaagagcaagagcttggaatatcttatacctgagagtaaggaagtgctcagagaatcacaggagcacgttaaaaggacatagaagtcagtttaatgagactgcttctggccaaagttggaacacatcaaacattaaaacaatgatggtaatggattagattccatagaataaaatccttgaggacatagttatataaacataactgaggaagaaggaaaagctctccctaacagaataatacaactagtaaatgggaaaggaaaggagttaggaattcacgct

SEQ ID NO: 271913 - DNA, 437 bp, Homo sapiens
caccccccatccccaccccagttctcgcccctggaggcaaccagtgttgccaggttttgtttatccttctaaagggagacttcgctcgcaaacatgcatgtaaatacacgcatgcacatacagagcatgcacacacacacacatcctttgcttaccactggtggtgaggctcacgtatcctgcatctttcatatatatatatatatatatatatatatatatatatatatatatatatatatatcttggcgatattgacatatgttaagtgttagtattctgcagatcaccccatgttagtctgtgaagaaccaccttattccctgtaattgttgcatccgatttcattgaatgaatgtaccacgattgatttaacgagtctcctacagttcagccaaggttgtttctaacatgattcctttcgtaaaaaaaaaaaa

SEQ ID NO: 271914 - DNA, 537 bp, Homo sapiens
aaccatttcctgtcttttttattacatggacttactccaaaaaggagcgaaagaacttgcacatgtttccattctgatcagttctttctggattttccgggcatttttgttaccaggtgtctgaaagatcctgagtgctatgaactggctttcacatctgcgacctgctgtagccctcccacaacactgggcccaggggtgttgattttcttttacaaatggggcaactaaggcatgttaacagctgagcctaggtttgaacctggttccccctgtgctggtgcagagctgtttcccctgggatatatgtctccagtgtcactgcccttccactgggtttcctgcttttacctaacatcgactcacacggtcattttcggggtggcagggcctcctgtcttgtcgttttaatggccacatggcattccatcatgttgatggatcattttgtttggtcactccctcatcgttggatatgtgtgaggtgtctaatttcttgctataataaatgcaactgctgtattttgttcaaattac

SEQ ID NO: 271915 - DNA, 253 bp, Homo sapiens
tcgcttaccagaaagcaaagcatttttttttgttttgcacagtttcctactacataaaataggaaattcattttcatgatgttttattaacataatactcttatttttatgtggtaaaggttttatttaaagcaaattcttaaattcttaatacctacattgatcattattatataatacacatgtgtttgcctgcaacatttctgcttgaggcagactttaaaaaaaaccctttgtaaatcttttcatttgt

SEQ ID NO: 271916 - DNA, 1079 bp, Homo sapiens
ctttcataaggcaggggttataacgaccaacagagactccacaaaaccatttactcacaagagaaaatatggcacggattggattagaagtggaaagactaatgcatttttgtccataaggattagaagaaaaatggttctctcagctctgcaagtgagcacaacaagcaatccaaaagcattatttgtgtgaagcagtttgtagaatttgttccatttgtcactagaactagtgtttgaagctcagcaaaagttgagttatggttaagccccagggtcagtggccacgtgttcagagtagtaccttaggtttaaagctgattcacaacctgaaaaacactcagtggtgttctctcccaaattatcaatcattaacttgtggtgttttaaaaagaggataaaagattgcttgaccagaaaataatgacaataaaaaggaaattatatatagtgtgtgtgtttatgtattacacatataatacataatgtgaattttcccccatgataactattaaacatgtttatttaatagttaaatatccatctttgagggcttttaaaatttatatttctttgttaactttgaagttgagactgcatgcaaaggctgctccatttcaggtaaatagtgcctcagtagctgtttgatttaccttaaaaaggaaaacaaaatgacacaccttccaacccatagactttctgaggtctttgaaatacaacaataactagaagaggagaatttgcgtagtatagtgatatggtttggctgtgtccccacccaaatctcatcttgagttatggttcctattatccccacgtgttatgggagggaccaggtgaaaataattaaataatcagagcagttttccccatcctgttctcatgatagtgagttagttctcatgagacctgatggctttataaggggcttcctgcttcactgggtactcattcttctctctcctgccaccatgtgaagaaggacatgtttgtttccccatccaccataattgtaagtttcctgtggcttccctaaccatgtggaagtgtgagtcaattaaacttctaccctttataaa

SEQ ID NO: 271917 - DNA, 536 bp, Homo sapiens
tctccttcagagcccccagaaagaaccaaacctgtggacaccttgatttttagcccctagaactaggagtatgacaactgggacttgtcttatcatttatccacagtacgtgggaaaatggccggcacatgggacttcaataaatatgtgctcaatggtgaaccacctagtgctttatattttacaaatgtctgcagcagttttttgtcatctttatggaaaacaaggcacgtcttaaagtcgttcaagtccttcactttttcacactgaggtctgtcttcatatccacttatctttcaagtctatgaaaccccttataaaaactttcctttgaaatattttaaaattcaaggcccacggctgattaatactgtttctcctccataacccctaggatcctccagttctgggttttaacaagaaaaatatcctcaatcctctctagtttctaggtgtaaagcagcttggaccctcctgggtttggtgggtccatctctcttggagtccaactctgtattcctaaaaagcaattattg

SEQ ID NO: 271918 - DNA, 529 bp, Homo sapiens
tttaaaagaccaattcaattcctccattgcacgaactctgccattctggaatgctcttcctctcatggctcatttcttcttgtcatcacacttcagcttaaatgtcagttctgaacggcctttcttgacgaccggaactaacacagatatttgctcagttttaattctcgacaatgcacttaccactatctgacattgttttgtattattttatgtatttcactggtaattgtgtctcctctccctcctacccccaatagagtatgacaactgggacttgtcttatcatttatccacagtacgtgggaaaatggccggcacatgggacttcaataaatatgtgctcaatggtgaaccacctaggtaggcagatatgtacgctaggatcgtgctcgtggggagcttaggttctaaagggaaaggtcaataaataggagaaaaacaaacacctagattctgttaactgttgcatagaagagattgaagttatacagaagacactgaggagtctataatcagaagtttctca

SEQ ID NO: 271919 - DNA, 357 bp, Homo sapiens
caggctgactaggatgggaaattccagcctggtaaattctagtcagactggttctctgctctcgaaccctgtttcctgttaagatgtttatcaagacaatacgtgcacagtgggacatagaccctcatcagcacagcggggcatagaccctcatcagtaattctaattttgcccttgccttgcgatctttattgccctttgaagcatgtgatctctgtgacctactccctgtatgtacaccccctccccttttaaaatccctaataaaaacttgctggttttgcggctcggggtcatcacagtcctaccaatatgtgatgttacacccagaggccagctgtaaaatttctctctttg

SEQ ID NO: 271920 - DNA, 303 bp, Homo sapiens
gtcagagctcccccaccttccccagggctgctcttggggacgcagcaggacaggcggctcccctttctaaggggagataggtgctgtcaccaacgaggaagggaagtgaagaggataccctcccaagaggctctcctgggcacagccaaagcccagccaggccaccaagatctgagacgcttccacttgtccaggctgaggcagccatgggacccctcccctcttcgtgcccctaaacacacgctgatgtctgccttcaggtgctgagcggggtcctggtaaaacggctaatctccaaatacg

SEQ ID NO: 271921 - DNA, 444 bp, Homo sapiens
caggtactctgtagtttcatttgctaaatcttgcagccctgctgggaacccacatagctgagaagctctatccaggcctcagtcaggactgtactcaggggggtgtccttacacccagggaaatcagcttggaggagcccagggctagaatgcctggtgttgaaatggcctcaggggccaggcgcggtggctcacgcctgtaattccagcactttgggaggccaagatgggcagatcacctgaggtcaggagttcgagaccagcttggccaacatggtgaaaccccatctctactaaaagtacaaaaattagctggccgtggtggcatgtgcctgcaatcccaactactcaggaggctgaggcaggacaatcattggatcccaggaggtagaagttgtagtgagctgagatcgtaccactgcactccagcatgggtgacagagc

SEQ ID NO: 271922 - DNA, 452 bp, Homo sapiens
ttattctgagtgtcagcggtgggactgttttatcctgccatctcccctttcacccacaggaatgagcagcccagtgggtaaaggttggccagaactatagttgactcaactacagttgagtgaatgatctttgcttgcttttcttcctcccacactttggttggggaaactgaggccaccctgaagttcccacctacacctcatgactttctgagatccctggagggtggcttaggaaatgtctttggagatttgggaacacactggatacatcagttggtgagccagggaaattagcaggaacgagctcatttcgatagcaatgagctgagtctccctccagctgccagacatttacgaggctggctgggtgccggcggccggaggcctccaatggccctcatccctctgccttccggctggaaataattcgtgtttaaaaaataacaata

SEQ ID NO: 271923 - DNA, 313 bp, Homo sapiens
tccgcttgtagacaaaaaactaatctgcagacttaagctccagtgtcttccgtaaaattctctgtaattcgtatccgttgtgtttcatttgtgggggaggagattcagaacatgagcctgaggaaacttgagaaaggaaagcacaaaaaacgcagatgaggaagctaaaaatcagagcctttgataccgctgtcttgaagtaattgccaccagaacagctgtgaaacatctggctttctgaaacatctggctttcggggcagttggacacttggtgaaagagacattaactgtaataaactgggctgacaaaa

SEQ ID NO: 271924 - DNA, 372 bp, Homo sapiens
agaagggttagctcattcttttcatctttaagcttttaaaattacttagtctaaatgttgttaggtaatggaataaccattccttttcagcttttggtacatttccaaactggctggcagagccaggaggaagtgaaggcattagaaacactaactttggttggttgctaccgtcttagtgctgagactataacctttgttggttgattgatagagaacaagagaacacaatcctcgttccactaacaggtaaggaacccttgtgataactagttggtatgagagggagattacttgatagcatttcataaaaactttatcccaaaatataacatgtcctagaaataggatactgtgactgactgtactccg

SEQ ID NO: 271925 - DNA, 394 bp, Homo sapiens
agtaggaaacctttctttgtaggaaattgctgacttataggaaaactattttacagactcacatattaaaaaaagagaaaccaacaatttgttttttaattttaaaaacaagaatttaaaatttccacgtagttgcttttaagagtaaggccaggaaagaggaagtctttgggagaagcgagatagtgggagaagctcaggggaacgtggagggacagagctgacattgcctgctactgctgccctgtgatgctgaccaataattccttttttgctaagtaatggtggattcttattcaaagttcagagtgtttctttgaagaaaaaggaatttccccaaggaattctgggggtttctcctatctgtaaagaaatagctaaagtccagactaat

SEQ ID NO: 271926 - DNA, 345 bp, Homo sapiens
accagcatatatggaaagtcagctctctgtattcaccggatgtgaaacatcacatctcacaaatacagtatttatttctttatttctcacaagctttttcctctttaaggagcaggcagacctgtattttttattgcttttggtataagtggatctgtgcaattcaaagctgtttccttcaagggtcaactgcagtagtattcccgtcttataaataaagacactggaggctgagaggttaagcaagctggctaagataatactaataggtaataggtcaagattggaacccagatcgtcccctcccacagtctgtggtcttttcagaaactaattttcattaaa

SEQ ID NO: 271927 - DNA, 467 bp, Homo sapiens
tctagagttcagatgaggaaagagtcagggtggagaaacacaattgtgagatgttacaatgaaatttagaccacgggcacactgagattacctagggacccagtgaccctgacaagagctgtttcagtagagttgtgagggttaaagcctacctggcgtgtattcgagacaaaatgggagaagaggaattgaaggtagcaaacctagacaatactattgagttttcctgccaccaatgtgaatttatatccccagtccaagtatatttgaaataccgccagtcatttgtatcttacagatacattcatgaggaaggaatattttatttttgttcatatgtatatctttcccactagccaaccagcacccagagggaagaatctgtatttttctcatctttctattcttgccaaacacaatgcacgagctagataattattgcataataaacacctttaattaagaaa

SEQ ID NO: 271928 - DNA, 440 bp, Homo sapiens
tcctataaataaactgctgaactttagcatgtaccatattaagaattttacaatcttctgaattctgaaactgtgtgctttgaattgtaattatctctgtagtctttagagcaattgtgggcatcatgcataatctacttgtttatttaacaaacattgggcacctatcaaatgccagaaactttgtcaactactgaaatttgacaaagaagcacaatcaagagcttgtccttcaagcactgagagtctggtacaatcacttataggctagttcaagtgcaatggttctcagaggctggtgagccatgagattgtatttaagtgttgaacttgcaaataagtcacatatttgctctgtttcatggagacccctatagtattttacctttgctctctcattaattaacgagttaaataaaatctttgactttacatttgta

SEQ ID NO: 271929 - DNA, 1177 bp, Homo sapiens
cagaagggcagcctcatatggtttgtatggggaatacttagtcttgggatattcaaagggaaaagaggaaaagtccagggtttttcctggaaaaaccaggcttgccttagagctctcatactgacaaaccctttaattacatgtattgtgctgtgtattggcatgtagtcagtgttcagtgttttttggagttgttttttgctttttttgtttttatagacagagtctcactctgttgcccaggctggaatacagtggcacaatcatagctcactgtagcctcgaaatcctgggctcaagcgatcctcctgccttggcctcctgtgtagctaggattacagacccacactactgggcctggccagcagtgtgttttgacttgagcagccttggcttctttctctttccctcagcagcggggagtcagcttggccagtgcttgtgatgggcaagcctggggcatccccttctcatgggttgggtgaagcctctagtgctgaaggacaaagctcacacaactccccgcttttggctgtcagcaccagccagacaggagcaagaaccaggaacaactcccagcatctcagaatcaaatctccactcctggatgctctagtctttcctgattacaggcccacatggagcctgtttgaaggggtcgctgccatgggctgagtcagggcattgaggtctggatgtcagggctcagcagtgtccagtttccaggcctcattacagctgctcccatgaggggttcccccagcactgggcctggagagttatgagtctctcctgtactttctgctctggggacctggttccacaatcttccgggaaggtctttctggtgtatgtgctctgtttcagtttatattctggactcctatgaagatgtttcagcaaagtcttttgctcctttttgttttatgtttagttatgtctgttgtaaaaaatcaatgtaataagtttataattaattaaaaaaaaacccagtcacttctaatctcacaaaagaaagaaagaaaaccccgggcctcacatgccgggggccggacaaacggggtctcgattggccttggccataagtgtccctgacccaattttctttgtccagggggaaaccggcggggcccccaaaagggggcgcggataatcatagcccggtacctgtagaccg

SEQ ID NO: 271930 - DNA, 538 bp, Homo sapiens
actcacttctgttctaccagcctgcacttcagcctgcagttgcttgggtccaatccactcctacattttgctcttaaggatttgaactgagaggcatagaatgttgtgttcaattatggtgaccttgagctgaaaggttttgtagagcaagggttacggttggtttcacaagctgaagtcatgagtaagcagaaggtataagtgagccgaggaagctgatatgcagatcatagtaacagtcaacatttattgagaagttactttaggccaaacatttctccaagcacaccctatgtataatctcctttagtcttcatatccatgctatggacagggccaaattgagacagctgcaataagcattgaaaagattatggtgttttgttgccactcctgcaatgtaagcacaaacccaagataatttcatataatacccattatattgcaaaatcaccactttaatgaccatatggatgctttttcatatcaatttttttgaaatattttatcccttcatcttgattcccctgctttgctg

SEQ ID NO: 271931 - DNA, 358 bp, Homo sapiens
atatcccaattacattgattttatctttacaaattatatgaatgtattaaattatcacatgtaccccaaaaacatctattatgtatcaatttgaaaatttgttaaagtaaaaaaaagtattcaagtaacccatagaagacaaaggagaaacaggaactaaaacaaatagaacaaataagacaagtggcagacttaagctctaacatatcagtaattcctttaaattaaaagatagatggcagagtggattaaaaatgacacaattatataccatatatagaaaactcttctcaaacataatgacacaggtagattgtaacttaaaagttgggggaaaaagtctgtaggactaggtacg

SEQ ID NO: 271932 - DNA, 328 bp, Homo sapiens
atcaggactttaaaacttgattctaagagtaaaaacgaggaacactttggtgggaaaggagccatggagctcagtgagatgatcctcacagtgtatggtcaggacaggcatatctaaaccacgtgacatgcatcttactcttatttcatgctcagtgcctggtacagagtcagacccatcataggtactcactgttcttggaaacaaacactgagtagtgacccctgacgcagatgttaacaatgtccctggcctagggtactttgagcttttcctaccattcatcttcaccaatgaggagctcttcctggggtggttttgctgtagt

SEQ ID NO: 271933 - DNA, 443 bp, Homo sapiens
tcaatcagctgggtgggcgagataacatttagagggcacagacccttcttatgagttgatgatggctttggttaccaagaaaaatgtacctatacacacacacaacttttgcctacaaatctaaggactcacagaccccccaatgtccgtctgcaaccccaacagttgaagtccattgccacctccaggttaaataactgtcatcaacgactctattattttgacaatattgatcaaaacattaaatgcccatactcttcaactaaataatttcacttgatggaatttgtcctacaaatgatgcatgtgaggaaaataacaactataaaagttgtttattgcagcctgttgattacagaaaagctaggaaatgatctcttcatccacaggggaccagttaaatcaattgtatctacagagtgaaacactctgcaatcttcaaa

SEQ ID NO: 271934 - DNA, 624 bp, Homo sapiens
tgcccttggcctgtttctatgaagctccctggtgagaagagtttgtcttttcctttgcaccccgaagcccctgcctgggctaaaaacgtgcaggaatgcggcatttggagaaattacacctctgagctgccaggatatattcaaacagccaagaacagaagttggcccaactgggacgcatccgtggagcagcaaatatgcacactcctggcagtcatgcaagcaagatggtcaacgtcagatacacaaggctggcttgagcagtgttcactggggaaaattcatggacaggggagcagaaacagaagaaaaaccacccaccccaatgtcttgcacactgcaacaactctgtgaacactggtcattattctactgttgttattggtgctctttactggccaaagctcagtgggaggactactatctaacacaagtgccctgcaggacagaaagaacaagagtgctagagcttttgtgcatctgggccattttttcatttgacatatgaagaatctaagaacctgcaaggtggaagtgacctgttcaaatagcagcaaagtcaaaagcagatgtagctctctatctctgagcctctaataaaattaatctaaatagttgtcaaaa

SEQ ID NO: 271935 - DNA, 303 bp, Homo sapiens
ctataataataattatttatttatttattgtttttgagtcagagtcttgctctgtcacccaggctggagtgcagtggtgcaatctcggctcactgcaatctccacctcccgggttcaggtgacgcttgtgcctcagcctccgaagtagctgcacttacaggcatgtgccaccatgcccagctaatttttgcatttttagtagagacagggagaaaggagaaacatcttcccaaaattcataaccataactaggccctcgtaaaagtctgtgacccaaatttccactgactatgtgatcttaaa

SEQ ID NO: 271936 - DNA, 455 bp, Homo sapiens
aatttcaggctcccggagactgtaagtggcagagttagaatttaagcccagatctatgtaactccaaaattcttaatctctaaactgaagaattgttttcagtcttgttccagtacctatactagatttccaagaattcagacaactcctaatctaccacataggggaaatagggtctataagaatatcatttatgtcagatagtgaaacaaacatgagattatttacacattccagacccaggtgacctaaatcttcaaagaaggtgactgatccctttggagcaggtgctgcgtacagtgagagagaagtatgtgtattgtgtgcagcggcatggatggggaacgatttcttctgcccaaggatatgagggtgtgggtggcttctcagagcagattatgtctgtgttgggttttgaaggatgaataggcatttgctaagcatggtttctttga

SEQ ID NO: 271937 - DNA, 278 bp, Homo sapiens
tagaaaaatgttctctgtctagggtgtggacgaaggcactttactaatcttatgcataattcatccttggttgctggggcactcaaagttgaaactttgccctctgataaaattcagctggatgttttttatttattagactctgatccctttaggggtttagcccttattgcgagcccagggattctaatttggctaagccctagctgtgaagacttttcttactaatttgcccttggtgaattttagctcttgtaataccacctttaaaaaacaaa

SEQ ID NO: 271938 - DNA, 428 bp, Homo sapiens
caaggcagccaatgtagacccacagaggcttcagttatgagaattagcagaggaacaaacaagtatgtttactatgcataaaaaaacacaggaataaattaacagagtaaaaaataaagacatataaaaataacacattagaaaagaaatgaaacagaatttctagaaatgaaaatacaatctcaaaaagcaaaattccaatgaatatgagaaatagagaaaaataaatcaatatgaacatatatctgaagaattacctcaaaagcagagagacagaagaataggaatgctagagtaagaacatctaatccaaattgcagaatcaatgaggaaagagagactagggcaagaacagttttcaaagacatatcaggtgagtattatcctaaagtgaagaaagacacaaaaccacaagtttaaagggtaaa

SEQ ID NO: 271939 - DNA, 219 bp, Homo sapiens
actaaaaaggtctgagagaccacacgcaggtcttcagctttagggtagacagaaatggagaagaaggaatgagagccctgggaggaaaacttttcacttcagcatattttggatagtgatgtcaaggatgacagaaaatagaaattattattttatgtaaaaagttgtatcctagaactgagagtatgaccaaaagcctatgtttatttgccgtcaatt

SEQ ID NO: 271940 - DNA, 296 bp, Homo sapiens
aggggatatagaatgtccaataccagagcccttacacagtggaaagcactgactcaggcacaagccaggccactggcaatcaaggtgacacaccttcttgccaccatcgccctcctagcagggtcccttcaatggtgtctcagagccaaccatcatatcctcttatcaaccacctttacaatctccggagctatttatgagctgacgccctcaacaagtcagctttcagtacaaactcctagaaaggcaggtcaaaggtctgactccagagaaaaaggcaacagctccctctcaca

SEQ ID NO: 271941 - DNA, 444 bp, Homo sapiens
agccaaaattcctgggtctaaatagtggttctgctacttaacatttgtatgagcttcctcatctataaaatgagcataacatagctacctgctagatactaagattaagtgaattgtgcaagtaatgtgcttagaatagtttctggggctcagtgtcagatattttcacaggacgtatacttggtattaaaggttggcattaaaacagtctgattaaatatttgtacttttgccagtaacattcatgaggataggccatatctaacttatttcccatttccattgtatctagctcagtgcttgacaggtagtagatgcttactatatagttttgaaagaacaaatatatctatatactgccaattaatttacctgtaaagaaaaacaatataatttttttttcctttacttattatttttaaaatgtaagtttcctgtttaatt

SEQ ID NO: 271942 - DNA, 221 bp, Homo sapiens
gttctttgttcctttttcttccttttctgacttattttggataatttagtactatttaatattccattttatctcttcttttagctttttagtaccccttttaagtcattactctggagattatcatatgcatccttaagttctcagtctaccatgaattcatattatttcaaaatgtagtaactttatcacagtgaagctccatttaacttccttctatc

SEQ ID NO: 271943 - DNA, 377 bp, Homo sapiens
aaaaaatgttcaagagaatgcagctgaaatgcagggcgcataagtggatatagtgggaaagaaggcaggccagcgtcagacagccgcggggccttagctactgggtggaggaggagtatgaactttatcctgtagatcagagctgcaaactagccatatctaggctgagtatttggctcctgcagtgtttggggagttaatttgttttttacaataagtaatacgttcaaatacatttgaacagggcgcaaaattcaaaagggtattcagtacagagtaagtccccttcctccagccactgtttccctgaccaggggcaagcattgttaacagttgttttcaccagagtatttttaaaaagtcagagccaacattta

SEQ ID NO: 271944 - DNA, 425 bp, Homo sapiens
gagcattttgtatatgaagaacagagtgacaggaagaagaaagagcaccaggctgagcaccattcgacctccactaatacacgtctgaccttgttcaagccccttcgcatctctggctcaggttcccctattaagtgcaaatcacagcagtaactcaacaagacatgggactcaaaaatctaaatgacatctcaacaacatgtgattgtacccaggcatttccccctgggagcaccaaagggaagaaggtaatttttcggtcttttggaagctgtgccctggtgccaagatgcctcaagccaaaaccacacagagcagcctgcctgacagatgggcccagtagcctttatcaagctcttaggctcttatgagcttccctacttgcgaattaaacataaatttatcctttgcggctctttcataaa

SEQ ID NO: 271945 - DNA, 565 bp, Homo sapiens
gaggttcaagaagtagaggttagctctggattggatgctttcagaaaattgggtaattctatattattttaatgaatttcatttaagaagtgggaaaaacactgaaattaaatctataattggtaaataagcagcattcactcatactagcaaggaaaaagagctcttttgtctttttcttttttttttttagacattgtctcctcaggcatgaagtctggctccaaccgggttataaggttattttctggtcttggtgttatatgaaattatttgcattcaataggagaagattatggccaacctgtgagtgtcagaacagttccacgttgttgggctgattctcttctcaaaatattgttcattgcagagccatattacttactgaaacctctaagtatagtctgggattgcttatggatctaagtaatcttagagctgagattacttaatttctactattattttcttgataatgtatccctaagtttaatcttgttatttccatctgagatttgtgcttgtctgttattaaatattcttaataaaaatttaaaaaacaaac

SEQ ID NO: 271946 - DNA, 449 bp, Homo sapiens
taagaccaagttcaaatagtagttatcaattaagtcttcaagacaaatcagtttcttccctctttgtacacccattctactttctatctttttctattatatttgcttaggtttttgccatcccagctggactgtaaaattttctttgttttaagtgtttttattttaatttttgtgggtacatagtaggtgcatacattgatggggtatatgaaatgttttgatacaagcatacaatgcataataatcacatcatgtaaaatggggtgttcatcccttcaagaatttatcatctgtgttataaacaactcaattatactttcaattaatttaaaatgtacaattaaattatttttgaccattctcactctgttgtgctagcaaatactaggtcttattcattctttctattttttgggcccattaacatccccagcacctcccctgcc

SEQ ID NO: 271947 - DNA, 958 bp, Homo sapiens
gaggtggaactgcttgctggtagtgacacaattgggaagaaggagaagggccggagtctggagttcgtgctctctgacttctgtgggtagcatctgccattctgctggtgctccttcagacctttcagacagtgcagaggacacagaggaatcaagggacagctgttctcttacaaaccttgaaaatcctgtacagagccctcagataaccaaaacgtggtccagaactgaatcctggggccaacatgcccatttagcacttctctcaatcagtccttttccccaggtgcattaaacagggcagctgccttcccaccctatgggcaaactgcttggcagctaggagtgtgcctgctcatctcccaggctgctttcctttgcacctcagcaaggagggcaggccgtgcatccagggaagcacatagttactccttctgccagaaggccaccccctaatctggtttaccgtggacactgaagtcactccctgtctcctggccatgaggaaaactcctttgagaggagcctctgaagccagtggagagagtaaaaagtgagaatcctgcctagttgaacaggcagttcagcctgttctggaaagagttaaggctgtgtccataccaagccatttaaagaatctgcccagtagaatcaatattgtcaaaatgtccatactacccaaagcgatctacagaattaattccattcctatcaaaattccagtggcattgcttacagaaatagaacaaataatcctaaaattcctatgaaaccatgaaagaccccaaattactaaggcaatcttgagcaagaagatctaagttggaggcatcacacaacctgatttcaaatattataggctggacatggtgactcacacctgtaattccagcactttgggaggctgaggcgggagttcgagaccaacctgggcaacatagcgaaaccctgtttctat

SEQ ID NO: 271948 - DNA, 471 bp, Homo sapiens
gcagatgatgaatctggttggtaaaacaacgagggatgttcaggtggctttgctatgagagcagtccaggtgaggaaggacatacttcttaggtgtgactgctgtctcctgagcactggtatgatacggccacagtgaatagccctgcagttgggctaatggctaatgtctcctgcaacccaaatctcaactgagacgatttcagaatgtagcaagttgtcagcttcttctcagttaacacataaaatgcatacagccaaatatctggcaaaagttcaagagttcaattttcctcaattactgatgcttacaggatttttcttaacatattctaaatgaattagctctgaagaatgaccctggccataatcacagcacagtgggtaagtgtttagacttttatatcaattaaacataacattcatatccaaagtgttttagtgtatctgacaataaaaccttttccaccat

SEQ ID NO: 271949 - DNA, 891 bp, Homo sapiens
tgagctctgatcatgccactgcattcctgcattccaacctgggcgaaagagcaagaccctgtctcaaaataaataaataaataaataaaaataaaaataaataaaaattgattgggagttctttgtggccaagacttgtcaactgatagctttaaggggaatgtatgctgattcctaattgttatcctccatccctctatcttatctcctgttgcaatcataaatgatggctggatgactactccattcctctggatgtaaaatctacattctcttgcctgaggtggatacgtttgcttgggttctgtttaaggagatggggccagcagtgtgtttcagggcctgtgaaatgtgttctctatccgggcttttgcttaatctctgttttcagtcttgcctatcagtcccactgtcgggggtacctcgtgtctgagtctagaacctttccaggttgctgtgggacagattagcctccttgttctcagtatccccctgacctccacctttgttgctttgctccatgaattaaccattttccatgtactgtcattgtctaatgaagatgaattctcttctgttggtaaccccattccttttttgtaattgtgtgcttatacaatgtttattcttcactgtatttctattggagcctcaggacaaagagcagatggtgagaatctgtgttcagtgttaagttttccttctgtaagacatgtgcaacttgtgtttttcactgaatagatcatggacttaatgcatatagagctactttgtttttcatgattgtgccttcaattatatgtagaaatataatttgtgaattgcctgatgaaattttcctaattttgaattatctttgcattcctataataaacactgttagaatggcaa

SEQ ID NO: 271950 - DNA, 398 bp, Homo sapiens
tctgatctgctagcctaactattccccaacacctttaggaagataggtcttccctgaccctcagtctgaggtctagaagcccttctgccttgcctcacaggcatcttccctcctcccccgtcccctagaccagtccaacagcagcccgtgcagcctctgaagtccactcccagtgctagctgatgggaaccccatgggctcctgtctgctatacaaatggaacagactttcttcagagccaaccccagctgccccactgaagctggttgccacagtgattttcagtctcataccagattctgatctcttctcttgcccacctttggtgctgcagagtggatcatcttgttttatactcaagtcatcattaaaatttatagaaaaagagagaatttaaa

SEQ ID NO: 271951 - DNA, 596 bp, Homo sapiens
cccgcctcagcctcccaaagtgctgagattataggtgtgagcctctgtgcccggccttgatttttcttttttttaagtgttaacttaatctttctcctgaagattctcagagactaaagatgaaagaagattttcattgcaaacttcttacccgttattaacaagtaaagcccatccttctgacacatggttggtgtcagtttggcattagatcacccttcctgtcctgaatctcccgacaatggaattcaggtgtggacacttgctgtgttgaaggaaagatgtggaatagccgaatcaccgtatgactcagtctgtactagagaaacccgctaaaaggctcaatcgtgtcacaaagacattcgtccacatgcatgtcaggacccttggagctattccacccagaagaccagagcagaggaactcaggctgaagaattaagtggacatttcccactgaaggatcatcagcaataaaaaggaagagcctctgaaaaactaacaggagtcatttgaaaagtatgatgctattttaaaaaatctatctgtaacatcatttcttgaacatattgcaagaaaaaagctatgctttcagtg

SEQ ID NO: 271952 - DNA, 321 bp, Homo sapiens
tgctggatggaaggactctgagcctaccaaaggaagcgtatttacaaacctctaggtactgacttgttgctgaaggtcagaaatttgcaatgacatttggatgtattcaagggtggaggggcaggtttggggaaagttcttttaaagaaaaaatgcaaaatttgattacaagaagctggggtgcctcccagggcctcggaaagggcttgcacaagtgaagcaccctgaagataatgcttcattagctttacagtgaagccacctctgaatctctgtttggtgtttgtccaaaatattccaagttgaaggcaggcctgatta

SEQ ID NO: 271953 - DNA, 447 bp, Homo sapiens
tgaaaaagatggacaagcctgacattagcagctcactgttgagcacacggccccctgcagaataaacaagtgtgtggtttccatctgatgaaggtgggcatgtagttcctggacagtccagtgacttccatcattccacagacaagatcagatgccctctctaccagccaccgtgctgggaccggcccaatctgtgtttcaaatcagcttgtagcacgcagggattcaaaatatttaaagatgaggtttgaaggtacgtctggagaccaaggacgttagttctggaggtccccgtctcctgcgtgtttgcggagctggtgacagtgccctctccccgtgctggagagggctgaggagaggctgtgtgtctcagcaggatgccagtcaggattcttctggctatgggcttattttttgcaataaattcatcgttaaagtcccaaactt

SEQ ID NO: 271954 - DNA, 218 bp, Homo sapiens
ccgccacctggatgcactgaggtgtgcacagccacgtggagatgatgctgggggctcacggtgactctcaggaggccctggcctggcctatctggagccttctctgtgaaatgaggctggtaacgcccactagcagggttgtaggggacatggatctgtggccacctcctcaaggggtgccacacgcaccaggtcctgactgggagtccggcccccag

SEQ ID NO: 271955 - DNA, 338 bp, Homo sapiens
tgcatcacattgacccaaattgtcacttttcacttgcccttctttcagtgtaagaagaagctgtctttggagtgagaacaagggtgaggttctggctcagaaaccttagaatcacagacactgttttcctgaaaacattgcttctttctctcatctcaaagaaatgccacaagtcgtgtgtaagtataacatgctggacaggtccttattaaatttatatttgtattttgatattattttaatcctgtagaagaacatatacattttggtgtttattcttcttgattatagaagtttttgtgtttctactttgtttataataaatattttaaagttaa

SEQ ID NO: 271956 - DNA, 552 bp, Homo sapiens
cttgtaccttttatgttgacactgtaagtttgggcactaaaacctaaggacttccatgttgtcattgactctaatctagttagcgttgctactgtatgcttctagctttgattaattcatttaaataaacgtcactgaacttattaaggccttcctagcaaagctctaattattgtaagattccttttgtcggagttgagaggaataaagaagttttgagactcatggtaactttagaagatagtatcatgaaattatttgatttgaatcattgagaaaagccagccagctccttattttaactaccttgggtataggagtatgtgctttgagaatgtatacattaattttttgcacattatcaagaatataaataattccagatgctaaagaaatttggggattatccgttactgcctagtttataggctctgtaaaattgaatagatgtaataagggaattaacaaagactctgacttttaaagtaagagttactatgactttattttaaaagtctgtcttattaatatatctgagatgtgaataaaatc

SEQ ID NO: 271957 - DNA, 511 bp, Homo sapiens
ttggtcatagcaatcctatgaggtaggtattataacacatactatacaataaagaggttaagttccttgtacagtgttgaacaatcaatgagtgtttgaggacaccaccaaagtagtataactgataccaagacatgttgtttacccttaggagctatttctatctaaaagcgttaaaggtgttttgctcaaataactaaatttaaggtagtttgaaataagtagcataagtgtagtgctaccaagatgtagtggatattcagagggaagattattttggagaccacggaaaggctttaggtgatggtttctaaatggaggcttttagaatcaataagatttcatcaagttggcttatgaggatgtaggagatgaactatttcagaaggtactcattttttacatcaaatacgttcaatgattctagtcttttgggaataggaaagtgatggtgaaggggcaacctctttagttttcagttttcgggattcatatactcactctatgacca

SEQ ID NO: 271958 - DNA, 297 bp, Homo sapiens
gccactgcactccagcccaggtaacagcgcaagactccatctcaaaaaaaaaaaataataataatatggatttaaaaatacagtataacaactacttagtatttacattgtattagatattataagtaatctagagatgatttaaagtatgtgggaggatatgtttagattatgtgcaaatactataccattttatatcaaggatttgagcacctgtgaaagtcctggaatcaatgttattaatacaggacctgaaacatgatagatatttaataaagaacagctttattattgtta

SEQ ID NO: 271959 - DNA, 473 bp, Homo sapiens
ggcggtccggacatgatttatagttgggtgaaatcttcgcagtaatggtcattgggcaaaaagccggttagcgggggcagggcgtcctagggagaggagggtggatggaattaagggtgttagtcatgttagcttgtttcaggtgcgagatagtagtagggtcgtggtgctggagtttaagttgagtagtaggaatgcggtagtagttaggataatataaatagttaaattaagaatggttgtgttaggatcacaggtgtgagccaccgtgcccagcctctttagtcctgttctgtttcttggaagcaccatgcttgtcccacctacaggcctgggtctcagccctcctggccctcctctgagaggcctctccacagccacactctccattgtccattcattttgtttctgttgcatttattcccgtctcaaagtctcttgttcatatattgattacttgcttatccactgcc

SEQ ID NO: 271960 - DNA, 985 bp, Homo sapiens
agctgcaaacatagataagcgagctggaatcttgcacaggggaatgtcagcagctgtgtcaatagaaaagggctacctgtgggccaggcatgtccaacatagaggctccatcttccctttttttgtttgttaccacatgtacagtaaaggaatgggcagtgtggcacaggccaggcagaggacccacctgcataataaaatttggttaggggtgaccagcttttcataccctatgcaaatggcacagctattcctaaccagtttttagtgtctatgcacacctggtctaatcaatcttttgcaccctatgtaaatcagaaactgcctcctcaccaggcacctataaaaacccctgcatttcactgcagatccagcaacttatttctctaggacccctctctctagcagggagctattctttctttcacctattaaacttacgctctcttaaactcactctttgtgtgtccatatcctttatttccttggccatgagacaatgaaccttaggtatcaccctagacaacagggctgcttcaataccagaatctctgggacacagctaaggtagtgttaagagggaaatttatagcattaaatacccacatcaaaaagttagaaagatctcaaattaacaacctaatatcacaactagagaaactaaagaaacaagaggaaaccaaccccaaagcaagcaaaaaacaagaaataaccaaaatcacagctgaactgaagaaaatttagatgcaaaaaactattcaaaagatccacagcctggatatggtggctaatgcctgtaatcccagcaatttgggaggctgaggtgggatggtttcttgagctcaggagtttgagaccagcctgggcaacacagtgagaccttgtctctacaaaatatcaaaaaattagctgggtatgatgaagtgcacctatagttccagctacttgggaggctgaggtgggaggattgcttgagtatgggagg

SEQ ID NO: 271961 - DNA, 552 bp, Homo sapiens
tacgaatgagactggaaaatacagcgtgtatttgggaggctgtatgcctagctaaaaatcaggaggcttattactaactaagaaggaagaatgtgatactgaaggtcaactggcaggttttgccacagtgtaaaaatcaggatttcatagatatacagaatttttgaataagtgactttaaaatcattccatacaaatccctctttttcagatgagggaagagaaacacagaagttaagtgatcagttatgatcatgtattggtaggagcatgattagaaaccaagtttcttgggccgcagtttcatattcttgatgctcaactaacctatgaaattaaattagggatgatggtttaagaaaacgattcacatggaacccccttaaattagtttatttattacatattttaaaaatttatcctgatgtacttatttaaaccttaagaaccacataatactatataatgcttttctgtacaaatctcaagaaacactttcattcattaaaacatcatgaaaatccttaaatgtgttaaatggaaaaaaatgaa

SEQ ID NO: 271962 - DNA, 310 bp, Homo sapiens
gaataaggaaactgcttctttcttttccaggaaattcatttaaaaatttgcacctcacatacaataatatcactcatagtaagtctgaagctgaagagaggggagcagggttttctccctaaatttcatcctactaatctttgaaaatcctcaggtattaatcttaattaatagtattagtaatatctcccagctgggcatggtggctcatgactataattccagcaatttgggaggctcaggcaggcagattgctttagccaaggagttcaaaaccagcctgggaaacacgcaaaaaccctgtctctac

SEQ ID NO: 271963 - DNA, 564 bp, Homo sapiens
acaggcgcgccaccacctctggctaattttttgtatttttggtagaaatgtggttttgccatgttgttcaggctggtcttgtactcctgagctcaaacaattcacctgccttggcctcccaagtgctgggattacaggtgtgagccaccatgctcagctttctggctaattttacaatttttttgtagagacggtcttgctatgttgcctagattggttttaaactcctgggcacaagtgattctcttgcctcagtcttccaaggtgctgggattagagatgtgagtcactctacctggctagggctcactttttggaaggagtttacctctcccccaccagctgataatttttaccaaaagtcgtatgttttggttccaagtatgtttatggcagttatcctgttagtgatgtgaacagaaaaaataagagtgctgagagaaagctgttccttctacaaaaactgaaggatgctggcttggtttctgtcgctacagaacaagttaccaaacacaaatttggcagcttgtaacaacaagcatttacactctcacagtttctgtg

SEQ ID NO: 271964 - DNA, 344 bp, Homo sapiens
ctagcccaacaaagctaattacattttaacttcagcaaaactgaggttgacttgactgctgggtctgctgttagcccatcccttcaaaagcatgcttgatggtccatttctctttcattctgtatagataagattgattcattcatactcatggcttcaatcatcactcagtttatatctgcacagtcatcacattactcaaataaacatgtttcttactccttagcaagataatcataattagcatgaaaatttatcaacatacctaagctctatgtcagtgacaatatcttacctaatgaggtaagactgggaggtgttacttttagcagaatgtacttcat

SEQ ID NO: 271965 - DNA, 456 bp, Homo sapiens
catttctctgcttaaaacctccgcttgaattcttttgctcggatgttcgtggctgctatgaattccttccctccctgcatgcatggagaggtggagtctgtccctccattgctgggaacctgggctggcctgtgactgctctggctaatggagccctgcagaagtgctgctgtgctttatggagactggctgtttaggcttccggccagttggaagcctttagttgctaagtgagaaaccccggtgggttctgctgaagagagaggccacatagaaagcaacacagtgccagacatatgagtgaagaaggctctcagcagaaccttatgggtgcctccagccccagcctctagctggctgcagcccatgggggaacccactaaagaaccacccggctgaacccagtcaactaacagaaacatgagaaagaatattaaatggttgtgttaagccact

SEQ ID NO: 271966 - DNA, 476 bp, Homo sapiens
aaatattgcctgttttcttttgaaatacagaaattcacaactggattttaagcagaagtttacaatctcaatattatgtaacaggtcacattgccagagaagtacatcaaatatttatctagtgcttactgtgtaccaggtgctggtacagtgggaacagatgtgataaagtgggcaatggaaagcgcaatgcagccgtattcccttgaaacttttcatgattccctttttactgttttcagccaagggacttaggtagtattcttctgaagaaaaaagacctcctttagtgatcagttaccttttgatattttaaaatcatactaaaattttagttgttaaataccatggtgctacaataagaataaaaagataaattaatggatcagggtgggtaccccaaaaatataccttttttttttctttgagacaggttcttgctctgttgcccaggctggagtgcagtggcgtggtca

SEQ ID NO: 271967 - DNA, 271 bp, Homo sapiens
aagggattctttttactttgttgattttccctattctaattttttcatagtcttccattaagggctcctctttgaatgattattttaaaatttaccttcctcttacattgttttccaaatcaatctttttccctttctaaaatagtacttttggggccacgcgcggtgcctcacgccgcaatcccagcactttggaagctcgaggcgggtggatcacgaggtcaggagatcgagaccatcctggctaacacagtgaaaccccgtctctact

SEQ ID NO: 271968 - DNA, 468 bp, Homo sapiens
ttatttaattctctaatgtatgggaagcagcgtagcatcgtccttgctgttgctatggtatttattgctgttgagccttcaggaaacctctctgcatctcggtttcctcatctataaaatggagatgataactgtacttacatcatggagctgctatgaggatcaaagaagttatcaacacttcagaatacggccagcacataggaacaatatatctatttgctaaatcgaaggataaaaagaaacctactttgtatggaaaaggagaaagaaaagagtaagattgaactatgctttgctgcatggtgggtttgatgaaagtggagtcacgctgattggtgctcaagataaatgtcttaggggaagactcatacccagtggaattttttttagtgaaatatcgtggctcatggactgtgagatttgtcatttgttttcaataaaatgataaaaatcataaaaaatttt

SEQ ID NO: 271969 - DNA, 813 bp, Homo sapiens
  misc_feature (4)..(4): n is a, c, g, or t
gggngaggggcaacgtatataaatgcgcgcaggcgtagttaagagagcgcattttgacttcgaggcaccgccgacgttactgtgtcgccatggggcgccgtccagctcgctgttaccggtattgtaagaacaagccgtacccaaaatctcgtttctgccgaggggttcctgatgccaagatccgcatctttgacctgggtagaaagaaggcaaaagtggatgagttcccactcggtggccacatggtgtctgatgaatatgagcagctgtcttctgaagccctggaggccgcccgtatttgtgccaacaaatacatggtgaaaagttgtggcagagatggctttcacatgcgagtgcggctccatcccttccatgtcatccgcatcaacaagatgttgtcctgtgctggggctgacaggctccagacaggtatgcgaggtgcctttggaaaaccccagggtactgtagcccgggtccacattggtcaagtcatcatgtccatccgcaccaagcttcagaacgaggagcatgtgattgaagccttgcgcagggccaagttcaagttccctggacgccagaagattcatatctccaagaagtggggcttcacgaagtttaatgctgacgaatttgaagacatggtggccaagaagtgcctcatccctgatggttgtggagtcaagtacgttcccagtcatggccccttggacaagtggcgggttctgcactcatgaaggttttggcagtactgtctccttgggccatgctggtctgacttatgcttactaataaattctgtttactggcaaaaaa

SEQ ID NO: 271970 - DNA, 1341 bp, Homo sapiens
  misc_feature (4)..(4): n is a, c, g, or t
  misc_feature (1341)..(1341): n is a, c, g, or t
gggngaggggcaacgtatataaatgcgcgcaggcgtagttaagagagcgcattttgacttcgaggcaccgccgacgttactgtgtcgccatggggcgccgtccagctcgctgttaccggtattgtaagaacaagccgtacccaaaatctcgtttctgccgaggggttcctgatgccaagatccgcatctttgacctgggtagaaagaaggcaaaagtggatgagttcccactcggtggccacatggtgtctgatgaatatgagcagctgtcttctgaagccctggaggccgcccgtatttgtgccaacaaatacatggtgaaaagttgtggcagagatggctttcacatgcgagtgcggctccatcccttccatgtcatccgcatcaacaagatgttgtcctgtgctggggctgacaggctccagacaggtatgcgaggtgcctttggaaaaccccagggtactgtagcccgggtccacattggtcaagtcatcatgtccatccgcaccaagcttcagaacgaggagcatgtgattgaagccttgcgcagggccaagttcaagttccctggacgccagaagattcatatctccaagaagtggggcttcacgaagtttaatgctgacgaatttgaagacatggtggccaagaagtgcctcatccctgatggttgtggagtcaagtacgttcccagtcatggccccttggacaagtggcgggttctgcactcatgaaggttttggcagtactgtctccttgggccatgctggtctgacttatgcttactaataaattctgtttactggcaaaaaaaaaaaaaaaaaaaaaaaaaaaaaaaaaaaaaaaaaaaaagaaaaaaaaagaggaggggggcggctataatagtattttccctagtagggggcgacagaagtattatgctgtgtaccaagggtttcttttcgtaagacgaaagggggccgccataataataggtaacggttactattatagtacgcgaggaggcagagggccgcgcgttttattaaaaaagtagtatagagttgggggagaaaacagcgtgagcacaacagtagggagaaactctttctggggagacaaaggagagagcaacataatactttgtggaggggggggatgaacacaatatctggggagagaagattatttgctctccaaagagaagaaattttatgtaaggccgatcttgagcgggagcacaaattattaacaactgtctagcagcggtgtatataacaggggttggaaaaaactcgacgtggaaatattaccgacgggcggtacttaaagagacttttgggtctctaaggagagtattgn

SEQ ID NO: 271971 - DNA, 378 bp, Homo sapiens
ttgcacaatgatgaaattgcctaatgatgtgtttctcagaatggatttctgttgttaagcagtgcatgacagtattcaggaatcaataacctcttaggtgggataattatattgtggttttgttttttaaaaagaaatccatctcttttaaagagccatgctgaaatattacggatagtatgatatgttgtacaggatttgctttccaattcttgagagtgagacaaggtaggaagggaagtgggggagatttaaatgaagcaagattgaacatgttttaactgggtgacgggtacgtggaattcattgaattgttatctttacttttgtaaatgtttgaagttttttataataaaaatatttatgggttttttgttt

SEQ ID NO: 271972 - DNA, 321 bp, Homo sapiens
ggctattagtatttatttgatacctatcacatcacatgttttttttttttcacttaatactgatcctgatctttaaagcaattgttattgttcccatttttctgatggaaaagccagaaagtgagtaagttacttacccaagtttaaacagctataaaatagctatggcagatctgttggttgcttgtctataaccatttttcttcttcttctttgctggctgaacatgcttctcattaaagaagttgaaaatgctggaaactcaaaaagaaggaaaatgctggaaacttttttaaatttttgaaacagggtcttgctttg

SEQ ID NO: 271973 - DNA, 412 bp, Homo sapiens
gagccaatgtagtggctggatcttcaatcgtgggagccgaggtgtctgtggccctggaaacaccatttgtctcccagcaattgggcctcttagttccactttcagttgcactgccgtcttctctagggaggcagttggggccaagcacagtggctcacccctgtaatccaagcactttgggagaacgaggcagctggatcacctgaggtcaggagttcgagaccagcctgaccaacacggtggaaccctgtctctactaaatacaaaagattagctaggcgtggtggcgcatgcctttaatcccagctacttgggaggctgaggcaggagaatcgtttgaacctgggagacggaggttgcggtgagtcaagatcatgccgttgcctgggcaacaagagtgaaactctgcctc

SEQ ID NO: 271974 - DNA, 340 bp, Homo sapiens
aagtgacctgcactacttcctagattgggctttcagacgctggttgtgcttcttccatattcatatccccttttctgccagcaggaatctggagctggtggtaccccaacttcaactgtgcagatgggaacaatgtcctaggatgtggcagaggaacatcatgggaaaaacccaagatctctgaatgactggagcagagacaccccactcgcctagactgttcgcgtgtaatttcttcaagccacagtattccagggtttttaatagtcatttggcaataccctgcataatatgataaacaagtgtgcaaaacatgtcagatgggataaatatgattgag

SEQ ID NO: 271975 - DNA, 638 bp, Homo sapiens
tgtgggtgtatacaattataaacacttaaaatctttgtttgtatgtagattatacctcaacttaaagaaatgcatcctattctccctcctccaaagcattttactgtgtacaactctctgtagctctggacttttctaggggtgcaatgactattttaaatttaaagtccacatcagggcaaggcctccgtataataggaaaactgaacaggatctttgaaactgagtctgtcccagaacatttctgatgaaaacagtgcccgtaacgcaaagctaggacagggcaataaaccttgtaagtctggccacatataacatttttcagttaatacagatagaatctgaatctcagaagctgaggcaggaggatcccttgagttacctgtttttttctgtgcccccagtttctttctttctagaaccaagctggcttcctgccttcaggtccaacttctgctccttcctgctgcccgccactatgaaaatccctttccataccctggagtctcttgtcctcctccttcagacagagctgccaagagcaatagctttatacgcagaagcccatccacttctggtggctttatgtactggggcccaccctcttctgcagccgatgacatttgaaatcccatcca

SEQ ID NO: 271976 - DNA, 511 bp, Homo sapiens
aatatgtgcctgtcttctctaaggttcccgtttgttctcacgttggatctgtctctccctcttcttctccccactctgcgtgtacgtgcctgtgcatgtttgtttcgtcatctctgtgactacctacccacctaccactttatcactctttttttggtccagtcttcccccgtgtctgagactgttcatctgtggccctgccgctgttccaacctcggggactttccctcactgcacgtggttaaacactttgctgagagccctgtcttcaaacagacttccccaggtcattgtgttggtatctggcacacaacgtcactcattgtttatccagttgtgttgttttataagagagtttctttatctcaaggaatgcgtgtcacgtgtctgcaggagttactgccccggtttcaagagatgtgatggtcttgggctttactgacttacactagggcttttttcagtgccttccccagaattacgtgttttttcaagttcatctaaaaaaaaa

SEQ ID NO: 271977 - DNA, 486 bp, Homo sapiens
gaaaaaaaagaaatggttgaagtttgtttgccttggttataggtgaaggctgggttgtttgaggatgacggctggttttaattgttccgaagctcggcctcctgcctggtcacatgccggctctgtcagcgagttgtgcaccttctgtaacttcgtggtgttgaacaagtgatggtttcccacattttagtttgtttctgtggtttgaaatgcaaaatgtgcaggaaaaaaaattgcgtggcaagaagtatttttccagggatggcatcacaggcacgtggagctacatacaccatgtgccccctgccctgctcaccatcctgatcactgtctgtcctgcccttggaaatggtgatgtattgatcttttaggcaatgggaatcaactttgaaggtgacaaataaatataagctttgagagcactcctttcacctttctgagagggagccattggtcacagagtggcactctcagatcggcggccgc

SEQ ID NO: 271978 - DNA, 712 bp, Homo sapiens
cccactctcctctttccggtacctgtgagtcagctaggggagggcagctctcacccaggctgatagttcggtgacctggctttatctactggatgagttccgctgggagatggaacatagcacgtttctctctggcctggtactggctacccttctctcgcaagtgagccccttcaagatacctatagaggaacttgaggacagagtgtttgtgaattgcaataccagcatcacatgggtagagggaacggtgggaacactgctctcagacattacaagactggacctgggaaaacgcatcctggacccacgaggaatatataggtgtaatgggacagatatatacaaggacaaagaatctaccgtgcaagttcattatcgaatgtgccagagctgtgtggagctggatccagccaccgtggctggcatcattgtcactgatgtcattgccactctgctccttgctttgggagtcttctgctttgctggacatgagactggaaggctgtctggggctgccgacacacaagctctgttgaggaatgaccaggtctatcagcccctccgagatcgagatgatgctcagtacagccaccttggaggaaactgggctcggaacaagtgaacctgagactggtggcttctagaagcagccattaccaactgtaccttcccttcttgctcagccaataaatatatcctctttcactca

SEQ ID NO: 271979 - DNA, 580 bp, Homo sapiens
cccactctcctctttccggtacctgtgagtcagctaggggagggcagctctcacccaggctgatagttcggtgacctggctttatctactggatgagttccgctgggagatggaacatagcacgtttctctctggcctggtactggctacccttctctcgcaagtgagccccttcaagatacctatagaggaacttgaggacagagtgtttgtgaattgcaataccagcatcacatgggtagagggaacggtgggaacactgctctcagacattacaagactggacctgggaaaacgcatcctggacccacgaggaatatataggtgtaatgggacagatatatacaaggacaaagaatctaccgtgcaagttcattatcgaactgccgacacacaagctctgttgaggaatgaccaggtctatcagcccctccgagatcgagatgatgctcagtacagccaccttggaggaaactgggctcggaacaagtgaacctgagactggtggcttctagaagcagccattaccaactgtaccttcccttcttgctcagccaataaatatatcctctttcactca

SEQ ID NO: 271980 - DNA, 487 bp, Homo sapiens
catcttcgagtgcttcaccggtccgtgctccccctactcctcatcagtggtctggattcatttccaggaagtgagccccttcaagatacctatagaggaacttgaggacagagtgtttgtgaattgcaataccagcatcacatgggtagagggaacggtgggaacactgctctcagacattacaagactggacctgggaaaacgcatcctggacccacgaggaatatataggtgtaatgggacagatatatacaaggacaaagaatctaccgtgcaagttcattatcgaactgccgacacacaagctctgttgaggaatgaccaggtctatcagcccctccgagatcgagatgatgctcagtacagccaccttggaggaaactgggctcggaacaagtgaacctgagactggtggcttctagaagcagccattaccaactgtaccttcccttcttgctcagccaataaatatatcctctttcactca

SEQ ID NO: 271981 - DNA, 512 bp, Homo sapiens
  misc_feature (36)..(37): n is a, c, g, or t
  misc_feature (39)..(39): n is a, c, g, or t
cgcggggcgccgcccgggttgaaaagttgtatttgnngnccttcggtgtttcacgttttgccccctctactctcatggtctggttctttccatgagtgagccccttcaagatacctatagaggaacttgaggacagagtgtttgtgaattgcaataccagcatcacatgggtagagggaacggtgggaacactgctctcagacattacaagactggacctgggaaaacgcatcctggacccacgaggaatatataggtgtaatgggacagatatatacaaggacaaagaatctaccgtgcaagttcattatcgaactgccgacacacaagctctgttgaggaatgaccaggtctatcagcccctccgagatcgagatgatgctcagtacagccaccttggaggaaactgggctcggaacaagtgaacctgagactggtggcttctagaagcagccattaccaactgtaccttcccttcttgctcagccaataaatatatcctctttcactca

SEQ ID NO: 271982 - DNA, 493 bp, Homo sapiens
cccactctcctctttccggtacctgtgagtcagctaggggagggcagctctcacccaggctgatagttcggtgacctggctttatctactggatgagttccgctgggagatggaacatagcacgtttctctctggcctggtactggctacccttctctcgcaagtgtgccagagctgtgtggagctggatccagccaccgtggctggcatcattgtcactgatgtcattgccactctgctccttgctttgggagtcttctgctttgctggacatgagactggaaggctgtctggggctgccgacacacaagctctgttgaggaatgaccaggtctatcagcccctccgagatcgagatgatgctcagtacagccaccttggaggaaactgggctcggaacaagtgaacctgagactggtggcttctagaagcagccattaccaactgtaccttcccttcttgctcagccaataaatatatcctctttcactca

SEQ ID NO: 271983 - DNA, 361 bp, Homo sapiens
cccactctcctctttccggtacctgtgagtcagctaggggagggcagctctcacccaggctgatagttcggtgacctggctttatctactggatgagttccgctgggagatggaacatagcacgtttctctctggcctggtactggctacccttctctcgcaagctgccgacacacaagctctgttgaggaatgaccaggtctatcagcccctccgagatcgagatgatgctcagtacagccaccttggaggaaactgggctcggaacaagtgaacctgagactggtggcttctagaagcagccattaccaactgtaccttcccttcttgctcagccaataaatatatcctctttcactca

SEQ ID NO: 271984 - DNA, 251 bp, Homo sapiens
tgcctcatagagtttatgagttttccagttggagaagaggagagaaagacgttactggccacaccacagctcttttgaggaatgaccaggtctatcagcccctccgagatcgagatgatgctcagtacagccaccttggaggaaactgggctcggaacaagtgaacctgagactggtggcttctagaagcagccattaccaactgtaccttcccttcttgctcagccaataaatatatcctctttcactca

SEQ ID NO: 271985 - DNA, 247 bp, Homo sapiens
  misc_feature (39)..(41): n is a, c, g, or t
ggtaatatgtgaagtgtagaacattttaaagaaaaaccnnncaaccctcactggccacaccacagctcttttgaggaatgaccaggtctatcagcccctccgagatcgagatgatgctcagtacagccaccttggaggaaactgggctcggaacaagtgaacctgagactggtggcttctagaagcagccattaccaactgtaccttcccttcttgctcagccaataaatatatcctctttcactca

SEQ ID NO: 271986 - DNA, 246 bp, Homo sapiens
gaagaggtggggggtgggaagtgtgtttatttacgtttataagacgttactggccacaccacagctcttttgaggaatgaccaggtctatcagcccctccgagatcgagatgatgctcagtacagccaccttggaggaaactgggctcggaacaagtgaacctgagactggtggcttctagaagcagccattaccaactgtaccttcccttcttgctcagccaataaatatatcctctttcactca

SEQ ID NO: 271987 - DNA, 767 bp, Homo sapiens
cccactctcctctttccggtacctgtgagtcagctaggggagggcagctctcacccaggctgatagttcggtgacctggctttatctactggatgagttccgctgggagatggaacatagcacgtttctctctggcctggtactggctacccttctctcgcaagtgagccccttcaagatacctatagaggaacttgaggacagagtgtttgtgaattgcaataccagcatcacatgggtagagggaacggtgggaacactgctctcagacattacaagactggacctgggaaaacgcatcctggacccacgaggaatatataggtgtaatgggacagatatatacaaggacaaagaatctaccgtgcaagttcattatcgaatgtgccagagctgtgtggagctggatccagccaccgtggctggcatcattgtcactgatgtcattgccactctgctccttgctttgggagtcttctgctttgctggacatgagactggaaggctgtctggggctgccgacacacaagctctgttgaggaatgaccaggtctatcagcccctccgagatcgagatgatgctcagtacagccaccttggaggaaactgggctcggaacaagtgaacctgagactggtggcttctagaagcagccattaccaactgtaccttcccttcttgctcagccaataaatatatcctctttcactcaaaaaaaaagagggatttacctgacaccggggtcttccgaagcattttcgtggaaa

SEQ ID NO: 271988 - DNA, 1123 bp, Homo sapiens
cccactctcctctttccggtacctgtgagtcagctaggggagggcagctctcacccaggctgatagttcggtgacctggctttatctactggatgagttccgctgggagatggaacatagcacgtttctctctggcctggtactggctacccttctctcgcaagtgagccccttcaagatacctatagaggaacttgaggacagagtgtttgtgaattgcaataccagcatcacatgggtagagggaacggtgggaacactgctctcagacattacaagactggacctgggaaaacgcatcctggacccacgaggaatatataggtgtaatgggacagatatatacaaggacaaagaatctaccgtgcaagttcattatcgaatgtgccagagctgtgtggagctggatccagccaccgtggctggcatcattgtcactgatgtcattgccactctgctccttgctttgggagtcttctgctttgctggacatgagactggaaggctgtctggggctgccgacacacaagctctgttgaggaatgaccaggtctatcagcccctccgagatcgagatgatgctcagtacagccaccttggaggaaactgggctcggaacaagtgaacctgagactggtggcttctagaagcagccattaccaactgtaccttcccttcttgctcagccaataaatatatcctctttcactcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaacgacgaaaaagaacacagaacaaaacacagaaaaagaaaacaaaagaggagcaagcagagcggcgcgcccgacagcgaccggcgaccaatccagtcgacggaggagcggggcgcacgaacaccaagccgagtacgatgagacgacgacccgaccgggagcacaacggagcagcagcggagagggcagcccaccacacccagagcggggcagcgggcaaagacggagaaacaacaacgggg

SEQ ID NO: 271989 - DNA, 631 bp, Homo sapiens
  misc_feature (609)..(609): n is a, c, g, or t
aggaactctattgccaatttcggtatatgtactagccaagcaaaataaggttcatgagccccttcaagatacctatagaggaacttgaggacagagtgtttgtgaattgcaataccagcatcacatgggtagagggaacggtgggaacactgctctcagacattacaagactggacctgggaaaacgcatcctggacccacgaggaatatataggtgtaatgggacagatatatacaaggacaaagaatctaccgtgcaagttcattatcgaatgtgccagagctgtgtggagctggatccagccaccgtggctggcatcattgtcactgatgtcattgccactctgctccttgctttgggagtcttctgctttgctggacatgagactggaaggctgtctggggctgccgacacacaagctctgttgaggaatgaccaggtctatcagcccctccgagatcgagatgatgctcagtacagccaccttggaggaaactgggctcggaacaagtgaacctgagactggtggcttctagaagcagccattaccaactgtaccttcccttcttgctcagccaataaatatatcctctttcactcaaaaaaanaaaatgggcctcctggcctaat

SEQ ID NO: 271990 - DNA, 741 bp, Homo sapiens
  misc_feature (719)..(719): n is a, c, g, or t
cccactctcctctttccggtacctgtgagtcagctaggggagggcagctctcacccaggctgatagttcggtgacctggctttatctactggatgagttccgctgggagatggaacatagcacgtttctctctggcctggtactggctacccttctctcgcaagtgagccccttcaagatacctatagaggaacttgaggacagagtgtttgtgaattgcaataccagcatcacatgggtagagggaacggtgggaacactgctctcagacattacaagactggacctgggaaaacgcatcctggacccacgaggaatatataggtgtaatgggacagatatatacaaggacaaagaatctaccgtgcaagttcattatcgaatgtgccagagctgtgtggagctggatccagccaccgtggctggcatcattgtcactgatgtcattgccactctgctccttgctttgggagtcttctgctttgctggacatgagactggaaggctgtctggggctgccgacacacaagctctgttgaggaatgaccaggtctatcagcccctccgagatcgagatgatgctcagtacagccaccttggaggaaactgggctcggaacaagtgaacctgagactggtggcttctagaagcagccattaccaactgtaccttcccttcttgctcagccaataaatatatcctctttcactcaaaaaaanaaaatgggcctcctggcctaat

SEQ ID NO: 271991 - DNA, 991 bp, Homo sapiens
cccactctcctctttccggtacctgtgagtcagctaggggagggcagctctcacccaggctgatagttcggtgacctggctttatctactggatgagttccgctgggagatggaacatagcacgtttctctctggcctggtactggctacccttctctcgcaagtgagccccttcaagatacctatagaggaacttgaggacagagtgtttgtgaattgcaataccagcatcacatgggtagagggaacggtgggaacactgctctcagacattacaagactggacctgggaaaacgcatcctggacccacgaggaatatataggtgtaatgggacagatatatacaaggacaaagaatctaccgtgcaagttcattatcgaactgccgacacacaagctctgttgaggaatgaccaggtctatcagcccctccgagatcgagatgatgctcagtacagccaccttggaggaaactgggctcggaacaagtgaacctgagactggtggcttctagaagcagccattaccaactgtaccttcccttcttgctcagccaataaatatatcctctttcactcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaacgacgaaaaagaacacagaacaaaacacagaaaaagaaaacaaaagaggagcaagcagagcggcgcgcccgacagcgaccggcgaccaatccagtcgacggaggagcggggcgcacgaacaccaagccgagtacgatgagacgacgacccgaccgggagcacaacggagcagcagcggagagggcagcccaccacacccagagcggggcagcgggcaaagacggagaaacaacaacgggg

SEQ ID NO: 271992 - DNA, 438 bp, Homo sapiens
gctgggggtggggctgccagtcctgtggattgtagtagggactcatggtgcctcttctgggtgcccgtggacaaattggcagccacttcctcctctctgaggtccataaaagccctgggctcagccagagcagggcagaggatggccagaggacaaagagggcagagaggtggtgggatgaccagctgcagagaggagtactctctgctgatagctggagacaatgggatggctggctgcagagaagagctaccttctccactgagagctgcagagacaacctgccagcagagagaagccaccctttccagggcctcctctccactgagaactgagcactggacagatgacctgcctacagagaggagctacccactgtgggcctcctctgagctgttctagcactaaataaagctcttcttcatcttgttcaccctt

SEQ ID NO: 271993 - DNA, 1738 bp, Homo sapiens
taagtcagtcagtgtttattgatcacacaggaagtaaagagccttagtgagaagtccatcaccaggtttatctttataccagactttaactgatcatgaccctatcttgctacccctggatattttccacattacttgggacaaatggaaagcaacctctgctctccatgatctgttttcacattggttatagcatctcttggatggagtagagggaggtcaggagaagaagcccacatagatatataactgtcttctctcagattacacattatagcattaaaggttttgattaaaatctaattgtaagatactgctgattacaattaccaaaatagcatcacaggagattcaattaaaattgttatggaaataatttttgaaatagtttaaaatgcaagaatattcagcgatgttaataatttagagatactaataagtgttctgctagatagactatttgaaaactataaatgtatttttggattaacaatgccaaggtattttttcatattcacattgaaaaatacaggcaaaactatcaatattttttctgcattatatgaaatttcacaggtagaactaaatctatgatatagaaaataatagcacattacacatagagaaaaccaagccacttaggtttagatagatatataacatgtaacatcttctctgttaaccaattatagatacatatacaacatgtaatgttttcttagttaaacaattggaaatgtttaggcattttactgtgtgggggcagtgagtatgcacatgatcagacttgtattctagctttacaattaaaattcacagaatcatttcctaaagattttattatcctttcataagtataaatatatatacttttacatataaatagttctgcatttagaaggtatcctacacatcaaacatccattaaacatgtactatgccaaaagttagagcttatactgttgtgggtctggagttgtaggaggatggatcatggtatggaaatgcagaagtgcctgatgcaaagatccttgcctgcaggttaaacaaagcaccacatatgtagacatagcacacatatgcaaaacaactaagaaaaagacctccttaggtctttgcgtaacacacacaaagataaatgtaaaaattatatagttgatttatatggtttatgtaacaaagagaaaaactccttaatggacttatccaaagatgaaatggactgactcaggaaacagtgggctcccagtaattcaaaggtgacatctgcatgggcaggaaagaagttaaaagcaaatcccatgtgccaataacaaccagatggcttggaagtagcagagactgccgaagagcaggagaaaataagattgctaaaagagaaagagtcagaggaagggagaatattaactcttaggataaaaagtgacataaccggccatagaaagttaccaactgttcataagtaaaggaagaaaataattattgtagtgtttgaggaaaattatgcttttgatcctttgtggaatagaaccaaagaaagcaaggttccaaggattaagtttcttactgaaggaataagtttggttaatggctacaaaagtgaaaagaaagaggaagaaggcattgaaggccacgagttacatttgttggcaaagatgagtatgcaagtcaacaagtcaaaatattttattttgtcatgttggggattaaagatgacaaaagaagcaaaaatgtattt

SEQ ID NO: 271994 - DNA, 326 bp, Homo sapiens
gcaaaaaaacataaaaataaaaaagtttaaaaaaattaaatgaaaggcttttatacagcacattcggaagagtggcattatattttatagtatttaaatgagtgtcttaatctttccttaattatccctttacacttgctgctggcctccggattcagattgcgtcttccgtataactcaaaggcttttcaagtacttcttctcagttttctttcaaagtaggtcagttcagattttatatctaacttgcaaatggaaaatctgaagcatgggaaagttaggtaatttaccaaaactttaataatcagtggcagaagttaaataca

SEQ ID NO: 271995 - DNA, 300 bp, Homo sapiens
tcccaagttttattcaagaactctgcagtgtggattgaacagaaaattggaaatcatagtcaaagggcttcccttggttcgccactcatttatttgtaacttgacttctttttttttctgcttaaaaatttcaattctcgtggtaataccagagtagaaggagagggtgactttaccgaactgacagccattggggaggcagatgcgggtgtggaggtgtgggctgaaggtagtgactgtttgattttaaaaagtgtgactgtcagttgtatctgttgcttttctcaatgattcagggat

SEQ ID NO: 271996 - DNA, 534 bp, Homo sapiens
cgtgctattacattgtacaaagacaagcgtcaagaatctgtagaccagctgtctttgattttgtcttatgagtgccagatttctcagaagctctacattcctcgaagtacagccactgctgccttaggtgctgccgcacggttagctacatccaggagcctcctacactggtaccccagtgtgaaaaggatggaagcatgagggagggagggaggagggagaaaaacagaatccagccgcttaggctttgatgaactcccaggccaaaatgaggagttattgaagcaaaatagtatcttgatcattgatacttttgtctttctgtgactatatgttagctttattatgctaacagtctactttgatgtgtaagtaagtattgatatttactgttaatcttgatttttcttgattttattctgtgtcattttgttcacctttgtttttaatgtagtttaaaggaatttgtttttttgtgtttgtttttcttgtacattatcatgactgataaatgaaaattgaaaaactaaaaaa

SEQ ID NO: 271997 - DNA, 534 bp, Homo sapiens
cgtgctattacattgtacaaagacaagcgtcaagaatctgtagaccagctgtctttgattttgtcttatgagtgccagatttctcagaagctctacattcctcgaagtacagccactgctgccttaggtgctgccgcacggttagctacatccaggagcctcctacactggtaccccagtgtgaaaaggatggaagcatgagggagggagggaggagggagaaaaacagaatccagccgcttaggctttgatgaactcccaggccaaaatgaggagttattgaagcaaaatagtatcttgatcattgatacttttgtctttctgtgactatatgttagctttattatgctaacagtctactttgatgtgtaagtaagtattgatatttactgttaatcttgatttttcttgattttattctgtgtcattttgttctctcctgccctccacgtaggcagaaggcatagtttctattgtccttgttttttaaggaaattatcatgaccaaatgatggaatttttttttttaaaaaa

SEQ ID NO: 271998 - DNA, 980 bp, Homo sapiens
actcctgtgctcaagtgatcatcctgcctcagtctctcagtagtctgggactacaggtgcgtgctactgtgcccggctgattttcgtattttttgtagagccagcatctcacttcattgctcaggctggtcccaaactcctggcctcaagcagtcctcccactgtggcctccccaagtgctggtattacaggagtgaactaccgcacccagccagttttcagtgtttcagtctcgtacagtcatgcgcagcataatgatgttctggtcaatgatggacagcatatatgatggtggtcccataagattataacagctgaaaaattcctaacacctagtgacatggtagccgtcctaatgttgtagcacaatgcattactcttgtgtttgtggtgattctggtgtaaacaaacctacttcgctactagtcgttatagaagagcaaaggcagaagacacacacatcacaattttaaaactatgaaagtacaataataaagacactgtggtactggcatacagatacacatatagatgtagcagctggttgtccaggctgggtggggtgctgcccccatgcctataatcccagctttttgggagcccgagatggaaggacggcttgagttcagaagttcaaggttacagtgataataataaagattattactggtatatgtatttatgatattgtactttttattttagagtttactcctacttattaaaaaaaagttaactgtaaaggagtctcaggcagtccttcaggaggattccagatgaaggcattgttatcagaggagatgacagttccataagtgttattgcctgtgatgaccttccagtggaacaagatgtggaggtggaagacagtgatattgatgatcctgaccctgtgtagggttaggctaatacgtctgtgtctcggtttttaacaaaaaaagttaaagaaaaaaaaaatagagaaaagagaaaatgatata

SEQ ID NO: 271999 - DNA, 405 bp, Homo sapiens
gagccttgctgggaattcagaacatcaaggtctggccttgtctggaattgtctggtgtcgagtttcccaaacttcaagcttcccgctactacctttattatttacttaacatttttccttaaattgactcatttttaaaatcaaagtacatatttttggaaagaaaatctgatactaccactgtaaattgaaaagtagctgttactcaccagaaaaggaagtggtaaaagataaacacagctaaaaccaagcaatgttaatacatgttagccgttttgctggcttggaaagactcctagaggctcaggtgtgtgtgtgtcattagcaagtgttggaagtgttaaatactgaatctttctcggaagaaatgagacaattgaaaagagaatgtttctcactattcaa

SEQ ID NO: 272000 - DNA, 1222 bp, Homo sapiens
ccagattaacactttaaaaaaagtcatacgcaatcagagtaaagggaatttgtcagtcatttactccaatatcctcatctaataattaacaaaactgaagttcaaactcgttgataactaacatatttttgtgagattgttgtataatgtctgccttcgtagtagcctgtgaatttccaaaaagtagaaaaccacgtctgtgtgaatggcttagtatcaacaatgattgatatagggtgaactctcagtgatgaatatttctggaataagagaatgttgtggaactacttctggccagacttcttaattgtaggctggtgctttttgtgttatactatgtttcttttcactcaaacctcatcttgttttgcagattcacttattaaaaatctctcctgaaagtttttgtatatcctggagtggcccacataaaactgatcgttatgagatccaggaactctcctggttgtataatgtgatcacctgcttttggaggtctaatgatgcatacccccagagacagaccaaggaaaaagtaaagctgaagcaataacttatttatttacttacttacttacttactttttcctggctaagatgatctagacatgtggatcttctatccttggcatcaaatttggtgctcctttcttgtgtctaacaattaattgcttcaaccttaatttcacagtagtaccaattttgtgttaaccttggctgtctgcagactactttcattcttgttgcttatttctactctttagtaacccggagagaagcagaaaagtttataggacttgtgttctataaatgagggaactaaggctttgtctgaattcagataccctctctgccatcatactgtttttacgttgtgcagttttgcctcccttcactgggttggggctgccttagaactatggttgagctaaggatgaggtggcctccacctgtaatcccggcactttgggaggccaaggaatgtggatagcttgaggtcaggagttcgagaccagcataggcaacatcgtgaaaccctgtctctactaaaaatacaaaaactagctgggtgtgatggtgcatgcctatagtcccacctacttgagagactgaggcaggagaagtgcttgaatctgggaggcagaggttgcaatgagccaagactgtgccactgtactccagcctgggcgacagaacaagactctgtcttaaaaaaaaaaaa

SEQ ID NO: 272001 - DNA, 1204 bp, Homo sapiens
tgagatggagtctcgcattgttgcacgatcttggctcactgcaagctccaccttcctggttcacgccattctcccgggaggcagagtttgcagtgagtcgagatgatgccactacactctagccttgagcgacggagtggaactctgtctcaaaaataataataataataataatcttactgagattatttttagtagaaagaggggtgatgtagaaagaacatatatttcagtagaaagccatattgtgcgccccatattagattcttgtcctgtttaacgtctttggggttttgttatctattgatgtctacaaactggacgggttcctgatgtttctagtttcctccagtatctggctgcaactcccaaactaacactttcaattttctcccaccgttcttattggaatcacgaagaacaaaactgccctttgcccagaaatcctgcaaactgaggctggacgacttgaaatactcatcagcgagattaccacgaagcccaggtgcgagggaccctcacgcctgttgctgcgtgggccgcccagacatcgccagagaccaaaccgcagaagatgctcggagcccaacatctacaaacctgccccgccacggcccccaggctcagaaactggtttttagtcagctccaatgattagctttttttttttttcttttgtttccatagaaatgcctcttcaaagcattatgggacaacacacccacccagtttctgtaccgtggagcttcttggggaagtttcagactaggaaacaatggggctcaggacacatcaccccaaagtatgactgtaggagaccagaatacgccacccctaaatatgactataggagaccagaatacgtcaccccaaaatatgactgtaggagaccagaatacgccaccccaaaatatgactgtaggagaccagaatacgccaccccaaaatatgactgtaggagaccagaatacgccacccctaaatatgactgtaggagactagaatacgtcaccccaaaatatgactgtaggagaccagaatacgtcaccccaaaatatgactgtaggagaccagaatacgtcaccccaaaatatgccatgttgacatgttgattactttgagctaaaagcaactgagaaccagccaacagaaaaaaagctcttcagctccctaaaataaagtaaaaaactctcttttctaaaga

SEQ ID NO: 272002 - DNA, 583 bp, Homo sapiens
tgacgaaaccaccttcattcaccagtcaactcccctgctatagctggttcagcctgcagcagccccacagtcctgtatcttcctgcagctgaggatgacgcagacgcctccgccatctggccccttcccccagtttcatctccgtgtgggactcccattcgtggacatatcattaaaatgggttttctcctgttgatctgtctgatgtcacttttcctcccctgcagcttggtgacatgaaaggacctccgtggctggccttactccctgtggatgccacagctgcaggatcctggggccccaacagaagccggtgaaggaagagttcctgctccagcaggtgcctggtctccaccttcaggggctgctccaggagagtggcaatttggggcagcaggaggaaacatgggtgtgaactagttctttttttttttgagacagggtctcactctgtcacccaggctagagtgcagtggcaccatcatagttcatcgcagcctcaactcctgggcttcaagggatcctgccacctcagcctcccgagtagctgggagacaggtgggcaccaccacacccagctaat

SEQ ID NO: 272003 - DNA, 1046 bp, Homo sapiens
cactacagggaacggcccaggaacccatccacccgtccccagctctcatcactctgacctctggctttttgtttcctggggcatttcacagcaaattccacctatgagaccgtctcatccgtaatacaccagtacatgcttccagcagcttggtgacatgaaaggacctccgtggctggccttactccctgtggatgccacagctgcaggatcctggggccccaacagaagccggtgaaggaagagttcctgctccagcagaacaaaactgccctttgcccagaaatcctgcaaactgaggctggacgacttgaaatactcatcagcgagattaccacgaagcccaggtgcgagggaccctcacgcctgttgctgcgtgggccgcccagacatcgccagagaccaaaccgcagaagatgctcggagcccaacatctacaaacctgccccgccacggcccccaggctcagaaactggtttttagtcagctccaatgattagctttttttttttttcttttgtttccatagaaatgcctcttcaaagcattatgggacaacacacccacccagtttctgtaccgtggagcttcttggggaagtttcagactaggaaacaatggggctcaggacacatcaccccaaagtatgactgtaggagaccagaatacgccacccctaaatatgactataggagaccagaatacgtcaccccaaaatatgactgtaggagaccagaatacgccaccccaaaatatgactgtaggagaccagaatacgccaccccaaaatatgactgtaggagaccagaatacgccacccctaaatatgactgtaggagactagaatacgtcaccccaaaatatgactgtaggagaccagaatacgtcaccccaaaatatgactgtaggagaccagaatacgtcaccccaaaatatgccatgttgacatgttgattactttgagctaaaagcaactgagaaccagccaacagaaaaaaagctcttcagctccctaaaataaagtaaaaaactctcttttctaaaga

SEQ ID NO: 272004 - DNA, 422 bp, Homo sapiens
aaggtattatttgtattcataattttcagatgaggtaatttaggtgcagagaagtttaagcacttgttcacattcacacaagagcaagtgttagagtaaggatttaagcttaaccaggatagttctggggggtactaggttgaccactacaccaatgcctgttaaccttgatttgctgaccatcatgataattatgaagtcaaaacaaggaataaacttagtaatttagtcaaatagactttaatgaggaagcaggtttaaaacaaatggtcagtaaacactttttgggcacgtaatatacaccaagcaatatgcctcctagcagaatggcattgaatggcaaagctaggtcctcaggaagagtggctgtccaggaatggaccaggtggaattaatcatattaaatcctatatttaaaatta

SEQ ID NO: 272005 - DNA, 318 bp, Homo sapiens
ccagggactgagggacgcgcccggggagggccagcaacaagccgcggcccgggcgcgacagcggcggtccgcgccgagccgttccagccgccggcctactgtagccgctgcgccaggacatttttttttaaagctctccaagctgcccccctcctccccgactcctcccgctgcaaaagaaaaacaaaaaaaaaaaaggaaggaggctagaaaggaaacccagatttgccaccacaacgaaaaaaagaaggggaaaaggaaaaggagagaaagtcgagcgactgtggggttagacggaggcagacagagcgtgggccg

SEQ ID NO: 272006 - DNA, 850 bp, Homo sapiens
caaattttattatttaagggcatctaaagagtccagtaactatgagaaatttacattaaaactgatatgagcatttgatttttaaagtttaaaacctaaaaccttgtttctaaactttatctgacaaatttcgtaccccatgttttgaaaacgtctggacttcaccaagagtgggccaagaacaattacattttggatataattcacagaaatattaacttccaagagtatctggggtatttttttatactaaaggagaagataatatagctactcttattgaatgtgcagcttatgagcttttggactttttaaaaaaaatgtgtggaaaaatgtcagtatctaccatgccaaagaaagtattggtcttatttttactacatgctttatatttttatgtttcattagctcagtcccacatgagaccagtgcctgccctgatttctggaatgctgccccaattcttttctcctaggccttgttgccagggttgcagctgcacaactaattcttattaaaatgtaagtctttgaaatgcaggtctacggaaagggatataaaggatttcattatcttttctcaaaactcacaatgaggattaaactcccacccttcccaagccataccactacttgtgcccttctctaccaagtcacacaccaaatataatgaagacagcagctcacccttaaatatccaaataaaaacagccatgaaggagagagctgcacagtaatgaaccttcaggtctggcaaaagttattaaaaaatgacttctaatactcataatgtagtcacaggctacagctggatattcatacagtgatgtgattttagaaataatacttct

SEQ ID NO: 272007 - DNA, 519 bp, Homo sapiens
cagaatatttgctgaatcagatttagaggtttgactatccggtagtgccagtcctgcccatccccatccttttctcatcactcctctttttaataaatttgttttctttccccatataaattttaggatcaatgataacatctagttagaaaacctgttgccatttttatggcatcaagttaaatttctaaattaaattagggcagtgttgacatctttaagatgttggtgattccgccccaaaacatgaatgtatttttccatttgctcacgttttgttttgtcgttgtgtaaaattttctttataaaggccttgcaggtttcttgttaagttgtagtaattttttgttgttgtatctcttggattttccagatatagaactctttcaaatagtagtaattttacttatacctttccaattatcatgtttctgatttcttctctaattctgtagggtggaaattataatacaatattaaagaatatttgtgtgcataataaacataagtaatataaaa

SEQ ID NO: 272008 - DNA, 397 bp, Homo sapiens
tctctgagctgctagagtagccaggcacccgccgaccgccacctacatcttcagatgagaccctgaggagggcaggcaggtcttcaggtgccactctcgggcagggctggaatctcccaactttgcatacgttggttggcaggggcagcaggcagcaggtggggaactgagacacctgagagaggctctgggaggtgtcggcaggttccctggaggggtgtgagaccctgacatggggagtccaggtccccagccacatgacacattcacacacacattcacagatcccacactcatcaatcctataccacacacattcacagatcacactcataaaccctacatgcacacaccttcacagatcacactcaaaccctacatgcacacacattcacaa

SEQ ID NO: 272009 - DNA, 260 bp, Homo sapiens
cacagccatccctggaacataacaaatgaggctgtggaacactgagcgaaagacgaatttggctcagagtgcagatctgccattgctctcaatgctggctgcaaggaagcggaacccaaggctccatgtcctttttttgatgaaattggtgtatgtaaagacaagcaaatacgaaagaagaatttgaaggacagacaaactgcaacatcaacatagattacaacatcaaaataaacattatctttgtagtagttttaaaa

SEQ ID NO: 272010 - DNA, 409 bp, Homo sapiens
gagtggcgggtcaggctggatgtgtgagtgcagtgccagcccctcgcagggagtggcgggtcaggctgggtgtgtgagtgcagtgccagcccatcgcagggggcagcaggtcaggctgggtgtgtgagcacagtgccagcccatcacagggagcggcaggtcaggctgaggttcagggaggccccaggaggagcaagtgccccagatcctgaaggatgggaaggtgggcagagagagttgacattcactgagtcccccatgcacaagaaggatcgcactaatgcaactaacatttgtatgcagcaactcacaaagcacttttctgatactttattacctctgcttgattttattaaattcacccagtgacctgacaaggtagaattcttattagctctattcttaggtg

SEQ ID NO: 272011 - DNA, 495 bp, Homo sapiens
ggaaagccatccatcctccttaggtttctttaatatttctcccgctcagaaacagacactacggggctatctccccggcagatgctgcccttctcaaaaagcagtttatttcctgggcctccagactttcccctggaccaacaggaccgggatttagagtaccagtcacccagaggcagcaattgtcaggataagccaggagccaacataggttgtgacacagaggactagacaggccctttgcatattttaaaatgggtccctcagtgtgggaagtacacacctcttagttagctggaacttaatcccttaaactgtcttaatatagaattcatctcgtgcattaatcttacatcatgttaaattgcacttatttctctcataaataaatatagaacaattagatgtgttataataatgtcatgtatcttattttccctcataaaatatataggtatgaaataaattcaatatattaaagtagtaatacacaaa

SEQ ID NO: 272012 - DNA, 613 bp, Homo sapiens
tgctttggaagctttgttcttttgctcttcacaataaatcttgctgctgctcactctttgggtctgtgccacctttaagagctgtgacattcactgcaaaggtccacagcttcatttttgaagtcagcaagatcacgaacccaccagaaggaacaaactccgaacacatcctgggggcttgttggggatttcaccacatggaggaaaactagtgtttctgctactgcttcagtgagcgcaactaatctgatcagcatggtccagggacagttgagagttcttgggcaagaggggaatctgctgctgcatcgagcttctaatgaagacaacaggcaccagtgaagtcagcgtttgcttggcgatgagtagaggcacagtttgttttcagattaataccaggcactctgcggggcagcctggagccacctcctttgtcttcccatgttatgcacaggtactttggacactatacaatctgtgcagttgacataaggtatggaccccaaccgacttccttaagattaaaaacgctgacaacttcttaaatacttacattgactacagaaaaatattttgaagaagaataaataccagttttaacttgcctttttta

SEQ ID NO: 272013 - DNA, 1275 bp, Homo sapiens
tgctttggaagctttgttcttttgctcttcacaataaatcttgctgctgctcactctttgggtctgtgccacctttaagagctgtgacattcactgcaaaggtccacagcttcatttttgaagtcagcaagatcacgaacccaccagaaggaacaaactccgaacacatcctgggggcttgttggggatttcaccacatggaggaaaactagtgtttctgctactgcttcagtgagcgcaactaatctgatcagcatggtccagggacagttgagagttcttgggcaagaggggaatctgctgctgcatcgggcagcccatccagtatgctcgctccacctgcgaggccggcgtgggtgagctccacatccaggatgccctgccggaggaccatggcacctacacctgcctggctgagaatgccttggggcaggtgtcctgtagcgcccgggtcaccgtccgtgaacctcagaggatccagaacggcagctggtccttgctgggctgttcctgtccatgtgcctggtcacggtgctggggaacctgatcatcatcctggacgtcagccctgactcccacctccccacccccatgtacttcttcctctccaacctgtccttgcctgacatcggtttcacctccaccacggtccccaagatgattgtggacatccaatctcacagcagagtcatcttctatgcaggccgcctgactcagatgtctctctttgccatttttggaggcatggaagagagacacgctcctgagtgtgatggcctatgaccggtttgtagccatctgtcaccctctatgtcattcagccagcatgaacccgtgtttctgtggctttctagttttgttgtcttttttttttctcagtcttttagacacccagctgcacaacttgattgccttacaaatgacctgcttcaaggatgtggaaattcttaatttcttctgtgacccttctcaactcccccatcttgcatgttgtgacaccttcaccaataacataatcatgtatttccctgctgccatatttggttttcttcagatctcggggacccttttctcttactataaaattgtttcctccattctgagggtttcatcatcaggtgggaactataaagccttctccacctgtgggtctcacctgtcagttgtttgctgattttatggaacaggcgttggagggtacctcagttcagatgtgtcatcttccccgagaaagggtgcagtggcctcagtgatgtacacggtggtcacccccat

SEQ ID NO: 272014 - DNA, 444 bp, Homo sapiens
cccaaagtgctggaattacaggcgtgagccaccacgtttggcctaaaggcacatatttttacatctcagatacctggggttaaaatgtgacctatgaccacaagacgggccagaataaaatagaggaacatggaagaaaatgccaggggaaagccaggcatatctgtaggcccagcttccactctccccagaacaccctaagctgggagactcatcttggacacccccggccgtcccaccttcccctttgtgggaaatgttctctcccatccttcagccggcaacttaggctcagtactgcaagcctcggctcacccatcccattccagaagcctcccgacctttagacgaggccagaccccctggctgtgctcatggtacccttctgggcttcccctttctctgtgctactgtgaccacttgttttaaaattctgtctcaaaa

SEQ ID NO: 272015 - DNA, 451 bp, Homo sapiens
aggagcgctcacattttccatgccaggtgccaggcatctctctcctctcccaccccaggggcagccaggtttaggtcacctggcatggaggcagacagttgatagcccggtccctaaatttggggcctttgaagccctggtgttgcctttcagttcccctccaagggtgaaatgggaactggctcaccggcaacttttatgcctaagcaagaagcctgctgaggaattcctggtctccagaagctcaccctcaggcccaggattctctggtccaacagcctccactgttggtcggtcaaacaaacgccctgggattcccaggaacatcctgctgccttcatcgtccgcatactaaatcatcaatccaacgaggcagccactcgccacacagggccatttaaggttacattaaattgatatttatagtatataatataaatttctattaata

SEQ ID NO: 272016 - DNA, 1211 bp, Homo sapiens
atcctggtttaaagacataaagtttgatgacagtgacacagaacagatagctgaagaaggtgacgataatttggctagtgagtttaactttctaacattttagttttgatgggtcattgctgtgtatgtatgataaaatgattatcttgtttgttgaaataattcagctttataatttatggctccaactaaatggaaacatctgatagcagtctttgtcttagatacagtattttcttaaaccaacttgttaggttgacatttctagattttaccatagtctatagtttgtagcagcttaaaaataactgaactaataatatggcagcagacaactttctcatctcttcactataatatcagactttctctctgcagaacctccaatatatttcttcattttaaaaattgattttatatttaacttgttcaaattttattaagtctacacagaagtacatgaaaatactgtatccattttggtattgcacattgggcttgtatattaaaaaaacatttttctcctttcctccaataccctgataaaacccatttttactcccctcctctccctatatttctttccccttcccaacactaaaagattctgccagtcctagcaagcgcacatcagtcagcagtttccagtccacagtggacagtgactcagccgcttctatcagcctgaacgtggagctggacaacgtgaacttccatatcaagaagccctccaagtacccacatgtgccccctcaccctgctgaccaaaaaggtaggaggtagtcaccatctggaatccaaacacaggctggacagctgggccataggatctcatgccagcctgtccttctggcttcctctgtcccacgtggctgagggtatttggtgtgggttttgttctaccctttctcatttctcccacacctcctccccatacctttttggttgattccttttatttcttgttttctccctcagcaccaccatgcccagtgtaaagcttgtagtctttaaaaggaactacatctgactgctcttcccataatgtgcaacttccaaggtggcatttctttgcatttataacatggatgttctgctctattcttttctctttcttcatttaacattttaaagcctatttgcctttgccgttacccagtaacataatatttcactaaacccattaagatgcttgaactagattgggggaa

SEQ ID NO: 272017 - DNA, 208 bp, Homo sapiens
tgaatggtctctcttgtctgtgcaattagtatgtaagagcacgtgaactggtgcctgggacctctacctgttttagtatgatagcaccacagtaaagggcctggactttgtatgagcttgggaaaatcatgtcacctctgcaagtcttggtttccctgggtgttaaatgtcaatttaagtaaaatgctatctactttgttttggagac

SEQ ID NO: 272018 - DNA, 353 bp, Homo sapiens
agaaggagccttcacatatgaatgcctgtaacaggttttattacaagaaattcctgcatgtcttacatgtacccttgtaacagaccttatcatgggaaatttctccaaccagataagctacttgcacaaggacacttgccttgcagtggctgtctccaccactgaactgatgtcagcttctgcaacaagcccctctagccaatggtcttgtttagcttatgtggacttgttttttgtctttaaaagtttcccgttttcccctaaccctcttggatgtacctatagtctgcttatggcaggtttatcctggacttcagtcctctgctattcctgaataaactctttgctttgga

SEQ ID NO: 272019 - DNA, 434 bp, Homo sapiens
ccacagcacctggccaaaattagttttattataagagatgcaactcaggaccagccaaatgaagagacagtgaagaagtaatgctgatggatcacacctggtgggggaaggcggacagctggggccaggagcaggagggacacctgcagggctggaagggcaggggaggtgggcctccatggtttgtgtttattgcataaccatttttattgtctacagtgagcaaagttatcctataaacaagtgtcagggaccattgcactaaagaaaacaaatgagagcattttggaagctctaatttcctgatcagtaatgggtagactaattcccagttatatttacctgttgtaaggtgaaaggttcttcagaggacctctgtcttggtgttatatgggcttttgaatgtactgaaattaaattccctaaaaatctgt

SEQ ID NO: 272020 - DNA, 246 bp, Homo sapiens
gaaaatccatggaaacagaaagcaggtgagtggtctcctggggatgaaagtaaagggaatgggcacaaccgcttaatgggtacagggttttatttggcagtgattaaaaggtcttgggattagatagatgtgattgtacaactgaattgttctgttttaaatgatttatgttatgtgaatttcacctccattgagaaaaaactttattctacaagcaatgggacatagtaaaaaggtttaaaagca

SEQ ID NO: 272021 - DNA, 323 bp, Homo sapiens
gcgctggatacttaggactcccacaggcgtccccctcagattggattggttctccgagactccacccgataccccaactccgctagttcaggcgcctgggaggcaagaccagcgtccatgcggaaccctgctcagtgcgtggcatgaggggtcggctgtgggctgctgcctcctcgtgtcttgttggtccagacccaactagggttgggggcttacttcccgagctgtacctgagcggaatggggctgaggctgataactggattgctctctggctacttttccccataaaccttgcaacaagtagtcccgccagtaaaaaaa

SEQ ID NO: 272022 - DNA, 378 bp, Homo sapiens
cccagatgtaggtggctaaagtgagcagggaaagctaagtacagccctccagtgaaacacagaaagtacaagagtcttgaaacaaactccagatcaccctgtggctctgggaatcaaacttcagaggtcatcaggctggcgcttctgttatggtttatgtcctggccagttatcccatgagaccacatctcttgttccatacaggcacggaccaaaggcctgggttctgcttgactccactgctcactggatgaccaagacatgttccacatctacaaactagaggtaatactggcttgctttaaagttgtaaggggagcaacttccttatggcatatatttatgatttaatactatggtctttgctataacattgtg

SEQ ID NO: 272023 - DNA, 842 bp, Homo sapiens
catagcaaaaccctgtctctgcaaaaaatacaaaaattagctgggcgtggtggtgcctgcctgtagtcccagctactcaggaggctgaggtgggaggctagcttgagcctggaggcagaggttgcagtcagccgagattgcgccaccacactccagtgtgggtgacagagtgagaccctgtctcaaaaacaaaactgtcagtgaggcctaaagaccctgataagaacctgaattcttgttcttgcctttttcactgactgcccagtgaagcttctgccagcgtcccctgcctcttttcctactgtcttcccccttgctgagtgtactctcaccatactgaccctcttcaagttccggaaatgtgtgttcttcactacccaaggtcccttccttgagcatactattctcacagctggaagcccgcaggcccaaccttagttaatgcctcttcaatcctgagctcagtgtgtgtgtctcctctttaatgacttcctaatcaccccgccccacattagaagatatcaattgtataattatttaatttgtatattatatttccccttctggaaaatagctacatgaataaaaatactctgttttattcacatttgtgtcaccaacatctagcactgtgagttgcacatagtaggtcctcaataaatattttttcaaatgaagttaagaaagagaatttaaaatagaatttctaaaaaacctcattttaggcaaagcttggtggctcatgcatgtaatgccagcactttgggaggccaaggcaggcaggtcacttgagtccaggagttcgagaccagcctgggtgacatggtgaaacccatctctac

SEQ ID NO: 272024 - DNA, 557 bp, Homo sapiens
catagcaaaaccctgtctctgcaaaaaatacaaaaattagctgggcgtggtggtgcctgcctgtagtcccagctactcaggaggctgaggtgggaggctagcttgagcctggaggcagaggttgcagtcagccgagattgcgccaccacactccagtgtgggtgacagagtgagaccctgtctcaaaaacaaaactgtcagtgaggcctaaagaccctgataagaacctgaattcttgttcttgcctttttcactgactgcccagtgaagcttctgccagcgtcccctgcctcttttcctactgtcttcccccttgctgagtgtactctcaccatactgaccctcttcaagttccggaaatgtgtgttcttcactacccaaggtcccttccttgagcatactattctcacagctggaaggagagctgataggggctggagcagcaggcccagttgaagcttctggagagtcagagtcggtctccagaggacaggcgtgccgctagtgtaacccggacaccccagtgatagctggccccccagtgtatcacgcacctc

SEQ ID NO: 272025 - DNA, 916 bp, Homo sapiens
aggcagaggaccctgcggccttccgcagtgtttgtgtccctgattacttgagattagggattggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaggaatttttcttagtgcagaacaaaatgaaaagtctcccatgtctacttctttctacacagacacggcaaccatccgatttctcaatcttttccccacctttcctgcctttctattccacaaagccgccattgtcatcctggcccattctcaatgagctgttgggcacacctcccagacggggtggtggccgggcagaggggctcctcacttcccagtaggggcggccgggcagaggcgcccctcacctcccggacggggcggctggccgggcgggggggctgaccccccccccaccggtcaggttagtctcgaactcctgacctcatgatctgctcacctaggcctcccaaagtgctgggattataggcatgagccactgcgccaggccaattttttttatatcactcttacacctgcaactttgctgaatttgtttacttgttctgacggttttgtggattccttagaatttcctacatacaagatcatgtcatatgcaaatacatatggttttatttcttcctttctaatttgtgtggcttttatttctttttcttgctaatttcctggctagaaatttaagtataatgttgaatagaggtggcaagagtgaatatccttgtcttcttcctgatcttaggagaaaaacttatagtctttcatcattaagtattacctgtggggctggatgcg

SEQ ID NO: 272026 - DNA, 365 bp, Homo sapiens
tccttgagggcagaaactgtcccctagtcttctatattttatttcacacaatgtacagaagactaaatgaataattgttagctggtttttttttttaaaggggataagatcagttacaatgtctttttcctcagtcaatcacataagtatctaaaatgacattccaaagtaaggacaggagtttaaatcctgaactatggtatctaaagtaaacttgaactttccttatttttaaaaaattttggccgggcgcggtggctcacgcctgtaatcccagcacttcagagggccgagatggaaggaaggattgcttgagcccaggagtttgagaccagcctgggcaacataacaaggccccgtcacta

SEQ ID NO: 272027 - DNA, 553 bp, Homo sapiens
tccttgagggcagaaactgtcccctagtcttctatattttatttcacacaatgtacagaagactaaatgaataattgttagctggtttttttttttaaaggggataagatcagttacaatgtctttttcctcagtcaatcacataagtatctaaaatgacattccaaagtaaggacaggagtttaaatcctgaactatggtatctaaagtaaacttgaactttccttatttttaaaaaattttggccgggcgcggtggctcacgcctgtaatcccagcactttgctgaatttgtttacttgttctgacggttttgtggattccttagaatttcctacatacaagatcatgtcatatgcaaatacatatggttttatttcttcctttctaatttgtgtggcttttatttctttttcttgctaatttcctggctagaaatttaagtataatgttgaatagaggtggcaagagtgaatatccttgtcttcttcctgatcttaggagaaaaacttatagtctttcatcattaagtattacctgtggggctggatgcg

SEQ ID NO: 272028 - DNA, 920 bp, Homo sapiens
cacagaacatggcatttctcaacctcctgcagaggggcagggatgctggaccagttccagtcaatgaaatgtggatggaagtgatcgtaaattgaaaacactatgaggacactgaggcacaggaagtcaagaaacctgcacaaagccatgcaacaaccagccagtatctgagtcatgaccaaagcccagagcccagtctgccttcttgtctgaggtcctttcgacagcctgcattgcttatcttctaggacaatctggccctagggaaggaggccacctggacagcaccatggcgacacagagggcaccagatatgggaaagtttctctctgagaccatgtttgcttctgtttctcaagccaagttaattctctcctagaacaacgccagttagaaatgggggaagctactgaaatacctttggtggcttgtcttgcatcgatattattttctcccactgaggagttagagggtttctggttatgtgctatgtaaattctttggctcattcttttttttccatccttccctccatggtccatcaggaaaatcatggttaaatgagtgagtaaaagcttatgatttgcccgtccacgtcccaacttccttcttcctttagacctttttgtgtgacatgtattttctttgaccctgattttttatttatagcttctactttattgaaagcactcttgtaagctgcctctattcctttgtggattgaaacagagtgtaaggaaataaaatattatctttttttcagaaaaagaacattttggaaaatgaaagtgtattttccgtgtttgttttgttttgtgatagaaacagaagataagggaaggattatccaattctacaagctttgtgctctggggaatacaggactgatgcttgatattaaatgtatgtgctacagtgta

SEQ ID NO: 272029 - DNA, 447 bp, Homo sapiens
tgtgaaggaaatactgtgtagtgtctgttgcctgaggggaagaagatagcaaatgtcatttgtggaataaatatatataattgcatgtcatattctgagcctgcactaaaaagctgtaggtgttattggttttcactggttgattgcctcgctagacaaaacagttgagaaggaatcttcagcttcttgttctcttcattttagaaaagaaaaaaaggatgagaatacagaaagtggctttgctaagttgcagagaacagggaggtaggatttttttccggtagtttttgatgtgttcaaatgtgatcaagatttatgtagtaactaggcgtttgacttacctctatctttttaataagccttagttacacttgtgatgactggtgatcattttatttgttctaagcattgttcaaataaattattagggaattggagcaaatactg

SEQ ID NO: 272030 - DNA, 324 bp, Homo sapiens
cgctataacataaatttgtaccatctacttggtacaggaatcccaaaccgaagaacatacatgataattgatcaggaacggaaagaaaactcccggggacattttcacagttccttggtcagtgtccagaggcaaaactgtttccaaagaagatgacctcacaattaaattacaaatcacaccaatgaaggtgaatagacacaaccagaaaatagcactgcaacaattaaggatatcatggacaagtctgaaagtgattacaaacaattatttacataatgatgtcagtaaagatatttgtaagtgtatatgaagtgtataaag

SEQ ID NO: 272031 - DNA, 552 bp, Homo sapiens
acgccctcttcagagacatcttcgtcatcctgcaagaaacaagcagcgtccatggctgttgtcatcccagatgctgtcctcaaggaggggctgagtggcgatgccctcagcagccccagtgcacctgagcccgtggtgggcatccctgataacaaactagatgctgactacatcaagagatacctgggcgatttgactccgctgcaggagagctgtctcattagacttcacgggtggctccaggagacccacaagggtgaaattccaaaagatgagcatattcttcagttcctatgtgcatgggattttaatattgacaaagccagagagatcatttgtcaatctttggcgtggaggaagcagcaccaggtagactacattcttgctacctgggccgttccacaggtccttcagaattactacacgggaggctggcatcatcacgacaaagatgggtggcccctctgtatgctcaggctggggcagatggacaccaacggcttggtgagagcactcggggaggaagccctgctgagatacgttctctccata

SEQ ID NO: 272032 - DNA, 443 bp, Homo sapiens
caaaattctgcatcttaaaaccagatttgggccaggtgtggtggctcacacctataattgcagcattttgggaggcccaaggcgggtggctcacctgaggtcgggagtttgagaccagcctgaccaacatggtgaaacctcgtctccactagaagtacaaaaattagccaggcatggtggtgcacatctgtagtcccagctactcgagaggctgaggcaggaggattgcttgaacctgggaggttgcagtgagtggagatcatgccactgcactccagcctaggcaacagagtgagactccacctcaaaaaaatttttaaaaaaatgaaaaaaacaacaacaacaaaaaacagactttcatgctccttctccaggaggggtgaggaaaatgtacccatttctctgattaaaaacttattttttgatcaagaggtggttgttta

SEQ ID NO: 272033 - DNA, 285 bp, Homo sapiens
ctgctgccccaggaagaaagtagtgaacactggaggactgtcagccctgtcagtttctggaaatgtgccctgagtttaagttctggtttcagattatgaggagcaaaattactgagtaggcctcctcctagaacaggaagctcttcccgctgtgggccagtggctctgacatatcacagagcctgctctgatgaaggcagcaggaatgatttcaaaacaagcaaaaccaaagaaaactgtttgacaatggaagtaatagaggctcattttagaaaacatagacat

SEQ ID NO: 272034 - DNA, 386 bp, Homo sapiens
acggtgggggtgctgaggccttggcgccacgcctctgtggggtgagggccatcttgagccagagcctagagtgcattccagaacctgatcttatcactccaccaaggacgctagtattctgggggattgatttgctgcaaccagtgatggatttaaaacacatgaggaagccaattcattccttcaccctgggcctgcagaaccatccgagctgcactggggcagttctgtacatctccagtgaatccagccctgcacccctctgttaacgtgcttttcaaaccaaacagtggaatgcattggtcatcacagggtttgatctgatgtgaaaagtgttataaagccattccaattaaagtgcctctggccttgtgtttcctgaaagc

SEQ ID NO: 272035 - DNA, 437 bp, Homo sapiens
ccccagaccatccgcttccagcctaccgtagaggaaaggcccctcaaaacaggcatatggtccgagctgggcctaagggcctatgtgtatcctgtgaaccccccacctcccagccctgaggctcctagccacaagaacggtggggagggggcggtgccagaggcagaggcggctcagtaccagcctgtcccagctcccaccctgggcccagcagtcatccctgaattttcccggcaccgctcctcaggccgaatagtgtatgatgcccgggacatgagacggcggcttcgggaactgacccgggaggtggaggccctgtccggctgctaccccctagcctctggatccagcactgccgaggagacaagcaagaattgggtgtaccgttccctaactgggaggtgactggaaaaaaataaaaaggagagaggaggtga

SEQ ID NO: 272036 - DNA, 224 bp, Homo sapiens
ccctgagtcatagagacaaggaggggaatgcagagtgtggggttcccccccaaaccccaaatcatagagatgaggaggggaatgcagagtgcagggtcccctctaaaccccgagtcacagagacaaggaggggaatgcagagtgcagcgtcccccataaaccccgagtcacagagatgaggaggggaatgcagagtgcagggtcccccctaaaccccgagtcac

SEQ ID NO: 272037 - DNA, 364 bp, Homo sapiens
caagcactgaacaatcttgatcatttattcaggagacaaatatttgccaagcaacaaccatgtaccaaatcctgagaaataaactaaggcagcatcggtgagcaaggtagcccgtgccttcttaaaacttctactgagaaagacagcttggcgattgacatgcagttataataaatttaatagctagacgattaagtatatgatcctatgggaccacttagtggtggtacccagtgcagtttacgggaagtagggaaggcttcctgtactaaataacctctcatgggttaagttatgcagaaaaaatgatccagaaggtgttccctgctaagagaatgttatatgttgaaagacactaaggtga

SEQ ID NO: 272038 - DNA, 473 bp, Homo sapiens
tagagttgtttattgcttaaaaaacagttcaggatgtttttgcaattttccctcccccatgcccaccccaatactttacttatccccatatagaggatatatagctgagcacattaattcctcacttaacatcaaggataggttcttagaaactgtgaccttaagggaaattatgtataaagaaaccaattttaccataggtgagttgatatcaacaggagttaagttcatgtggcatacttctggtcacgaaaacatatctaacttctacataaaggcccaaaatacttctagcattaaacattgaaataaatgtgagctgtacatacacttaagaaagatttatgggccgggcacggtggcttacgcctgtaatcccagcgctttgggaggccgaggtgggcggatcatgaggtcaggagatcgagacgatcctggctaatacggtgaaaccctgtctctactaaaactac

SEQ ID NO: 272039 - DNA, 466 bp, Homo sapiens
tgagatggagtctcactctgtcgcccaggctggaatgcaatggcacaatctcggctcactgcaacctctgactcccaggttcaagccattctccctgcctcagcttcctgagtagctgggattacagtctgggtgacagagaaagatcctgtcttaaataaataaataaatagttgtatcgcatatatggaggaaagaaatgataaagaagaaaaattacaaggttactaatgatttcttttcagctaagcttttggtaatgctcatcttttaatgttctttgggcaaacacaaatcaaacaatttttacaactgttattaatatgcctaaagcagtatagcaaaacatttttcataaaaaaagagcattataaaatccttaaatatttaggatagttatacacttcaacttctctatttaaggggtggagaagatggagattgatggaacatgcctattttctga

SEQ ID NO: 272040 - DNA, 237 bp, Homo sapiens
acaggggtgaactactgcacctagccaagtggtagtttcttaaaggttgtttgcaatggggaatctgaaaccatatcaatgaactttttgtactgttatttaaaatccattagtctatcttgcacttggaatggatcatatgtgacagaattagtctagttttgatatgtagatatgctacttgtttaattagtactttaagtgtttagccatatgccttttctgttaaatgccttc

SEQ ID NO: 272041 - DNA, 531 bp, Homo sapiens
ttagataaaagaaataagttgtttttgtgtatgattttaaaaatagtttaccatatttagataggggaaaattaaagtttttctcaattgtattccaatgttttacaaaatggtaatttattccaggaaattttattcaacaaaaaatatgagttccatcagaagattattctcagacattgaactatttaaaattgctattatagatgtatttatttactaattctgctgtatacaaagttccacaaactagctagcttgaaacagcagaaatctgttttcacactggaaacagtggaaggaggctggaagtctgaaatcaaagtatctgtaggcccacactctgtcgactagcttctggttattgccagcagtccttggtgttcctaaggagtttgcagctgcataactccagtctttgcctctgttgttaaatggttgtcttccctctctgtcttcacttccctttttatgtgtctctgtgtcttctcttgtaaggacagaaattaaaattacttgtgcattgtttga

SEQ ID NO: 272042 - DNA, 103 bp, Homo sapiens
caggaggggctggagcggtggccgggagactctgcacatcggtttggaaccgtggaggaactgtacacccacagactgaactggcgtgtgtgcaaactgaaaa

SEQ ID NO: 272043 - DNA, 415 bp, Homo sapiens
ggaagtgactccttatcagaacttaactatgctggcaccctgatcttagacttccattctccagaagtgaaggagcttagattgctgattttagactttcttcttttctaatgtaagtatttagaactatacattgccctctcagtactggtttagctaccggccacaaattttggttctgggggtacatgtgcaggtttgttacatgggtaaattgcatgtggctgggatttcatatacaaattatttcatcagaaattgccacagccaccccaaccttcagcaatagcaccctgatcagtcagcagccatgaacatcaaggcaagacccttcaccagccaaaaagattaagactcactgaagcctcagatgaacattaattttttttttgcaataaagtgtttctcaattaag

SEQ ID NO: 272044 - DNA, 407 bp, Homo sapiens
gcactctctgtagttaccctgctgtaaagctctcactcccctcctcttgcacattggtcatcttgggaggtgggtatgttttcaaggtacatacccaaatggcaaaagtccaccatactttgtagaaggcgcctagcataatgcctagagggtcacaggcattcactcagcacttgttcccaacaccatctcaatgacaacaggtagatctttgctatctttggatttccatagcccttctctgtacctcacgcaagctcttaatcagatactgtgataattaattgaaagtttagtgtgtatttccaatctccctcaattagtctttctcttgtaggtaaggatttagtattttttttttctccttacctccattccaaaaagccattccctgcctgtggtaggcc

SEQ ID NO: 272045 - DNA, 137 bp, Homo sapiens
caccaggctaaagtcctaaattcccaaatcatttattgtgttctgtaaatatcacaacactggccactagtttgagattttaaaattgaagttgaaaaatagtgttttttaaaaaaattaactgaatttaaaacgta

SEQ ID NO: 272046 - DNA, 493 bp, Homo sapiens
attcttttcacttcttttgcattctgatggggagggagagagggacagacaaaaagagaggcagagcgagacgaagaggacaatttgcatttcagctttcttctcatcccaaaaatgatttagtataagacaccactcaaaacaaagcaaacacattataggacaaaagaaaacaattcaagaaacaaggctagaagaacagaacactaccactgtaccagttaaggctcctgaatataaacaacagacatatattctagtgaatctaagtcaaaaaggaatttattggctaggtactagatagttcacaacactaagacaaggttggaaaatccagcttggacaggaatcaaggaaggcaaatcacagaagaatgtttgcctccacagccttgaatgaagactggaacttatgttactgaatcaaaggttacaggctcttttagaatttgtctaccaggctttctggtttttaccggaaagccccgctattt

SEQ ID NO: 272047 - DNA, 426 bp, Homo sapiens
atgctcataaaggtccaccaacatacaagacagctcccagaattagtcctgcctgcctccgtccactctctagatctattcactaaattcagtatcatcagaggcaggagatgatagggagaacaagcaggacaagagttcttaaatacggagatgaacagagaattcaaagacgaacaaacatttgagaaaagccaacaccgtgagaggccccaaactcggtgtattactcaaagagttagtagacaaaaaatatttcaaggagacttttaatatattatctaggggattttctttaacagaaaaacttaaggatatctagtcctcagtattgccagaaatgcatgctgctgagtcattctacaccattcagagctggttaccacttttagaagcaagctagtattatagtgtgatgctgtaaaa

SEQ ID NO: 272048 - DNA, 447 bp, Homo sapiens
caaaatccacttcacaacccagatggttcatatcacaccctctttcaaggacccagagcagccactggaagagaaggagtaggaacgctctcttaaagtccacttatcctattccttcaaattaagaccaaagtccaatgtatttaggtaaaaaataatttcttttagaaaatgctaaggtttgtcttctgaaatttaataacagaaacaaaaaaagaacactagatgtaatgaagtgagaccagaaaagacaaactaaactatccttactaggttggaatggatggggtggagttcctatcaggctagcattctggggaaagctgtattttttttttttggcggtggggggaaggtgtctcactctgtcgcccaggctggaatgcagtgggccgagatcctgccactgcactccaggctgggcgacagagcaagactccgtttcca

SEQ ID NO: 272049 - DNA, 1238 bp, Homo sapiens
caaaatccacttcacaacccagatggttcatatcacaccctctttcaaggacccagagcagccactggaagagaaggagtaggaacgctctcttaaagtccacttatcctattccttcaaattaagaccaaagtccaatgtatttaggtaaaaaataatttcttttagaaaatgctaaggtttgtcttctgaaatttaataacagaaacaaaaaaagaacactagatgtaatgaagtgagaccagaaaagacaaactaaactatccttactaggttggaatggatggggtggagttcctatcaggctagcattctggggaaagctgtattttttttttttggcggtggggggaaggtgtctcactctgtcgcccaggctggaatgcagtggcgccatctccgctcactgcaagctcagcccctcgggtttatgccattctccagccccagcctcccagtagctgggactacaggcgtccgccaccacacacggctaatttttttgtatttttagtagagacggtgtttcaccgtgttctccaggatggtctcgattcctgaattcgtgatccgcccgcctctgcctcccaaagtgctgggattacaggcgtgagccactgtgcctggccggatttctttttaagagattcatcataccttgacctgtgccccatttccctcctccacctgtctgacctggcattcctatttcgggagaccagaagtggggggaagagaagggatgactgtttctttgctttcaccattcctgcatgccatgcaaaggaaggaatattgcgcttttaaatatccgttttattaagtaagtggttactctttcaaagacaaaaaaaaatgcaaattgttacaaaactggcagtatttgtaagtgcaagcactacacgctgccttgttcttttaccaattgcatttgcattttaaggtactacttgtacagccatggtggagaacagtttggaggttcctctaaacactgaaaatagaggtgccacatgatccagcaatcccactgttggatatataccccagaaataagaaatgagtatatcgaagaaattatctgcactcccatgttggttgcaccactgttgacaatagctaagatttggaagcaacctaagtgtccatcaacagattaatgtattaaagaaaatgtggtagatacacacagtggagtattattcagccctaaaaaagaatgagattcagtcatttgc

SEQ ID NO: 272050 - DNA, 637 bp, Homo sapiens
ttttaagaaatggcatgctaggctttaagaaaactggataaatgaaaatccaaacttaaataagataaatatttggacgcaaaagttctcaaggttcattatgagaaatgtagtcatttcacataaaagctttgttttgcacatttctcaataatgtaatttgtcatgtaaaagaagaaaagtctggagtgggccaggcatggtggcttacacttgtattccccagcactttggaatgttgaggcaggaggattgctggagcccaggagttcgagaccagcctccgcaacatacatggggagaccccagccctacaaaaaatagtaataataattagctgggcatggtgacatgagcctgtggttccagccactttggaggctgaggcaggaggatcatttgaacatgggagtttgaagctatggtgagccatgatcatgccactgcattccagtttagacaacagagtgagactccgtctgtgaatgagtgaatgaatgaatgaaaaagaaaaagcttagagtgattgtaccaggcattcctgaggtacattcacattttataattaaactcaaccactctttgtactaaattttttctcgctgacattgacctaagatatattcctttcccctct

SEQ ID NO: 272051 - DNA, 466 bp, Homo sapiens
gacaataagagatgaactgcactaaggtatttggtgagttcgatttctttctcaaattatgcaaatttcctccagcgtttccccctaaacaatgggaagttgcatattctcaaagctgtaagaccttcaaagataatctcagagtgattttaaggcaaaataagtagtttaatatttatatctaactgcgtctctggtgtctcagaagtctttgacatcattggaatgactttgttagtacctttcccataaatagttagctagacaggtgaaagttcaagaaaaataatgagatcctttacgcaactcaaatagactgttcatgagattccctgttcaacaaacatctgacaaattattgggtggttgtgttgacctagacacctagagtgaggcacctagagtgagcagcagagaaagcagccgggagattacattcttatgggacattaaactggtaagccaa

SEQ ID NO: 272052 - DNA, 461 bp, Homo sapiens
gactgctgagcatgcattcccccagcccaggccttggatctctgctctgccagctactggcagggaaactgagggatggcagaactgagccccaataaggggcaggcgctttgctccacgccgtacatgcacatatcacttatatcacttattgctcacaacagtcctatggaattaccgttatccctgttttatcaaagaggaaactctcagcctggcccacggtgccatgggcaggacatgagtggcagagccagggattggaacccaggctagcctgactctttaccatgcttgggaaggcccagaaagcagaggaagagcaggagcatgagagttagaggatggttcagaccccagaggagatggaccccaaggcccctagcctccctgcctgccctgccctatgcgagcccaacactgatacggaggaaagctggccaactgcatggcctaatgtg

SEQ ID NO: 272053 - DNA, 430 bp, Homo sapiens
aaacaaggttctgggatccaggcccctaaagcagccacagaggtgcagttgtcagtggcctccatggagctcccttcgagataattcacacttggaacttgtaaggaagtagcttttctctcagataatcattcctcagacactgcattaaggcttcacaaacattgtcagcatatttactgtaaattatacaaagcttcaagggaatgaagttgagtcatcttttctgccccactgtattctctggaactttctccctttttttgagactgagtctcattctgtcatccaggttggagtgcagtggtgggatctcggctcactgcaacctctgcctcctgaggcaggagaatcgcttgaactcagggggctgtttgtggtgagctgagatctgcaccactgcactccagcccaggtgacagagtgagac

SEQ ID NO: 272054 - DNA, 373 bp, Homo sapiens
tgacaaatgtatggcatataacccaattatagtattacacagactctaattttttggtagtctaaagatatctttaaacttataaaactaaacaaaaataaaaatgttcagtcactggataacttcaagcataaaggtggtcttaattgttggtaacaaaagagtaagttgaaaacacacctactatttatatgcaattttttcatatgtggcaacattccccaccaggaaaatgtccacattaaggaacaagtcactaatcagtaacagaacatagagctctgaatatcaaagtagtattctgttaagaaatgttctgtcttgatgaaacttttaaaaacagatgcacaatatttgtattatttctcaaaac

SEQ ID NO: 272055 - DNA, 487 bp, Homo sapiens
cagatgagaaattcattcataaattatctagctctacccaaactttcaatgataatgtgtttctattccagaaatgattccaatttctatgattcaactgttatttttcttcattgaatgagacatttacaatgctattgtaaattttagtttttcatgcatgtacaagtaaaaggaagtagtgtgcatcacataattaaaggctacttttaatttgattggttaggaatttgctcaatttatgtcttttgcataccatatgcaaatacgaagtaagatttcaagtttgtttgcataccacatgcaaacaaatgttattagttttcttgatcgcgtaaattggcatagagaaatattctacaagattaaaacaccgttgacaattatgtacctaaaagtttctataaatatgtttttactatgttaaatataactgtttgaatatatgtgaggcacctttgaaataaagttgtatataaaggcagta

SEQ ID NO: 272056 - DNA, 450 bp, Homo sapiens
ttatacttccaataggtattttttggtactctactatctgcatttttctatccatgtctacacatgagtagtattaaaataaccagacactgaatctgtcactgttttcaggattttgttcctatccagctgtggtctgaatttttccatttaaaaggaccataactatacttttttgaccaagtctgttgtttcatcctctgtgggatgaacacatttcttagcccttcacagcatgcattaccagaaacaatgacagactagaaacttccaaaattctttataattctaattcccaacaggcacattgaatccattctacagtaccttgcacaagtggtgatgcacggaagctataaagaactcaatgttttgaattttgctgactcacaatcagctaaaaaagaattgtatcaatgtatcaattcttgttgtcttctttcaattaag

SEQ ID NO: 272057 - DNA, 328 bp, Homo sapiens
cctcctttcttcacccacctctaccctcagtccccaccaaaagcaatagcctaagccctagagtgtagatatagactatagggcccttaggtcatctctgagatgacttctgagactttttccctatctgtaatgacatgcccaaggtcctataaccggattgtggtagaaatgggcctaggaatcaggcattctggcccctacactatttctttccattacaccattatacccttgggacacattgtaagatcctgaaactggtggctggtagcctgcctccatgttattttttgatgaggggaattcaggacagttgctgctatta

SEQ ID NO: 272058 - DNA, 416 bp, Homo sapiens
aaatttatcatgtaaaagaacacttcttgctgtagctactggacacaggttaaaatattcttaagtgtgatccatcttagcatccaaactcaaattttaattttgtggtatgaacagactatgaacagaaccaatttattgtatgaattttaatttttgtctacttaaagaagataggaaaatttaacagattatagaacttattcctaaacatgtattctttaatatatggtttagtggttattcattatcacttcttaggcaatattttgaagctgggataaatgaagtgaaggagaattaggtgaaaatggaaggctttgctatttagaaaaataggaaagaagagtatatctggaaaaatggcataagatttttttgaataagataatttggattctaaaatggaattagga

SEQ ID NO: 272059 - DNA, 1190 bp, Homo sapiens
aacggcgtggactcaggcgggttgctggatttctctgagccttggcgtgctctacactgcagggctatacatgttcccagcttgagggcgtgctggggattgacaaatatatgaaacatataagcgcaatgattttctaaaattgtgcattcccagcgtgcccattggttctctctcgctggcccaactttgtgtgctgtccataaatccctttctgtggacggtgacagtaggattgggagtgagtgggaagattgtggaaagattgcaaagaggtcattgcaggactcagacagaccttgcagtgggtttcagagtaatactcaggttctcccatggaactttcaaagctggctctaagaaagatgaagaggacaaacccactcctggacatagtgccaacctagaactgtcagctccacacaggatcacagggaagggagcttggtaagacagcccagtagggggccctgcttttcagaagaggaaactggagccatgcaaggggctggggatcaacttagaaaagagcacaggactcacagtcctgggcctgcacgtaaagctagccccctgccccacggaaatggcaagcagtgcttccctccaggggttctacatctgtgctccatctcaaaatgcataaaagcctgagtcattcagatgggagagacagtgtttctacttcctcttagttggggttcctccagaaggagaccctgagagaggacttgaggttatgtagtttatttgagtgaagatcccggaagtagggagagaaggaagctgacggggaaggcgtgcattatcaagtaagttaccgtcatgtgcacaactggagctgaatcccactggggaaccccgagagacagagctgacaccccagagttcacccagcaaggcggggagacagctggggtatttattcaccaagtctatcacttatgaaaggctgtttctggaaacaatttctgactggccctgcacacacctgagcatacttcctaagccggggatgtccctgagctgagacaggcgttcgtgacaagcagacttcgagtggaaggcaggcatcagaaccaccctgtgagctggttcagacaaagattgcaggcccttccacccccctggccccgccaagttcctgactccctaggtctggagtggggcccgggaatttgcatttcaaa

SEQ ID NO: 272060 - DNA, 1133 bp, Homo sapiens
aacggcgtggactcaggcgggttgctggatttctctgagccttggcgtgctctacactgcagggctatacatgttcccagcttgagggcgtgctggggattgacaaatatatgaaacatataagcgcaatgattttctaaaattgtgcattcccagcgtgcccattggttctctctcgctggcccaactttgtgtgctgtccataaatccctttctgtggacggtgacagtaggattgggagtgagtgggaagattgtggaaagattgcaaagaggtcattgcaggactcagacagaccttgcagtgggtttcagagtaatactcaggttctcccatggaactttcaaagctggctctaagaaagatgaagaggacaaacccactcctggacatagtgccaacctagaactgtcagctccacacaggatcacagggaagggagcttggtaagacagcccagtagggggccctgcttttcagaagaggaaactggagccatgcaaggggctggggatcaacttagaaaagagcacaggactcacagtcctgggcctgcacgtaaagctagccccctgccccacggaaatggcaagcagtgcttccctccaggggttctacatctgtgctccatctcaaaatgcataaaagcctgagtcattcagatgggagagacagtgtttctacttcctcttagttggggttcctccagaaggagaccctgagagaggacttgaggttatgtagtttatttgagtgaagatcccggaagtagggagagaaggaagctgacggggaaggcgtgcattatcaagtaagttaccgtcatgtgcacaactggagctgaatcccactggggaaccccgagagacagagctgacaccccagagttcacccagcaaggcggggagacagctggggtatttattcaccaagtctatcacttatgaaaggctgtttctggaaacaatttctgactggccctgcacacacctgagcatacttcctaagccggggatgtccctgagctgagacaggcgttcgtgacaagcagacttcgagtggaaggcaggcatcagaaccaccctgtgcccgaaaagtacctgtggtatagggatccttagagtcaccgctg

SEQ ID NO: 272061 - DNA, 445 bp, Homo sapiens
ttggtttcaaaacttgttacaaagctgcagtgattaagacaaggtggtgctgtcataataatagacataaagatcaatggaatacaactgagagtgtagaaataaacctttacctctctgccagtttatttttgacaaggatgccaaaacaatttgatggtaaaagaatttgaaaataatttttcaagtaatagggctgggcaactgcatagacacatgcaaaaggatgaatttggactcctacctcataccatatacaaaaattaactcaaaatgaatcaaagacctaaaggtaaaacttaaaactataaaactcgccaggtgcagtggctaacaccagtaatcccagcactttgggaggctgaggtgggtggatcacctgaggtcaagagttcaagaccagcttggccaacatagtgaaactctgtctctactaaaaatacaa

SEQ ID NO: 272062 - DNA, 299 bp, Homo sapiens
taattttatacctaaatttagtttaaaacaaaaccctcccctgtttggatggcaacatgttggtgaggttagcccttttattttcagacctcgggttttgtacagtttctttttctctttcagttcatgagttggaatagggaagtattttcattcaaaaaaaggctagaatttttaaagttctaaatatagaactcgtattataaaatttaagtgaagtaaaacatctcactactttccatttatattcgaacaaattttatgttatataaaaatggtttataaacctctccttgttt

SEQ ID NO: 272063 - DNA, 405 bp, Homo sapiens
attcttctgcaggcaaacggagtcgccatatgacccagccctggtcttgcttggctttctggatgttctcaaccttgacatgactccttattctccaattcatttggacctcaagacactactactctggctacagccgccaggcattaaaaagatgacacagaaaaattacagagtcagcatatatttgaatactggataaaagggaagaggatgaaatggatttttcaaagcttctaaagaaaacagaactagctgtgtagcagactcctcttataaacctctgcgaagttctacttgaaaagctgtggtttcatttcaaaggaaaccagcaatcagggggatctctacaggaaaatctcttccctatgtcttctttagactcttcaaaaaggagagagagca

SEQ ID NO: 272064 - DNA, 796 bp, Homo sapiens
ctttaaaagaataagttaaactgagcagctgctattcagacggtttgctgtgcctgtaaagggtatgctattcagccacctagccatttaaaaaaaaacaaaaaacctagaagatgcatattctgtaagcataatgcttttcttcagtgattaaacctctattaatatgtgtgttaatcctatgaagtactatatttctacacagttaaaatgtattagtggaaaaaatataaaagggattgtgaagtgcatttattgctgtagtaaattaagtcctggttagctgattatcaaaacattatctgatttacatttctataggcttatggacatatgaacaggaaattaattttggaagtaggttcagttgggtttttaagctcagcaaatgagaaaaccacatctctgctcatattaactgctctccatacaggagatcatcaagcatttgttgacttacccagtggataaaatattaaaacttcgaaaccaagaaaccaaatatgttgtttaggtatttatcatttttatacagttaactccttatagggattactgtgaaagtggttaagattttctctagttttatgtttatttgcttaagctttgagcaagggcagctgtgtggtcatgtagccgactactactcccagccctttcctctcccattgcattcagctcactcctacattctgttctgaccaggacggtagatactgagcacctcagggtttcattcccaactcagaagaaacactgagtttttaagtccagtgacctaccataagtcatatca

SEQ ID NO: 272065 - DNA, 560 bp, Homo sapiens
tactactactaaattcgcggccgcgtcgacattaatttcctgttcatatgtccataagcctatagaaatgtaaatcagataatgttttgataatcagctaaccaggaaattaattttggaagtaggttcagttgggtttttaagctcagcaaatgagaaaaccacatctctgctcatattaactgctctccatacaggagatcatcaagcatttgttgacttacccagtggataaaatattaaaacttcgaaaccaagaaaccaaatatgttgtttaggtatttatcatttttatacagttaactccttatagggattactgtgaaagtggttaagattttctctagttttatgtttatttgcttaagctttgagcaagggcagctgtgtggtcatgtagccgactactactcccagccctttcctctcccattgcattcagctcactcctacattctgttctgaccaggacggtagatactgagcacctcagggtttcattcccaactcagaagaaacactgagtttttaagtccagtgacctaccataagtcatatca

SEQ ID NO: 272066 - DNA, 472 bp, Homo sapiens
acaactcaaattcaatgtgattaattcctaaaatcatagcactaacattcagtagtcatgtccagctcttcctttatgtcaggtacctagacatagcggaacagaaaacccttcaaaagttcagtctagtctggaaaacaaacatgaagcaaagaaggcacaacaccatatggaaaagcaagacagaaatatgtacagggcagagaggctgcactgtgtcatttaatcacgaagactctgttattagactgctcgaatacacaaagctgtgttaccttggacatgttacttcacctctctgggcttcagttgtctcattctgtaaaatggtgatattactggaactcatctcatagggttgttagtgagtgaatgtttgtaaaacaggatagtgcccagcacatactagtaacaaatgtaaaatacatgaaacaaataaatatttcctgtgtcctctgaactttaaactctc

SEQ ID NO: 272067 - DNA, 622 bp, Homo sapiens
gatggtggggaaaaatgtatttctggacattaatgaattgccctaatagatttccataaacaggttttggaactgaatattgcattgattattcagatttcttttggatttttcactggcagaagagaaactaatctgatcagtaataaaaaaataaaaagaaaacaatacaatataataaaactctgacatttcataggttcagttatccttggctaaattatgaggtatgactatttgagctttacatttattaacaaaagtggtctttaattggggtgtttttatgcttttttgttcagggtttttatgaagttctgcatggctttgtattcagaagccattcttttatcaaagtttcactagcattatctgagcttaatattctgggatgtactttgtagccagtgatgaaaggaggaaagtcagcagaaattacttacatatttgttagcatttgaaacatcttagccttctaataagaactatcacggccaggcacagtggcttatgtctgtaatcccagtgccttgggaagctgaggtaggaggatggaggatggctcaaggccaggagttccaggcaagcttgggcaacgtagccagactccatctcaaaaaaa

SEQ ID NO: 272068 - DNA, 526 bp, Homo sapiens
ctccggcacgaggcctccgactccgccaggcaaggagccacactctcccacaaggaggcagcaaacaccgcacccttggctctcggagcagcaggcgctgattttggaaaatccgctccttaagttttcacttaccacctggactagagaaggtggcaatatcttatactgggcacttacaacctgccagactcatttaattcttagaaaactcctgtgagatggatgtgggtatccccatttcacgatgaagaaaccgaagtcagaggagcccagtacttgggaacccaagtggaggtgatgccaaagctgagcattttctgttctgccactttgcctctcaggaacccatgggtgcagttcccaggaggaaggggattccagcctccagctgccatccctttttcaagaaaaaagctacggttactggcattaggataaataactttggctttaagatgatcttagaattaacgtgttcactgcatacatttggaaaaataaaaataaaagtattacccagaga

SEQ ID NO: 272069 - DNA, 379 bp, Homo sapiens
gacacaggctgttgctctgtcacccaggctggagtgcagtggcgcagtcatggctcactgcagcctcagcctggatcaactgatcctcctgtccttgcctcctaagtagctgggaccataggcatgtgacatgaagcctggctaaatttatttttttagagacgaggtctcaccatgttgcccaggctggtcttgaactcctgggcccaagtgatctccagccttggcctcccaaagtcctgggattacaggcatgagccatagtgcatactattactgcacatttaagcaggataagagccaatgggagggtgagcatggtggcttatgcctgtaatcccagcaaatcaaatatttaaagcattttgttaacgtaaaa

SEQ ID NO: 272070 - DNA, 342 bp, Homo sapiens
gacacaggctgttgctctgtcacccaggctggagtgcagtggcgcagtcatggctcactgcagcctcagcctggatcaactgatcctcctgtccttgcctcctaagtagctgggaccataggcatgtgacatgaagcctggctaaatttatttttttagagacgaggcggtcggatcgtggggtcaggaggtcgagaccagcctgatcaacatggtgaaaccccatatctactaaaaatacaatacaaacattagctgagtgtggtggtgggcgcctgtaatcccagctacttgggaggctgaggcagaggttgcagtgagccgagatcatgccattgcact

SEQ ID NO: 272071 - DNA, 353 bp, Homo sapiens
tgcatgtttttactcaaaagcgggagttgaacaataagaagacacacacacagggatgggaacatcacataccgtggcctattatggcattgggggaaaggggagcaagagcattaggacaaatacctaatgtatgcggggcttaaaacctaaatgatgggttgataggtgcagcaaaccaccatagcaaatgtatacctatgtaacaaacctgcacattcatcacatgcatcccagaacttaaagaaaaataaaaataattttaaaaagaaagaaaacctagtaaatacttttcttgacatgggttttggcaaataatttatggccaagttcctaatagcaattgcaaaaaa

SEQ ID NO: 272072 - DNA, 362 bp, Homo sapiens
ctgctaccatccttttccatacagaataaaagcagaaaaatagagggttgggttctccccctttttcaatgttataattgcaatgagtgctttcagtattcaacaattcattattttaatgttttataattggctgtgctccacaaaatgatgaggcaattctcagtaaatatatacaataaaattagaaccagtaaaaatacaaaacagaacaggaagacaagatcaggagaaaaaagtcgaatacacctctgctaagagtgtctccacagcttctcttttggctttgagattttcaatacaatgagaagggagaccctattatttacaaagctcttgttatcaaaaaccagaaaagataa

SEQ ID NO: 272073 - DNA, 374 bp, Homo sapiens
tccaattctgaaatgataaatgacagtgcatttatgtataaatgacagtgtattcatctccccaaagctggtcacaagtgccctcactgctctggagtaaaacatgggctagaaacaaggaagcaaagacttaaaaacagcatcatgtttattcactggagaaaaagacaaacagttcaactgcctgcttcactttgccttcaagtttatcaagatgaggccgagaattctcataaactcctcaaggacaccaaaaggagttcctgtagactcactcagagtcctttccctcctctccctcaagcagtgcccacctcttttcaggaagcatcttctcttttccatttgactttcataaagaagctggagtttta

SEQ ID NO: 272074 - DNA, 221 bp, Homo sapiens
tttatttacgaaacactaaaataaccaaagtaaaaacaaatgtttgaccaagccgaccacgtgtttttatactaccttttcttagtgcctcaaatgtcttcctaaatcaagtgcacctgctgcaaagatggaacattctggtgcgagagcccagagcagagcacgttttcgttccccaagctgaggcaactgcgactcgcccgcgcgaccggcaaggccac

SEQ ID NO: 272075 - DNA, 420 bp, Homo sapiens
gctgatttttaaattttttgtagagatggggtctcactacattatccaggctggtctcgaactcctgagctcaagtcaccctcctgtctttgtaatcccaaaattctggggttacaggtgtgagccactattcttaattattcttaatctctgcttttgctaatcggattttgctttccatctttcagtgtacaccgaatcattgtgtcactggccttagtgtgggggtcctcttctgctatctcacatttgtctggaattccagcgggaagcgttcactggcatctctggtcttcctcatgacatctgtggggtttgcaggtgtgatgaatcattcttgcctcagagaatttgaggcctcaaactttattgttccccagtgtttctgtcccacacctggtcaacttactgaaaattaaa

SEQ ID NO: 272076 - DNA, 473 bp, Homo sapiens
aatccttttcctccaacttggagaaaaatacatccctcctctctattgtttgtcttaccacttatacacttattatcatctattcaattgataactcctgctatttttttcatctttaaccttcctccttcagtaaatcttccatcacatactaatatgctcaaatttcccttgaaaaaagcaaaacaaactctacctaattatattcctctgccttttatttttgtagactcaaacactgagatcatgcacagttctcttatacccaccgttattgacttcccagcctccagaactgtgagaaataaatgtctgttgtgaaagccacccagtctatggtactttcttatattagcccaagtggactaagacatgccttcacccagcttcccctactattaacatcttacattagtatggcgcatttgttacaattactgacccaatattgaaatgttattattaactaaact

SEQ ID NO: 272077 - DNA, 389 bp, Homo sapiens
agcacttatctgttatactactacgttttgcctacttgtttactatctccatccagaaaaacagtgatttttgtcactgctagatccctatactatcttttctttaacatactttcctgaatgcctctccctcaagtttgagaatatccatagagttatatttcttcttgatatgtaatgtgactctgcttcccctcccaacaaagctatttcttttgacttgagtttgagcataccttctgcaactgcatctcaactaggagctccagacaaccaaggtttttttttttttttccgagtgggggaggggggcacaagctaagttgtattaaccaattcccttattcataactcataaatgaacattaaaatctgatgtcatcagtatt

SEQ ID NO: 272078 - DNA, 383 bp, Homo sapiens
cccaggcagaaggctgcaacagcactccaaaaaatgcaaatggaccagtgtgctggctcaagcctgtaatcccggcactgtgggagggcgaggttggtggatggcttgagcccaggagtttgagaccagcctgggcaacatggcataaacccaatctctactaaaaatacaaaaattagcccggcgtgctgcacacctatagtcccagctactcgggaggctgaggtgggaggattgcttgaacctgggaggcagaggttgcagggagccgagatgaaaccactgcactgagtaactactagtgcgaccctgtctcaacaacgacaaaaaagcaaatgatctgtttcaaagaagcctgggcaacaagatcgaagctccgtctc

SEQ ID NO: 272079 - DNA, 473 bp, Homo sapiens
cacgtgtgaatatgcatagaaattttcatgtagcaatttctgtgtttgtgatctgtatacagattttataaaaataatagcagggacatttctgaccttgatcattgttgttaactgatgacatttgccagttacagtttaaattaagttgaatttattatttaggtgtttcataagaaggagtgagttgcatactaggatatactcttgtattccatatcctctcctcactccggcgcttcctaacaggaagagcaaatgcattgtgaggataaacactgattggttactatctgtagagcaggattagcagctctttttagattttgagctgcaatctcttttaatagtgcttaaattgatgcaggtcagtgaattttgtgtttacaggcttttaactccctagctttgtgaatactgaatttatggaaaagcttaattttctctgtatctcagaagggatatgtacaatt

SEQ ID NO: 272080 - DNA, 1416 bp, Homo sapiens
catattggtgagaaatcctagaaatgtggagaatgtaacaaagtatttaaatggttgtcacacttgattataggtaatattcatattggaaaaatttcctacaagtaagaacaatgtggcaaagtttttaactaatacaccttattgcacagaaaatcatttatatttgagaaaaattgtagaaatatagactgtgaaaaagacgtcaatatctgctcacatcttactaaacaccagagagttcatgcttaataaaagcatgataagtgcaattactgccaaaagatctttcagaaaatattatcctttaaagtgaaggagagtatttatattaaagatgaacattacaaccataaagagggttgaagtacctttacttgtatcagatcttattgtccacattttgtactacagaaaaactctgaagaggtcactcaaactttgttcaacatcagggaatttatattggagagctgtcttgcaaatgtaataaatttgggaaaacaaattttcaaaaactacagcttagaaaacaccagagtttatacgaaaatatattttcaaaggtgtagtaaaaataaaaaaaaatttaatccaaatttgtctatgtaaataccagaatttatagtagaaatatatgaggaagcgacacttcgaatattctactaaatgagagttctgagtatagaaaataaaactaaagttggtagaaaaattatttgtatataatgttaagaggagtaaaagattttttgtagaataataactatattcagattatactttgttcttgaaaaaattacagattttttgaaaagcaaatgatgtaactcaactcattattttctgctgtttcttcattcttattcacttgtgaaagcttgtgatcatttgttgctgcatcagaggtatgagagattcttcttcattagatgggcattatttatgatcttttctatggatgagtaagaatattaaaatgtaagatgcatggtgaaaatctaagtggagaggttctttgtggttaacttatactattgagtgatgcacaaggtaggtgttaagagtaatattcttttgcattatgagaaaactagtatattattcatatattttactaattgtactttttttattatactttaagttttagggtacatgtgcacaatgtgcaggttagttacatatgtatacatgtgccatgctggtgcgctgcacccactaactcgtcatctagcattaggtatatctcccaatgctatccgtcccccctccccccaattgtacttttatataataaaatgcagtacattttaaaaaattttaaattctgtgtgaaggtaactgtttcaacatttttaacatggtaaatattattgtgcattcaataaagtgttgttatgccacaaagattaa

SEQ ID NO: 272081 - DNA, 390 bp, Homo sapiens
aaatacataaaacattctgaagagaatgtatggaacaagtatctgaggactttgaaaagtaaatagcaataaatacattggggaataagaccagaatatatagtaccacctgattggcagtgaatttgcctatttctctctctggtatccaccagcttccacccaaggtcacctgaaagctgggtgtctgcaccaactcagaggggagaaatcatctagtctagggtggaggagtgcaaaaatagtctcctttcagtgcagcagtggcagctattataaaaattctccaatgaggaaggtggaagttcggaaatgaatgaaaatatagaaagtcttaggaaagaaatagaatatatgtaaaaaagaacaaaatgggagattttagggctg

SEQ ID NO: 272082 - DNA, 1383 bp, Homo sapiens
cccagctattcaagaggttgaggcagggaaattgcttgaacctgggaggcagaagttgcagtgagccaagattgtgccattgcactccagcctggatgacagagcaagactccatctcaaataataataataaggctagtatgactaaggagctaaattttaattttgttatacttcattttaatttagatagccatgtgtggctaagggctaccatattgagaagtgctgctaaagagcaagactgatttttctctctccccgctgacaggaggttatgagggagaggggattggggcctcttggggtttttagatctgacgctggtctgaaatctctacctgagggtaggagggagagtggggctctggaggagtgtgttattcacactcagagagtctgtgattggaaggtgcctgaacacccacttgcacctctccttttgttgtcgtttgcagtcttgaggatactggctaagcctctgcctacgcagtgagtcctgttccttctcctctccaggtcttccctctttaaccaacatttccctctctgctgattcttcctttctgccttcaaatgcaagtccctgctacctccaaccaggcaacttttcaaatgaatgaactgaagcaatttctcccctttgtcacacactccctctgccacagaagacttgctttcttactcatagtgcccctttcctgaccggttcaggggctggttcagagttcatcctttttaacattcttgtcactctgaccctattaatgaggtctttgttgcaacgtctctcctcctgtagcttctgtggcggccttcttggctccatagccctcctctgccttctctgcctgaggtacttgtttcatactcctgaactgtgagtgtcttctaaggcttgtttcctgactttttcctcactctacatcatcctccttgacagtacagctatgtttatgaccttagctaccacctctccacaaatgagtcctcgacctaaatctcttattctgatccttcaccagtggaaaggatagaaactagagcatagcttccataagattatgggcaaatagtccaggcacggtggctcacgcctgtaatcacagcactttgggaggccgaggtgggcagatcacgaggtcaggagatcgagaccatcctggccaacatggtgaaaccccgtctctactaaaaatacaaaaaaatcagctgggcatggtggcgggctcctgtagtcccagctactcgggaggctgaggcaggagaattgcttgaacctgggaggtggaggttgcagtgagcagagatcatgccactgcactgcagcctggtgaccgagcaagactccgtctaaaaaaaaaaaaaaaaaaaagaaaaaga

SEQ ID NO: 272083 - DNA, 338 bp, Homo sapiens
gacagtatgttgcatcccagaagaattaatgtgctgttatgctctgacctgctcagggttattctggtgcccctatcctgcccacagcttaacaccagagagacaatctattcctagggctagtggtggtgacctccatgttttgatggacattccctttcaagtgtctgtttagctcacaagtgttaagtgttgttaaggactgacttatgcacccccaaaatccctatgttgaatccctaattcccagtacctcagaatgtgactatatttggagatagggctttcaaagaggtaattaaagtaaaatgaggccaatagagtgggccctaattcga

SEQ ID NO: 272084 - DNA, 455 bp, Homo sapiens
agacagccatgctgcctgcctggtggggtacacggtcagttgggaaagacagacctgatgacaattgtgtgaagtgttgtgaatcaggctggaggcctggcgctgggggcaggtgtggctggggatagtccatgaagtttcccctgaggaagcagtacttaaattgagacccaataatgagatcataagacagcatgcttacaggtttctggaatatttgaattgtaatgttgggtgaatgttttgccacaacattttgcttgtataagactttggaaaggaaccctgagtagtgtgaatttctatatcatgggtcagccaatgaataaacactgattgagcaccttcaaagtgtgagggcactggatgatgtgtgaggtgtctgggccaactgagaatcattttgatatttcagatatccaggactgattaaatggaagagatagacaaaagac

SEQ ID NO: 272085 - DNA, 340 bp, Homo sapiens
ctcagcctcccaaagtgctgggattacaggcgtgagccactgcctctggcctctgtgtttaaccatttgcggaactgccaaactgttttccaatttggtggcaccattcattgtagattcccaccagcaatgccccagggttctcatctctccatctcctcgttagcacttgtaattgtctacctttgattatagccaccctagtgaatgtggaatggcttctcatggtggttttgatttgcatttccctggtgtttagcatcttttcacgtgcttcttggccatttgtatatcttcttttttttggagaaatgtctattaaaatcctttgcccattttt

SEQ ID NO: 272086 - DNA, 502 bp, Homo sapiens
caaatctagtcgtgtaagtgcaaggtatctaggggatggcagtcatggaaatgcacctcttagctctcccttctggaaagaacctgctggtgagctgtaagttgtacagttagtggacagcttctagtccttaatgctttcaggatgacattagcttttgaaccacagtcatgctttattctgggacagctctctaccaagacagaacacggcaagggtgctagagcctggtcattcctgcccgatgttggacaattgcaatgggcattccttgctctcaagcttcccattggattagctgaggctttgtctttattgtgatctgaggtgccccctgcccagtgctgttttcctcacccatactcccttccttaaacatttttcagatctgcatcatattctgaaggctttcccaacccaatatttctccttcttctttttatctttcacagacattatccacaacaaaccactctcctgtttgagtaaaatgagaaagtta

SEQ ID NO: 272087 - DNA, 185 bp, Homo sapiens
ggggaaccactgtccctgggttttagtgataatttattgaaacatgcccagtgagcgccaggagcagggcctggcgcagagttgatggtaagcagacgtcattcgcctcacaacccttttcctctgacccgtaaatcaacccatttttttcaagttatagacccatttgagaaactggtttttct

SEQ ID NO: 272088 - DNA, 497 bp, Homo sapiens
agctcaacttcccttttcttctgccttatttgtccagaagccagaaacgtgaagagaagacctcgccttgatttgccagatgacccctggcctttttagtcaagttcctggagaagttagggtggagacttatttgtcctgtgtttggggcaataaaaggggaggggccgcctcctccagcctgttctaaaaagccaaaaagcaaggctatttactcagacctgggctactaagtgctggggtggcccatgttgacttaaatgagcccttgcagttaggtggggctctctggagctgttagtcatgtgaggttgccagggcaacttaatgtcttatgagttggaatgcttcaagaagtacaaagaggagactgcaagagtgcattacaacttacagtcatatgttcaataacatgtcatctttcctaatggggcttttatttttattttattttgtgggattgaaagatcagaagccggaaattatctggagaggat

SEQ ID NO: 272089 - DNA, 205 bp, Homo sapiens
agctgtcctcaaggagctggagtcgcttggtggagtttcagcctctgggtgccctggcttgcccttggcgaggtggtcctggaagtgaagtgaccaggactgggaaatggcaaagatcgaagaggggaggcagagactggagaagctaaaccaagcaacagcctgagactaagtgccaagtgtgtaaatacattctggccaaaga

SEQ ID NO: 272090 - DNA, 347 bp, Homo sapiens
ggtactgtgatttacagtttacatatctgtgaaggttgaatcaactccatcttggatgctaatctgccatgttagcttctgattaacccgttttgggaaagcctctgagatttccagtttatctgttgttcgtcgtgtaagaggactgtacttcctgcaaatcctgccctcagggcaatttcctacctattctctgtgaaacatgtatgcctctcccctagagtatataatctctgggtctggaggctattggtgccgcagggatccaccatcttgtctttccaccacccaagacacaggcatggtttctgttcctaagcccctattaaatatttcttcctaagaaa

SEQ ID NO: 272091 - DNA, 484 bp, Homo sapiens
agacagcagatttgcagaggcagacccctgatccaatagcactttttactgtgatccatttgacctgtggccatgccattctggaatagaccaaaccaatgtcaaaggtggtctctatgagagctgcatgcctccaaagtaatcgatggccgatgggagagtggaagtagagaatatacatttctggtttacacaatgagaagccttgggttccccttcaagaatattatgtcagattctatcacagtgcacttttactactattttcacatgtaaaatctgcattttgtgagtgtgtattgagtaattgagtgcttctttgttcaatttgcataacaggggcatactgacattttcatgtatatcagacgtgactgtcatactcaagactggtgcaatttcagaatatggctttatggtaataccacaaatggcattgttttttcagcagtgtgcagagttttgcaaatactccattagcagc

SEQ ID NO: 272092 - DNA, 479 bp, Homo sapiens
cctttcaactctgcctggctgtaaccaggatctctttccacaactagttttaccatgtctacttcagcctcattaaggagttaacactgaccagttgcttcctagaagcaagttttatggcaaagcatcccaaggtgggtcaccgaatttcaagctggcattagagaatcacagggctggtgcacggagagctggctctccagcaaggacgtctggcctggccgggaatgattcattgagcaaaaggacatgccagagaaaatgaggaggatgttccaacccaggagtgagccgacgggtatgcagaggctggagctgtctcctgcacatgggatcatgtccctgtgttccagctctacatggggtgcccaccagctgccccacagggcccttatcacaaacatcacaagcctatttcacaagctcttttctccttgaaatgttgagatcaatatatctccactgttatttaaaaaaaa

SEQ ID NO: 272093 - DNA, 378 bp, Homo sapiens
tttttttttacaagtggtagagattggaagtcttagataccacaccaatatcctgaacaacaccatggctatattgcattgtacaaaagaaagctgataatctacatcttaatgacatagccaatatgactttacaatacttttttttttgagacagagtctcactctgttgcccaggccggagtgccgtggcgtgatctcgggtcactgcaacctccgcctcccgagttcacgccattctcctgcctcagcctcccgagtagctgggactacagacgcccgccaccacgcccggccaattttttttttattttttagtagagacagggtttcaccgtgttagccagaatggtgtcgatctcctgaccttgtgatctg

SEQ ID NO: 272094 - DNA, 387 bp, Homo sapiens
actcaccaaccatctgctgccttcaggagactcacctaacacataaggactcacataaacatcaagtaaaggagtggaaaaaggcagtttgtgcaaatggacaccaagcaggggtagctatttttatattagacaaaaacaaactttaaagcaaaagcagttaaaagagacaaaggacattatataatgataaaaggccttgtccaacgagaaatatcacaatcctaaacatttatgcacctaacactggagctcccaaatttataaaacaattactaatagacctaagaaatgagatagacagcaacacaataatagtggaggacttcaatactacactgacagcactagacaggtcatcaagacagaaagtcaacaaagaaaaaa

SEQ ID NO: 272095 - DNA, 360 bp, Homo sapiens
gtcagatccacgaacacagagtgcagttgggaaggatgtgggcagtaatgaaggtggtgctttttgctcctgtgggtgctatggacaggtgagggttcaaggatattaacaacaaattttaagccataccttacactacattggagcttaatcaaattctctgttcacagtatgcctaaattggccaatggaacggaaaaaaaaaaaaaaagcaacccacccccaagagttatttatgtcatgtagacaaaacctgggttcgttgactgattatttccactctctagtgatggtcgttgcattttcactctgagttgaattgctgcatttttccataaatatatctgctcctctggaaga

SEQ ID NO: 272096 - DNA, 377 bp, Homo sapiens
gtcatcggggatactgttgttctgtaaagacatcatgtagtttactcttaagagtcagtttgagtcatgctataaagttttattaaatttgttcattaaaagtttttttccagctgggcgtggtggctcatgcctgtaatcccagcactttgggaggctgaggcgggcggatcacctgaggtcgggagttcaagacaaccagcctgaccaacatggagaaaccctgtctctactaaaaatacaaaattagctgggtgtggtggcgcatgcctgtaaccccagctactcgggaggctgaggcaggagaatcatttgaacccagaggcagaggttgcaggagaatcacttgaacccagaggcagaggttgcagtgagct

SEQ ID NO: 272097 - DNA, 869 bp, Homo sapiens
cttttcccctcaaatgctaaggatactgcctacactggtactccacttttcatttcaccaagatttaaatctcttaacatttccgcaacttcattagtatctccatgctcaaaatattcctgtatgattggtgttaaagtcttctcaagtgccctttcatccaaaggcaaaactacagtttcataaacacagttctcctttgaggggaaaagaccctgcagggtcttttcccctcaaagtctgtatttcttccaagttgcttttttgttttgcttaattcccaccacccacctttgatgctggatgctttcctcaaataactggtaatccttgggtatttgcttatgattaagactgggggtctagagctaggtgcactggctcaggcctgtaattccagcactttgggagctaccaaatataaaggattatccacaactaacagtattacaggtaatcactgtcgagttctaaatttccttttctattagaacataactttccccacacaccgaatctgtactcaggtgtgcatttatccctagattcagtctgaggagttgaaaagtgacaaagggatggatggcttcctgactactatgaaaatgtcccctgacccacatatttcaatatagtattaagccttgttttcattacctgaaatgtatgtttgcttacaaacaggtttccttgaatctattctccccacctcctccaatcaaggagcaaagagaacaccagagaagctggagcacagtgaacaaggggaaactggcatgagccaccgtgcccggcccatcctgcttatttctgtgagtcacggcttggaatgtgttaagaaaaaggatctatgtctctctaaaggggac

SEQ ID NO: 272098 - DNA, 230 bp, Homo sapiens
catgcttgcaatcccatctctttgggtggccaagggaggaagactgcctgaggccagcagttcaagaccagtgtaggcaacatagcaagaccccatctcaaacaaaacaaaacaaaacagaacaaaattagccaggtgtcgtggctggcacctgtgttccaacaacttgagagactgaggtggcaggaggattgcttgagcctaggagttaggggctgcagtgagctgtg

SEQ ID NO: 272099 - DNA, 746 bp, Homo sapiens
ggatgggagctggcatttatgctcaagtgatgggaatatgttaaaagattttaaggaggggagtaacagttgggattaatgtgtattctgggaatctcaacaaagtaaattcatagttcgaattttcataagacttctgcacaggcagagagaaataagatcgcatctacagctgtgtggtgattttctttaaaaatactactaagtttttaaatgtgatttcaaatggtgtgtttctgtttcacattggacataagtagattgcaaggctaatggaaagtagaaaagttaactcatgaacataaaagagacatcgatttgaaaacaaaacatttattcatttacttctgctgcagttttcttgactgctgaatttcgtaagaagggattggtcagggagggtcttggggctgaagacctggagaggagctggtgctatcgctgttcaaatctgaaggtggtggagatggagccttggggaggagccggtgctgccttttaagtctatgagagtcgttgagctggaggtccagggaagagctggtgctgccactgatgtcttaggttgtggagctgaagacagtgaaggagctggtttggctgttctgtgagggtcgtggagctggagatccaggtgggagaggtgttctagtttgagggtcatgcagatggagatctgtgaggagctgatgttattttaattggtgggtcgtagagctggagaccagggaggaactggtgtggtt

SEQ ID NO: 272100 - DNA, 418 bp, Homo sapiens
accattgaaatttcctggataataggagcttcttctgttccaatggggtgactcttggtgggctcctggatgggggctggtcactagcgagaccacaccatgatgagaaacctggagcttcagccctacccccacctctgagcaggggagacgggctagctagaggcgcggttcctaatgcgccatatgcctacatgaagacgtctccgtaaaagtccctcagcagtgggggtttggagagctcccaggttggtgaacacatctctttgtggggggcgtggagcaccccagctccccagggctggcagctcctgtgctgagaacgcttctggacttcgccttacgcacccttcatctgactcctcatccctatcctttatcgtatcttttataataaacatgtttctcgccaggcgcg

SEQ ID NO: 272101 - DNA, 349 bp, Homo sapiens
gctgtttttatcagtcataagagttgtatgaaagggagcagagatcaggagcacctaacctagtggaggggatcaggaaggcgtcctgaaggaagtgacatttaagctaagggctgatcggcaagcagacgttagcagttataagtgattgccaaaataactaataaaagcagtcatgaaatcactgtcagaaatatttgttgaaggcattaattcattcacattcatatacatatatggcctactgtttgccaggaagcatcagagcagtgaatgaaacaactccctgcttacaaagagatgccagagactggatatgaacaaacctaagcctaatcttttttaaaaa

SEQ ID NO: 272102 - DNA, 477 bp, Homo sapiens
actcaaatgagttaaaaacatgtccacacaaaaccctgcacatacccttcactgcttccatgttgtagcaaccaatgaataaaattgctagaaacaatgtccttcaataggtgaatggataaaccatcgtgcatcaagacagtggaatattatccagtactaaaaaacgcaatatggaagccatgaagacatggaagaaacttaaatgcatattgctaagtaaacaaagccaatctgaaaaggctacacatgctgtatgagtccaactatgtgacatgctggaaaagacaactatggagacaggaagatgatcagtggttgccaggagttagaggggagggaaggatgactaggtggagaacagaggatttttagggcaatgaaactgtatattacagtgatggattcatggcataatacatttgtctaaacccatagaatgtacaacaccaagagtaaacgctaatacaaactgtg

SEQ ID NO: 272103 - DNA, 523 bp, Homo sapiens
gcccaaaaagtataaatgaatgaaagtaatccttatcctcactcttagaaacaatataattcaaagtgtgtttcctaccttccaggtattgttataataatttatgtatatagaggctaacatagtaatgttttcaatgggtgggagcattacaaagctttttgtttgaattttgcctacagagcagtgggtgtacagcacttagccaagtaatgaaaaacatcattttaaactgcacagaggccaacaggttacaaagcattatctcatttaatcttcacagtgaccttacagcacagcaggtattgtcattctacattcacagatggagagactgaagcccaggaggtgaagcaatacagcatgactcacactaaatgccagtgccaggacttgagcctcaaggttacgccaccccacagcatttgtcctccaaaaggccaggctatcttctcacaatggctgtcagtgtgttcattttcaaaacctaaactagctaagtcttaacagatgaaaacaaaaa

SEQ ID NO: 272104 - DNA, 630 bp, Homo sapiens
tgctttgacaattatctgcagcatgtagtgaaccttgtttcatcttcatcctattcactaatcccctccaatccctctgccccttgcattattttgaagcaaatttaagacattatattgtttcatctgtaaatactaatgtctagggataaatttttaaagttgcataatatatgccacagggctaactggtgatggaattatttaagcaaaagtgactcttatataagtttccagagccagcaaaacataattacctcaaatataccatggccaaagtactaattgtatgaaaagatgtcactaagtcaataccctaaaacttaaagggagagacactcttttatacatttgtacatttatatataattctacccatctcgattatggcttctcagctccagtaatgaaaaggcactgtaagaaatgaggccgctggacttaattatgttcaaacaccagcaccagcaccatctgactctgcctcatacccttgggggggtccagcattgctagtgcataatgtcacagttggtcataatgatgaccctggcgcatcaagaaaagggtatactttgtttaggaaaacattttaaggggacaaagaagtatatgacatttagattccca

SEQ ID NO: 272105 - DNA, 904 bp, Homo sapiens
tcacgtgataccccccagtgtacctttcctgcagcgtgttacgtggcgcacagagaacgtcgcttccagaggaccgttttttcgtaactggaagtagtaatctggcggttgacactctcgttgcctgtataggctgatggcccactcacctttttagctgggctcctgacctgtccggccagaaagttgccactgggaaacctggacccctactgaatggatctgctggcacctagacctcagagaagggggaactgaagactgaagtctgaccactgttctttgttgaaaatttctttctcaggggcttggagggatcacatctacaatcctgagctaatattctcttctgctgtccccaaaatttaaacgaagcttctcttaacccattgcaaatgagaaaaatctttgaatctacctatgactataagcccttatttcaagatatcctgcctttttaggccagaaccaaagtgtaacctccatctattgatttacaattttgcctgtaactttggctttcctgaaatttaccccagccttaaaaaaaaaaaagaacagaaaaagaaaactgcaaggcatcagggaggtcagaattggggcatgagctgcctgatcctccttgcttggcatctttgcaaatagatgccttcagctgtgcatgatggctcacacctctcatcccagcactttgggaggccaaggcgggaggatggctccatcccaggagttcgagatcaggggcaaaatgccgaaaccctgtctctacaaaaaattaacaaattagctgggcatgatggtgccacttctgtagtcccagctacttgggaggctgaggcagggggaatgcttgagcccaagaggttgaggctacatgagccatcatcgtgccactgcactccag

SEQ ID NO: 272106 - DNA, 844 bp, Homo sapiens
cggccgcttgggcctcagttcctctttcctgcccaagtatctccccagctctgacgaaacaggcaacttccagactgtggcgttagctcagcgactgcactgagccgccgggaagatcctggtcccgtcagccagctgacccacatgcgttgcggaggcgctgaccaccccgcttcgctggctggtggggggtcacgtgaggacctcggggtcacgtgaggtcctcgggcgccgcagggagggcggcatccaagtctttccgcgcgtgcgcgagcgtccgctgtcactcaggtagaacagtctcaaatcgcaccgttagtaccggccccctttgcctttctaccttgcccctccgagtcccgacccaagatcccaagtaatcgtcttccccctgcaccagggccgggaccaggcagccaagaaacgcggagacagactactgggactgcgacgtctcctctcctgttcgctgcgatatgccggcgtcgtgttgagcgggctgcggacacagacagcctgcccggccccactgagtgtttgatccccatcctcgcagctctctagaggaccagagttggcggtgcagcccagcggagcttcgaagcgacatgtcctccaacattttagcccagcaagtcttgtggcccctgaggatataacccagagagggctgctttctgggatttctcggctgtggttcaagtggagtacacacagttgagaccctgtctgccctgggcagctttcttgacccttgggggaccagctcacaataaatcctaggcttctgttgctccttgctgcctatccataagcaataaacctgcttcagctcattcactca

SEQ ID NO: 272107 - DNA, 1308 bp, Homo sapiens
cggccgcttgggcctcagttcctctttcctgcccaagtatctccccagctctgacgaaacaggcaacttccagactgtggcgttagctcagcgactgcactgagccgccgggaagatcctggtcccgtcagccagctgacccacatgcgttgcggaggcgctgaccaccccgcttcgctggctggtggggggtcacgtgaggacctcggggtcacgtgaggtcctcgggcgccgcagggagggcggcatccaagtctttccgcgcgtgcgcgagcgtccgctgtcactcaggtagaacagtctcaaatcgcaccgttagtaccggccccctttgcctttctaccttgcccctccgagtcccgacccaagatcccaagtaatcgtcttccccctgcaccagggccgggaccaggcagccaagaaacgcggagacagactactgggactgcgacgtctcctctcctgttcgctgcgatatgccggcgtcgtgttgagcgggctgcggacacagacagcctgcccggccccactgagtgtttgatccccatcctcgcagctctctagaggaccagagttggcggtgcagcccagcggagcttcgaaacctggacccctactgaatggatctgctggcacctagacctcagagaagggggaactgaagactgaagtctgaccactgttctttgttgaaaatttctttctcaggggcttggagggatcacatctacaatcctgagctaatattctcttctgctgtccccaaaatttaaacgaagcttctcttaacccattgcaaatgagaaaaatctttgaatctacctatgactataagcccttatttcaagatatcctgcctttttaggccagaaccaaagtgtaacctccatctattgatttacaattttgcctgtaactttggctttcctgaaatttaccccagccttaaaaaaaaaaaagaacagaaaaagaaaactgcaaggcatcagggaggtcagaattggggcatgagctgcctgatcctccttgcttggcatctttgcaaatagatgccttcagctgtgcatgatggctcacacctctcatcccagcactttgggaggccaaggcgggaggatggctccatcccaggagttcgagatcaggggcaaaatgccgaaaccctgtctctacaaaaaattaacaaattagctgggcatgatggtgccacttctgtagtcccagctacttgggaggctgaggcagggggaatgcttgagcccaagaggttgaggctacatgagccatcatcgtgccactgcactccag

SEQ ID NO: 272108 - DNA, 895 bp, Homo sapiens
ctctgacgtcacggctcggtgggactcccggagcccggatgcgcgctgggactcggtgcagtccagctccacggtcgcgcgtcccacagctcccttcacgtccgttcctccgtttccccaccttgggagggccaggacttccgaggctttagggggcaggaagctgcgagaaggtggcgcttgcttagaaacctggacccctactgaatggatctgctggcacctagacctcagagaagggggaactgaagactgaagtctgaccactgttctttgttgaaaatttctttctcaggggcttggagggatcacatctacaatcctgagctaatattctcttctgctgtccccaaaatttaaacgaagcttctcttaacccattgcaaatgagaaaaatctttgaatctacctatgactataagcccttatttcaagatatcctgcctttttaggccagaaccaaagtgtaacctccatctattgatttacaattttgcctgtaactttggctttcctgaaatttaccccagccttaaaaaaaaaaaagaacagaaaaagaaaactgcaaggcatcagggaggtcagaattggggcatgagctgcctgatcctccttgcttggcatctttgcaaatagatgccttcagctgtgcatgatggctcacacctctcatcccagcactttgggaggccaaggcgggaggatggctccatcccaggagttcgagatcaggggcaaaatgccgaaaccctgtctctacaaaaaattaacaaattagctgggcatgatggtgccacttctgtagtcccagctacttgggaggctgaggcagggggaatgcttgagcccaagaggttgaggctacatgagccatcatcgtgccactgcactccag

SEQ ID NO: 272109 - DNA, 507 bp, Homo sapiens
cagctttgcccaaaaggcagcaaaagctgaaaaatgtaatcgcatgtgcattagggtctcctggaacggctaacattaaaagattgacagtagcaagtgctgacaaggatggggagcaactggaactctcatccactgcaggtgggcatgcaaaatgggacagccactttagaaaacagctggtggtttcttataaactaaaataacacatttaccatgtgacctagcaacccaatgcctagatattcacataagaaaaaagaaaacatgttcacacaaagacttacacaagaatgttcagagcagctttattcccaatagccaaaaactggaaactttgatgtccatcaactgatgaatggataaactgtaatatatccacagaatgaaatactacttagccatgagaaagaatgaattgatacatgagcaacatgggttatgcagagtgaaagaagccagacacaacaaagtatagtatataataaaatgataattttattataa

SEQ ID NO: 272110 - DNA, 831 bp, Homo sapiens
aaaatgttagagggctggtcaaatagatattttagttcagtaaattggggtatggagaggtaatataattagatttgtgtttttagatacttttgaagtattataaatatataaacataccaaatgtcaaaatgttttaaatcagctggtcacggtggctcgtggctataatcccagcactttgggaggacaggacaaagtgagcatattgcttgagtccaagagtttgtgaccagcctgggcaacatagtgagaccttgtctacaaaaaaataataataattaaccgagtgtggtggcacaggcctgtagtcccagctactcaggctgaggtgggcagagttgcttgagcccaggaggtcgtggctgcaatgagacttgatcttgccaccctacactctaacttggggaacagtgagaccctgtctcaaaaaaaaaaaaaaaatatcgaggaagaagttcaagaaaaaaaagaatttttctgagaaattcaagaaaacatttgctgtaaatatttaacagagaatattatgtacattacatacattatgtatgtacatatggtttagctcagttgaatagtttccagccattaaccatgacagtaataatctagaataggctgggtgcagtggttcacgcctgttatctcaacactttgggaggctggggaaggcgggaaggatcacttgagtccaggagtttaagaacagcgtagtcaacataaaccccatctctacaaaaagtttaaaaaaatagccaggtgcagtggtgcatgcttgtagtctcagctactcaggaagctgaggtgggaagatcacttgaacctggg

SEQ ID NO: 272111 - DNA, 399 bp, Homo sapiens
ggagggtgcttcctgggcttatgtctcagatacaacagcagcagcagcagacaggctcccacatcccatgtgattgtggggaggtgatcatggtgagggcgcccgccaggacgtgagcatgcctttgctggatgcagttgtctctcttggtgcttgagcaacttagcctttgcattctggccttctggaggtcatcttccctcttgcagtggtagcaagtgttcacgtttaaaactgcacactacttttgacagtaggagtccactgcagtgaacataagagaattcacacacgtttcctgtaagcatttaataaccaccacttttttgtatgcaaccctcttcaagagatacggagatgaaaaggaaatgggccttgtcatctggcagatggtagaga

SEQ ID NO: 272112 - DNA, 554 bp, Homo sapiens
atctttctagttaccaggtgaatttaggataaactgtgccaaatggtgctgtcaaattttcctacttgagggctactaatattaatcttgacaacacatatgttttataactcaaaccagactgtgatgtttaaacactacatgttttgcttctgatgcacatcacattctggtttgagttataaaacaattttatctctcttctacctttgtggggaggcattctaggttgggaggcaatgttgttttaattatatttcccaagcactgttcagaattacaagatcaaatataaacataaaaggtaccgatcaggtttcatactagaagggactttggcagatacccatcaaattttctttcaggctttcttcccccaagccacaattgttcagtgaagatcttgcctgccctcaaaatgtgaatgcagtatgatcttgctgcctattttgggctctgcagtttcatctggggcatagttagaaaagatttgtaataaaataacctcataaagtggcaatcatccgttccagccctgtctttcaatgtacctg

SEQ ID NO: 272113 - DNA, 584 bp, Homo sapiens
cacatttccccctttttttctttaacatcttttggagaaagcattttaaaaggaatatgtgttcctggcctcagttcgctttttcctccttttttgagctggtttcttgtcgctaggatggtttattccaggaaattcaggtctcacgttactaggaaggctcattcctaggaagtcatgttccatgttgctaggaaggctcattcctagaagtcatgtcccacaaagattaaaaaataaattgggggaggaaagagggaaaaaggaaggaaaggagatgattctgagggctccagacttaaaggagaaaagggtcctatctcttttctcttaatgttaaatgttattttgtttgtggaatgttcactctataatatatatgttgattaagtataccattatgcatgatttgcaatattgattgacctgtggagtgccttgagcctgtgtgtccaagactctgagtgctgagtgagtgggaagtactaaggagaattgctttcttggaaactccatgtagttcgtggcttttgtgattgaaatagcatcagtaaaagtctggcattgtggaaaaacaaaaaaaa

SEQ ID NO: 272114 - DNA, 413 bp, Homo sapiens
ttaaaaaaaaaaaaaaaaagcctttagggaggtgcaaatggaaggccacatacaattggtatgtttgtattcataccaatacacacacaatagaataggtaaaataaaacattccagtcctgcgtggtggctcacgcctgtaatcccagcacttcaggaggctgaggcgggtggatcacaaggtcaggagttcgagaccagcctggccaagatgatgaaaccccgtcactactaaaaatacaaaaattagccaggcgcagtggcaggcacctgtaatcccagctactcaggaggctgaagcaggagaatcacttgaaccccggaggcagagggtgcagcaagccaagatcgtgccactgcactctagcctggtcaacagagcaagactacatctcaaaacaaaacaatacaaa

SEQ ID NO: 272115 - DNA, 362 bp, Homo sapiens
ttggcagcctctgctgggcacagggtggtggccacatctgctgcctaaaagggctgccccggagcatccctgggggtgctgtatctgcacctccagcactgcaggcccctcacagtgtcccagccctgttgccgggtggctgctcccctgcccttggggctagggcatccaggtcctttgggggctctgctggcggtgcccagacctgtgggagctgagcccctcctgatccagcctccctgctgggtgccctcccctgggcctgcagggcgggagcccccggggctgcttctcctggggcctgggccgttacagggtgaacacgaagcgagggcgcactaaacacgctccgtaactacctg

SEQ ID NO: 272116 - DNA, 252 bp, Homo sapiens
tttttttgtagtgacatgctttgatttctttcccatttccttttggttatattctatagatatcttacttgaagttaccaatgagatcacataacatgtcttaaagttataacaatctagtttaacaacttcagttgcatacaaaaacctctacttctttactactccactgcaatttatattatcaatgtcttaaaagttagatctttatatactgtatacccataacttgttttgttttttgagacagag

SEQ ID NO: 272117 - DNA, 336 bp, Homo sapiens
caacatctctcatttcaaggttgccatctctaaattgaaccgtgtttgtatttacaccggtgaaaatgagtatactgtcattaaaatagaactctttaagaataattgtggtctcttgtggatcaaggaataaactgcttacagcaaaagagtagcaaggtcttcctggcaagatgatgcctttctggtgttcttcctaccaacagagtaacctcctgatctctagaaggaatcctgaagcatgtgccagagacgcagttcctaaagtctttttttctctatggttagagtgactggccaacatccccacaaatctattaaagcaggtttttgtgt

SEQ ID NO: 272118 - DNA, 437 bp, Homo sapiens
atataactgattcatttcaatgcacaatcccattatctttgaaagctaaacaggcagtttaaaccacattattgtttttaaattaaagtgttgctcaattaaaaactaaagtggaaataaacaatttcccatactagaaattattcctccaggctgggtgctgtggcccatgcctataatcccagcactctgggaggccgaggcaggcggatcacctgaggttgggagttcaagaccagcctgaccaacatggagaaaccctgtctctactaaaaatacaaaattagccgggcgtggtggtgcatgcctgtaatcccagctactcaggaggctgaggaaagagaattgcttgcacccgggagatggaggttgccgtgagccgagatcacaccactgcaatccagcctgggcagcaagagtgaaactccgtctcaaga

SEQ ID NO: 272119 - DNA, 472 bp, Homo sapiens
tcctcaaacctcccttctaaattctgggatcccttgtgttctcacttcaatccaggagcattccattcttccagatgcaggatacccatgctccctcctctacctgcagaactccaattctataggaacaaattcccttatatcttcttcctttccaaggcattccactgttcagctggaagcctgtttcgctttttttgaaactcctcacctaagcagactactctgattctttactaagaatacagatgctattagctacaaggtcttttcaagtcttgtcagagagcttctctatatctttaccaatgcttgacttccttcctccattggtgaaggtcatgcctcctgtcactcattcatgtcatacccggagggcacctgccccgagctgggttttctaggcactggtggtacagaagtaaacaagctagacaaggtcctgctaacagcttatgttctagtgggtggg

SEQ ID NO: 272120 - DNA, 436 bp, Homo sapiens
ataggattagcttactgcttatatttaactgatatgaaattggcaagcaaagacaattatgcactccacacaagagtgagtgatgtaaataacatttggaattctgcacacccttccaccatccttggtcccagagggagacgcggtcatcatcagtctcccaggattcccagcattgagagctgctctggtgtctgagtgtggcttccagcattaagaaaaataggtatccttgggccgggtgcggtggctcacacctgtaatctcagctctttgggaggccaaggtgggtggattgcttgaggtcaggggttcgagaccagcctggccaacatggtgaaaccccgtctctactaaaaatacaaaaattagccaggcacgctggctcacgcctgtaatctcagcactttgggagactgaggcggccagatcatga

SEQ ID NO: 272121 - DNA, 448 bp, Homo sapiens
caaaaatttaaatttaaatctaaaatcaaccaagactatttattaattcagtaatttctaaattaccaaacgtaatttagaaatttccaatgtaagtgtgctgttgaggtcagttttgttctgtgttttctgtttgtaaaggcatgtaagtatgccataaaatctatttttggtcttaaagttatgtagtattaaatttcgagagttcatatgtgaataatgattgtgggtgtgtgtttacagatatatgtctaagtggatatcatgtgaatgaaagattgtagatacaatgactataaatttattatatctttatatttaaaattgactttaggccaggtgtggtggcttatgcctgtaatcactttgggtggtgaagcgggaggatcgcttgagcccaggagtttgagactagcttgggcaacatagggagaccctatctctaccc

SEQ ID NO: 272122 - DNA, 736 bp, Homo sapiens
  misc_feature (2)..(2): n is a, c, g, or t
cncacctaataccactggttatattgtacaagtttctttattgcaggacttctgagtacctttagtttcctaccactgtaaatcctcaggaagagatacagtatctagcatttcccaacgtattgactgtgaaaacttttttcatacaccatctgaggagccacaacattccgtagaaaactgctttaaggcaccacatcagctctcagaactcatcttcttgctcattgtaatggccatcctggtttatcagacccagcttgcctctaagttgaagcaaatatggtgttttctatgacccttgctattttcacttgggataaaaatgtgaagaagatacattgtgaaactatcggaattcaaatttctatgacttgagtcacaactcttgccctattagcattgatgcctttagaaaaaaagaaagaaagaaagaaagaaaaggattcccagatgagcactaggagaaacagcagcttctgcagttgagttgggccacataggattgagggtgaaggtttcttcagtgaatgtgaacacctgtctctcttctgttttgatgtaggtattaacaatcttttctgcctccaactactatgaagttggcagcaacagaggggcctatgtcaaactggggccagccctgaccccacatatcgtgcagtatcaagctaacaaggtgacccacacactcaccatgaggcaaaggcaagacttttcaatgagtgattttcag

SEQ ID NO: 272123 - DNA, 2164 bp, Homo sapiens
gaattccggatttgaagggggcctgatctgactgacgtcagggggtgcctactccttcgaggcaagaagcctgaactttccttcctgtcactgtgaatacttggccagggctgtgaatgtcaccattgcttttcaggaagaagacatggcagactagggctgcaccttctttatggctctgtaggtctgaagaatcagatcagcctgggatcctcagccaactctgaagacaggatgggatcacgcctgcatgttaaagagatttctgccttgttgtgtctcatgtaaataaaaaacccagcaaagaagcaaacagctcactgtcctctggatctgctgcgtcctgcaggagcattgcgcttaaactatgggaagcggcacctccacccaacatcattttgctttccagaatgcagagagagccttcaaggcagcagccctgatccagagatggtaccggcgctacgtggcccgcctggagatgaggcggcgttgcacctggagcatcttccagtctatagaatatgctgggcagcaagaccaagtcaagctccatgacttcttcagctatctcatggatcacttcatccccagcagccacaacgacagggacttcctgacccgcatattcactgaggacagattcgcccaggactccgagatgaagaaatgcagtgactatgaatccatagaggtacccgacagttacacggggccaagcctctccttcccactcctgcctgaccatgcaactgccctggtagaagcattcagactgaaacaacagctccatgctcgctacgtcttgaaccttttgtatgaaaccaagaaacatctggtacagctgccaaacatcaaccgggtctcaacctgttacagcgaggagatcacagtgtgtggagacttacatggccaattggatgacttaatctttatattttataagaatggcctcccatcgccagaacggtcatatgtgttcaacggtgactttgtggatcgaggcaaggattcagtagagatcctgatgattctttttgccttcatgctggtttaccccaaagagttccatcttaacagaggaaaccatgaggaccatatggtgaacttacgatatggcttcaccaaggaagtgatgaataaatacaaggtacacgggaaggaaatactaagaaccctgcaagatgttttctgttggcttccactggccactctgatagatgagaaagttctaattcttcatggtggggtgtcagacataactgatctggagcttttggacaaaatagagaggagcaagatagtttccaccatgaggtgcaaaacgagacagaagagtgagaagcagatggaggagaagagaagagccaaccagaagagctctgcacagggacccatcccatggtttctccccgaaagccgctctcttccctcttcgccccttcggcttggctcctacaaggcccagaaaaccagcaggtcctccagcatcccctgcagcggttccctggacgggcgggagctctcccggcaggtgcggagctccgtggaactggagctagagcggtgccggcagcaagcaggcctcctggtgaccggagagaaagaggagccctcccgctcagcctcagaagcagactctgaagccggagagctgcggaagcccactcaggaggagtggaggcaggttgtagatatcctgtggagtgatcccatggctcaagagggctgcaaggccaacactattcgaggaggaggctgttattttgggcctgatgtgacacaacagttgctacaaaaatacaacctgcaattcctgatccgttcacatgaatgcaaacctgaaggctatgaattctgtcacaaccgcaaggtattaacaatcttttctgcctccaactactatgaagttggcagcaacagaggggcctatgtcaaactggggccagccctgaccccacatatcgtgcagtatcaagctaacaaggtgacccacacactcaccatgaggcaaaggattagcagagtggaggagtcggctctgagagctctgagggagaagctgtttgctcattcttcagatcttctcagtgaatttaagaagcatgatgcagataaagtcggcctagcttccagccaactctgctactatcaacaaaaatag

SEQ ID NO: 272124 - DNA, 3421 bp, Homo sapiens
gaattccggatttgaagggggcctgatctgactgacgtcagggggtgcctactccttcgaggcaagaagcctgaactttccttcctgtcactgtgaatacttggccagggctgtgaatgtcaccattgcttttcaggaagaagacatggcagactagggctgcaccttctttatggctctgtaggtctgaagaatcagatcagcctgggatcctcagccaactctgaagacaggatgggatcacgcctgcatgttaaagagatttctgccttgttgtgtctcatgtaaataaaaaacccagcaaagaagcaaacagctcactgtcctctggatctgctgcgtcctgcaggagcattgcgcttaaactatgggaagcggcacctccacccaacatcattttgctttccagaatgcagagagagccttcaaggcagcagccctgatccagagatggtaccggcgctacgtggcccgcctggagatgaggcggcgttgcacctggagcatcttccagtctatagaatatgctgggcagcaagaccaagtcaagctccatgacttcttcagctatctcatggatcacttcatccccagcagccacaacgacagggacttcctgacccgcatattcactgaggacagattcgcccaggactccgagatgaagaaatgcagtgactatgaatccatagaggtacccgacagttacacggggccaagcctctccttcccactcctgcctgaccatgcaactgccctggtagaagcattcagactgaaacaacagctccatgctcgctacgtcttgaaccttttgtatgaaaccaagaaacatctggtacagctgccaaacatcaaccgggtctcaacctgttacagcgaggagatcacagtgtgtggagacttacatggccaattggatgacttaatctttatattttataagaatggcctcccatcgccagaacggtcatatgtgttcaacggtgactttgtggatcgaggcaaggattcagtagagatcctgatgattctttttgccttcatgctggtttaccccaaagagttccatcttaacagaggaaaccatgaggaccatatggtgaacttacgatatggcttcaccaaggaagtgatgaataaatacaaggtacacgggaaggaaatactaagaaccctgcaagatgttttctgttggcttccactggccactctgatagatgagaaagttctaattcttcatggtggggtgtcagacataactgatctggagcttttggacaaaatagagaggagcaagatagtttccaccatgaggtgcaaaacgagacagaagagtgagaagcagatggaggagaagagaagagccaaccagaagagctctgcacagggacccatcccatggtttctccccgaaagccgctctcttccctcttcgccccttcggcttggctcctacaaggcccagaaaaccagcaggtcctccagcatcccctgcagcggttccctggacgggcgggagctctcccggcaggtgcggagctccgtggaactggagctagagcggtgccggcagcaagcaggcctcctggtgaccggagagaaagaggagccctcccgctcagcctcagaagcagactctgaagccggagagctgcggaagcccactcaggaggagtggaggcaggttgtagatatcctgtggagtgatcccatggctcaagagggctgcaaggccaacactattcgaggaggaggctgttattttgggcctgatgtgacacaacagttgctacaaaaatacaacctgcaattcctgatccgttcacatgaatgcaaacctgaaggctatgaattctgtcacaaccgcaaggtattaacaatcttttctgcctccaactactatgaagttggcagcaacagaggggcctatgtcaaactggggccagccctgaccccacatatcgtgcagtatcaagctaacaaggtgacccacacactcaccatgaggcaaaggattagcagagtggaggagtcggctctgagagctctgagggagaagctgtttgctcattcttcagatcttctcagtgaatttaagaagcatgatgcagataaagtcggtttaatcaccttgagtgactgggcagcagcggtggagtctgtgttgcacctaggactgccatggcggatgctgaggccacagctggtgaacagctcagcagacaacatgctggagtacaagtcttggctgaagaacttggccaaggaacaactgagtcgcgagaacatacaatcaagtttgctggaaacattgtatcgaaaccgatccaacctagagaccatttttaggatcatagacagtgatcattcagggttcatctcactggacgagttcaggcagacctggaagctgttcagctctcacatgaatatcgacattacagatgactgcatctgtgaccttgctcggagcattgatttcaacaaagatggccacattgatatcaatgagttcctggaggccttccgccttgtggagaaatcctgcccagagggcgatgcctcagaatgcccacaagctacaaatgctaaagacagtggctgcagcagtccaggtgcacactaagaacagcctggtcttcatcacccaaagtgcctcataggcaatgctcagcttctcactagactatctcccttattctccatgtgaaactttatgctgaaaatttacctatccatatgcatcagaatcacctgtgtatttcagtgtggaggggtgggttggggtgttgtgtatgtatgtgttttaagtatatgagtgccccaaccccacctcacaatcttcacaaagtagaacttaggtatagtgttttcaaattctaaagtccacttcagttaagaaccactgacaatgtaactctctcattgttttcattttatacgtttttttgagatggagtttctctcttgttgcccaggctggagtgcattggcgcgatctcggctcaccgcaaagtccgcctcccaggcgattctcctgcctcagcctcctgagtagctgggattacaggcatgcaccaccacaccaggataattttgtatttttagtagacacagggtttctccatgttggtcaggctggtcttgaactcccaacctcaggtgatccaccctcctcagcctcccaaagtgctgggattacaggcatgagccaccgcacccagcctattttatactttttatttattgtctttaacaatgtctattggtaaagcaaagttatttttaaaaattgtattgtaattccatgacccaagcatatggattttcttcattatttactttttcttacttgttactgtagtgtttatataattttatgttctacttttaaaaaaataaattaatatctaattgt

SEQ ID NO: 272125 - DNA, 2853 bp, Homo sapiens
gaattccggatttgaagggggcctgatctgactgacgtcagggggtgcctactccttcgaggcaagaagcctgaactttccttcctgtcactgtgaatacttggccagggctgtgaatgtcaccattgcttttcaggaagaagacatggcagactagggctgcaccttctttatggctctgtaggtctgaagaatcagatcagcctgggatcctcagccaactctgaagacaggatgggatcacgcctgcatgttaaagagatttctgccttgttgtgtctcatgtaaataaaaaacccagcaaagaagcaaacagctcactgtcctctggatctgctgcgtcctgcaggagcattgcgcttaaactatgggaagcggcacctccacccaacatcattttgctttccagaatgcagagagagccttcaaggcagcagccctgatccagagatggtaccggcgctacgtggcccgcctggagatgaggcggcgttgcacctggagcatcttccagtctatagaatatgctgggcagcaagaccaagtcaagctccatgacttcttcagctatctcatggatcacttcatccccagcagccacaacgacagggacttcctgacccgcatattcactgaggacagattcgcccaggactccgagatgaagaaatgcagtgactatgaatccatagaggtacccgacagttacacggggccaagcctctccttcccactcctgcctgaccatgcaactgccctggtagaagcattcagactgaaacaaagtctcgctctgtcatccaggctggagtacagtggcgcgatctcggctcactgcaacatccgcttcctgggttcaagcgactctcctgcctcagcctcctgacagctccatgctcgctacgtcttgaaccttttgtatgaaaccaagaaacatctggtacagctgccaaacatcaaccgggtctcaacctgttacagcgaggagatcacagtgtgtggagacttacatggccaattggatgacttaatctttatattttataagaatggcctcccatcgccagaacggtcatatgtgttcaacggtgactttgtggatcgaggcaaggattcagtagagatcctgatgattctttttgccttcatgctggtttaccccaaagagttccatcttaacagaggaaaccatgaggaccatatggtgaacttacgatatggcttcaccaaggaagtgatgaataaatacaaggtacacgggaaggaaatactaagaaccctgcaagatgttttctgttggcttccactggccactctgatagatgagaaagttctaattcttcatggtggggtgtcagacataactgatctggagcttttggacaaaatagagaggagcaagatagtttccaccatgaggtgcaaaacgagacagaagagtgagaagcagatggaggagaagagaagagccaaccagaagagctctgcacagggacccatcccatggtttctccccgaaagccgctctcttccctcttcgccccttcggcttggctcctacaaggcccagaaaaccagcaggtcctccagcatcccctgcagcggttccctggacgggcgggagctctcccggcaggtgcggagctccgtggaactggagctagagcggtgccggcagcaagcaggcctcctggtgaccggagagaaagaggagccctcccgctcagcctcagaagcagactctgaagccggagagctgcggaagcccactcaggaggagtggaggcaggttgtagatatcctgtggagtgatcccatggctcaagagggctgcaaggccaacactattcgaggaggaggctgttattttgggcctgatgtgacacaacagttgctacaaaaatacaacctgcaattcctgatccgttcacatgaatgcaaacctgaaggctatgaattctgtcacaaccgcaaggtattaacaatcttttctgcctccaactactatgaagttggcagcaacagaggggcctatgtcaaactggggccagccctgaccccacatatcgtgcagtatcaagctaacaaggtgacccacacactcaccatgaggcaaaggattagcagagtggaggagtcggctctgagagctctgagggagaagctgtttgctcattcttcagatcttctcagtgaatttaagaagcatgatgcagataaagtcggtttaatcaccttgagtgactgggcagcagcggtggagtctgtgttgcacctaggactgccatggcggatgctgaggccacagctggtgaacagctcagcagacaacatgctggagtacaagtcttggctgaagaacttggccaaggaacaactgagtcgcgagaacatacaatcaagtttgctggaaacattgtatcgaaaccgatccaacctagagaccatttttaggatcatagacagtgatcattcaggtaaaggcactcattattctatcacttttgaagcactgcaagtattttaccttaaacccttaatctccttcctgattcatcctcattcatctccactcaggcatttggagagcaaggtaagaagattagtgcttataaatgacagaaactaggaaagtacttgagtagtatcagcagcccatagagaaagaagtggggcagagaagaatgaagacaaactgaatgagagcttcttataggaagaataattattagaagatgtgatatcctctggacatggtggctcctgccttaatcccagcactttgggaggctgaggcaggtgaatcacctgaagtcaggagttcgagaccagtctggccaacatgaagaaacc

SEQ ID NO: 272126 - DNA, 392 bp, Homo sapiens
gtgtgtgttttaaattgcggtaaaatgtacgtaacatgaaatttaccattttagctctgtaagcatacaggtccgtggcattcggtacattcacattcctgtgtggccatgaccaccatccatttccggggcttctgcatgatcccgaacagaagcttgcacgccctgcgccacgccccctcccatgtcaacccccgtaaccgctggtcttcgtctctatgaattaaactattccaggtacctcccatcagtggaatcataaaatatatgttcttttgcatctggcttatctgacttagcataatcagacgaccccgtcttaacagacaagtaaactgaggcacagagaggctatgggactcgccccagctgtgtgccccttctcaccgcct

SEQ ID NO: 272127 - DNA, 478 bp, Homo sapiens
gcccagcaatggggaaagtgattgttttaatttatttgagactggattttatcactcggagctaaaccctatgaacatgtgcagtgaagagtcagagagaccagcaaaaagattgaaaatgggcattgccgtccctgaatcctttatgaatgaagtttctgtaaataacctgggtgtggactttgaaaatcacacacatcacatcaccagtgccaaaatggctgtttctgtggctgactttggcagtctctctgccaacgagaccaatggtttcatcagtgcccatgctctgcatcagcacgcggccctacactctgagtgacctgagtgaggatcccggaactgcgtgtgcagcaccagtaaacttgaggggagctatcaggtttgcatagtctttcactggaagtttgaacctttctcactatgacatcagtgatgtcagtatgtatagaactatatcttgatttatcaagagtat

SEQ ID NO: 272128 - DNA, 441 bp, Homo sapiens
atctcatctggacagagaaagaactaatgcattccaacagaatgaacaatatgtaaaaaaaagaaaaagaaaaatccctcatcagttactccaaaggtgctgggtcatcttccctcagcctatcaaagaataagttccacccaacctttgtggcagttcagcctgaccagagtattccatagtgtcagactgccccagaggtaaggcagattctcccattttgtgaagctaactcagtatagcagtgttccttatcagttactaaggttgtatacgactgattcactctccatttcacttgaacaatcaaacacagctgtgcaatatttaacctaacacttacattgttctaaacgtatttctttatatttataagcatgaatttaatgaagcatctagtgatcttctaaattcattattcttgcctggtacattgagcca

SEQ ID NO: 272129 - DNA, 419 bp, Homo sapiens
agtgaaagcaaaaagagacaagcaggattgcatcaaacccaaaagcctctgtgcagcaaaggaggcaacgagcagagtgaaaaggtgacctatggacttggagaaagtgtctgcaaaccatgtgatatggtttggctgtgtccccacccaaatctcatcttgaattcccacctgttgtgggagggatctgttgggaggtaattgaatcatgggggtgggtctttctgtgctattcttgtgatagtgaatgagtctcatgagatctgatggttttataaaaatgggagtttccctgcacaagctctcttctcttgtctgctgccatgtgagatgtgcctttcaccttccaccatgattgtgaggcctccccagccatgtggaactgtaagtccaataaacctctttcttttgtaaatgcc

SEQ ID NO: 272130 - DNA, 435 bp, Homo sapiens
gccccaactatggcagcaagaggcaggggagcctggctccagagccaacactatttttgcagtaaagagcctttcctaatgagccaatctgtctctacttctattggcatcctgggaaccagggtgcagcagagataatttgcttcacacaccccccgcccaaacaaagcaccattacctccaaaccattacattagcctttatcagccttggaagctctcagtcatcctccatgagctgcagtaatttcagctaatttcttaagtgttctaagagcctctgatgtgttatgagcctagtaattgttgactggttccttttctgttgtggcttgatttcataccttgtatctgagctgatgcgtgctttgggtactttattataatgaggctttttgcaaagactcacattaaaaaataacattaaatactgagg

SEQ ID NO: 272131 - DNA, 360 bp, Homo sapiens
atatcttgcaagccaagagggccagctgcctttgctatttaatacacttaatagtcactcttctccatttacagctgtgctactacttgtcactttgggatcccttgcaattatcttaacaagtctaattgatttgataaactatatttttttcacgggttcattatggtctatattattaatgataggaatactaaggcggagataccaggaacccaatctatctataccttataaggtaaaattggatttctaattcttttctgtgtgaaataacagatattgagtataactgtatttaagattataatcagagcatctataagtagatcttctgaatactcagttactgtgaaacac

SEQ ID NO: 272132 - DNA, 371 bp, Homo sapiens
gaattttgtatgtttaatgtattttgtcactttatccattttataaaaatgagacctttgcactactgtgagttaacctttgtgatacattttgtaataaagccaggagaaaccagtagaactgtgtgccacacacggcttgctggttgtctgcggcaaactcatgtaagagggttgaaggctgagcctcggaggcaccggcctgtggtgggaacgggacgccccagcaaacactccccagtaaaataaaccttcagtgtaaaatagacatctgagctgtgtgtgagaaaatgtgtgtgcttgaaaagcgaaaacaaaaaacagccagctgtggcacattttgaaaatgaatatttggaaatagtttcatt

SEQ ID NO: 272133 - DNA, 406 bp, Homo sapiens
aatgtatttagggaagccaggcatgtatgcatgaaatagaaagtcaccatacaaggcagtggggcacctgccatttgctgcagaggacgcagctgaagataaggactacagccattcaaggccccaggggaggccagggcaggactgggaccagagcctcaccaaagacatggagatcctaggataagaaggctgaagggttagtttctggatcatctgaaatttgatattttaaaagctttctttaaaagacgcttttataattctctcttaaaaaattcagcccattttgtcctttgccatttttgaattgggttataggtcttgtacttattgatttataaaagctctttcattttagaaacattaataataaatattttacctagttaagaaaatttagctg

SEQ ID NO: 272134 - DNA, 479 bp, Homo sapiens
acggggttttccctgttgcccaggttggtcttgaactcctgggctgtagcgatccacctgcttcggcctctgacagcgttaggattacaggtgtgaactaccgcaaccagccagacaacaaataaaaatgaatgctatatatttatagtttgtaataaaatgttacattgtgaaatggttaaatcaagctaattaatatattcattacttcacgtaccatttttgttgtgagaacatttaagaggtactcttagcagttttcaagtatacaatgcattattattaactgtagtcaccatgctgtacaatagatctactgaacttatgcatcctaactgaaactttgtaccctttgaccatctctcagcccctgggaggctgaggtgggaggatcacttgagcccaggaggtggaggttgcaatgagccaagattgcaccattgcactccagcctgggtgacagattgacacccagtctc

SEQ ID NO: 272135 - DNA, 190 bp, Homo sapiens
ctgtggctgaattgattttatattttgttccattatattccctcccttgtgatttgaaatttatatgtctatttatattcttctagtggttacacttatatttttaacaattttaacaattctgtcgacagctataacatctatatcctcctcttacataagaataaaaaatttagtattcttacacttc

SEQ ID NO: 272136 - DNA, 333 bp, Homo sapiens
tcaggtgagcatcaggtcacaaagctcagaggcttcgtggccagcttctttcttgtgtcacctttccctggcatcagatccactccttccaaaaagaacaatgtgggtgcctgtcctaggggcacaggctgtgctctgtaacccgtggccctgccacgtggaaatcatcaggttatttttaagctcattctttgcagcaagcctggtgggtaaattcaagactgaggaacaagagttagtttacctcacaaatggaagtaattttgtaagctttgaggactgagatctatgatgtagtggtatgccctgcatatcactgtatatatgggagag

SEQ ID NO: 272137 - DNA, 802 bp, Homo sapiens
aggaaccagagaggatcgtcagaggagaatcctgactcgggctgcgggttcatgaatgggaagagctttggtctgtggcgttcccaattcctctttccttctgttaaaaatttatgggagtcatcaccaaaatattaaagaatttaattaaagaatgattctaaaattgtagagcacccagttatggggtgtagcttgttatccatgggacgggcttgaaggaaagactttcataagatgcatgatgcaaaaacccaaattcagtaatcggttaggtacagttacatagtttctaaatttgcaccttgagcgtacaaattttctggttatgtaatcagagcttaataggcagtttatagtttgttacgcctaaattttgttttccttaatgtagtaatttacaaaaaaatacatttgagttacatttttttttaaagtaggaatccaggcatcgcagccacgtacctcgaattgcctgtcacttaactattttcacactccacaggagactgatcttctgcatttttttttcatgtttctcaaacggggtctcaagtctacccctcaacccccattcctccagcctaactctggcttgcagtaaaatactaaatttccagtttcttctgattatcccaaatgccaactttccctctctaattcacattattatctgtttgtcctttagggtacatttttgatactgtattttaattatttttttacaaaccattgggtgggacatttaaaaagatttgttttctgtttgtaaatatcgcccatgaaaataaaccaaaactaa

SEQ ID NO: 272138 - DNA, 242 bp, Homo sapiens
agtactattattatccccattgcacaaataaggaaactgagctactgacatattaaatccaaatgttgtgtgcattattgagagaataaatataatgttatttctaatctttataatattcttgagaggcaggtcttatgataataagatcattttaaaaatgaaaataaaagaaacctatgatttagaaaagttaacatttccaaacatggtcagctgggatttctacttctggtcatgag

SEQ ID NO: 272139 - DNA, 738 bp, Homo sapiens
gacttgtcatcctagaggtcaaggtgctaggccctgagtatcccatcctggccctcgtcggggaggaggtggagttcccgtgccacctatggccacagctggatgcccagcaaatggagatccgctggttccggagtcagaccttcaatgtggtacacctgtaccaggagcagcaggagctccctggcaggcagatgccggcgttccggaacaggaccaagttggtcaaggacgacatcgcctatggcagcgtggtcctgcagcttcacagcatcatcccctctgacaagggcacatatggctgccgcttccactccgacaacttctctggcgaagctctctgggaactggaggtagcagggctgggctcagaccctcacctctcccttgagggcttcaaggaaggaggcattcagctgaggctcagatccagtggctggtaccccaagcctaaggttcagtggagagaccaccagggacagtgcctgcctccagagtttgaagccatcgtctgggatgcccaggacctgttcagtctggaaacatctgtggttgtccgagcgggagccctcagcaatgtgtccgtctccatccagaatctcctcttgagccagaagaaagagttggtggtccagatagcaggtcagtggctgttagctcacacccatcttcctagtcctcatgtgtacatacacattgggcccaaaggcagtctataaagacacaatggtactgcgc

SEQ ID NO: 272140 - DNA, 434 bp, Homo sapiens
gtatttgatgatgttagggaattattgtttattttggtaagtgtgataatggtcctgtggtgttttgttttgtttttaaaaaacatgaccttttccttcacagtaagaaaaaggataaaaaatgatatggacaggatattaggtaatagtattgtgttgatgtttaattttttgaatttggtcattgttttctgtgtaagagaatgttcttatatgctgaagtgtttaggggtaaatggagatgaggtccgcaactgacttcaaaatgggtcaggaaaataagttgtagaaaagtgtttgggggataattgaaagatgattggcagagtattttggtaatggttgaagctgcacgttgggtatggtagctcattatactgctctctcaactgttgtgtatattacacagttttcaaaataaaatgtaaaatgaa

SEQ ID NO: 272141 - DNA, 380 bp, Homo sapiens
atgtatctttaatctttatgagcatgttcttatgtgtaaaacagagatgagatttattaagggctgatatatcatccattgagtttgaacttccaatttgcctatgctaggttcagaatgctgaagtgactatttagaaaatgcatagctgggaggccgaggcaggcagatcacaaggtcaggagatcaagaccatcttggctaacatggtgaaaccttgtctctactaaaaatacaaaagaaaaaattagccaggtgtggtggcgagcacctgtagtcccagctactcgggaggctgaggcaggagaatggcgtgaacccgggaggcggatcttgcagtgagcctagatcgcgccactgcactccagcctgggcggcag

SEQ ID NO: 272142 - DNA, 196 bp, Homo sapiens
actgttttttcatctacctctggtctctgtgcagataaccagaagattctacctgtggatcagaaactagaccctcaccagacaccaaatctgctggagtatggacttcctagcttctagaactcttggaaagtgtgcttctgcaacatggcagtcgagccccacatcaaagaagcaaaatatagaataacagcat

SEQ ID NO: 272143 - DNA, 845 bp, Homo sapiens
cagaggcctctgtctcctaatcttttccataggctactgttttctttcttttctcatgaggaaaaatgataaaagcaaaataaacaaattagctaccacttatgaaaatccccaggaaattccttttccagagttctcacttactaatttggctaacattaccaatggtaacagaccccacgtatccgccacaattgctgtgagttgcagaggaaaaagactgggaggaaatcttcacttttcttctgcaacagcaaccaacagaaatgaaagagccaggggattttgcaaaatatcaactcctgagaactaagaatgagagcctttcctgccaagcccattctgtgccagtcatcataaaatactatgacccttccttccagaagaacaatgcgctgtgatctttggctactcaagctttacatcatccatattaccctgcagcaggaacagattgatgggtattttcactgcccccagagagttaccctctaatccttcatttgctgctccagcacaattgcacggaagcaatagcagggatagttagagtgcatacaattgattccaatccatccatcacttaaactactgtctaggacatcaggaggccacaaaaaaaaaaaaaagaaagaaaaaaagaaaaacttttgaatcaagaaatgctttgtccattccaggtcaaggaaaatcatgatgcaatttggttggatactttgactttagaaaagtttctcacttctcagtagagaaagtttaatgtttgcaaacatgcagtaatgaggtaacagttgcagtaataagcatttttaaactgcatttgtggaagagcagcttctacctac

SEQ ID NO: 272144 - DNA, 595 bp, Homo sapiens
cagaggcctctgtctcctaatcttttccataggctactgttttctttcttttctcatgaggaaaaatgataaaagcaaaataaacaaattagctaccacttatgaaaatccccaggaaattccttttccagagttctcacttactaatttggctaacattaccaatggtaacagaccccacgtatccgccacaattgctgtgagttgcagaggaaaaagactgggaggaaatcttcacttttcttctgcaacagcaaccaacagaaatgaaagagccaggggattttgcaaaatatcaactcctgagaactaagaatgagagcctttcctgccaagcccattctgtgccagtcatcataaaatactccagaagattctacctgtggatcagaaactagaccctcaccagacaccaaatctgctggagtatggacttcctagcttctagaactgtaaaagagaaatttccgttgtttataaactacccaatttgtggtattttgttatagcagcctggatggactaagacaacatattctattttaaaatcaactttgttgggggtataataaaatttgtaaattttaaatataaa

SEQ ID NO: 272145 - DNA, 369 bp, Homo sapiens
atgaagtcaccatttactgagatggtaatgactgggaggttgagctggaagaactgagaatcaaatatctggttttgaatctgttctttttgagatgcatattcaacttccatatggaggtgtcaaggaggatttagatctagaattttggagctcaagggaaagggttgagctgtagacataaattctagagatgccggaatatagattgtgatccttctttatcagcacagaaatgacttgactttgtccaaactaagcaatcatactgtacatgttagcaacacattttacaggccaatttggccttttgcaatgttctgtggtttctaagataaataaacatattatatgtttccctctggatgc

SEQ ID NO: 272146 - DNA, 622 bp, Homo sapiens
aaagacttcctaagcagctctgacagagggagtgagcaagaggacctggaggactcagggagcatggactgctctgctccttctgtgatccaaggtgacagctccaagagggcagacaaagatgaaatacccaccatttccagttacgtagacaaaaacacaaaggacaggttcccagtgttctcacacagaatatggaacctaccatattatcacccatctagttaagttacttacaactagaggggtttttatgaacaccttagaactcctaatattaagaataagaaaaagtgatgtgacttcaagtttttctttgttacaaggtcagtatcctgtggatgtagcctatgttttaaatagtgttctttttttaaccactctaaacatgctatgttttcattgaatagtatgcttttaactaaaatgtttcctaagtattttgaaaaaatgtttgcagtattttcttatacctcaaacccacctcacaggaactaaagcaactttagtatgaagtctgacaaattctgtacaaaacttagatattaaccttgacttttattctacaatgaagctacgtatagaattaaataaattattaatacgaatcctatctttacaa

SEQ ID NO: 272147 - DNA, 379 bp, Homo sapiens
tagtatttttggtaacaggaaataaatgtaattctcatctataacaactcttattctaagtttctgaatttctctactcaattgcctttttaaagtattttaactgtcttgtgctagatgttttaatattatctttggacttaaatcctgaggaatagaaaatacatatctttaaatttataaatagataaatctagacgagtaaacccttaccaataagaatgtcaacttacgccgggcatggtggctcacgcctgtaatcccagctatttgggaggctgagagagaagaatggtatgaacctgggaggtggagcttgcagtgagctgagattgtgccactgcactccagcctgggcgacagtgcgagactctgtctc

SEQ ID NO: 272148 - DNA, 384 bp, Homo sapiens
ccagatagcgcctgcgattgtttgttaccgttttaatcctattaattaaaacgttaacctgattgggtagaaagcgctgtcccaacaggcgagtcttcttcataataacctactcagagataatgatgtaaaagactcccccgtctgtggcggcggctgtttgatgggtccggaaatctcttgaaggtgaatccaagcaagataaacggtgcggagaggaggcgcggggctgggctcagagcggcggcggcggcggctccactccctccgcgcccaccctcccaccatgcggggccgcggcccatggtgagccccagcagccagcaccatcggctggagacgaagaagaagaagaagaggaggcggcgagcgcgggggaaggcg

SEQ ID NO: 272149 - DNA, 682 bp, Homo sapiens
agatatcttctgcaagcctatagccagattcaaaagtaaaagacgcctgctaacattgagataatttaactttgttttgggaattcttgccagtgtaatccaacaagaaaaggtaatacaacatctacacatttcgaaaaaaggcataacagatgatctgtttgtctttcagggaaatttaagacaagtaattgaaaagctattagaggtaataagagaactgaaatagacaaaaatcaatagctttctttttttcaacaataacattagcaatgccaattctccaaaaattgtatataaatttaaatttaatgccaataaaaatgaatgcaggaattcatagcttgtcaaaattatagccttaagttaaatcagaaaaatgaatgagaaagaataatgaagaaaatcttttaaaaaagaactgaaactgtatcattaaactggagtaattaatttatgtggttctatgcaggaaaagacagagtccagaaataggcccatgattatgtgggaattgagtaagtgataaggaaggcaattcaaatcagtaagaaaaatggcttttaaaaaatttattatctaatatttgatttgtcaagtcattaaataattatctataccctaaagatatcctgtattttttctaaaagatttaattttcacctttgatttacaattaata

SEQ ID NO: 272150 - DNA, 564 bp, Homo sapiens
  misc_feature (37)..(37): n is a, c, g, or t
tgtgtgtgtctgtgcgtgcatgtgcacgtagcggcgngttgagaaatcaagaggtaaaatagcagatatgtgctcatttttctgcccaataccccctgcacccttcttctgggacagccatccctcatttgggggaaacggacatcccatactccatgtggttctagaagggctgctggtcttcttatcccacctcataaatgggccgcatgaatgcgcatgagcccaagcttgatcttttatcctgatcatagtcataagctcagggaaagaatgtgactaattagaaaccagtggtttgttcggatgggaggaagaggggctctctttacatttgaagtgggagataatgacgttagcagaaagagttaggagaaagatgcggaatcagaggagaaatctttttcttatcttaactctgtcaccacaggttaatcagcacaatcttgaatttcaggacgctaagccaccctacaacacaggaatcctctgggtatcaaataagacactttgtgtttaaatgcttgatgaattctaaagcactgttcaaatgttaactaaatc

SEQ ID NO: 272151 - DNA, 725 bp, Homo sapiens
ttgttttctaacagcataacaataaacgtatttatttctccgagctttcaaaggcatcaacagaagggaatcactaaaaatgtaggggaaaagaaacactcggctggagctttggtttctaagcagatccttctggaaagacgcttagggagagtctagggagcagctctgacgtcagtagctgccatcggaagtcaggtcatgttctacaaaaagcagtgacgcacgcccgacagcacccgcggggccggacagcggcttcaccagccccgcgggtccgaatcgcacgcggccgggtccgctctcccgggaggagagcccggcgtggaccagcgtgacgaccccagcgtgctgcggcctctccccgagggcccctccacaagggtccctgcgcgggccgggctcggccgttgccactcgggacagccatcccctcgagttcgcgctcgccgtccccgccttcacctcccgggttgggaggcgggcgactgcgcgcgaggtaaaggaacttgcgttccccggcgccgaggcggcagcagcgcagtgcacagcggcttctgaaggcggcgtcgacggggagctgcgcgtggctcccggtttcctggttacgtgcgcgccggcagagccaaaacctgcagccgaaactcccgcttctccgtaaggattaaagggcgggcgcactaccgggagacgtgtcaaactcagcgcgcctcatggcggccgca

SEQ ID NO: 272152 - DNA, 772 bp, Homo sapiens
ttgttttctaacagcataacaataaacgtatttatttctccgagctttcaaaggcatcaacagaagggaatcactaaaaatgtaggggaaaagaaacactcggctggagctttggtttctaagcagatccttctggaaagacgcttagggagagtctagggagcagctctgacgtcagtagctgccatcggaagtcaggtcatgttctacaaaaagcagtgacgcacgcccgacagcacccgcggggccggacagcggcttcaccagccccgcgggtccgaatcgcacgcggccgggtccgctctcccgggaggagagcccggcgtggaccagcgtgacgaccccagcgtgctgcggcctctccccgagggcccctccacaagggtccctgcgcgggccgggctcggccgttgccactcgggacagccatcccctcgagttcgcgctcgccgtccccgccttcacctcccgggttgggaggcgggcgactgcgcgcgaggtaaaggaacttgcgttccccggcgccgaggcggcagcagcgcagtgcacagcggcttctgaaggcggcgtcgacggggagctgcgcgtggctcccggtttcctggttacgtgcgcgccggcagagccaaaacctgcagccgaaactcccgcttctccggcagctgcgcattcttgacctgtcggggtgcggcgagtgtctcacctctctgcacttccaaggactctgtcatctgcttaggcggaatgctgttgtggtgggaccccgagtgtg

SEQ ID NO: 272153 - DNA, 461 bp, Homo sapiens
aattgagatggattctctacttaccaccagttttactaccacattttcatttttgagtgtttcattttaattaacttcttattgggttggatcattttttgaatcacttttgtttttatgtttaaaaatgaggatcatttaagttttacatgatgtcatatttgtaaaataaagtaaaaaaaagacttaatttggtcttttgatgatttttcattggaagtctaggcattccattgagttagttatacttaaaaacactgtataggtacttttgtgaaaacgctactgtattttcgagtacgaaaaaacccaaagattaaaaattacttttgtaattttgagaaatatcaaacttaatagcaaagaagcaaagtataatactgctacatgccattatttttgcttttatcaaactttctcaagtaactactttgtgtgataaacccaaatgtaaagggcaa

SEQ ID NO: 272154 - DNA, 886 bp, Homo sapiens
cccagcatggctatttcctgctaccagcaggctgggggcctggttctttcactagagctaccatgcactgagccagcatctgatatgtgttaactcattccattctcaaaagccactgatatcatcttgcaggatggatttgggacctagcaagactgacttatccaaggtcacattgccgataagaggaacaactggggttcaaaccaaggcagctgggtccagagcctacgtgcttaaccactaccctcttgtcgcctctcttagtggcaaatgataaaaacccacttcctaagagttaaggcagacaggaaaatgtgtacatcatggagccaaattggagaagaaatacagctgggtgggccttaaagttagttgaaacctggaacataaacgctgccaggaccgtatccctggcccttaacgctgtcaggaccgtatccctggcccttggctttctgtgcatgtaggttcggctcccagaccaaccctctccaccaagctcaggataccatctagtttcacatttcccggcatcatctgctgctgcctgaacccgaactcaccattggaggctttggcatcaataatcccaggggagggctctgactggccccgtttggcccagatagtaatccttggaccaatcagtgaggcccaggcaggagggggtctcccacaggcccggcttgtcttcagtctctggcacggagggtggggtcacgtgacaacacggaagtagccctcgcccccgcaatgaggcagtgtggtgggtggggagatggtttttcagaggaagggaggatttggactggccagaaaaaaaaattgcggtctacctaccctgcccagcctgtgagaatcacacaggcccagcagaggggaa

SEQ ID NO: 272155 - DNA, 456 bp, Homo sapiens
caagagtatagaaattgcatgagcggaaaatcatttcagggatggatccagctgcttttgcacatgtgagaatggccatgccaacttagggtaccccctcaaagagggggtgaaggaagggcacctgagccccactgcctgtccctccccatcctgtgtcctctccaggacatgctgattgccactgtctcttcaccccggcagctaaagaaagttgcatgggacgtggtggggaaggaaatcaaaagtctagaacccacacggaatgctggtcattcttcatctctcatttgtcgctctaacaacatgtcatttcacggctcaagtgaagccacgtttcactgtagtttattctctcagaagctgaagccccacgctctggtttctatcccacgtactgtatttaattttagcaaaatcctagtaaataaaataatttggaaaaataaaaaaaaa

SEQ ID NO: 272156 - DNA, 363 bp, Homo sapiens
tataatgtgggaaatgagatggttgcattttgagctgttttcctgatcagcaagcaggaggtttaaaaaagacatggtacagggccgggcacagtggctcatgcctgtaatcccagcgctttgggaggctgaggcgggtggatcacttgaggtcaggcgttcaagaccagcctggccaacatagtgaaacccctgtctctactaaaaacacaaaaattagccaggtgtggtagtgcgtgcctgtaatcccagctactaggaaggatgaggcaggagaattgcttgaacccagggggcggaggtttcaatgagccaagatcgtgccactacactccagcctgggtagcagagtgagactgtctc

SEQ ID NO: 272157 - DNA, 864 bp, Homo sapiens
tttttttgagacagaatttcactcttgttgcccaggctggagtgcaatggcgtgatcttggctcaccgcacactcttgttgcccaggctgctgagtgttaggggtgagggagagagctacgagaagttagactggcaagtggagattgactctaagggccttgaaagtcatggggacaactctggcttttgcttgcttgggttgggaactatggttggcaggataatggctcccaaaagggtccacatgcttatcctcagaaccctaaatatggtactttacaaaaaatgggaaaaataattctgccaatgtaattaagtttaaggaccttgagatggagagattaacccggattatctgggggggcctactgtcatcacatgacccttaaaggtagagaacctttcccagatgtgggcagagaaagtcatgatgatgtaagggttggagagatactatgttgctggccttgatcatggaggaagggaccatgagcaaggaatgcaggtggcctcaacaggctggaaaaggcaaggaaccagcccatgggctcactgggcaacaccttgattttagcccactgtgcccatgtgggctttctgacctaccgaaatgtaaaatcggtggctcatgcctgtaattctagcattttgggaggctgaggtgggaggaccagtctaggcaacatagcaagaacctgtctctaataaataaataaataaatgaataaagagaattcggatttagcaacatgaaggtcataggtgactcagcggagagggaacaaggttgggagagaatgtggaggtgaggaggaagcggaagcagcaatcacaaagtctttgatgtttatcataagggaga

SEQ ID NO: 272158 - DNA, 386 bp, Homo sapiens
catattaggaatacaaggctgactgaccatttgaaatacattcaatgtgattcaacgtattaacagacttaagaaaaagccacataatcacatcaatagatacagaaaatgcattagataaaacttggcatccattcatgataaaaactctcaataaactaggaagagaaagaaactttcttaacctgataaggactatctactaaaaacctatagcaaaccatacttaatggtaagggacagacagactgctttcgtcctaacattgattacatggaaggcaagatgtcctctctcatcattcctattcaataatgtacaagatgtaacagccccttcagtgaggcaagaaaaataaataaatagtagatagactggaaaggagt

SEQ ID NO: 272159 - DNA, 245 bp, Homo sapiens
catgctcagaacacttacataagcctgcagttgggaaaaatcatctaacatagaggctattttataataaagtgttggatatctcatgtaatttattgaatcttgcatgaaagtgaaaaacagaatggttgtatggtttctactaaatgcatatcacttttgcactatcataaaataaaaaatgataagttgaaccattgtaagtcttgggccatctgtagcagtttcaattatccaaactagag

SEQ ID NO: 272160 - DNA, 219 bp, Homo sapiens
aactccactgaaaatacacccccggcccagtcatttcttggccagctcggggcaggtgccaggtaaataaacttgcccagccctataccaagtcactgcagaccccatatctcagtctggcatcttcagtcaccaagagaaggtccaaacaagcagaggcggtgggtgggagaagaatgctcatttacttaaaccagtttggggagccctgagaataaa

SEQ ID NO: 272161 - DNA, 436 bp, Homo sapiens
gcagctccttgtgtggctgcccagttgtgtagtggagctgcattccatacaggtggggggttgggtctgaaaagtccacacagcaccaattacccatagtcaaaatcacacagagaatccttgtcggagacccacagagccagttgtcttcagcattggaacagaatgctgtttcttaaaagcagggatggcaaatgggccaaatccagttggcggtctgtttttataaataaagttttgttggaacacagccatacccatttagttacatattgttggtgctgctttcttaccaaagtggcagagttgaatatttgcaacagattgtatggcccacgaagtccattgtttcgtatgttgcccttcaaggaaagtttgctgccctctgctttggagcaaatgaaggaattcgttttatattcaggtactacgttgt

SEQ ID NO: 272162 - DNA, 534 bp, Homo sapiens
aaagtgtcagtacttatgaaattataaaacatttccttcctgatgaaactggattttaagagtaaaggatcacatcaatgttttatttccatagacggcccatgtttgtcttataccccaacaaatggctttattttctggctaaaatcctttgctttcatttgcggtgatttaaaaacactcaaatctaacgtgtgatttagagatgtgcttctcaaaatggaatgagctttgggggttctgttaaaatgcagattctggccgggcacagtggctcacgcctgtaatcccaacattttgggaggctgaggcaggcggatcaccctgaggtcaggaattccacaccagcctggccacatggtgaaaccccgtctctactaaaaatacaaaaattagccaggcatggtggtgcaaacctgtaatcccagctactcgggaggcaggagaatctcttgaacccaggaggtggaggttgcagtgagccaagatcgcgtcactgcattccagcctaggtgacggagtgagacactctct

SEQ ID NO: 272163 - DNA, 543 bp, Homo sapiens
gctttgtagttctcatatcttttcgaatgcaaatacttagtactttgacgaaatgcaatatacttagtattttgacctttggtcttaacttgtaaacttaaaatgaagaggaggagagaaatatttatttgcaaaggtgagaaccctggcttcagcttccacaaatcaaattactggtagtaagctgttctgccacattttcaacacagttttctgtagctgggcctaacttaggcattaaaaaattccaatattctggccaggggtggtggctcacgcctgtaatcccagcactttgggaggccaaggcaggtggatcacctgaggtcaggagttcaagaccagcctggccaacatggtgaaaccttgcctctacaaaaatacaaaaaaatagccaggcatgatggtgggtgcctgtaatcctagctacttgagaggctaagctggcagaatcacttgaacccgggaggcagaggttgcagtgagccgagatcgcaactactgtactctagcctgggtgacagagtgagactctgtctcaaa

SEQ ID NO: 272164 - DNA, 418 bp, Homo sapiens
tcaagaactatgaaagaacccatttctgttggtgaaggctccccgtctgtggtcccctgtcctggcagccctaggaacctgacctctggtccctctgcatccctggcatcactctgcctccctctctttttctccagtgaatccaacacactctcagtgagacagccaggtggcaaggggttctcggagaaactccagccggcctgctcgctgggcatgtacactggagtggagccacagaagttcacggtgtttgcagcagggaggagcctggccactcctcttcctggttggaacctggaatttattttgtgaggcgggaagcctatactggggagactcttgctctgctgagtccccattccccctttattttcctttttgcccaataaatcctattattctcagtcttcaaatt

SEQ ID NO: 272165 - DNA, 303 bp, Homo sapiens
tcagtgcagcaggtccccttctggcccaaggtgggtttagaaatgccgtccaagagctagggcctgggatgggaggctttaggaatcttcttggtgtttattttaccaggttgcaagacaaagtcctctttacttttccttctcctttcctcaagcagaagtctctccctatggccattatcactctaggctcagggcagctaccgcttggctgccactgatgtttattcaaggcccaagggctttttagtcaccactggtgagtcctgcgaggcctgtatctctcccttctgtcgtcttctc

SEQ ID NO: 272166 - DNA, 339 bp, Homo sapiens
agactatgtgagtgggaaacggggggagctgctgttttattccctgctcttggaatgttgaagaatttaaaaaatgcttttaaaaagatagtttcatttttggaaaagtaggaaacagccttagggggagataaagacttgaaaagcccaggctctcggcagagaagacagcggggataggggtgggagggctggagccaggcgtgaagagcttgctgggctctgccaggattgttctggatcctctccacccaaactaaaagtcctccaaccctccaggttaaaaatgggggttacaagagctctgccacacaaatggagggttcctgctgcattcat

SEQ ID NO: 272167 - DNA, 387 bp, Homo sapiens
tgaagaatgatgtagtcctgtattagtttgtcaaggctgccataagaaagtcccacaactgagtggcctaaataaccaaaatttattgtcttatagttatggaggctggaagtctgagaacaaggcatctacagagttggttccttctcaaggctgtgggggagacttccacacctcctggcttctggtggtttgccagcatgcttgggcattctttggcttgtaaatgcatcaccccaatctctgtcttgatggttatgtggtgttctccctgcacatgtgtctgtgtccacatttccttttttttttttttttttttttttttttgagactgaatcttgctctgtcgcccaggctggaatgcagtggcccgatcttggctcactg

SEQ ID NO: 272168 - DNA, 858 bp, Homo sapiens
catgtcacaaccttacatgaggctttttgaacatctcctcctggcccagctggggtgagagcaagtcctcgaaggcactgcctttgagccttgctcagcccatctgaactatcccaactctagaattgactgctttcgaattgtgtgaccttgggaatgttatctggcttcaaccacaatgccctacccccagctcctctcccaaatgatcctagatacagggctgcttccccccgaccctaccccacctcgggacacaggctcatggcctcatggcacttcaccaccagaagtggtgctcagagttcctatttccacatctaaccccctaattcctgggaaagtctgaggcctggtccccccagtgctttccctggctggcctctccacattttcatctgatggtggagtgagatcaggaaaaataggacaggagctttgccttgggggagaagagagttaagtgtggaaaggggtgagttataggaggttaagcagtccaagatttctctctctgtgtaggaggccatttcctgatgtgaggggtctgaacccaattatgatgggacagggttgggcattgacttcccatctcttctctctgtttttctcccactatctgtagcccaaaactcttatggaggactttgatctttagtataggctattggtcagggccataggaactaaccccgatcctcactccaccaggatctaccacatcccctacacacaaacacatgctgtggggagggagttttcccctgggtcaagttgaggatccttagatcaccttgtgctcctgtggactggtgtgtgcgtgtgtgtgtgtgtgtgtgtgtgtgtgtgtgtgtgtgt

SEQ ID NO: 272169 - DNA, 416 bp, Homo sapiens
gaattcaagctggctacagaaatttgcctaaataacaagaagccaaatgttattacagtagccaaaacaatggcaaaatttttcttgggcgtatcagagacttccatggcagcccttctcatcacagacccagcagcctctgagggaaaaatggtttcatgggctgggcctagggccccgttactctgggcaacctcaggacttggtgccctgtgtcccagctgctgctactccagctccagccgtggctaaaaggagccaatgtacagctcatctgttgattcagagggtgcaagccccaagccttggaggattccatatggtgttgggcctgagggtacacagaagtcaagaattcaggtgtggaaacctctgcctagatttcataggttgtatggaaatgccaggatgtccag

SEQ ID NO: 272170 - DNA, 223 bp, Homo sapiens
tgtgtgggtggaaaacatggtcttcagaaagaaattatgagtgcaagacaggaggaaatccatcagaggccccagctgaggactgaccacggcttgttatttctcttgccttgcctctggcaatcacagcctcacagagcctgcaatccttgctttgtgagtttatagctcagtccagagaatggctaagaaagtttaggattctttcaacacccactccaca

SEQ ID NO: 272171 - DNA, 120 bp, Homo sapiens
gtaaaaacaaatcaaaaaaataaaaaacaaactgttttatagtcaacatgtagagattattaaatggagttttagtttaggtctaaataaagtaaggtttcttgcctgttctacagtgtt

SEQ ID NO: 272172 - DNA, 553 bp, Homo sapiens
tggcttgagtacccagataaatgggatgccagtctctgatttaggtaacacagaggcagactcacttgggaggtaactggtgattcagttttaaacatgtctagctcaacatgcctgtgaaacatacacatgacaatgtccagatacatggcaattggatgaatgattctgaaactcaaaaagagaggtctgagatggattctttgcatacttacaaaaaaaaagtttatgttatattgaaatgatctgttttgtgcctgtctccactattatacagggctggttcttaatgacctttgatgctccaacacctaacaccatgcctggtacaaactgcacactcaattagtatttgttgttgaactgaactccttttgagacatgatgcgtctaacaaagtaatagtagtagcctctgaggagggaaactagcaggtcagagtgaaaaagaaattttctttttgttgaatatattttagttctttttgccttttcctccaatgtatttctatttcctgagaaataaaaagatgacataaaaagtgttctattag

SEQ ID NO: 272173 - DNA, 469 bp, Homo sapiens
agaaaaagaactcaaagggcagcaataccagcaagaaggaaaccagttaggagataattgtagtaatccagggaaagaaagatggcagtttatactggggcattgccagtatggattctttgcatacttacaaaaaaaaagtttatgttatattgaaatgatctgttttgtgcctgtctccactattatacagggctggttcttaatgacctttgatgctccaacacctaacaccatgcctggtacaaactgcacactcaattagtatttgttgttgaactgaactccttttgagacatgatgcgtctaacaaagtaatagtagtagcctctgaggagggaaactagcaggtcagagtgaaaaagaaattttctttttgttgaatatattttagttctttttgccttttcctccaatgtatttctatttcctgagaaataaaaagatgacataaaaagtgttctattag

SEQ ID NO: 272174 - DNA, 430 bp, Homo sapiens
gcaataattaggaaactcacctcaggatattatcaaaatgacccacccaaacccaagtccatatggtttgaaatagctaatgagtcagttaatgtgctatgtccaggagtaatgggtactcaatatggatagcatgaaggtataatttaccaacgttctgactgattaagggtttcaagtggacattttacaacctaaacagggtatgaagtattaacacttttgatggttgagacaaaaggaagaaacagtgtttaaaagtcagggacattggaacttgaacaatttctttcaatcatattttccaggcttacaaagttaatactatataaaatggaatgaagatgtaggtttcggtagccaattgtgataatgtggaaaggtatgggggatgctactggctgagtcctttgcataacagaaaaataaa

SEQ ID NO: 272175 - DNA, 556 bp, Homo sapiens
ggaggaaggttcagaagtgacaagtttctaatgactaatatctcggcaggaagtgaaaatctcaaaagatgttatcaactttgcagcagctgtccaagttggggggtgggcaggggttggaggtgacctggcagcccagccggtcccctgcccacccgcacctgacaaaatcctctctgtccagccacacttgcctccaatgccttcctcaaacccctccgctggcaatgatcacttcctcagcaatcagtgccccaggcccctctctcgtgtccctgcctgagtcccacacagggaactgagatcctcagggtccccagggcagatgctggaacatgctcacctctgaatccccccagggctctgcacagtgtggcccacagcagatgcctgccagctgctggctaaatggaactggctgcggggaggaaggctctggtgagaacagaggctttttgggacctccaactaaacgcaccctcccccatctacagtgtaaagaacactttatttcgaacagcaataaatcagcatgctgcataaaccaggaaaaaaa

SEQ ID NO: 272176 - DNA, 336 bp, Homo sapiens
taatgaatgtcttcatcattcccgtcactgatgacagaatgttaatatgaaattgtaggaatgattttgcagccattgactggttgctgttgtccctatgctgaggtcatttttgttttattattaaaatagatgaaatgcctacagcacgtgtgcagagccctgagtgctgaggcaagtgatgcagggtgactgactcagggagggcgtttcaggcaatgagagctgaactgcaggaaagggagtgtcagatgtcacgctgaggtagacctccatctgcctggaagaggcttttttggctttgagaaggccatttctggctgagttaaatccact

SEQ ID NO: 272177 - DNA, 502 bp, Homo sapiens
tggtgtcagggaggaataggattgtagagctggaagagtcctggggaggtggggcccaggcaggtgatgtggctttgtccatggccgcagagcaggttcatgggcaggcaggacttgagcccaagcttcctgccctcacgtgcactcaatctgccagcagaattcgggcccctggcagacaagttggcatatggagatgcacagaaatgaaatgcccgagcttgttgccaggtcctcctccgtcaggcacgcccctggagaccacctcagcgccgaccctccctgcctctccccttggctagcacagcctcttgctcaggtgtctaaggggctttgctcctagcatatctcctgacctttttgagacaagagagatctagcatttgattcaaaactgtaaagaaatctattctccacaaagtaatgtatggactgaatacattactcctgccaaatggatcccatcaaataaaatatcagaggaacttttgaaaaggttaaa

SEQ ID NO: 272178 - DNA, 624 bp, Homo sapiens
ttgcttccacctccgcctcccaagtagctggggctataggtgcacgccacccatgtccaccagctctgttgctaatgctttcattgctagtttgatatgaatttcatcaagttccttaagtgtaatgagcaacatacattgttttcaaatcattcccactggtctttcttggatttgcttgtaatacaagtttgctgtataaataataaagattacatttgaaattgtagtaatttctggactatttgttatctagaacattctggacaaatattcaatatgtaagggcagtatagaccttcctgaggataaagttttgaagaacactcacctgggaataggaattcacattaatatataatttacagcaaggaccccaggtcacttcctagacttgagggtagaggagctaatgcctaaatttcactcctctttaggtgactctactaactgatgaaatggctataacagaagcgactgatcgatgtgctacttaaaaacagctagaggctgggtgtggtggctgtctgtaatcctagcactctgggaggccgaggcgggaagatcacctgaggtcaggcattcgagactggcctgggcaacatagtgatagctagtctgtat

SEQ ID NO: 272179 - DNA, 441 bp, Homo sapiens
atcagaaagaatgtttgaagaaataatggttgaaaaactcccaaatttgatgaaagaggtgaatctacatatccaagaagctcaatgaactctaaagagacccacactgagacgtgttatagtcaaactgtcaaaagccaaagacaatgaaaacaacaagagagaaacaactcatcacatacaagagagccttaataaaattactagctgatttcttataaaaaaccatggagaccagaaaataagaatgtcgatcaagaattctatatctgacaaaactattcctaaagaaattctcagataaacaaaagctacagaatttactagtagacctgccctacaagaaatgctaaagagaatctctcagattgaaattaaaggacatcagacagtaacttgaagccatatgaaaaaataaagagcaattgtgaaaaatctgtc

SEQ ID NO: 272180 - DNA, 433 bp, Homo sapiens
gcgggacctttagcctgtcactgctcagtcttctggattcagtccctttttccaggggtacgtatgggggtctacgtacccctttgccagagttgcagctgcttttgccaagaagcctgggtgtctaagtttcttggggctctgcatgtgcctgagtggctgctctgctgagactccacataattctgtgtgtcagactgaagacccttgtggagtgagttcatgaagtgacctcagagtgaccttggaagctacatgctgaaatgctgaagatggcagaggttcagtgagacaggatccttgaagatttaataaagcagagccctacctgccaagacttctcttttgcagaacccattacgtgtttgggcctatttgttattgtagcctagcctgaaataattaatactaataataaataaatgacttctaa

SEQ ID NO: 272181 - DNA, 448 bp, Homo sapiens
ggattcagtccctttttccaggggtacgtatgggggtctacgtacccctttgccagagttgcagctgcttttgccaagaagcctgggtgtctaagtttcttggggctctgcatgtgcctgagtggctgctctgctgagactccacataattctgtgtgtcagactgaagacccttgtggagtgagttcatgaagaaggcagaagaaatcagagagaaggatggagtggggaaaagaagagggaggctgacagagaagcttaaagaaatgctttcagatggcaacaaaagccaaaatagacaaatgggatttaattaaacgaaagagtttctgcacagcaaaataaactatcatcagcgtgaacaggcaacctaccgaatgggagaaaattctcacaatctacccatttgacaaaaggctaatatccagaatctacaaagaacttaaac

SEQ ID NO: 272182 - DNA, 437 bp, Homo sapiens
gaaagaaaaaagacaaattcgctctcttctggagctgggacatttatcttctcctgcccttaaacatcagaactccaggttctcagctcttcagtcttcaacccggcttccctggttctccatgtcacagacagcatatcatggaacttcttggcctccagaatcacataaaccagttcccataataaatcccctcttatatatctatatatacactatcagttctgtttctctgaagaatcttgattaatacaacctacattcacctgaacaagaaaaagaaactaatgtgttaagacactgaaacttacaggcttatttgttgcagcagctggtcttgtcccgactaatccaaacaccatttgtggaaccaaggggcaaaaagaatgagagagaaagtgtagcaagatgtcaaggtctagagtttctaaagcttt

SEQ ID NO: 272183 - DNA, 129 bp, Homo sapiens
cctaaggctgggcctgtgttgggggttgggggaggcccctacatgtctgcaaggagtgggagagaaaggattggcagtcagtgggggaggggcctcctcctccaaccataaatacaaattttattcaag

SEQ ID NO: 272184 - DNA, 789 bp, Homo sapiens
cacttaccacatcagagtattgatccctgataatgtacttaaccatctttcctgaaataacaaggtggctatgtccctcagttttcaaacagaattacttaggtaacagtagagatcatgggacctgcagcatagctcagtgaagtgtgaaatgttactaaagattgtaggtgagtagattctgtccttttcccccgagtccttgacattctggcttgatgaaagatcttagctaaggccggatgctgtggctcactcctgtaagaaggccgaggcgggcgaatcacgaggccaggagtttgagaccagcctgaccaacatggtgaaaccccgtctctactaaaaatacaataattagctaggcgtaatggcgggcacctataatcccagctattcaggaggcagaggcaggagaatcgcttgaacccgggaggcagaggcagcagtgagctgagatcacaccactgcactccagcctgggcaacaatgtgaaactccatctaaaaaaaaaaagaagaagaaggatcttaactaaatcataataaaaccaaagctgtacctctgaagattgattagtgtgtagcgcaatggtgccccctgtggaagatctccctatcctggatctaagaagattatgctaacctgtatctttaattgattcctaagatttgtgtgcagctgtcagaaaaatgggtagacctttctatgtgctgtactttctttaagatgcatgccattgtatgcgtgctttgcagcgtacactgtttaagacacacactaaacacctta

SEQ ID NO: 272185 - DNA, 491 bp, Homo sapiens
actttttcccaataaaaaccagactaaacaaaattaaaacgtaagtgacaaacaagggagggaaaacatttacaactgactattaatatcccatattcagagaaatccaactcattggaagaaaatgacagacaataccctaaagggataaagaatacttataggcaaaaaagaagtacacacggcaaataaatctgtgaaaagatgctcaaccacggtattgattaaaggaataaggaagtgaataacaacaaaatagtttttgccaaatctgattgtcaacatgtcatatattgttaacattgattgctgtcgaggctgtgaaaaactaggcagcttcataattgttggcaggaacaaccaactgctacaaacattttgggggcaatttggaattatctaataaaatatatttgcataccctttggccatgccatttcacttttacggatctaacaaaaaataaaataaaaacattataaaggtaaaag

SEQ ID NO: 272186 - DNA, 164 bp, Homo sapiens
ggaacatggacctttcatatgtgacatctataaccccacagtataagtacagttgaatatttgatgagtgcaatatttacaatacatgaaagttaaaaatcttttatatttctctttgaattgataacagtagaaaatagagtctcctaggatttaaaacaagt

SEQ ID NO: 272187 - DNA, 551 bp, Homo sapiens
tgctaactgttcccccactgagtgctcagaacctttgttcacacctcctttactgtatttatatgataacaacttgtatttgtttgtaagtctgtctttcaggaatgtgaggctccagagagcaagagctaggtcttattcatctagcacagtatgtgactcacggtaccactagagaagtgattgttgaataaataagattgtatttgagctaggccttaaataaataggaattacagcaaatctctggatggccttttaaatatgaatgttaacctgttagtgttatacattaacccatcagaaatctctagaattaattatcaaggattagcctttaagatgagctgacaggcaggaccaaagtgagtcaaaatttcattagggaaagctggaggtggatgcatggatgaatgaaaggaccctggagcccaggcaagcagctcaggaaacaggtacagggcttccttaggttagccaggagcacttggtggtatgatggtgagggaagggaatcactttaagagtaaataagagattcaaggatagac

SEQ ID NO: 272188 - DNA, 378 bp, Homo sapiens
agctctgtggaagtgttaacaattagggcttacttcctataatttcagaaatttgtggaagacagcagttccctccctttctcagaacccattaccatcaaaacagctaacgattactgagcatttccaaagtgcccaagtcctgtaactaaccattttatataaattatcttataagagggagggattaattattcctctttagtaggtaagagatcaaggatcagagaagtgtttacccagctggctagaggaatcaataggtttacaacccaagagggtctgactgtattgcctgtgctcttaaccattgcatttgttgcctcccacaaactagtttccatgcttgtaaactagtgggaaaattgcatgctgtat

SEQ ID NO: 272189 - DNA, 1009 bp, Homo sapiens
ctaaatagtgaaatattactaagaaccttcatcccaaggggttgagtggtagaaccactgagaatattgttgctgctcttttggagacaacaaactgcattaataaaagtctgagaacaagaaagttgagttttcaagtaatgtcctttgcatattgctacatagggctcatctgagtctgtgatgttctactttgttgatgaaagaaaacaagtggaaattctgctcccccacacatcctgcactgcaaaaagataacaagtagcaggagatactcaattatgatgcagttcaacaaagaaaacaaattaaaataaagagatcctgggtggttaaatacagagtctcctttgtaaacagcaatggatgatgatgatgactgttaccagggctctgtatgatcattttcccaattctttggagtacttttttcaaaagcactcttgtagaattaactggaaacatagactacccttcactcattacatgggaaatgggattgaattctcttcttggcaatggaaaatacttgatgcatgcaaataagaaaactcttactttttccttctctccttgcagggggagcacgcgtcctaagcttgccaggaagccctgctctcctgccctgggcacctccgttccacttgaccttttccacctgtactccctgcattttggtctcttgctctggtctttagccttcgcattttcctgatgcagcccaaaccagtcacctctctcctagattcattctctgtgctcagaccatctctttcctttagttcctgtgacgaaagaaaatgtatttggccattggaggtataagcaacaaagaatccaacccacacagctttatatatgcaggttctctatatgctcttcttgtgaacagcgtggggagaggaaaatagacttggcaagaggactaagaacagaatcggacagttatctgatggctttcctaaggttcaggaaagaacagtggtccctttgttgggcctttctgttg

SEQ ID NO: 272190 - DNA, 458 bp, Homo sapiens
tttattttagccaaatgcttttatattttcacagcatgctctcctctggctgactttttttttcctttgcactttctggtggttttctagtggtttgggaacttatataaaaagtaaacaatctgggggcaaaaatggccctttctcttcctcctccaaaatatccttttttagcaacttttagactcgaacctcatcactgtctttatgcaggcgggaatggggttacaaattctaggcaacagagaaaaagaagaaacatctatcgggtttagtaggtggtttcaaaaatagcctggagtaaaacacttattaggcagactctaaaaaaaaaaaaaatagaagaccaaacttctgccgcagagttgggggacctatgaatttggataccagggaaatgctttgctgctggttctttatgcctctgaccttgtctcactgagtattactcagggctt

SEQ ID NO: 272191 - DNA, 404 bp, Homo sapiens
agaggccatgctctctatagaaggcaagttttatactaatggaaattgggaagcttaggaatgggcttttgggaataaatgtcgtattggttttatctaaaatcaatgggctgtgtgtgatggctcacacctgtaatcccagcactttgggaggccatcacaggaagaaggtttgagtctaggaatctgagatcagcctggacaacacgcaaaaactgcatctctacagaaaaataaaaaattagcccggtgtggtgatgtgcacttgtagtctcagttactcgggaggccgaggtgggaggattgcttcagcccaggagttctaggctgcattgagctatgattgcgccactacaccccagcctgggtgacagagtgagaccctgtctttaaaaaaaaaaaaa

SEQ ID NO: 272192 - DNA, 421 bp, Homo sapiens
ttttcttctttctaaacgttctatctttttacttcaggccttacgttattggctaatatctcaaatatgttaaacagtagaggttattattgtttttagacttcaaagaaccaacattttggctttctctattgtgtgttatttcactgactttttgtcttttattatttcgttgctcttctttttccagctacttgaaaatagtttaggtaattgactttcagccttgcttcttttctaatgtatgcatgtaaatctataaattttcctccacgcactgcttcagctgcaacacactttttggtatgtcatattattcacttgaaaatatttttaaatttgttttattctttgacccagggactatcaagaaatctattacataatttcagagtagttgcgggtttctctaatcatcttt

SEQ ID NO: 272193 - DNA, 260 bp, Homo sapiens
ttttaaatccttgcagtagcccaataaggtaggtattgttgttatccccattttacaggtaaggaaactgaggcacagagagtaatttgcacaaggcttatggctttttagtggaggagccaagagtcaaattaagagtggttgagtcaggcatggtggcccctgcctatagtcccagctacttgaaagagtgaggtaggaggattgcttgagcccaggagttcaatgctacagagcaagacctcaactctttaaaaaaa

SEQ ID NO: 272194 - DNA, 344 bp, Homo sapiens
ttgtatgtctgtactgatctatactgggtgctgggcaaacgggcattcttaaacactcctagtagggaagaaattggtacaacctttccggaggacaatttaactgatttatttaaagcccgaaaaatgtacatacctttaactcagcagtttcgttactgatttatcttaaggaagtaatttagaatctgtgcctaactgtttacaataactcatagatgaaaaaggcaaaacaaaacacaagtaacctcaaatctccccatgtaacagtttgcttaaacactatagcgttattttacgcaagctacagaagcattgttgaaacatatatttattaggacaga

SEQ ID NO: 272195 - DNA, 780 bp, Homo sapiens
agtgtaaagagccagtaggagtgcaatcaaaacacgtaatcaaagtcactggacaatgaatgtttgtgctgaggaccgagaccagctgtgtcaatgttaactgctggttccaggatactctttcccaggtggatgagggtgaaaacaataaagaatgtcactcattgcttcagggaattcctgaaaaccaattatccaggttctaccctggagagtgttccatatgcacttgagattattatgtattctgctgtgttggatggactgttctatagttgtctattaagtctagttgttttgtaatgtaatttaagtcgtttatatctatgtttatttaccatttctatatgtttttatgtagttactatatttgatgtttttgttttctttattcagagtcacatctttagtatgattttctatctgagaagtgttctttattattttctatagtgtgtgtctgcaggtcatgaatagtgcaagtatatttatggttaaaaccattttattttgccttcccttctgaaagatattttcactgagtaaagaattcagaattgacagttttttttaatttaaagaacatgttttactgatacattataattgtatatgtttatggggtacacgtgctattttgatgcatgaatacagtatgtaaggatcgaattagtgtttaggatatccatcaccttgagcatttgtcatttctatatgttgggaatatttcaaatcttctatgtattttgaaatgtacaataaattatgttaactatgttc

SEQ ID NO: 272196 - DNA, 297 bp, Homo sapiens
gaaaaagaaagctaataggttcttatccatctgctttccaaacaacttaaccgcatgttagataattgtatccttaggttttattagtcttataaggaaacatattataaagcaaaagaacttccttctgggcaccagagcctacaaaaacagaaatctggtatctgctttgaaaaggtcagtttaaccctcttagcattagcaggcttaatgccattgtggttgtctacaatgaaggacagccatgagctctcttcctacattcttaatattcattgaagagaagcctctcaggaa

SEQ ID NO: 272197 - DNA, 446 bp, Homo sapiens
tataatatgattgtatcattttgtacaataatataattatatataataaaattacatcataattataataaaattttattacacattttataggaatatattttcaataatttctacaatctaaaattgattttcagataattggaacacaggtgtttacaagcatgttctttttgagattagccatcagctgtcacttactggaccaattccaggtgaaattacagactttcatttaaattcatccttttggtgcagtggaatgtgatacttttttcaagtgatagttgatattagatttattaatctgccaaaaaatacccttcatttcatggtatacataagaggggactaagcttttggtatttatgagtagaattctttacagtcttctgattcagagctgtatgtccaaaagaaggaaaaaataagaaagaactaagtga

SEQ ID NO: 272198 - DNA, 380 bp, Homo sapiens
cctcctagtattatttacgagacaccttgaaaaaaaacactgctagtctgcttaagaacttaagtgagtatatgcactcaacccatcagctttaagctatgagaacatactttaagatacataatgtttcaggtcacaacaaaatgcaagctacatgctgaaagtctctgggtcatggcgttggtagttgccatagattctgggatcaactttgccatttaccatctgcattttctttttcttccaagactatgtttctcttgcttttgactgaccagttgcataaatacttttggaataagcttctgattaaatacctacatgtaaaactgctaatgtgatttgcaaagccaataaaatacccaagaaatagtcagaac

SEQ ID NO: 272199 - DNA, 213 bp, Homo sapiens
aaccatcggtataaactttctttagtcatgagtaatccctccttattggcttctgcatgataaacacaaatcttttccatgtttattagtaaaccaaaagggaaaataatgtttttaaagaaaccctgaaacgtagataaatgtcaaaagagaattgctctacccagtctctctctcagtaagaaaagtaattgtttatttttttgttactct

SEQ ID NO: 272200 - DNA, 461 bp, Homo sapiens
gaggctgagacagcagaatcgcttgaacctgggaggcagaggttgtactgagccgagatggcaccactgcactccagcctgggtgacaaagtgagactctgtttcaaaagaaaaaaaaagaatgctactaggaaaccaagtaaggtcttcaattacatttaacttcaaaatggagactgaaaagtattgatactgccaatatgattttgagaagattgtttcaccttaactacctcagaacttctaaagctgcttcagttgtattaacttgcattgagcagaccaatgatagtgttaaactactgaggctttggtttctattttctgacaattcagaccagttttctcactactgtggaggcttagggagtgtcacacaatctatagatggaccaggatttttcaaattgagagtgaaaccagcatcaaattggtgggttacaaccagcattaaaaaaaaa

SEQ ID NO: 272201 - DNA, 393 bp, Homo sapiens
accatcatatgtctaatacataatgatgcttcataagttactgagacctccctcgatctctgggatagttggagtaatggctgaatataaactatcagaaaaattgaatctgtaattctgtcaataagtgagaaaatattctaagattctttaaattttaattctggggttttgaacacattgatatgtaaaatataacaaaataaggtggacactgtttaactgcagttggtatcaattcttatgtactgaatttaaggagagagatgttatcaccgtaggaaattataccaactaatgactgcataccattaatatattttctgaagtttgaattttcagttaatgcactttcaatgatattaaagagcactttattaacagctatttgaa

SEQ ID NO: 272202 - DNA, 423 bp, Homo sapiens
ccgccggtagctcctgcctggccctgggaaacatcttcccacttcagccccgagcatccacccgtctgccgcgctggatcaggcctcagcgctgtgttccagcctcattcctcatcctctcgctgaaacgctcccgggatttcagcgcagcccctcaaaacacaacccagaatttcttggttaatggaaggatcaggaaatggatggcctggttaacggagcttagaaactcttcttggaagttttctgcaaacgtattattagtccagcaccttcagtggtggccaacatgagactctatttcaaatccttgaatacagtggatccctgaagaaagggcagaggccctcacagctttgggacaagatgatgaccatgtttgatttgacagaaacagccctgtacattttggacttgcaggga

SEQ ID NO: 272203 - DNA, 437 bp, Homo sapiens
gtacaaatagtacagggtgatctcacactctgaactagtagacacagttgacaggcccagataccagaggaagcagcagataaaatctttctggagagaaggtctcattctgatctttatctgtggttttcaaaccactgcttccttgggtcatgggtgggtcatttgcacccaaccaccatggttcccaaatggcagccacaacaggcctcaccccgggtgcttatagatgaactagcaaactgtgggcactctaggacacccactgtcctcacctgtgcccctccatttctgtgtcactcatattatcctgtctccttagctgcttctgtccctggcccagactccaagggagtgtgcccacaggcatggccaaggggccaggacttggtagatttcacaaaagagcagaatcaaggactgagccagccagaagg

SEQ ID NO: 272204 - DNA, 288 bp, Homo sapiens
gaacatcgtaggacttcggcaaatgtcggtccctttcccccacactccaaaggtgacgttccctgagacatcttagtctgggcaagtgtgttgttgtagcttggggggtggcctggtcccttggcctgtcctgctcagccagcagcccttggctggctcagtatgggaggttcagacacggtctcagttcttgacaagctcctagccagaggaaaggcgatttcattccggtgtgatgagcactagtagaagagatgttagaacggagggactgcacggaccaggtgg

SEQ ID NO: 272205 - DNA, 262 bp, Homo sapiens
ggaggataaggatgggcattcccaggacaaaaaggtttcctaacatgtgaccttgccttccagccacatctgactgaactagagactgctgctcacactggatggccagaatgaatcagatcatgctttgtgtgtatcatagctcaggtgcttatataagcaaaccaattaggtgttcataggatctggaattaagggtaagaatcacggtcaaattgatcacaatggcaggtctaaatcctgaagatgaatgatgaggcag

SEQ ID NO: 272206 - DNA, 539 bp, Homo sapiens
ttttgtaaatgtagaaatccattacagctatattaagactaatattcaaaggaaagaagcaagatacaggggaaatgtgacaagtatgcctaataaaagcttattatatagaacatttttatcacttctctatgttctaagatggtaacagtgagactacaagtaaataatccatagagataaattgttactcgaagaaaactgatagtaagttttcacatgggaaaatgttgtcttaccagcaatccaaaaaatgagaattaaggcaacttgaacacaaaaagtaggctaaaacatatagttagcaatactgtgcatagagacgtttaaacattactggttgctaggcatatcaagcccatttttctataaatcagtcgggatatttaacaaaatgcaaaattgctgtacttttaaattctacctctaaaattttatcacaaagataatccaccccagaatttaaattgtggctaaacaaattataacagtgctattattaacataagaatccaaataaaaagatgcaaaaaaaaaaa

SEQ ID NO: 272207 - DNA, 365 bp, Homo sapiens
gaaaacgaggcagaacaggacgtgattttaaacatttgctgggctgtgccacattcctctggcagttagctcagaggaagctcccttcgctctggggaacggttctgtgtctctttggttcatttctcttgagctcttcggcagtcaaatttgcttttttgaaaacttaagctgggggcgcttgcaagtagtaaatagaggagttggggtgggggggggcgttcattatctaggtttgttaggggcctcacggttttcgggtcggagaatccactgcgtgctcctcctcttcccctggcccggactcccagcttcattgtgtcatcccgcctgggggaaagcacccaccgggatcgtcagcccac

SEQ ID NO: 272208 - DNA, 376 bp, Homo sapiens
tagcaaccaagtggggttagggtgatggtggacactccttctggagtagcagtgcaagtttcctatccaacatgggtccatggacctcacaaagttggtttatggttggactttagaaaggtccataacttcccaatattgtatgcacaatttgttccccatgtggatttctttgaggtgacagtcaaatactttcattagattctcaagggatccaggacctaaagatatttaaaccatggtaatatcaccaatgatacagtgacttacgttgatgccatatgctgaattaactcctttgagaagttttgtcctcatttgagttaagatgggacatggtagataagctagaataaagatacattcatttaagaag

SEQ ID NO: 272209 - DNA, 392 bp, Homo sapiens
aagctgagttccaagagccttagtatgatagtagtaaattgagtagttagaatgaagattgatcatattttcttagccaggagaaccaattagaaggctatttaagatatttagggagggccaggtgcagtagctcatgcctgtaatcccagcactttgggaggctgaggcaggcttatcacttgaggtcaggagttcaagaccctcctggccaatatggtgaaaccccatctctactaaaaattcaaaaagttagccagacagggtggcaggcgcctgtagtcccagctacttgggaagctgaggcacgagaattgcttgaacccaggaggcagaagttacagtgagctgagattgtgccattgcactccagcttggacaacagagtgaga

SEQ ID NO: 272210 - DNA, 497 bp, Homo sapiens
agtggtaggtaagactatatagtggtagtttaaattagattgatagaggccatattttttagtacgttgggtactagacttttcctgttggcacttgaggtgttttgaatcacaagtgatataatgataaatgatccttactatatgttgaatgaattaatttgttagacgttttcatttttgtacaaagtatgaagactctcaggaggcaaagtaattccccaccgtctagtttatccctagactccttactcagctcatctgagtgttcggtttttctataatttctatcattctcaatttaaaaaaaaacaacatcaaggataggtaacgcaggaagtgcattaacaattttgattcttattgactgctctcttttctttctctttccccaactcagaagaaggttacagggccaggaatggttctttttttttttttttttcaagtgtttaacatgttttgaaatatgtatacattgtggaatgggtatattg

SEQ ID NO: 272211 - DNA, 633 bp, Homo sapiens
ctgatatttgacgtttttgttgttccaggcactgtaccggacactttgcatacaaaaactaatctaatcctcaaaacaatcatttagggcactgtcaaccctcttgactagcatgtgaaagttctgtgtttggaaaatagaatttacgtggcagggtcagcccctcacaactgaagttaaaaatatctgacactagctctcccagcctcccttgctattgtggtagagcatacacattccactagtcagatacacatgccccagagtgggaatcagaagcttgtgatatgaaagaggagaggcctttcaaatccatcgcagtgatggtggtggggatatatatccagaatactggataaaagcaactcagctggttttgtagattgtcttaattcttaagcaaattaatagcggtaattacatcagaaggggcagggttcaactatgttgaagagaaagctattttcaaaagtttagtagaatatatttgcatcaaataacttgtctaatgataaaaatagcttagtttaataaactttccagcaatagggaaatactgggtatcagttctaaatgtttccatactttcaaaatcaacacaattttatttcttaataaaattctcaaaatctg

SEQ ID NO: 272212 - DNA, 464 bp, Homo sapiens
gacttgactgaatttttcaatgtagtgctgtctttgcataggtgtatgtctttgcacagatggtgactagtagaatgtggattccgcttctcatcccatcatacttgtttagtttttccgggtgaatatatagccaagttttaaaagcaatgctctgagattcttactccacatcttgttaaatggcgattgtgaaccagtagatctggagtagggtttgagagtctgcatttctaacaaacccaaaggtgatgttatgctctcagcaaggttctagactgctaaatttcctatatagacttagttgttgcgatgtctttattcaaaaagaactgctttgttcttggtcttataattgtaagatattttgttaggtgagtcccatatattttttctcacttaatcttcacaacacccctgcaagactgtaatacatgttcattatggaaaattcagataagcaa

SEQ ID NO: 272213 - DNA, 287 bp, Homo sapiens
aaaaattaggcacggtggtgtatacctgtggttccagttacttggcagcctgaagtaggagatccgcttgagcccaggaggtcgaggctgcggtgagttttgatcacaccactgcactccaacctgggtgacccagcgagaccctgactcaaaaacaaaacaaaaaaaggatggtgggagcggctggaggataccaatggaagagtgatgggaccttgttcacatcccttgggccactgtgcagagaacggattgtagggttaagagccaggtggggataccagtga

SEQ ID NO: 272214 - DNA, 552 bp, Homo sapiens
gcagagcttttctttactgagaggaccccttggttccaccaattcccccaaatccccgtggctcccgatctctcatccagggggactagaagaaaagattttctcagcactagaagaatacttggagcagcaaaggtgcccgtggtgtctttctaccattcaaggggtgtcctcctgaaggcgtctgagagggcctctggcggttccaaggctgtgcagccggggaggaaggtgaggaatatcgtgggtaagaagaggcaccaaaatcacagaatagagaggaaaattattgaggaaatgtacttgcctgtgagggtgaagctggcatttcgaggtagaaggggactagccttttttgatatctaatagtttagcattatacgtaatggactcactttagcactttcatgggaggaaaaaccaatctgagctctataaatgtggctcttggcttctcactgtgcatgcttttatgtagaaccagagtccatccttagatatttattcagcttgctggcactgaagcaacaataaaaagatgcctctaacaaa

SEQ ID NO: 272215 - DNA, 761 bp, Homo sapiens
atgggttttaagctccatacagtaaaacctagcatatgaaaacagttctggctgatgggttggtagaagtgatagatatagatacatacatacacatatatgcacagtaatagatataggtaaagaccttgatatatgtacatatattgtatgatacatatccatgcatatacgtgggtgtacacacacaggtacacacaaatatatatgtgcctttggacaagaaaaaatccccaggacagtctcatttggcttttaaaatgctgcagttgaataggaccgtagaggtggcctaaggcagccttccattcagggcacgcagatttggttcctcagctcccttcttctctatttctgagtcacgtgggctgcacctatctgtcagaagcccactgcccacccagagcccctgactctgaatggtggcccagtgctttctgaagacagaggtgggacctggtgctggagacaatccattcctttcacaaagactgtaagccttacccaagcattaattttgctgcataggcggcctgttctcccacaaagcactgagtaagaagaaaaggggcccggataaaccagcagggcctggcagacaacttctggctcccttgccatttaaggtcccgaggaatgtggagacattggtgggggccagggtgggtttggaaggacggattttttcctctttgtctctatctctctttctctctgtctttttctctttctctcatagttaatgctatgattttgtaaaa

SEQ ID NO: 272216 - DNA, 445 bp, Homo sapiens
ttttaaacattctctgttagcaatcacttttaaaagactagaaaatcatttttggttttccaaaccacctccacccagtgagtcagttagtaaaagggctgggtctcaccgtttctcattgatggcatgaagcccaggaacccaagaggcagctgttgcaaatttatgggggaaaaaatacacgaaacaggaagggtgactgaagatacgcgcaacagcgaatacaattttgcaaaaccggcttctaggtatggtaggatcatttaaatccgtcagtgatgtggagaaagaacatggaggcatggctagtcctctgcacggacaggtaggtagccaaccaccagtgaggactgaaagacagtcctcactgaaaaggactgaaagtttgcagtggccaaaattatctcttttacctattcagtgcttgaaactctttccttgcctg

SEQ ID NO: 272217 - DNA, 429 bp, Homo sapiens
aaaagtaatgatccaggaaaaggaaaagaatgatccaggctttgtgtcccatctggcttgtagagcgatcatatgacagctagttaagagtgactcccctaacgtcagttcaaacttttaggcatagaaaagttatttagaagtggacttaaagatccttggattttatggctgggcatgatggctcacacctgtaatcccagcactttgggaggccgaggtgggtggctcccttgaggccaggagttgagaccagcctagccaacatggtgaaaacccatctctactaaaaatacaaaaattagctgggttggtggtgcacacctatagtcccagctacttgggaggctaacgctgaggcacaagaatcacttgaacctgggaggtggagattacagtgagccaagattgcgctgctgcactccaacc

SEQ ID NO: 272218 - DNA, 408 bp, Homo sapiens
cgacagcagcctctcgcatggctgggttttcctttacttgttttatttctgtcattcatccattgtctccgcagccatctagcaaaaaccgaaatggttattccaggctgggcatggcccctcggaggctcccaagccccacgcggcgcgcggccgggtctcctcgcgtgtcctgggggcttcgtcctgcacggccctcctttcaggcgtttcctgggtctccagtccgccccgcgttgatactggattatctgcattttaaaaacccacctaactttttcctgtggccaattacgctgtcatcctatattcgagcttcatttgttaaatgaagacgtgagtgaatggagagaaaggaaataccccaaacaattccaaaaagggttgaagaaatctgtaagtacgcaa

SEQ ID NO: 272219 - DNA, 450 bp, Homo sapiens
aaacataatagttttattatttgttactgaaaaatattttctgatttctgggtgggaagttatcttttaatgttttcacatttggactatctcaaatacagcaaagatgtataattttttttttcagagatagaatcttgctttgttgctcaggctggagtatagtggtacaattatggctcactctaacctccaactactgagctcaagggatcctttccactcagcctctcgagtagctgggactataggtatgcaccactacaaatagctaatttttctttaatttttttatagagacaaggtctcactatgttgcccatgctggtgttgaattcctcaagtgatcctcccgccttggccttctgaagtgtttagattacaggggtgagccaccgtgcctggccccaaaatatttaaaaataaaaatgttcttgaaaaaaatcttaa

SEQ ID NO: 272220 - DNA, 359 bp, Homo sapiens
ccacctgctgactctacagaacagccttctaagtctttaaatagaatggtctctccatccttacaacaaagtactgaaagtaacttgtgtacacttccactctgcctgctggtttgcattaacagctttaaccatcagagccactgatgtaagagtttcgttaactctagcatacacttgtaagaaagaagactcagaggctgggtgcggcggctcacgcctgtaatcccagcactttgggaggccgaggcaggcagatcacttgaggtcaggagttcgagaccagcctgaccaatatggtgaaaccccatctctactaaaaataaaaaaattagttgggcagggtggcgggggcctgt

SEQ ID NO: 272221 - DNA, 262 bp, Homo sapiens
tcaggattgctttgaatgcagcccaacacaaattcacaaactttcttaaaacattatgagtttttttgtgatttttttttttagtagctcataagctatggttagtggtagtgtattttatgtgtgtgtcccaagacaattcttcttccagtgtggcacagggaagccaaaagattgtacacccatgaattagaaagaacaagcatcaggaactgattaaatcattatacaacataggtatgcattaaaacacagcataaaa

SEQ ID NO: 272222 - DNA, 447 bp, Homo sapiens
gaaactgaagaagacacaaataaattaaaacatattctgtgtgttcatgttctggaagaattaatactgttaaaagatctatactacccaaagtgatctacagatttaatgcaattcatgtgaaaatctcaatgtcacttttcgtagctgtagaaaaagcaaatttggcagggtgtggtggttcatgactgtgatctcagcattttgggaggccaaggcaggcagatcacttgatgtcaggagttcaaaatcagcctgggcaatatggtaaaaccccatctccactaaaaatacaaaaattagctgggcatggtggcacgagagtaatcccagctactctagaggctgaggcaggagaattgcttgaacccaggaggtggaggttgcagtgagctgagatcatgccactgcactccagcctgggcaacagagtggagactctgtctc

SEQ ID NO: 272223 - DNA, 213 bp, Homo sapiens
gtgttttgattttatattcacccatgattgtttcttcagagtcaggagcacatcgtatatttttggcaagaatatggcattggccatgatatgtccttggtgtgtcctatcaggacacatactgccagtgtgtcctggtgtgggtgatgctaaatttgacgaactgcttacatttctccattttaaaggcagatatttcccctctgtaattag

SEQ ID NO: 272224 - DNA, 411 bp, Homo sapiens
tcttttgctctccttggggagaaccttggggctgttttgggaccatcagtggccatgagttttccattgcttaagttctctctgaccatctctcttgctcctgtcttcgttcgttgaaccctgatgtgaaccatctgacccttcctagtccccaattcttgcctagtttttgttgactctgactgacttgtacagtttctagttctctgcctataaatataaggtgacctaatccttcgatgctctggccagccctgagtggagtttgtcttcatgtgaatacagacatcttttgccttggtagttctggcttctgctgaatgttttctccctccaggcactcgctttgttgttctgtaggcacacagtttcaagcctgggatggcttggagtgttacagatgcatcagga

SEQ ID NO: 272225 - DNA, 413 bp, Homo sapiens
cctgctttctgattatagaaggtgacttcttgctgtgcccacacatggtgaaagggactaccaactctctggagtctcttttatgagggcactaattccaattatgaagcctcttccctcatgacctaatcactgcccaaaggccccatgttctaatgccatcatcttggtggtttaggatttcaacatatgaattttggaaggacataagcattcaaccccctgcacatgtcttctttcctacttcctcaaggttctttctgtccagttgctccttcttctattgacccttttttgccttctctttctccttcactgcctcaagttacagccagaggaaaggaggaactaaaacttagcaaatctataatcacatgcaaatacacagaatggattgttacaaccaaaatgca

SEQ ID NO: 272226 - DNA, 364 bp, Homo sapiens
aatcattggtttcatgtcagtttttaactacctgatattctaagcaattttttaaattcaaagtcaacattctgtgaaattattcattttgagaatcaaaagtcatcccttgtcagacgcttggtttctcgggaaacggaatgttcaagttctttgattttgccatctttaatttcctaaagtggagcagatgttctctggatataatagatatgtgtctaagtgaatctttcctttctaaatataaacttccagaagtatttgtctttatgaacaaaaataattttgccataattgtttttcataagtatgaggatgaagctttgtcaacaaagagaaatttgattaaagatttaaagtgtta

SEQ ID NO: 272227 - DNA, 386 bp, Homo sapiens
gctacgacacaggcaaatgcactgtcattcccgtcccgtggcctggagaggtaccaacctcctctaagacttcaatctctttagagaggcctgggccacaggtgattcttattattgcatggcagaagggagcaacctgctgagctacaccagaccctggctggtatccacccaccctgttatcagtcacagaagcaaatttgcatttcctcactggaaagaagttgagagcccaggctctggacgaaggactgagcatgcatccgagctccacccacacccaatttacaaacttgagcaccttaatccatctctctaagcctcagtttccccctctgtaaaatgaggcaataatggcacctgcatggacttcctgtggttattgt

SEQ ID NO: 272228 - DNA, 441 bp, Homo sapiens
tacagctttgtgtgggtttcagtgggatagagccgctttgtaggttgggcattgtctatgatagcatattacattttgagtaacaacacttgcttttgaatttttaaaaattatcacaccactaaagagaaaagtataatttaattttaaattaatttttctctaggaagagacattaaatataaaggaataagattttgacaggtaaggttaagttagatttagaggaccagatttagatttttttcctccaagaacgagtgtttgcccccattgagcatatatactatagcagactctgctttttgtatttaaaattttccgaaatcagtttggaagtggaatggctgcttcaaaaattttgactgtaagaatagattgggaaatagtgtggtggttgtgcagtgctgggcatgtaattggcgccactgattgtacact

SEQ ID NO: 272229 - DNA, 603 bp, Homo sapiens
cttgcttttgcccttgacttatgtgctcttgagcattgtacgtccttgggctaatcgcttgccttcagatcttctgcgctaggttgaggggcttggaggagatgggcctcttggctctctgacactgaatccttcctctcaggcccagtagtctttgcggcctgttgggtctgcaagtctagaaacagcaactccatgccacgggaacgtttctgcttccattgttactcaccggccttacacggatgaccatgcgctgtacagggaatgccagggctggccaagctggctccagcagagcacaaaatagagcttgctcctgctgaggtgaggtccgttcctggaattagatgctctctgcatctaggtctatcaggaaggtgagctggcaaaagatccctaaagcctttaaacatcacttaaataggtgtgtgtgcaaaattgtcttccattaacaaatatgtcaaaacacaagcctaatgttttctttggacagtttccaaacactgagcttctttctgaactgttactggccggattattgggactattcccaggtgtttatttcacatcctcctctttttgcaagtgacatttaaaata

SEQ ID NO: 272230 - DNA, 2448 bp, Homo sapiens
  misc_feature (1373)..(1373): n is a, c, g, or t
  misc_feature (1583)..(1583): n is a, c, g, or t
  misc_feature (1775)..(1775): n is a, c, g, or t
catcaccaccaccaccaccacaaccacctgcagatagatgctcaagtgattctagaagagatctcaaggactggcgctctgctccagttatgtaacccatgggcttccctttgcacagctcctcatgtgctcatctccatgctgatcaaaccaccccacctcattccttgccttctgcaaggggaagtgcctcaggctggagtttgtcctgtctacagactgaatatgcattttgcccagtggctggagatgtgctggtggtggaatgtgctggtgattgtttctggatggagagccacagccccccagtgttctgccatgactgactcctgaccttggcaaattgcctcctctctcccagcctcctccataacaggtggcgatgagtcccatttcctccctacctcacaggaaggcacgcattataaagggcacacttatcagatgtgcccagatgtggctggaacttttggagacagatacttggttcacaaccgcaaaggtgggctttcaccagagaagaaaatctctgggctgctgagttcagtgggctccttgcaggctggtccaggaagtctggtgttcctcctgaaggtggctgctatgtccagcaggtgatcaagctgacagtaccacaagaaccaagaaacagaatctgttcccaaggaatgaatgttctatctctctgacccaaaagcaagagcaagagagagctgtcaccatcatcaccctgctcccaacacaaacacagccccccaagtccatattgctgacaagggtatctgccttgtcagggtgaatcctctggacccccaggccatccctggagtggtcagtgcccactgtgccggggttattgtggccagtccgcctgggttcgcttctctaaatttccatgggataggaactatagatcatgaagaagaaacaggaaccttgactcttcacggaggagcccaggaggtcagaaccatccaccaggagggtgagcggtagctgcccagggcatccctggaggaagtcgtcatactgaggaagaaattgccaaagccaagagctcccagacctgggcagctcaggagctgacagaaaccaccccccaagtctggagttcaagggttttcctcgtgggctgctggtctgtctctttcccttctggggcagccgtctctcctccttcagctcattcccgtgttccatctgaggggcgggaggaaggcaggagggggagatggcaggacccagacagatcctcaggactctcccagcctctgttgccatggcaacactgctatttttatcccgttgttcatgatgctcaaagctctaactttctctgttccagagaggccaggctggtttctgccctcatnctttaacacagcatcttctcccagaggcctgaggatgggaaaaagtgatggagaaaaggggaacccctaaggtcacccctcagccagggggaactgtttaacaggggtttgtctctgcccttttgagcctttggttttctacctggctcaggcacccaggtttatgttttctagatcaaaactctgcatggtctccctgagagactgganaagagctgccaatcaggatggattttttcctacacaggtatgacactgcagccacttcccttcttgggaaaattaaacttcattctgaagaatgtcctgttggtggtataagccaacccctgccctcctaaaaggggatagataattaaatttggttaattagcaatcagattcactggggaattgaaaccngtacttccctttcttctgtccctccaccaaagaaccggaacaaatggcttcatgtctttgtccagtctttctgcctaaagcaaaatagcatatattctccaggctgaaaagtagattcctcctcacccctactcaagacggccacatttcaatccaggctcttgaagacagggtctaatgaaaggatttctgttctttctctgtctgttccctctggcccagcttctagtcctctccttatgtccccacctccatggcagtggcaagagacccctgagagtcaatggtgctaacgttccccacctatatacccctatgtagtttatcgagatttgaacccagcacctgggtggctgtgttgggcggatacatttcacgtcctcaagaccacaaccctggcgacaggtctggattaattctgtaaagtagcaatctatatcatgctaaattcctgcactgaggttctacctcggctgaactgactcgtggatggttaagtttcctggggtggctggaacccatttactaagcctctaattggtttcattttggctcaagttgcatggtttcccgaatctatgcacctggagtaagcacttttctggttgccactgaaaagcatgccggcaaacgctgctctgttaattgctgtaataaacagactttattataa

SEQ ID NO: 272231 - DNA, 284 bp, Homo sapiens
attttaaagaaaatattcaatttaaatagatttaatcatgtcatattttattaattatagctctgccttctgaattgcctttggttgctattacttctaccatagctaattctcctgtgttaaattttgcagatctagatttcatcaaagtttttgtatcactctggtcactaaaaagttttgtgtgatgtgttagccatggtcaattttcgtttatggtatttctaccggtaatatacattatgaactggacaaaagccctatttatttacaaatgtacagtt

SEQ ID NO: 272232 - DNA, 388 bp, Homo sapiens
gagattttatccaaaaaaaaaaaaaaagaaaacctaagaaaatacttaactcacatcaaagccaaactctggaggcctcagatcattttcatttgtcagaatcctccctcctgccaaaccagactcattttgattcctcattttcctttcatacttaacatctcccttcagttaatccattttatttagataaattaataccactgactaggttatactacaatcaagcagagctttttgtactggggtggagaatttcaaattaatcatgtctaaaaacccttttgaatataattaagcttatgaactataagttcatttttccattatattcaagtgttttagaggcactctatcaatatctttatatatacaacctatgagtttt

SEQ ID NO: 272233 - DNA, 235 bp, Homo sapiens
ccaccttgtctaccttagacaagctactgagtctctgaggtttagtttcctcctctctaagatcagtatggcatcgctgactccccacagcactgtgatgagtattaaatatgacttaattcatgtgaagtgataacacagtctctcatgcacagcaagaaccccttcccgggcaatagcttagaacaatggttctcattcccgacttggcatcagagtcaccagtggaatttaa

SEQ ID NO: 272234 - DNA, 300 bp, Homo sapiens
aaagtagaaagacttcaaataaaaaacctaatgatgtacctcacaaaactagaaagcaaaaacaagccaaaccaaaattagtagaaggaaagaaataataaaaatcagagcagaaataaatgaaattgagaccaaaaatgcaaaagatcaacaaaacaaaaaagttgtttttttaaaaaaacaaaattggcaaacaatttaccagattcagaaaaagagaaaagacccaaataaataaaatcagagaccaaaaggagatttaaaagtgatgccacagaattacaaaagattatcacaaat

SEQ ID NO: 272235 - DNA, 295 bp, Homo sapiens
tggggagagtttccaggctgtggtgtggcacggactctggaagaccctcagagttgagaagatggaactgacagtctggagaaagaggtggctgaatttcatgaagccattctccatggctgcacgaggagggagcacgcatgccaacagccatgcaggccggactgtggtgccatcattactccactgagacatggttcacaggagtactggcgcagtacagaaacaaaaagcaaagattgaaagtaaagtaatttaaatgaattatttaataaacagtaattcccctttatgc

SEQ ID NO: 272236 - DNA, 526 bp, Homo sapiens
aggaatagaaaggaacttctttatcacaataaaaggcatttatgaaaacttacatctaacatcatacttaatgcagaaagactgatgctcttcctctaagatcaggaacaagacaagagagcctttcctcatcacttccctttaacattgttctggttctggtcttagctgtgcattaaggctagaaaaagaaatacaaggtgtacatatcaaaaagcagtaagtaaaattgtccatattcacaggcaggattatccacatagaaaatcgaagagtgattttatcaaggtcccagaattcatgttcaacatataaaaatcgtttctcgttctgtatactggcaataaaaattggaaactgaaattttaaaaatacgatttgaaatagcatccaaaatcatgaactaatttagaataaagtcaacaaaaaatatgtactgaaaactacaaagcattgtttagaataagtaaagcaaatttaaataaacaacagatagattatgttcatgaatcagaagagtcaatat

SEQ ID NO: 272237 - DNA, 319 bp, Homo sapiens
ttttttctttttaaattttaaggatgaactttgctcttttagtccatttgtctgcaggcatttgcagacatgttctaaacacacccacacttgtaaaatgtacgtacttaaaatcagccttggctttgagagaacagtataaagattttggatgatagatgggctgactgctatattcttcccggtacctggtggaattttaaagccagaggaagccttatatgttaatcaaactttttgtaactagagatagtcaggaacactattggctaaaggactcaacgtgaataagacatgagatgggtttaggttcattttc

SEQ ID NO: 272238 - DNA, 96 bp, Homo sapiens
aagccctttgctcctgtgcttgtcttctgtttgctacatccatttccccctctcttcctaattattcacatcagcatagaacacctcccattttag

SEQ ID NO: 272239 - DNA, 425 bp, Homo sapiens
cacaatgaagactcggaagtgtgggaggcagaggggttgaatagagggatattaattaataaacatagtgtttgttatttgaaaaaaaaaagaaatagatttaccaattaactgaacttagaggtaggaacaaaaggctctttctgaagtcatggagtcaaacaggataggcaagtgaactcaaagccactgacctctgtctacagggaagccacaggtctaagggccagcctagattcccttcagacaatacctttgaatctgctgtgacaggcgagccagcgggtaatcaatacctcaaagccacatgccatggaatgtggctgcaaaatgtttggctggaaaaatactccaagagactgtaaccaaacacctaccttaggtattaaaaaacatcaataaagcaaccattgaatgcctaactt

SEQ ID NO: 272240 - DNA, 387 bp, Homo sapiens
gttgttggccaagctttgctggcttttttgcagctttctgttcccgcaagttactcccccaaatcctacctattttaaaagcaactctcacaggaagaaaggcttggtagccaacagatgaccaccacattctctcccccaagacgtctgatttcagaagaaattcaagaatgaatatttactgcctatatctgacagaagaatcccatttctcatgagaaaatcaatggataatactcagcgtttcttcaaaaccaaaacttcctttatcaaaacctgtagaacacaggtttcagcaaacttcgtaaaatattcagatcaaatttgggtttgttattgattttcagggggattaatctcttttatattaaaagctcatttggtcac

SEQ ID NO: 272241 - DNA, 469 bp, Homo sapiens
tcaagatccaagtattcatttgtctctaggccatggaaagggctgtgtttcaataccttgtgataaagtcagtatggcacaagtgtgcagaaaatgataaattacttaatcggggttttatgggcatttacatttatgatatgttaagcaatatttagaatttctcaaaagataaaacaaagtcttatatgagtaggaatgctttctaagcatgactgttcagttaactacttgtagtcttcaactggcgaaatctgttcatgcctatctccacagtagcagtagttacaagtcatgatggctgctaatagctgttgaagccttcccacctgccaggtgctcccagtgcgctgcatcccttattctcacaagaagctccttagttaagcaccaatattaactctgttttacagacaaagaaactgaaacctagtgagttgaaataacacagagtcaaataatagctaaa

SEQ ID NO: 272242 - DNA, 1017 bp, Homo sapiens
gccattctcctgcctcagcctcccaagtagctgggactacaggcgcccgccactacgcccggctaattttttgtatttttagtagagacggggtttcaccgttttagtcaggatggtctcgatctcctgacctcgtgatccgcctgcctcggcctcccaaagtgctgggattacaggcgtgagccaccgcgcccggcgtaaatcaggttttttaaatgtttgccaaaccttatcactgacttttataacaaaattatttactataatcattagggaatatttaagttctgctaatacttaaaattgcagagtgctaaaaccagcagtgagtttagaatcaagctaagctttattgttgctactatttgaggcatattagttgactggtgttcatatgcaaggcagtctactgggtgcaacaagggttagaaggatatttttaaaaaactgaccctattctcaggatgaaaataatacactagtaatagtctgctctgttggttaactcctcgtaaggaggtacaattaaaatgctgtagtgttgcaagggaaggagaggaagaatcatattccttcactagcaggatcaagaaagcttttatagaaatatacaaaatcttcacttcttgaaggattggtaaaatttaatagccaacattgggcacttattcattctctgagtaaatatttattgcatgcttatcttgtatcaagcattgtgatgaaagcacaagaatgaaagaggagggagaatgtttagagaataagggctgaaacacagattttgtagggagcgtaggggagactgagaagacaggttcaggttagtaagggcgctcatattttgacactgaatgttaactatgtgcacatcatgctagctattctaaatcaggcattttcaaatggaagcaggcactgacatttttgagcaaagacgtgatgttatgagataaatatcttaggggacttttttatatttttatagcaggatatctatcctatggattgaaaaaa

SEQ ID NO: 272243 - DNA, 646 bp, Homo sapiens
tttttccttttttcaatccataggatagatatcctgctataaaaatataaaaaagtcccctaagatatttatctcataacatcacgtctttgctcaaaaatgtcagtgcctgcttccatttgaaaatgcctaatttagaatagctagcatgatgtgcacatagttaacattcagtgtcaaaatatgagcgcccttacttaccttcactagcaggatcaagaaagcttttatagaaatatacaaaatcttcacttcttgaaggattggtaaaatttaatagccaacattgggcacttattcattctctgagtaaatatttattgcatgcttatcttgtatcaagcattgtgatgaaagcacaagaatgaaagaggagggagaatgtttagagaataagggctgaaacacagattttgtagggagcgtaggggagactgagaagacaggttcaggttagtaagggcgctcatattttgacactgaatgttaactatgtgcacatcatgctagctattctaaatcaggcattttcaaatggaagcaggcactgacatttttgagcaaagacgtgatgttatgagataaatatcttaggggacttttttatatttttatagcaggatatctatcctatggattgaaaaaa

SEQ ID NO: 272244 - DNA, 128 bp, Homo sapiens
taaatgttcataggagctttatttgtaataacccaaaactgaaaacaatctagatgttcttcagtaagtgagttgccaaaaacagttaaacaaattttagtacttgcgtatcatgtaatactctcagt

SEQ ID NO: 272245 - DNA, 457 bp, Homo sapiens
aaaatcagtaaattaatatgggtgtgtttgtgtgtgtgcacgtgtgtgttcactccttgctgatttatagcccccattagaagatgtaacatgctcatatcaacccatccatatgtgagtgtggcagattattagaataaatgatacgtgactgtctggggataattttcctctcctgatctcttttatgctattcctaactacagtatctgttctaggaaaaaaaatgatgattttcagtcacttcttcgcaatcacagctctcttaatggactttagatgatgtctcctcttttatacttgtatgctatgaaagtgatacacaatagcactttgatgtatttaaactttataagggatattatattaaattctgtatgattgcattttgttcaatactatatttgtgagattcatacacattcaaagcaattaaaatgaacaaaatagagctatc

SEQ ID NO: 272246 - DNA, 449 bp, Homo sapiens
gacaccgtttaaaccgcattatccattagttatgaaatgtgctgtccggtgtaggttgcttctcaaagggtcatctgtaagctggttatctagaattcagcatatttttaaccattcatttaataaatgttggtgacctattgggtattataaaagaagacaaagataagtagtattttgaaatccaggagggacagaagttgattttatagaagtttcaaagagctgtgaaatttatatatggtgattaggaattcaaggcagctttttttcaaaaaaaaagaaaattttgcttcctctaatggccaagtaacaaatttttgttgcttgtctttcactgcttctgagcggatgcttcggtattgtcacggtggctcctgagtcaacctgagcctcatgagtggggtactgttgcagcttgtaccccagagactgcctatgcattcata

SEQ ID NO: 272247 - DNA, 398 bp, Homo sapiens
ggccagcccagaccttgacttcaccagctaccataccataaaccctggtgccctgggaggtagggcctgggtgggggcagtctcattatagaaggtgagtccctggccaggagcagtggctcatgcttgtaatcccagcactttgggtggccgaggcaggtagatcatttgaggtcctgacctcaatggtttgagaccagcctggccaacatgatgaaaccctgtttctactaaaaacacaaaaattagctgggcgtggtggcgtgcacctgtaatctcagctactcgggggtgctgaggcaggaggatagcttgaacctgggaggcagaggttgcagggagccaagactgtgttaccgcactccagcctgggtgacagagcaagattccatctcaga

SEQ ID NO: 272248 - DNA, 439 bp, Homo sapiens
gtatggctagtaattgtatgtgatggtccacaaatgggaggaaaatgccttttacctgtggggtgaggctgtagagtgtagtgtatctataggtcacttagctgttaatatgaagtggccagttacatagcccaggggtgcttctctccgtaaaatagctgctgctccagcccattacattaggctgtggcttctggggtgttcttatggggacaaggtttgacaagcgatgctggggttcactattagaaaggtttggcaattcttttgctccttgtaacactcggggctcattttctcctgtcttcttagtaagttgttgcagaattgattaagtaaaagaggccagccacataatgtactgaaagaaatgtcatactagccccacattccttttatgtgaagcccttttaaaaatgaacacaacccactctttaaa

SEQ ID NO: 272249 - DNA, 336 bp, Homo sapiens
cccataattcttcgggcctctctcaagccttcgagtggatgctgtttcatatttcatccagcctgggagttggagacctgagctgcattacctaagccactgttagcagaagccaataataataataataataatgataattcttttttgtttaacttatcttttatatcttctcttattactgctctatatattccggaagatttctccaattatattttccatatcccctacttgttcttcaccgttacctactgtaatattataacttgaagaaattttttaaaacaacaaatagagacaggatctcgcgcttttgcccaggctggagtgcaa

SEQ ID NO: 272250 - DNA, 402 bp, Homo sapiens
aagaaatgaaaaaattggccttatatcccagcatgtcaccaatctgcagagtgaagagaacagctgtgaccttcagatggggaagagacaatctccagagtgaacagatgccaccagaacaaggcattcatttatgttactcatctggatcctgtgggcacttgagtttgccatctgtgatctaaaatagcactgtccagtggaaatataacgaaaaaagaaaataagaggaaaacagccggaagtgagacggtagatggcgaaagaacagagaagaaagttgactggaacggttgaaattaaattcaaatttctgagaaattcttcaacttaaaattgcaaggaaagcaaaagagatggaggatctgtagattaaaagcgtctccagagatgtaacaatca

SEQ ID NO: 272251 - DNA, 478 bp, Homo sapiens
aatcaggccttctttttttcagactgccaattgttaaacatttacctgcacatactgggctcatcttcattattggtaaaatgagctagatgctattttccattagctcacactccaattccaatcgacctgaccatcagaagagacaaaaagggaaaatcctggccagttctcccctacctgatcaaccagtagcataatcagatttgcaagacctcaagaaaagaaacctgaaaatgccactggaggtgtgtgttttgccaaagaaaaaagaatcaaaaacaaaacctgcaggatgaggacaaacaaacaaagagcaggggctcagccatgaaccttgtgatggatgaggaaaagatattctttttctccccttacagtttctggcagccaacatggggtggctgtgacaccccactagttccagaacctgcagatgagatcctgggacaaccaataaaaaaacaacaaaaagtta

SEQ ID NO: 272252 - DNA, 392 bp, Homo sapiens
tgaaaggaatctgaacaaataggcctcgctgagttccccagattattactattagatcacactcttttgtcctccaattacacttctgcacaactgtccctaaacacacatggttttccctgggtccttggggcttcgttttctgaaggtttctgtgtcactgaaaacttacattaaatataacttttatacttttcccatttaatcttttttttttctttttatttgttataggggctcagccatgaaccttgtgatggatgaggaaaagatattctttttctccccttacagtttctggcagccaacatggggtggctgtgacaccccactagttccagaacctgcagatgagatcctgggacaaccaataaaaaaacaacaaaaagtta

SEQ ID NO: 272253 - DNA, 445 bp, Homo sapiens
ctgtccctgcaccttgattctctcacagtcccaaatagaacagtgctgccatgtaggacaggaacattcattcagctgaggccagtttgggagaccacaagccagatctgagaagtccccagataggcatgggtcttgctctctctgtcagttgagtagcttcaaaacttctgttgggccaggtggctcatgcctctatttccaacactttgggaggccaaggcaggaggatcacttgaagccaggagttccagaccagcgtgggcaacatagtgaggacccatctcaacaaaaaaattagccgagcgtaatgatgtgcacctgtagttccagctactcgggacgctaaaataggatctcttgattgagcacaggagtttgagtgagctatgatcacagctctgcactccagcctgggcaacagagcaagatcttgtctctaaaa

SEQ ID NO: 272254 - DNA, 340 bp, Homo sapiens
agaggagaatgttaagccaaaagcccatttcacttggctctgtacagacagtaagttaatttccaggatgtataactcctgattttctgtgatgacagagaaaatactgacctgatttgggtaactctgaggtttggagatcttgaatagcctcatgttcctgaacttctttaccatacatgaattacttcttaggaagaaacatttattctgtagaatttggtttcgcattttatttttattttcttagacactggtagttggaaattcaggaagaatttgactacaaaaaacatttattaaaaagagtttctaatctcacctgctaagtgctacaagg

SEQ ID NO: 272255 - DNA, 485 bp, Homo sapiens
caggggtaactttgatcagccaacaagggtcagtcctatgcttatcccttgaccaatctctgtgcccagagggcagggtactctgattggcaataccttcatcgtgggccaaccactgtggggaagggggagggattagaaaagacagccacacccaaatctcatgaagcagtcccctttattttaaaaaagtccctgtgagagcaacaggagcaaagcatggagaagaagcaatcttggagaagctggaagagaaccgacccaaagaatccaagagactaagactgtgcagggttggggaacggaagctcacacaggaggcctggacagagctgcagcagagccaggagagaagccaagtggcacagctcatcttgaagtaattataatgccactaaaattctcatttgtattaattttttttaattactggcaagataaggcaaatgtttttaaaggcctaaataaaatgatattccctgaag

SEQ ID NO: 272256 - DNA, 1422 bp, Homo sapiens
gtgaacttttctgtgaagaaaaccaattgtgacagtaggggtaaaggaaaatcaactccaaatggaatcatgttttattcaggatttgtgctgccggtggggaaggccagacccagcgacaggatgggaaagtgggacaccccaacttcaagctttgtgcgttctgccacgaagttctatgcgcttcactgagctcagctcctggggacctctaatggcccttgatagcaaacatagttaaaaattaacagactgacagaattaaatatggatgacaagcaaccactgtggacttaatctgacacagggtgttacatgcttgggtgcttttaacccaagtggcatctcaagtgaacttctgagatgtctgggcacatttcacatgcctgtttggaagcagggcttagcttgtgcttaggacagacaggaaaagagtctaagagcccaggagagaaaattctccctggaggcttttgtttcattaaacccagctttgatcaggcttaccaggatgtactcacagtcctaggaccttgtccttgtggtctagaccttgtccctgcctgggctcggacctcagtagcacctgccatcgtgactggaagatccggcaagagcacaaggccagcggggagcatggcctcctccagctaggactttcttgctcacctcttttccagctgttggggcaggtgagatggcagccttaaccaaggaccaagtcatacaaatcttgacattctgcctagatcatagcgacttaattgccctaggcaaggactattaggtgccagacaggtagtgaagaatgctgatggcgttttcatgcctgagtctgctgagaaagagtataggctgccgattctggggggcagggagaagaggagtggttcctttacaagagggcctcatttcatgcagcagcgaaattcccaaaaagtgttcttccagttttggtgagtgcttttttagaaatggaggtgagggttgctgtttaaaagaatcttgcaatcagcgctgtaaggaagacaatctttttgtattgcacatcatccctccagcctattcgatgagtttggagtttcttggaccagattatgctgggcttggcagcctctcttcagcctggcagtctctgacagagcttgctgtaatggcctaacgtgctttatttggtgatgccacccaaaagtggatcctgaggtctggagcgagtagggcagagctgatggtaggtagtcactgtgtgagtggttccctgcagttgctcagtgttgggaacgagccccacagcgaacttcagcgctccattctagggagagtcatggaaacctgcctgagaatatccatgccttcaaaacattaacccattagtttgagataacattcttgtcatttacataaaacaacttgttcaagcta

SEQ ID NO: 272257 - DNA, 97 bp, Homo sapiens
agtcaccttaaccatctctttcttcataaagcttgcctggctctccaaatgtaggttaattgctctaccgtgttggttactgctgtagagctgtgtt

SEQ ID NO: 272258 - DNA, 435 bp, Homo sapiens
cttctaccatgtgacgacgacagctagaaggtgctatctataaactggagagtgggccctcaagaatctgctggcaccctgaccttggactttccatcccctagaactgagaaataaatttctagttttataagccacccagtttatggtatttgttaaagtagcccaaatggactaagacatgtgctagtggatatagtttccaaagtgggcaactggtggtgcacatttgtggaacattgaggaatatcatggtacagtgatgcagtggcccctcaggaagctaatttctatttttagacatgtgggcataaaaatatgataggagttctgaaataaccaggaattcagatttcttatggtgagctatttcttccgtgatctttccctatacccatatgtcaaatcatgctaagggtgaggaaagaatgatga

SEQ ID NO: 272259 - DNA, 187 bp, Homo sapiens
tagtgattacagtgtttaagtaacggaggatattcctggataggaaacattacatagaaaacaagttgtgtccatttagcacctgagatacagcattcgctaattttagaaatcacaaaataattcagtctattgtcatatacaaatctgaatttatgaaatttgataggtgtcttataccatcttg

SEQ ID NO: 272260 - DNA, 145 bp, Homo sapiens
gtggggcacagaagacaagctttggaggacatctcataaatcttctaattcaattgcacttaaacaagaatcctctctacatcatatctagataaataattactcagtttttgaagacaggctctctgtggactgcttgaagtaa

SEQ ID NO: 272261 - DNA, 250 bp, Homo sapiens
cagaaacagacagtagaatgatagctgccagggactggaggctgggtaatgaggagatgctgatcaaagagtgtaaactttcaggtataagatgaacagattctgggaatcaaaggtacagcacgggtggagatggatgtgttatttcatttgattatgtcaatcattgcacaatgtgcacatacatcaagtcatcacactgtataccttgagtttatacaatctgtcaattaaatatgttcttttaatt

SEQ ID NO: 272262 - DNA, 468 bp, Homo sapiens
agtgcaatggcatcgacctcggctccctgcaacctctgcctcccaggttcaagcgattctcctgcctcagcttccctagtagctgggattacaggggtgagccacggcgcccggcctcaaatgtcttttaacaggaaaactgatcaatatattatgttatattcatattggtggaatattatagaagagtgaaaatgaatgaagtatggctacacacaacaaaatggttgaatctcaacctaatgttgattgaagttactaccaaaagactgcttatggaatgataatccttgtataaaatttaaaaacctggctgggtgtggtggctcacacctgatcccacccagtattttgggaggctgaggtgggaggattgcttgaggccaggagttcaagaccagcctgggcaacacagcgacactctgtctcaacaacaacaattagccaggtgtgatgttgtgtgcctat

SEQ ID NO: 272263 - DNA, 613 bp, Homo sapiens
cgtagcagttcccaaattattgttttgttgaagttggatttttactaattctctaaaagcaccataaaatgtagtgctgaaaggaacctgacattgtgtagcccagtttcttttcccataagtatgaccccaagcaagtgagtggcctgcccaggtctcgtggggtgtcagaggcagaacttgggctcctggcaccctgctcattattttggtcacagtgaggaccataaacctactactacgtgtaaggcagtgttgggaagggacaaacaatgtgactgtgtacattaatttctttttaaactagtcttctagaatttacacatccaaatccatgttgcttttaaaaagtagactatgcagatgctgaaaaagatgcctcagcactggtttagtctgtctgaaaatagtttcaaaacagtttgaaccaagaaaatattactgaggcctggtgcggtggctcacacctgtaatcccagcactttgggaggccgaggtgggtggatcacctgaggtcaggagttcaagaccagcctgaccaacatggcaaaaccctgtctctactaaaaatacaaaaattagccgggcctggtttcgtgtgcctgtggtccca

SEQ ID NO: 272264 - DNA, 445 bp, Homo sapiens
  misc_feature (416)..(416): n is a, c, g, or t
tgactggggcattaggatgctgaaggcaagtctcaaccatgctccgcagtagctgtgtgaactgggacatgtcactttctgtctggtcttgtgtctttaacagtaaaacagcaggttgggttcgaacatgactctgagattccatccagctctaacagtttatctaggagtatttgctgccattggcattacatgctacattataggtttccttccaaaatccttttttggactttaattttgaccattttcttccaatagaatctagtatacagacttcacttgatttctaacagtcctgtaaaaccgtgacttagtcaactggccatacagatccagctatgggagttaccctaagagatacctgtctgctcttgccctgtatgtccatgtgcctaccctttggcctgttcatnacgccttgggctttgtaataacctacctt

SEQ ID NO: 272265 - DNA, 832 bp, Homo sapiens
ccaaaatgtttcaaaaaatcagacccagttcaggtaccgtggaagacagctgtcatggagggggcattgcttcccagggtgctggggaaggcttccaggtacaatccacaccacccactctttgctgttgctcccatccttgagggtttaggaaaagagtcagtgggctctgagtagaagcctgggagcctctctccagtgacatacatgggaaggaacttcctgaactctatttcaatactttttgaggccttttctttttcttgtctgtgtttggatgagatgatatggagggtgcatgtatcttccctgttataaattctgagagggcagaggcctatgtctgcttcttcacctcttcctcggcccctaacacagtgccttcatgtgctttacatgtaccaagtcctcgataatccttggtaatggattattatttcaatgtgtgcttatctgtgctctatctcataaactaagaaagtacagactgagggcagcaggtccagcctgtacttacagagtatgccctataaatccattaggaattataggccaggcaccgtggctcattcctgtaatcccagcactttgggagaccaaggcaggtggatggattgagtccaggagttcaaggccagcctgggcaacatggcaaaatctcatctggacaaaaaattagccaggtgtggtggtgcatgcctgtagtcccagctactcaggagctacttagtggggaggatcacttgagtccaggagtttgaagcctccagtaagctgtgatctccccactgcactccagcctgggtgacagaacaagaccctgtctcaaaaa

SEQ ID NO: 272266 - DNA, 406 bp, Homo sapiens
acaaaccccaccattgcccctgtcctctctcatctctactttccacattgaaaaataataaaagaggccaggcatggtggctcaaaacagctataataccagcactaggatgccaagatgagagaatggcttgaggccaggagttcaagacctgcctgagcaacatagagagacccaccccccagtctctgcaaaagctaaaaattagctgagcatggtgggatgcacttgaagtcccagctacttggaggctaagtcaggaggatcacttgagcccagaaggttgaggctgtaatgaaccatgattgtgccactgcattccagcctgggtgacagagtgatatcctgtctctaaaaaataaataaggtaataataataaaataaatgccctccaggagtttcagt

SEQ ID NO: 272267 - DNA, 602 bp, Homo sapiens
ttttacaggtgggtcattttaattcattttagacaaagttttgcattgttctaaatgcaagtattcctccttggcttaaatgattgatcaaacctaattcttttggttcttattgatataaatcatactgttccttgattgtcaactagcattttaaggaattccctaaattccaccaatagaattctcaatcttattggtcctacatgcctcaaagaattaaactgaaagaaaaagttctttcggcaacaccaatatacaaaaatacagtgaaaacaggcaaaaagatgataccccctccccatttgcaaaaccaaggtgactattcatggtaggtgatgacaaagacagaggtgtaaagacaaaacccagaggtgttgtaatttagagggaagactattgttcaaatacaatgagacctttccaggagaccactcaccatttcacagaatatccctaagcttttttgacaaatgacctttcagaccaggtccagaaagtgtctttagctgaaatttcatataaagaatattccacctgttaaataagcatcttggtttactagtggccatcaatacaggtttcactattcaagacagcta

SEQ ID NO: 272268 - DNA, 496 bp, Homo sapiens
acagccccaaggttattagtggatttcattctaaatgattaagttattaacgtattaaattatgaatatatcttcccattgaaacaaagttatcatgggtgactcagttcctgtgtgtattttaaaatgtgtttcacattccagtggaagctcctagaacgcaagctgcttggcatcttcagaagagaagtgaaagggaaccgggatggagtcatttgtgggcacagtgcctacagacacattgtagccattcaataaaagttgaggaagtgtttctaggaatagatggttggagggagagaaggaggaaataagcctatgtttctaacatgaagctgcctgtgattgttgtaataaacatgggtttattagaacaattgcctttggtggtttaaaacagcatttcaaaattccatctgttttgttgtccaatccctgagtcccaaagtagtgaacaatttgagagtcatttgaagtgagtaattcaaaaagaaaa

SEQ ID NO: 272269 - DNA, 324 bp, Homo sapiens
aagtgaggtgctcaatagatgttagaactggactgtgtcagctgggtgtggtggtttatgactgtaatcccaagccaaggcaggtagatctcttgagcccaggagttcaagaccagcctgggcatgatagaaccccgcctctacaaaaaatccaaaaattagccaggtgtagtggcatatgcttgtagtcccagctacttgggagctggggtgagaggatcacttgagcctgggaggttgaagctgcctgggaggtttagccatgatcgtaccactgcattccagcctgggtgacagggcaagactctgtctcaaaaaaaaaaa

SEQ ID NO: 272270 - DNA, 180 bp, Homo sapiens
aaaatattctccacactatggcatggtgacatggtgatttgaatcaccactttgattacacactgcctttacctgtctatattctatgttcttcttttgtaattgaaggcactacagaaaagaaagaagagctcagaggtagaaccatcctgatgcttcattggggtgaattttagaatg

SEQ ID NO: 272271 - DNA, 548 bp, Homo sapiens
aacagaatattactttttttctttccattattggttacaccagctagttagagacttggggtaatactgtgggcatgggttggatcctgatatctgtgtcagttagtgagagttggttctatgaccctagagctctttgtgtccttcaaacgagggtgctgaaacaagacgaacatagaactgtctataccaagcaaaaaactcctgaaagcacatgcccactgcaggtgaattggtagcatagtgtggagataagtgggcagtgcttggtcctgtttctgcctcctagagagtacctctcagcatccagggatgctttagtaactcttagttaaaacgaaatgaactataattaattacctttcttttgggagggacacagagagtttcaacagcatctacaatgctttttttttttttttgaaaagaaaatatgatagaatattaagattgacagagctggggatgggttggaggctgaattatgatgtgtgttttctttatgcttgaattatttcataattaaaaacaaaacatataataacaaa

SEQ ID NO: 272272 - DNA, 401 bp, Homo sapiens
agtatcacagccacagaaaaccagtttggaacattccagaactctggggatatataaatgtgcctttcctgaggaaactaccaaaggatgatcttcatttaagcaaagaataactagtgaaactttacaaaagaactgacattgagtattccatctctttaattgtagacaaagactaaaagaaggaagagtatgctgatcagaaaaggaataaactgagtaaactggtgagatatcttgacaaaggtctgtcattggttaccatgaaaaacatctaagcaatactactggtcatcagccaaacaactgatctctaccacatcactaagaaacatagtttattatactttccctctttgatgttactgtcaaagaatagaatttatgcctaacatcttagt

SEQ ID NO: 272273 - DNA, 185 bp, Homo sapiens
atggataaagctaaatatcaactcaggattttgcattgagtaaatatatattttctgcttcacttggaaattgtaaggctaacttactctagcacccataaagtcttaatccatttcttttacatatcttaggtatcaaaaatgggtaagaaatgcagtggtgataaggagtatttgaacatctt

SEQ ID NO: 272274 - DNA, 466 bp, Homo sapiens
gaagcctgacattttccacattgctcccaccccttgctaatctttttatttaaatttttgattttgagataattgggttataagacatagagagatcccatgtacctttacttggtttcctcaatggtagcatcttgcagtactaaaatacagtatcaccaccagggtatggacagcgatacaatgaagatacaggacaattccttcactacggggatccctcatgttggccttttatagacacacgcatttacagccacttccctctgttgcccccattaccctgcctgcttacccctgccaactacttatctgttttccttttctataattttgtcacttcaagaatattgtatgaatgggatcaaacggtatgtaattttttgggattggcacttttcactcagtataattctctggagatttcatccgagtacattgagtatatcagtagttcattcattct

SEQ ID NO: 272275 - DNA, 250 bp, Homo sapiens
aataaaaacaaaaacaaaaaacaagtcctaaaacagtaatagctttcgtaatacattctttattatttcttatgactacaaaagtcatctcaattctcaattctcaaacacagatccagttgaagatatctactgaccttaataacattttaaaatttaatagctcagttgtttctgccccattcttataatgcctatagaaatttaaactatctagcacatagaacttagtttctagctgatactctaa

SEQ ID NO: 272276 - DNA, 158 bp, Homo sapiens
actcatgtgggaaccttctaaaaatatagatcctgatccagcaggtctgggatggggcctgagggtctagatttctcacaaactcccaggtcatgcagatgctgctggtcccaggagtagaaagattctagagaaaataaactcagagaatgtaactt

SEQ ID NO: 272277 - DNA, 152 bp, Homo sapiens
atatactgacaggatgccaatttgttttaagtgaattcatgttactaccctgcacaataaaataatatacaaggctgtgctttgtgaattatgagttatattagtgaatatcattttctgattgcctgcatttttcctattttatatacatg

SEQ ID NO: 272278 - DNA, 352 bp, Homo sapiens
ccattgtgaaataagggctattgcaaagaggcaactacccgactcctatacaaggtactgacctaaataaagcatcagagcaaagagaaataagtcttttttttttttttttgagactgagtcttgctctgtggcccaggctcactgcaacctctgcctcccgagttcaagcggttctcctgcctcagcctcccaagtagctgggactacaggggcgcgccaccacacctggctaattttttgtatttttaatagagacggggtttcaccatgttagccaggatggtctcgatctcctgacctcatgatccgcccacctcggcctcccaaagtgctgggattacaggtgtga

SEQ ID NO: 272279 - DNA, 524 bp, Homo sapiens
taaggtcttcaaattcttatagtacagatgtttttcatctttttcatatgtagtaagtttgtgactttgatgtaatttttggaattcggttcagggtattggtgttggaagggacctcagaggggaaaatgaggcccaggaaggacagtggggcctgtatacactagttaattgcttggtccagtgctcttctcatgacattaaactgcatctcattggcctggctggaggtctttagaaaacactaacatgttgagaaatattaaaaacaacataattcttctcagtaaaagaaactaaggtggtggaataaacttttttttatgcgtgtttttgagtgtcaaattgtatgaacacttggtttgagaagatagaatgttttgcgaatgatagagcataagaatgaagctgggaagttaactgttagcgagagcatgagtttagggtaatattcctgctctcctattgactatctttgtgattgggagcaagttagagataaccctgtcagggtcctcatctat

SEQ ID NO: 272280 - DNA, 506 bp, Homo sapiens
aaaaaactccaattaggactagagtctcccttacccctgcttataggctgacctctcctaaacaaaactatagaccaacccctgaaacacaactaggatcttcagcttcccaagggcactgatcaggtctgattatactctgtctcccaggcatgaagcacatagtaggtatacaataaatgtgggctgaatgaatagacagttgactagtagggttcactcaggtctctgttcaaatgccacgctgtcagagtccctccctgtctatcccatcagaaatagcaacccttcccaacccctcttaccctgcctgcttccctgctgtggttttcttagcacctacctcttcttgacacagtctctattactagttcatccggtccctgtccacccctccccactaaaatgaaagcaaatgagggcaggccttctgtcgtttactgctatacccccagctcctccccaagcaggcacatagcaggtgctcactagatatttgtatcaaa

SEQ ID NO: 272281 - DNA, 474 bp, Homo sapiens
agttacccatagtcccaatgtgagccctgtgtagagttactgtttttagtccttctaacctttttggcagggggagggggccaaaacagcctcagctgtactggaggagaacagctggaaataaacagccaatggatgagaaaacttgagggtcgatatcctccagttgccaagttctatcctgcttagcaaagtctctgtgctgcttcattcttcatttctaaaagtgaccttcaacttgatttccccctggccctcagtgtaaatattggcctggtcattgaggtcgtccaaagaatgatttggtctcttgtgtaaggttgccagatttagcaaataaaaatataggacacccagttaaatgaatttcagataaataacaaataatttttatttttatttttatttattaatttattttttgagacagagtttcactcttgttgcctgggctggagtgcaatggcacgatct

SEQ ID NO: 272282 - DNA, 683 bp, Homo sapiens
caactagagcatgcccagaggagagctataagaaagggaatggactacaaaacgaggtccatgaaataggaaggtccttagaagcagttccccctgagcgatcatccagcatctcccaagccacatgcctgaacccctagccctgtcctgtcccctcccgttaaaggctctgcccttttctgggtcctggagcctgggtcatagcgttggccattttcccagcacttccactcagttgactgcctcattgggtcagtttaccttcacaggatttcttatcttcatcccttctttctgagtccccacagtcaaccattcttcttgtacctttcctgagctattgcagcagattcctctctggtctccctctttctctcctacaggtgtccaaatcctaccctagagtttactaaacacagctcaggtttctctcatccccctcacctcacctttatttctgatgtgcccagtctgaaacattctctgtcctatttactaaaatccttcccttggtttatagcccatttccttcagaaaacctttctgtattctctttgaaaagagatttacttaggcacctgtagtcccagctgcttggaaggctgaggttggaagattgcttgagcccaggagtttgaggccagcctgggcaacatagtgaggccccatctctaaaaaagaaa

SEQ ID NO: 272283 - DNA, 267 bp, Homo sapiens
ggtgggggtgggagggaacagggctgtaaggggcaggaatggctcctggagctcactcattccccatctcaagtgttgcagagcaggcgagatcagtggggaggtttcgactggttctccccagaagagggaagaggatgtgtgccagtgccggcctgagtgttcccaggtgagcaggcacctgcttagggagaagtaagcactatcctccagctctggtcccccaccgtgcagatgagaggaggaagaggcctgggctggggtgag

SEQ ID NO: 272284 - DNA, 513 bp, Homo sapiens
cattaatatagattgagaattaagatgctgttttctgctgaggatggcaggagggaggtgtgttccagcccacagggtgatatggttgtcctgacagcagtgaactcctagggtaaaagcagcagtcagactggctgttagatagcaggtctctgggagctcccagggaattgggtccatattgtggtccctttttggaatcaaattctgagatgtaatctcagaaggagaaatagagttatgaaagaaggtaatgtaatagagaagaaagaatctgaagatgtgggttctaatcctggcaacatgcctaattacctatgtgacttcaggaatgtcacttaatacctctgggcctcagcttccttacctgtggaatgaggtggttggactggattagtggtacctgaccctcactatacatcagaatcaccagggaaacttttttttttgagacggagtctgcactccagcctgggtgacagagcgagactcagtctcaacaacaacaacaac

SEQ ID NO: 272285 - DNA, 492 bp, Homo sapiens
caaaggaacttgttgaaaaactaaacaataaaagaacttagtaaagtagctattaaatacaatttacataaaaatatcagtaggcttcaccagacacaagtgcatactttgattccatttcggtgaagttcaaaacagacagcatctatgtatggtgtcagaaatcagcaccctctttcagtcactacctctcttcccaaaggtaagtgctgtcaaaattaccatcaattagttttgtctgtttttgaattttatatgagtggaaccatatagtatacattatttttcaactggctttaactcagtaggactgaaagagggtacaagggagactctgcggtgctggtaatgttctgtttcatgatctaggtgctggttacgtaggtgcattcaccttatgaatatttatcaagctgtatatgatttgtgcacttttctgtatgtataattatagctcagtaaaaatgtttactaaaaagagtaacaagacta

SEQ ID NO: 272286 - DNA, 324 bp, Homo sapiens
aggtctccaactggtttatagtgttattcaaatcctctgtttccttactgatcttctgtctagcttctgtccattattgaaatctgagtattgaagtctccagttattgttgtaggactgtttatttctcccttcaaatctgtcattgtttgcttcattttggggccctgatatttggtgcatatatgaattgcatgttttaaaacttcacatatatacaaatatatgtgaagatatatatatatatatataatctcatttaggccacagcctcttataatattctttttgtgtgctgaatatatttttaggattcatccatgt

SEQ ID NO: 272287 - DNA, 382 bp, Homo sapiens
gagcacagaatgaatgataaaataaatttatttatacctatattgataagatatgaatatatacatatatattggattagtcagggtactctagaaaaacagtaccaacagtatgtggggacacacacacatacacacacaaaatggggactagcaagtatgaaatttgcagggtaggtcaacaggctggaaacccaccaaattgctgatgttgcagtcttgagtctgaaggcagtctggaggcagaatttctttttaggacctcaggttttttttttttttttggcctttaagtggttggatgagatccacccacatattgagggtaacctgctttactcaaagtctactgatctaaatgttaaacacatctaaaaaaaaa

SEQ ID NO: 272288 - DNA, 426 bp, Homo sapiens
aaaagttgtctttattaaaaggcatatgtgagagcactataagcatagcatgtgctgactatgggtaaaaacaaagaaaatgaacagtgagaaaatctgttaggccagatccgacattacaggaaacatcgcagcttcacttcaaaacatacatcgccactaatgaggtgagagccctgcatattaataaacctacagctccagtcatagccatcattacccacatcaaacataaatacaagattaacacctatgccatttcttgggaagatgtgagaatgccctggtagtaactgctgtctctttccctgaggataaaaaatagaaatgcaagggtaatgagaatagaatttagattaagaaaataaaattggcaatcattctggggccatcttacacagatgcagaagtttatagaagaaaaaa

SEQ ID NO: 272289 - DNA, 340 bp, Homo sapiens
gttccctgaccaccaggcctgggcttgtccttgattgcgcctcctctacagctttatgcctgaaagccgtcccagctgcatggagactggggtcacatatggccagaaggctggggagagcattgttctccgtgtccgggggacaggccttctgcaagtgaggtgctgaggagccctgcagccctgggtcctggcaggacagtgggaggggaagagtgagcttggggtaaggcagctagggttcaggattctcattggatcatttctagggtgagcccggatacatcactttcatacctgcagcccgcccatctatatacagtagtggcagtgatgctgc

SEQ ID NO: 272290 - DNA, 485 bp, Homo sapiens
tagggactttccccacccccattttgcatatgtatgtatgtgagccgtacagggcgtattggtgattgaggaatgtcagctcataaaatgaggcttccttgtaattctgtttaaatgacttttcctttgaaattcttatccataccttatttggcacacaaaacagatatacagttgacccttgaacaacacaggttagagctgcatatgtccacttatatgtggattttttttcaataaatagaattggccccccatatccacaggtttcacacctgcaaccaaatgcagatcaaaaatacagtattcgtgggatgcaaaacctgcagataggtaaggccaactttttgtatacttggattctgcaggttcaagtgtggggcttgagtatgcatggattttggtatctgcaggggtcctgggaaccaatgtttacaaggaattcacaactttttttaaataaaaaatgtgccttataaaaaatg

SEQ ID NO: 272291 - DNA, 417 bp, Homo sapiens
gcttttgttaattcatttcctattacctaattttttgtagcagatacattttcctatgaggtatgccagcaggtgaaaagaatgccttcatcagacagaaaacagagattgagcttgtccactaaaatcacgtatgtggaagtgatagatctaattgacactgttgcaatttttgagcagcaagactacctgcacattagaaaaaaaaaaaaaaacgttattgagaaggggagtttagtggggctcactggtgaaaactgaagttaatgtcagcattatgttcattgttctcagcatggaagcctttgattctgattagaagatttatcctttggcataagaagataattttaactcagcaatgtgtcataaagggtggataattcttcaacaatattaaaataatactgtactact

SEQ ID NO: 272292 - DNA, 429 bp, Homo sapiens
aattatccctttgaataaagtttctaccccatctctctctctccctttcccttaaggcccaaaactcctaaatttgcccttttgaggttattttctagatcttgcaggcatgttacaatttttaaattcttttatcttttatacataatcctttgattatgtataatcacagtcctttgtgtattttcaaatagcctgttttcaagattactaattatttcttatgcttgatcacgtctgctgataagaggttctgatgcattctttagtatgtcaattgtattttcatctccagaatttctgcttgattcttttaaattatatcaatctctgtaaaatttatctgataaaattccaaattccttctctgtgttatcctggattttgttgagtttcctcaaaacagctaatctgaattcattttccaaa

SEQ ID NO: 272293 - DNA, 492 bp, Homo sapiens
cataaacctgtagaggagagggcctttctaaatgtgactcaaaactcttgaaatctctcttgaccccatgtctcagtcagtttcaacacaatctttgttccctttcaaagcaatattttagttagttacatcccattctctgtttttcaaaattattaaatgtgacacatactgaagagtacaaaaaacataaaatgtacaatattcaatataaataaattacaagatgaacgcacaagtaacaacccaggtacatacattcagcattactaaaattctataggtgtatatgacaacttctgacaaccctgctagagccaactaatatcacaactttcacaactattttctaggattttattataaacatgtgagctcctaagtaatgtaattttgtttggcctgttttcaaactttatttaaatggaattacattgtttgtattcttttatgccttgcttcatttgttaataaaatctttataagattcat

SEQ ID NO: 272294 - DNA, 601 bp, Homo sapiens
cagccggtccgctaggatgcgcctattgagaactggttataaaatagaaaataaaatactggcaacggaaccagctttgaactgggtaaatacacaggcaatattaacaattctaactaaattaggacaagctgacaattgttggcttatgttaagtattttctttactgaatataagtacaatataactaaagttctaacagaaaactgcaatttgcttgaagaatttaaaacccaaggttatacagactgcatagagcatgaacaactaataaaaataaaaggaaataaagagttttgcaaagaaagacttgatacagctctattacaccagagccactgaatagagacctgaaaaccattttctttatagtaacagagctctttgttttcttcatactggacagtttagaacacagtcccatggcataaaatttggaaaatagaagagtttaaaaagaaaataaaaatcaccagcaatccaaccaccttgaagaatattgctgtattaatgttattcaactttttttttttttttttttttttgggaaaagggaattcccccccaaccccccggggggaatggcgggggggaaacccc

SEQ ID NO: 272295 - DNA, 365 bp, Homo sapiens
acaggttgaagagcttgcagaatctctgtgccacgcttgccaaggttcttgcatccctcatctgtcatagagaaagtggtggagataaaattgtgccagcagcaccttgtcaaacccctgctacaggcatccattgtgagtcatgggataaaggataagagagcagccagaggcttcagcatcatatgtctgagttctgcagaaaggaccaggcccagaagactcctggcttccacacatacccatgaatcacctgattaaggcccactctcaggattattcccctatcaatgcactgaatctactttcaaccaaggtaccaaaaacttcattgctcaatctaataaactcctttcaatgaagtc

SEQ ID NO: 272296 - DNA, 460 bp, Homo sapiens
tttgtgttaggctggcactgggttgggtgacaatcctcaggaattgtggagcctgactcccttggaagttctctgccagctcgctgaccccagtcctcgtaaacacagttctttgccaagccctttccttgctccaccgctcactgtgatacgagccccactccaaaccccagactcccgaactgatctcatgtaaacttcaggaccatccttttggggtcctgctcttgcggttgcgaaattagtttgaggaggccatgtgagtgaatttctacagcataaaagaaatcactgatcatctgaccaggcccagaagactcctggcttccacacatacccatgaatcacctgattaaggcccactctcaggattattcccctatcaatgcactgaatctactttcaaccaaggtaccaaaaacttcattgctcaatctaataaactcctttcaatgaagtc

SEQ ID NO: 272297 - DNA, 425 bp, Homo sapiens
taaatcatttccaaacccttactgctgtaattttgctttcctgcaagtgttcataattataaataacggctgtgatgatcacctttgttcatgaatgtttgtgacaatatttttatcattttcttcttttaaattcttagaagtgaacattgctgacgaaaactaaaaatatttgaagacttttactgacatcagttgttttccagtatatcgataaggactggcattcctaccagcaggcttggaatttttggccataaaaatggaaagagaaagagaccttgtggtcagcattacatttctttaaactgaacaggtcagcctatttctgtgcaagctttatattcactttctatgaacgtgtgcctccttttcactctgctatgtaagacagatgcatagataaatatctatcctttgttgca

SEQ ID NO: 272298 - DNA, 388 bp, Homo sapiens
tgcttctcctttccaaaagtcttacaagggcatctctatgggagagcttaaatcatatccaccatgttagctgcgaaggaagtctgggcaaggttatgttctactttcctgcctctctggtaataggatgtgcactagactagaagggaggtgcagaagatataaagctagcgaattcttaagaccgtgcaatatttattcctctgagcctcagatctgcaaaatagggatattatctattttgtgggacatttgtgtggattgtacaagatttatattacattatattatatattagaatttaccagctctcttgctttagtatttcactgaagatttgtcagtcctgtgatacttaaaacaaacaaagaaaacacaagagaattta

SEQ ID NO: 272299 - DNA, 430 bp, Homo sapiens
tgcatcttgagaagatcgtgtggttttagtcttcttttaatatggtgtattacattaattgattttataaagcatgttgaaccagtcttggattgctgggatcaatcttacttggtcatggtgtataatccttttagtatgttgctgattctgtcaatggcttttatttctatagtcatatgaaatattgctgtacaatcttcttttctcgtaatgtattttacttgttttagtatcaggtaatactggccacatagaatgagttggtaaatatttctctcccattttttgctagagttaatgaaagattaatgcaaattcttctgtaaatttttggtagaattcaccagtgaagccatttgatcatgaggctgagtgctgggattgcaggcagaatggcacttttatcattataaaatgttaattgttt

SEQ ID NO: 272300 - DNA, 485 bp, Homo sapiens
tgcatcttgagaagatcgtgtggttttagtcttcttttaatatggtgtattacattaattgattttataaagcatgttgaaccagtcttggattgctgggatcaatcttacttggtcatggtgtataatccttttagtatgttgctgattctgtcaatggcttttatttctatagtcatatgaaatattgctgtacaatcttcttttctcgtaatgtattttacttgttttagtatcaggtaatactggccacatagaatgagttggtaaatatttctctcccattttttgctagagttaatgaaagattaatgcaaattcttctgtaaatttttggtagaattcaccagtgaagccatttgatcatgaggctgaggcagaagaatcacttgaacctgggaggtagaggttgcagtgagctgagatcacgccactgcattccagcctgagtgacagagtgagactttgtctcacaaaaaaaaaaa

SEQ ID NO: 272301 - DNA, 1471 bp, Homo sapiens
gtgaggacatgagatttgggaggggccagagatggaatgatatggtttggctgtgtccccacccaaatctcatcttcaattcccacatgttgtgggagggacctggtgggaggtaattgaatcatgggggcagatctttcctgtgctgttcttgtgttagtgaataagtctcacaagatctgatggttttaaaaagaggagattccttgcacaagctctctgtgcctgctaccatccatgtaagatgtgacttttctccttgccttcctccctgattgtgaggcttctccagccctgtggaactgtgagttctccattaaacctcttccctccattaaacctcttccctttgtaaattgtccactctcgggtgtatctttatcagcagcatgaaaatggacgaatacacatatataaaaattttacatgtataaaaatgaagctgctctgacagaagctgttagccttgtgctttgaaattctcttgtgtagtacttttccccacctcttccttgagttacattactagaattgaacatggagatcaatttgaaaaccactttctagtctagattcttccttttctagatgaggaagctgaaacctattgagtttataattatccttttctttggttttaatctgtaaagttatctggatttagaacagagaagaaaaaaatacatctaaactaacactgattctaggacctttcagcagtgtgcaagtctgaacgtcttccctgtttttgttcatgttatcactactgttgttctgggtatcatgccaaatttagtgcaatactctcttatattagtttcctagggcttctataacacattatcataaactagtgacttaaatatattctcacacagttctggagcgcagaagtctgtaatttgtgctatgcatcctatttcaaaatcaagccgtgttccctccagtggctctaagggagattttgttccatgcttctttcagctttggtggctacaggcattccttgtcttgtggctgcataactccagttttttcctgtgtctttacatggccttctcatctctctgacctcactctgtgtattttctgtaaggacacttgtcattggatttgggatctacctggataatccagtgtcatctcatcctgagacctttaacttaattacatcttcagagactcatttttccaaataagataacaggttcatttcacctaattactctttctgcatctgtgctctcttttttccagtacaatatgtgaactgttagaccagttttcctatttactcttgttaattttttgacttcctgtattttcaacctgcaatattctgtttctcctcctgactacactttaagtttcccaaggtaaggagcatgcttcatctcctttgtccttcctcagcataaatgcctggcccatacaggtaggttgttaaataaacgttagtttaaaaaaaaaa

SEQ ID NO: 272302 - DNA, 475 bp, Homo sapiens
ggtttgtgactacaaatttatttaattgacatctagatgtatttatttatcattaagtccttaaatggctatgtgctaaagaaggcaattaaaacaggtacaatgccttttataagtaggacaccttgctgtagtgctaaagtcatagtagacatagaacaaatgcttattgattgatttgtggcactataaaggaaacgtttaagtctattatgttactgcagaaggaaaaaagagactaaattagaatcagttcaaaagcaatattaccaaattcattagttacattctattttagtcatctttagtgttacaaaatgctaattttagagataatcttgcctaacctcatcatgaaaaataatttaataacttagacgatatagctggcattgtagggtaaggttgagtcatgggagggcagattgttgcaacactgattgtttaaagaagaaaaaaattgtagaaagtaaaa

SEQ ID NO: 272303 - DNA, 441 bp, Homo sapiens
tattgtgtatagagaatggatactgttttgaaagcaaaatgttggaaactgagcatgatgctaagatgcctttataaaaacatgagccactgcacccagcttttagaaatttatctttattcatctcttgggattggtggtagtataaaagtagttgatagccgggcgtggtggctcacgcctgtaatcccggcactttgggaggctgaggcaggtggatcacctgacatcggagttcgagaccagcctggccaacatggcgaaaccccatctctaccaaaaaacacaaaaattagccaggtgtggtggcagatgcctataatcccagctactcaggaggctgaggcaggagaatcgcttgaacccaggaggaggttgcaatggaccgagatcatgccactgcactccagcctgggctacagagcaagactgcgtctgaaa

SEQ ID NO: 272304 - DNA, 169 bp, Homo sapiens
gaaatttaggggaggcacaggcattaagtccataacattggggaagtaggttctcagtggctcctctcccttgggttatatgagggtctttagtagcttcagaattccctgagttgtattcagagtcaccatttgctttggagaattctaggattgctacatagaccag

SEQ ID NO: 272305 - DNA, 426 bp, Homo sapiens
caaaaattctcaacaaaatattagtaaatcaaatccagcgatgtataaaaggaattatacaccatgactaaatgggatttatgccaggtatgcaaggctgattcaacattcaaaaataaattaatctaatccatcacaccaacagggtaaagaagaaaagtcatatgattatatcagtagatgcagaagaatcatttgataaaatataacaccctttaatgattaaaaaaaaccaactaaactaggaatagcggcaaacttcctcaacttgataaagaatatttaccaaaaaacctgcgggaaaatttatacttaaaaatgaaaactagagcctttgtaactaagatcagaaacaaggcaaaaaatgtcacctgtcaccactccttttcaacattgtggtggaagtcctagctaatgcaataaaac

SEQ ID NO: 272306 - DNA, 426 bp, Homo sapiens
gggaaatggatacttattattaatgttcttcattttggcacagaaaagtgtagaactcgggtcacttggtgtttttataatccaacagtgagataaaaactatttccaaatggccttctgaaaacataattattaaagagcagctttattattagtaatgtagtagactgtggcaggtgcggtggctcatgcctgtaattccagcattttgggaggccgaagcgggcagatcacttgaggccaggagtttgagaccagccagaccaacatggtgaattcctatctctgctaaaagtacaaaaattagccagatgtggtggtacatgcctgtgatcccagctactggggaagctgaggcaggagaatcccttgaacctaggagacagaggctgcagtgagccatgatcgcaccactgcactccagcc

SEQ ID NO: 272307 - DNA, 372 bp, Homo sapiens
ttgctttacctattgacaagttcctgagttggcaccagcaccaagcagatagaaccatcctccctcttaggaaggctgataattgacgtggatgatggcagatagtaagtaggatgttctcccagattcagtctgacttactccagtcatatcccatccacttggagcaactagctactcttgagcttgaatggcaatgggttcaggaaagttctgttttgcaaattacatccatgatacgtacagagttgttttcttcatgcagaatcagagctggcttcagacagttatgtcctctcactgtaactttcttgcttctgtgtacttctacctctcgtactgtgtctatccaaatcagtgtgctcttgatta

SEQ ID NO: 272308 - DNA, 410 bp, Homo sapiens
caactgcactctcatacattgctggtgggaatgcaaaatgacatggcctctggaaaagtttggcagtttctcacaaagttggaataaccacatagaagacccagcaatcccactcctagaaatttaccctagatacatgaaaatttgtgttcacataaaaaaattgtatgctggctggggacggtggcgcatgcctgtaatcccagtattttgggaggccttggtgggtagatcacctgaggtcaggagtttgagaccagcctggccaacatggtgaaactctgtctctactgaaaatacaagaaagttagcagggcatagtggtgcacacctgtagtcccagctgcttgggaggctgaggcatgagaatcacctgaatccaggaggcagaacagaggttgcagtgagct

SEQ ID NO: 272309 - DNA, 402 bp, Homo sapiens
atctctagtagactcactttatgctgaaattatgtcatcaaccaagtgacctacacatagcttgtgggcctcttgttggtcgtatcaactgaagaaaaaaataaatcaaacttttaaaaaatagttttattcagaaatcttactgaggactgtagaccatagactacagcatgggagctgttctgtcagactgcttcagcacaatatttcagctcatggctaataaataggtagcaggagtttagtatgtgaaaaatcataccaaagtttgggtacagtagtacatctgatttatcccatcagatgctatcttatgtgcaggaaaagtcaaggacaagggtcatttttctttcaaggaatatagtgactcaggcaagagatgtgggggtacggtgatgtgtt

SEQ ID NO: 272310 - DNA, 182 bp, Homo sapiens
cgcgtgactccttgcatttttcaaaacccatgcaagtccacagcacaaagaatgaacttcgctgtatgcaaatttttttaaatgagccaggatgtcaggggaacccaggaggaacgcggcctgtgacaacggactctaattgaattacaaatgtgtgacatcactcagggagagggagtggg

SEQ ID NO: 272311 - DNA, 482 bp, Homo sapiens
gaaaaatattctgaaaagcattcactcctacatgcatgaaaattgttttcatcattgtggcttggggagctttctgtaaccatactttaaggaactagttttattataatgttctttaacttgaaataagaagatacaaacagaagccaggcaaccaaatagtgcagatccataatcagggttttgcaagaggattggactgtctttccttctctgtggacctcattaaggaagcacataactccttccccttggtaggggaggattcatctacaaaagtggtatcagaattggagaaacaaaattccaatcatagctgtaaagaagccattcaagctgggtgtggtggtgggcccctgtagtcccagctacttgggaggctgaggcaggagaattgcttgaacccgggaggcagaggttgcagtgagccgagatcacactactgcactccagcctgggcgatagaatgagactccatctca

SEQ ID NO: 272312 - DNA, 608 bp, Homo sapiens
ccgaacatggcggcggtggtagctgctacggcgctgaagggccggggggcgagaaatgcccgcgtcctccgggggatcctctctggagccacagctaacaaggcttcccagaacaggaccagagcactgcagagccacagctcaccagaatgcaaggaggagcccgagcccctctcccctgagctagaatacattcccagaaagaggggcaagaaccccatgaaagccgtggggctagcctgggccatcggcttcccctgtggtatcctcttcttcgtcctcaccaagcaggaagtggacaaggaccgattgaagcagatgaaagctcgtcagaacatgcgggtgtccaacacgggcgagtatgagagccagaggttcagggcttcaccccaacaagcccagttccctgaggttgggtctggggcccagacctgagtgaggatcactgcaaccttgtgctagactattgactgccgtcttgtgtggccatggctcctgaggcccaccagagggcgcaggatgcccaagctgctgccagcacccaactcttccacaccgtggaaggagccaaatgcaaataaagttattaagtactgacacggaaaaaa

SEQ ID NO: 272313 - DNA, 448 bp, Homo sapiens
ggcagagggacagtgccctgtgttccaggacacacagatgcatgaggaggaggaggccagccagcagcaaggaggagagccagggcaccgagcaccgggaggcagccctccctcccgcaagctctcagaccgccgatgccctcagacctaggagcagcgcccgtaccccgccaggccccatctcctcccctccctcaaagcctcacttctccagggtccagccctgatatctctttcccaggccttccaggagctgtctgccctcctgtccccctgtcggatccccctgccctgtatattcccctaggtcccgcttctcacccatctcagtcatctatggccacataaaaccacaccccaaggccagcacagtggctcacgcctgtaatcccagcactttgggaggccaaagcaggaggatcacttgagcccaggagttacagaccag

SEQ ID NO: 272314 - DNA, 252 bp, Homo sapiens
ttttagtagagacggggtttcaccatgttggccaggctggtctcgaactcctgacctcagttgatccacccactttggcctcccaaagtgctgggattacaggtgtgagccactgcacctgaccccagacgatttcttatgcatttttatgattctccatagtgtcagaaagagttccatgattgtcagaggtgctcaatgtttatttaggaacagaatggagttaatgctatatgaaattggtaaacccag

SEQ ID NO: 272315 - DNA, 420 bp, Homo sapiens
ggaaaccataacgctcttcagtgttattgtctttgtcaataaacagtattagcatcaattctctccctcttcctctttaacagaatctctccccaatacaaccatatacctcagtagaagccaacaccattccagattgagaaacgtgattaacctaagggttatttactggtgactggttcaggaactagcctatgacccaattctggccaaaaagatgggaaagaagtttgctagaggtttttgtagaaagtttcctctatccaaaaacagtggcacaggaagagatacttttcctcttcttttggaagttgttatttatggatatgatatgatgcctggaatcaccgcaaccattttgctactagcctgaggatgaagccagtcccaaggatggcagaattgagcaatatatggcta

SEQ ID NO: 272316 - DNA, 1176 bp, Homo sapiens
gccctccacaaagctcctgggcccctcctcccttcaaggattgcgaagaactggtcgcaaatcctcctaagccaccagcatctcggtcttcagctcacaccagccttgagcccagcctgcggccaggggaccacgcacgtcccacccacccagcgactccccagccgctgcccactcttcctcactcatggggaacagcaaaagtggggccctgtccaaggagatcctggaggagctgcagctgaacaccaagttctcggaggaggagctgtgctcctgggtaccagtccttcctgaaggactgtcccaccggccgcatcacccagcagcagttccagagcatctacgccaagttcttccccgacaccgaccccaaggcctacgcccagcatgtgttccgcagcttcgattccaacctcgacggcaccctggacttcaaggagtacgtcatcgccctgcacatgaccaccgcgggcaagaccaaccagaagctggagtgggccttctccctctacgacgtggacggtaacgggaccatcagcaagaatgaagtgctggagatcgtcatggctattttcaaaatgatcactcccgaggacgtgaagctccttccagacgatgaaaacacgccggaaaagcgagccgagaagatctggaagtactttggaaagaatgatgatgataaacttacagagaaagaattcattgaggggacactggccaataaggaaattctgcgactgatccagtttgagcctcaaaaagtgaaggaaaagatgaagaacgcctgatgccaactgttcagctgtcctccctccacctaccactcacatgacacccgtgagcgcctgtgcacacacacacacatgcacacacacgcgcgcgcacacacacacacacacatccaccccagggccaagagaaaggcctgcacacaagcccacagcacagctccctgccaaactgaagcatctgtagtgacccactggttccttcttcctgggtcttcagcattccctcccatcatgcccggtcccacccctccctctgtccaccagcccatggccctgtgctaatcccaggattaggccataggagtcctaagtgtcaccccgctgtaagctcctttgtggagtgctgggtaagcagtttccaataaacgcaagctgagctggg

SEQ ID NO: 272317 - DNA, 1251 bp, Homo sapiens
gccctccacaaagctcctgggcccctcctcccttcaaggattgcgaagaactggtcgcaaatcctcctaagccaccagcatctcggtcttcagctcacaccagccttgagcccagcctgcggccaggggaccacgcacgtcccacccacccagcgactccccagccgctgcccactcttcctcactcatggggaacagcaaaagtggggccctgtccaaggagatcctggaggagctgcagctgaacaccaagttctcggaggaggagctgtgctcctgggtaccagtccttcctgaaggactgtcccaccggccgcatcacccagcagcagttccagagcatctacgccaagttcttccccgacaccgaccccaaggcctacgcccagcatgtgttccgcagcttcgattccaacctcgacggcaccctggacttcaaggagtacgtcatcgccctgcacatgaccaccgcgggcaagaccaaccagaagctggagtgggccttctccctctacgacgtggacggtaacgggaccatcagcaagaatgaagtgctggagatcgtcatggctattttcaaaatgatcactcccgaggacgtgaagctccttccagacgatgaaaacacgccggaaaagcgagccgagaagatctggaagtactttggaaagaatgatgatgataaacttacagagaaagaattcattgaggggacactggccaataaggaaattctgcgactgatccagtttgagcctcaaaaagtgaaggaaaagatgaagaacgcctgatgccaactgttcagctgtcctccctccacctaccactcacatgacacccgtgagcgcctgtgcacacacacacacatgcacacacacgcgcgcgcacacacacacacacacatccaccccagggccaagagaaaggcctgcacacaagcccacagcacagctccctgccaaactgaagcatctgtagtgacccactggttccttcttcctgggtcttcagcattccctcccatcatgcccggtcccacccctccctctgtccaccagcccatggccctgtgctaatcccaggattaggccataggagtcctaagtgtcaccccgctgtaagctcctttgtggagtgctgggtaagcagtttccaataaacgcaagctgagctgggaaaaaaaaaatttttatttttttttatggtgtaaaaatttttttgtgggccccggggggggtcccccctttcaat

SEQ ID NO: 272318 - DNA, 1068 bp, Homo sapiens
tggtgcagcctctttggaaaacagactggaatttacttcaaagattaaatatagagttaccatgtgacttagcaattccactcctaaatttatacccaagagaaatgaaaacaagcatttatatatgtacatgaatgttcatagcagcattattcataatagaaagtggagacaacccagtgttcatcagctgatgagtgagtaggcaaaatgtggcacatttgtataatgaaatgttgtttgtcaataaaaagaaataaaacactgataaatgctacaacatggatcaaccttgaaaacgtgctgggtgaaggaagccagtaacaaaggaccacatatcgtatggttccatttatgtgtgattttcagaataagcaaatctgtagagacagaaagtaaattattgatctccaagggctttagagagttggagaaaatgtggggtgactgctaatggatgtggagtttctttttggaatgatgaaaattttctaaaatcatgctaattatcgtgcaactctgaatatatactacaaggcttttggactgtacactttatatgggcgaattgcatggtgtgtgagttctatctcaataaagtttgttgtaaacaacctattgcaaatgcttatctgttaatgccaatctgtaataaaattttatatagttcatctttggaaatgttctttcacaccgatagcattgttggatgctggtatctgtccataagcatattatttcaattgggcatatccattgcttggaagtcatttatagaatttagttagattctttggatgtttgcctttcagcacactgttacgttgcagattaagaagggtttgggtggatgctcctcagttgtactgttaagtgaattttgaaatatgtatatttcttttgcatttgcattaggatctaaaaaatgctgttggaactggagtttgtgctcagaatccatatgtgtggaaaatatttgtgagaatggagatatctcttcttattttaaacttggacagcatgtgaaatatataaagcattttcacattacttgcgattcaaatatta

SEQ ID NO: 272319 - DNA, 421 bp, Homo sapiens
tacagtaaaccaggtttacaccactgcactccagtctggatgacaaagcaaaaccctcatctcacaaaagaaaagaaatgacaatcacagccactgcaacttcaaggaaggttgggagagtgatattggtcaggatgagtggtctctgacatgtttcttaagttggatatttagcttattaatttacaactcttttctaatattaatactcaagactacattttccccaaaacatttattttgccatgttttgcaaggcttggtatatggcattttcattactctttaattctaactaatttttaatttctattatgatttattatttgatctatgaatcattttgaaatttgtttttgtaaccttggatagggaaagatttcttatagaagacagtaaaagggctgagtacaaaagaaaa

SEQ ID NO: 272320 - DNA, 365 bp, Homo sapiens
ctagatggtttagcctactgcatacctaggctatacggtataacatattgctcccaggccacaaacctgtatagcatgttattctgctgaatattgtaggcagttgtaacacaatggtaagtacatatgtatgtaaacatagaaaaggtacagtaatcttatggagccatctctgaatatgtggttcattattgactgaaacattatgtggcacatgactgtacttgggcagctgctgcttctctttcagttgcaaatgcaaacctgttataatctttgactaaataaagcatcctggattctgtaagtccatagatagtaaaaacttcttaaaacacaataaagaagagagaggaaaaaaaaga

SEQ ID NO: 272321 - DNA, 151 bp, Homo sapiens
aggagacacaaacattaagtctatagcacatgacttctgttatttccaaattatgggatttccaaattatgcatgtattaaacccaaataatttcatttttaaaggcgttaaaaatgaaaagtgaagagaggtcagagcctatgttcactg

SEQ ID NO: 272322 - DNA, 879 bp, Homo sapiens
catgcatataatcccagaactgtgggaggccaaggtgggcagatcatttgaggtcacgaattcaaggccagcctggccaacgtggtgaaacggtctctactaaaaatacaaaaattagctgcgtttggtggtgcgcgcctgtaattacagctacttgggaagctgaggcagcagaattgcttgaacccaggaggcagagattgcaactgagatcgccccactgtatgccacctggggcaacagagcagactccatctcaaaaaaaaccaaaagaaagaatctgcatttaaataagcatccttagctttcattaacaccctaagcataagcataccttaactaataggtatgaaagagatggtgacttcataaaacactactaaattggacgggcacggtggatcacacctgtaatctcagcactttgggaggccaaggtgggtggatcgcctgaggtcaggagttcgagaccagcctggccaacatggtgaaacccgtctctactaaaaatacaaaaattagctgggcatggtggtgcacgcttgtaatcccagctaccaggaaggctgaggcaggagaactgcttgaacctgggaggcagaggttgcagtgagctgagattgcaccactgcattccagcctgggtgacagagtgagactctgtctcaaaaaaaaacacaaaacaaaaaccattatacacatttccttatttcatgctacataatttctttacgtggaagataggcaaaatgaactgttgccatagtgaaggacagaattctagagagaaaagatgccatctagataaaagtaacatagtgctggaacatgtggaacaaaataccgaggggaggctcagataggagtggccttaacacc

SEQ ID NO: 272323 - DNA, 737 bp, Homo sapiens
catgcatataatcccagaactgtgggaggccaaggtgggcagatcatttgaggtcacgaattcaaggccagcctggccaacgtggtgaaacggtctctactaaaaatacaaaaattagctgcgtttggtggtgcgcgcctgtaattacagctacttgggaagctgaggcagcagaattgcttgaacccaggaggcagagattgcaactgagatcgccccactgtatgccacctggggcaacagagcagactccatctcaaaaaaaaccaaaagaaagaatctgcatttaaataagcatccttagctttcattaacaccctaagcataagcataccttaactaataggtatgaaagagatggtgacttcataaaacactactaaattggacgggcacggtggatcacacctgtaatctcagcactttgggaggccaaggtgggtggatcgcctgaggtcaggagttcgagaccagcctggccaacatggtgaaacccgtctctactaaaaatacaaaaattagctgggcatggtggtgcacgcttgtaatcccagctaccaggaaggctgaggcaggagaactgcttgaacctgggaggcagaggttgcagtgagctgagattgcaccactgcattccagcctgggtgacagagtgagactctgtctcaaaaaaaaacacaaaacaaaaaccaaacaaaaaaaccatcagaacattctttcaaatgaatgaagccacg

SEQ ID NO: 272324 - DNA, 213 bp, Homo sapiens
ccccagcacaaagctgcccccaacaccgagtctcccttctgggagtatgccactgtcatccagtcagtgtcaaacagaaatcgggctgagctcattgattccccgacccacactagtcaacaggtcctgtatcctctgcctattaagtgtctcttgaatccatcacttctctgtctcctctgacacaactatggtcccaggtcaccacaacct

SEQ ID NO: 272325 - DNA, 381 bp, Homo sapiens
gaacatttgcctcgcggtagacacggggggaaatgtaatatttttttaagcgcttaaacaatttctgaaattcctcaaagaaaagcctttcagaggcaccttggcctcaagctgcagcaaatactgggaggtccggctcgcattcccaggcctgcaccaataatgacagcgtgctggatagtgcgccagtgtgtgccagatttttttttcctcttctcttttcttttataactaaagggaagacttaggctcttgcagggaacaacgcctcgcattaagataaacagaatggaaagttaaagaggaaagcaaggacgttgggaaaagccatctttcttaaaatccgtctgccccccagccgctttctccccccaacttaaa

SEQ ID NO: 272326 - DNA, 257 bp, Homo sapiens
caaaagtatttactatctggccctttagtggaagactttgctaacccctgaactatatcatactatgagaaatttctcactggctagttccccttttaacctgggctttccatcctcttcccaggcctctctctctcattggatactcctctcttttgttcaaatctttactgcattctcagggtatgcagtaaatacaggcattcagactctcgggcttcttgcaaattcaaaactccatttttctttaaaattca

SEQ ID NO: 272327 - DNA, 233 bp, Homo sapiens
gatgaccttgaacaagggacttccccgtcctgagccccagtgtctttatctcacatctgacagtaaggacactgatgtttcttgcacattcccagctttgaatggtttgtgtgccacccacctcctccacctgctgcagatccattcattcagttcattcaatacatgcatctactctgtgcccagtgctcttccaggcaccaaaaataaagccttgaacaaaatagacacaa

SEQ ID NO: 272328 - DNA, 447 bp, Homo sapiens
tatttaacccacgcctctgggaggcgctcaagaacaggataatttaatgtcattctcagcctgaaaaagttccttagttttcttttaattaaatcagtaattattttaaatgcatcatttcaacaagataccataagttagttgaatgaatgcatgtaaaaccaaaatgttgactggcataatccccaaatcgaattaatattttaatcttaggtataacatactttatatttcatacctggcacgttcttaaatgtgttaaatgtgttttccacaacttggcataactatacatccactcagtttattgggtggggaggcagagaagagaactttgtttaaaaacaaaacaaaacagaacaaaaaactatgactaaaggatagaactctacagcagacatttagtttctacaattgatgccaaaggtagaagagattttgagagga

SEQ ID NO: 272329 - DNA, 127 bp, Homo sapiens
gttttggggttggggaattggaagagaaggagaatgtatataccaaagacatctaaggggaaagaatccaaaagaaacaagggaatatttatccacttaacatttacgctaaaaaaaaaaatgtagt

SEQ ID NO: 272330 - DNA, 371 bp, Homo sapiens
agggaatcacaattacgaacactcatcctattaaaaaactaaccgtaggactgagtagaatgaaggattctgaatgtttaatatgtttgttacctgcaagcatttaccacaagacatacaacagcaggtgttaaggttgaaaaaaaaatcataagaaaaagacttaatttttcttgataactggtagaaggccaccattcttctgtttcagccatgggacgcctttgtccagcccaaggaaaacacgcagaggctcagtttgagaactaggatggcctctcccaaatatcaaggttgccgtggaaactggtggcaactgttgcattaaacgaaaatctccatttctaacactgtgcaatgccgactcactc

SEQ ID NO: 272331 - DNA, 416 bp, Homo sapiens
tttattttatttttgtaggaacagaatcttgttctgttgcccaggctgctcttgaactcttggcttcaagagatcctcttgccttggcctccaaaagtgctgggatgaatctctgtcatggtggcatgagccaccatgcctggcccagatcctgaattctagcaggacagctcatgcccaccagtctgaagacaccaaaaggagaactgactcaatgcaagaatgcaatttctttagttccatgacgtcacccttcattcttcaaccaatcagtgatccttataccttggcccactaaccatccaaaccccttaaaatccctagatcctaaactccttgaggaggtggatttgaggtttcctccagtctccttgtttggctgccttgtgattaaacctctttctctgctgcaattc

SEQ ID NO: 272332 - DNA, 306 bp, Homo sapiens
tggagttgaggaattatttttatttttaaaagggaaattaacgtagacaaatcgtaacatgtaccccaaatccaaatggattaaagacaaaaatgtcaatagaacatttgtggacctttccaatagaaaaaaaaaaaagagcaaactctaactgcctacaacattttaaatctagaatcctatattcaatcaatatggggataaagttcttccccttggataggagaggtttcgtttggttttcttttaatttcctccaaaacaatcattggcaggaagcttctgcaggataagctccaggtgtag

SEQ ID NO: 272333 - DNA, 248 bp, Homo sapiens
aggaggaggaggaggaagatagtgatgccctggctgaggagtcaggagacctgagttccaaacctacagcaccttacacactcgaaattcatgggttgaatgcataaatgaatgagtgagtgaagaaattaagccaggcgtaagggctcacatgtgtaatcccagcactttgggcggctgaggcagatggatcacctgaagtcaggaatttgagaccagcctggccaacatggtgaaacctggtctct

SEQ ID NO: 272334 - DNA, 453 bp, Homo sapiens
ttttcatctaccaaccctaatcaaggattctcccctaaagttagctactgttaccagtttttgtatgttcttccagaaggacattgtatgttcacatagaaaaattatatagtattgttttgagtgtatgtatgtatgtggggatgttatgtataaatacatactccaccatttacatgtggcattttgtgttgtgtttttgtttttgtttttttgcatttgctattttcatatgctgtagttttaaattgtgctctgtggaattggaggcctgaaagcctgtgtgtttctagatgctttataccacttcctctggagcagctctgctttagattttttacatatggggcctttgggtaaaattttatttaaagaacaaaattgcttacaaagaaaagcttgcaaactattttatgataccttgtctctactgccttataaaaagaaagaaaa

SEQ ID NO: 272335 - DNA, 670 bp, Homo sapiens
cagaacatgtctgcatcctcacctccttaagcctgcagctcatcagaaccaaagaccctggcagagtttggtggtagttcttttttgtcagacttacagtcaggggttggtgggtttgtgggtagctccattctagtcctgggctttaatctgtgagtatggcttttgtcttccatcttgctcagggtactttggaaccgctatacattgcaggagcttagcttctggttaccatggtttgcttccagagcaacaagcctagtacttcaacatggagacaattatcttttgtttttgttttgttttgtttgttttgtcttggccatgcctttttgagtttacctttttatattttgtccatcattgccatgtgtttggagcagtgggcgttccataacatgaactcactgtaccatcacgaatgggaagtaaggggaaaccttatccatgtggattttactcttccctgattccctaaattgggtttgcaaaatactactgtgcactttcttgatgattcgggcttatctttatgactgtctgtttttgtgtcagactgtaaagaagtataaaagtctttagcttgattaatgcaatccacgcttcctttctggaaaaaaaaggggggggggcgcatttttttacagttgcaataaatcgtcttaagcca

SEQ ID NO: 272336 - DNA, 349 bp, Homo sapiens
aacccaaccagcctggtgttgcaccacagggctcacacctcagatcaagacaacgggggcccagccacagcccactgacgagggcatgcagggcgtccaggatgcagggcagagagagaagcgagggatgagtcacggatgcgccccccgctctgagcccgacggggccctgaatggcttttcctgccctggctcctcccatcatattttaaatgccgtcttcctcccgctccaaggaaaccttctcttgacgtcaggtactctccagccacggacctatcaacattctgacagttttctggtcttgacacattatccttttaatatagcgctggattcaatttattaa

SEQ ID NO: 272337 - DNA, 478 bp, Homo sapiens
atgagagaagagcagggcaggtgggggtctaaagagctcagggtctcattatgtttctggtggcagctccctcgtgggtgggagtcccctctccccatagacgtgtgttgccttacgagaggcttgtgcctgcctgggtgtgtgacacagttactctgggttcagatttctatgttactgctagctggttgggagagtctgagggaatcatttcacctctctgtgaaatggagataactcaaggtcccttacctcatagagtccatgtgagaagtaaatgagggaaagcacagacattactcgctccgggggctgcacctccagaattgctgttgtcattattaccatgtgtctgacacattgatattccatcccacaacaacctcggaaaggaaacactcccattagcctcatttggtagaggaggaaattggggttcatcaagggttaaatgacttccctgagggtccacagttgt

SEQ ID NO: 272338 - DNA, 190 bp, Homo sapiens
ctctgtttcctcagcttccactcttgccttcctccctcctctccttccctcctcatttctttatcatctccttttagtctttttcaaacctttcagcttttgcattccacatttcctcacctgggatggggacaatgcctgcctcacgggatgtagcgcagactgaggacagaggcagccgcagagggaa

SEQ ID NO: 272339 - DNA, 262 bp, Homo sapiens
gtcctccacagcaaagtgtattccacccattttcttagagagagagaggcaagcatcctattattagacagattctcaatgtgcctctcacccctctgacattcagactcctggctgttattttccagaagattttgagcccactctgcccctcatcctgtgcctatgaagaccccagactcagtcagagagaaagggagaagcagctggacttctgaaagaagaaacttgacttcagagggaagacttgatggcttgattt

SEQ ID NO: 272340 - DNA, 1206 bp, Homo sapiens
acggggccagagggaaacttctcacaaacttcgtagagcctcctcaggggaagctaggaagaagacatcaaatgtttttaagtcatgaccaaacaggcttgttggggacatatcatggggtgagctttgaagtgctggtggtccagaggggttgcagatacgtgacttggagcacccgtgtcttacgatggacagtgataaaggtgaacacacagagacagactattctctaagaatgtgagaaacctgatctggaagaggagctatataaacactatctgactatctttgtcttttggggccagtggctgttggcataatcacaagcctgtctgtcttcgagaagggacagtggagtcatccaggtgctgccacatgacaggcacggtgggcaccgatccacagtgggccccgccttccccagctcgcctccctgcctgtgctggcctggccttgcctgctggcaccattggagtaggagggggtggaacacagggggcccatcctgatcaggccccatctcaaggttggcactcctgcccatcacccttagaaggatcttttcccatggcttgacttccttcatttccctaactgaaatacacccactctcttggaataatgacgtaccactcagttggaccctcaagagtcactgctttgtctgtgctggtagtttgtgagaagtgacccgcacgcttccatttgatgcatttgatgtgagtgaatccatacatttgaatgtcattgtccttgagaccctacatgtgcagtttggctcatctcattaaagatgcttgatgtaataattggttagtttccttttattttcctgcaggcttttccatgagtattatttttttcaaagaacaaatctgtatggcttttccccatctccatattttgttttgctatgaattgctttgctttggtgaacttgtcctagtatgcttgcctcacaaacgttttagccattgtgaattttcttcatctctgtaaatagttcatctgtgcttctccctgatgacgttttattttttttcccctgtaagcaaccgaggtagaaaaataaattgtttaccatggacatactgtgtgctgccgtctcttagcctgacagtgtcctgttctcgctccgggggaggtgaatgcactgaataaccagcaccgatgacagcctagtgcagtttctaaaagcatgcgaac

SEQ ID NO: 272341 - DNA, 999 bp, Homo sapiens
acggggccagagggaaacttctcacaaacttcgtagagcctcctcaggggaagctaggaagaagacatcaaatgtttttaagtcatgaccaaacaggcttgttggggacatatcatggggtgagctttgaagtgctggtggtccagaggggttgcagatacgtgacttggagcacccgtgtcttacgatggacagtgataaaggtgaacacacagagacagactattctctaagaatgtgagaaacctgatctggaagaggagctatataaacactatctgactatctttgtcttttggggccagtggctgttggcataatcacaagcctgtctgtcttcgagaagggacagtggagtcatccaggtgctgccacatgacaggcacggtgggcaccgatccacagtgggccccgccttccccagctcgcctccctgcctgtgctggcctggccttgcctgctggcaccattggagtaggagggggtggaacacagggggcccatcctgatcaggccccatctcaaggttggcactcctgcccatcacccttagaaggatcttttcccatggcttgacttccttcatttccctaactgaaatacacccactctcttggaataatgacgtaccactcagttggaccctcaagagtcactgctttgtctgtgctggtagtttgtgagaagtgacccgcacgcttccatttgatgcatttgatgtgagtgaatccatacatttgaatgtcattgtccttgagaccctacatgtgcagtttggctcatctcattaaagatgcttgatgtaataattggttagtttccttttattttcctgcaggcttttccatgagtattatttttttcaaagaacaaatctgtatggcttttccccatctccatattttgttttgctatgaattgctttgctttggtgaacttgtgcgctggccggcacgggtctgcttctgcactggcataatcttcaaaacctcatccttg

SEQ ID NO: 272342 - DNA, 303 bp, Homo sapiens
gaggttaagttacttgcccaaggtcacaaaatagagattaaaatttagttttgtctgactccatattcttaaccttcaaggtccactgcatctctgcagagcttcccaagctttccactgaaggcctctttatattctattgcacctatgtcatccacattttgaaagattttattactgagcacactgcatttgtgaactaataatttcttccatctggctgatgattatttttctactcctgtttctgttacaacatcaatccagactttaatcccaattattgaaggttcaacataatat

SEQ ID NO: 272343 - DNA, 374 bp, Homo sapiens
aataatgattggtaatactgtaggataaaatacattagtcctcagattaaaagtctatctataaatacatatatatccctggatacagcatagtgaaaccagaatcttccctataagacacttccttgactggagaaaagacagactatgaattaagatgaaaataaagaaattttcaggtaaacaaaggtgagtgagtgccactgttgggtcttcactaaagaaacattaaagggtgtatttcaacaagacaagaaaccccagaaggtatgagatacaagaaacactgagtatagcaattaataaaacatttggctgtgactgctgttgactagggaaagggttagggttttatggataattgtgtttaaaaa

SEQ ID NO: 272344 - DNA, 492 bp, Homo sapiens
ctgaccgaggagagaatagagccttgagtgcttcagaagagcctggctattctcatttgaaaagtctgaggacctgaagctgccatcctacctgcaagcccagctatgtatctaatgctactactcactttagctttggctcaactacttaaaatactggatggaaagtcttacattttacaaggtattttcatgtgtgctgaaacttccacctttgtgaggtaagagacagaggtcaaacttctcactcataggcctggggagatcttgcttaatgataattgtgtgtctccccacaaccttgcaaaatgaagattatccttatcaaacagaagataaaataggctcagcgtatttggcccaggaagtagcagagttgagtttcgacctcagctttgcaaatacaaaacccattctcttgtttgtcctgtagcttctctggaagcagtcttttccagaataattctgatagtatagattttcagatgatat

SEQ ID NO: 272345 - DNA, 370 bp, Homo sapiens
accacattttccgaaactctgttctattcagtaacaaaccattcaacctaaatattcatcattgcttcaaattcaatgttcttcctccaaagtcactctcaagcccacctgcctcactctgtcagttccccgatcaccagacctccaaacttgggcttcttgtatgaccaattctgctccttcactcccatcctaaggtttcctttcagtggcctcttgcaactgtccctagccctccatcctcccaggcatcctccttatcctcctccctggtgacagatcacctcccagcaggattcccctggcttccctagtgaggacctgagtcttgccttgtggcccgcttcaccatggctggacccccttcttt

SEQ ID NO: 272346 - DNA, 576 bp, Homo sapiens
tttttttttttcaagagataggatcttgctatgttgccaaggctggactcaaactcctgggctcaaataatttttgagccctcagactctcaagtaggctgggactacagatgcacatcaccataccaggcttaaatttcttgacaacttagtttgaaagtaaatgaataaatgattttccagaaaaaaagcccagcctactccaggccaggtgcaagttttagctgttttttcatgcttatttcatgaacactcacatggaaatgaccttggtatactgtacactctggtactttggttgcacagataaattcccccatctgggttatacaacaattagcctaaaacatgtccagtttaggacagacgttaatttataagttattttactgaaagcacaggcaaaaaaagcaaagtcaacagttttgaattataacatcagaaaaattgattttatacatgtttaaagtctctgaataatgctgatttaagcaatgatgcattgagtaatttgcaatttttttttttgagacagcgtctcactctgtcacccaggctggagtgcaatggcacaat

SEQ ID NO: 272347 - DNA, 434 bp, Homo sapiens
ctagtaacttttaatgaaaaagatgtgtgaacttttatcttgacacaaaacgttttttccctttgttttgtttaattcatttaatcagtagagggagttctggtatcatatgcctcctagcaaattttctccttaacttgaatatggagatctgactctacttctttacattagacagaatcaagaagctggcaagtccagctacatttggtaaggtgagtctttaagggctgtgcatagatatgagagcttagatcccagccaaaaatcagacagcaggactgggagaggcaggttaccttattggttattaacctaaagaattatagtgacaggaggctgggcgtggtggctcacaactgtaatcccagtactttgggagtctgaggcaggtggatcacgaggtcaggagttcgagaccagcctgaccaatg

SEQ ID NO: 272348 - DNA, 778 bp, Homo sapiens
ttaaccactgccttcttttgccagtaattgaaggaggcctgagtcccatatgagctactgctttagataatcaaacctccagaccctcctcttcttggagcctactccctgcttccctggtctcggcccttcttgctgcttccccctcgttggggccttctgtgcctgtgccagcttgttgccagaggctctgtgtttataggatgaggagccctatttggcctttgcccacatcctgctgcaatctgggcaggatctccttgtcctactgctgtggctgctgtcccccaggtgacccccgtgctgccggcccagcagggtccatgtgcctaacagctggcaggaccttgttcctgtcctcctgccacatgctggctgcagctctgcagacagtccccatttcatgctgatttgctttgattcttttcagacctgggagtgactcatgtttacttcaaaatgtgtgggccacaagtgtgccagagctgtcagaccttccggtgtgcaagctttgatcgttagaagacaagccttgaaggaaaaaacctccatttaggtgacaaaaccagatttagaataacctggcttacttgggatatctgcttagtgatctgtgcctttaagtactagagacttaggacatctgagccagaggagacctatgaggccatctgttcccatagctccattgtacagatgaagaaaccatgacccagagaggagtgtgacttgcctccagtcacccagctccaaagagcagagtaaaaaccagaaccca

SEQ ID NO: 272349 - DNA, 405 bp, Homo sapiens
ttttttttttgttgagacagtgtttcactcttgttacccaggctggagtgcaatggcgtgatctcagctcaccgcaacctccacctcctggattcaagcaattctcctacctcagcctcccgagtagctggaattacaggcatgtgccaccacgcccagctaattttgtatttttagtagagacagggtttctccatgttggtcaggctggtctcgaactcccaacctcaggtgatccgcccgcctcagcctcccaaaatactgggattacaggtgtgagccaccgcgcctggctttttactcactttttgaagccctgtctgagcattcatttgacctccgtgaagttctccatgaccccagtccttcagcacgtagaacgcaagctccatgaaagcagcaacc

SEQ ID NO: 272350 - DNA, 1071 bp, Homo sapiens
aaaaaaaaagaaaaaaaaagtccagctacacagaagcgaggagtgcgaagcaaatagccgcttcacgtcccacaccctggcagcagctgcgcccgggtctgtccggagatggtgtgtgcaagcgtattccagcacaagaatctggacttctgtttcttatgaaagcagctgatgccacactgtgtgccctgtgccgtactgtgccaggcacctggacggacctggcttctccctgtgcctctgaagggcggacggcgttgtgtctgcgcagtcctgcaggcgggagaactggagtgctgctgtcttcatttgctcacagggttgagcatctccagttactgggaccttcttgtctctccgcggggccccgttacctccttcctctcgtgtttcattgtgatgttcatcattttcttgaactgcagctggtctttatatgttaaggaacttttgccttctatcacctgttgacaacatttctttccctgcttgctcttttccttttgactcggagagcaaatgagatgttctttcaggcgatggtgtggtgggatggaccgcaaactcagcattgatagtggatgttggtcattctttttgactttccaacatcagaacccacttggggaatgggacgcagaacccctccctctgcagaagctgccgcactgcccaggctccttgcggtgagctgagcccaggccctgccggccccacactttgttgatggctgtgaggccgaaccataggtctgtgggcagaaaagtcacatcatgtgtcccgggtgagcgctgagtccaggcgaggcaggtgccctcgctgtcctcactgtgggcttcggggcactgccctgcagtttgaggaatttcctgttaaccttttctcttcctcagtcggccggaagagttttcagttgcttagaagcccactgccgatgctgagggcactgaccagccccggccctgggccctctgtgtggctcactcagcaggtgtgctgcccaacacaccaggcgccgtgagagcagtgggccacaaggaacgaggcgggggctgatggggagcaggtgct

SEQ ID NO: 272351 - DNA, 438 bp, Homo sapiens
atgcacttagtagcattctcgatagtgggcttggccactgggttcttgagctccattctcagggagcctacctacttcagcccagggaagggatagctcagacaagatacccagaggaggatgagcccagcaactcatggcccaggggtctttccatcatggccatttgtatattggctactaaatggcccctgttttttatttaaacacatgagttattttcctggaaaatccgcaaaaatacgtagtcggtttaattgatttagaggttcctgagccttcaaattcagtaatacataatttgccttcagaatcttcaattgtttgccttatttttaagagtacaggtaaaaaggggcctgtaggtggaggttgcagtgaaccgagagtgtgccactgcactccagcctgggcgacagattgagattccatctcaaa

SEQ ID NO: 272352 - DNA, 465 bp, Homo sapiens
cagccttcagccttagacctttcctctgacagaggctacccaaatgagaaggaaccagaaaaccaactctggtaatatgacaaaacaaggctgtttaacaccgcccctcccccccagaaaaaaaatcacagtagctcaccaacagtggatccaaaccaagaagaaatccctgatttacctgcaaaagaattcatattagttattaagctaatcaggaaggcaccagagaaaggcaaagcctaatgcaaggaaatccaaaaaaaaaacaatacacgaagtgaagggagaaacattcaatgaaatagatagtataaataaaaaaaccccaaaacttcacaaaacactggacacacttatagaaatgcaaaatgctctgggaaatctcagcaatagaattgaacaagtagaagaaattcagagcttgaagataagatcttcgaattaacccaatccaacaaagacaaa

SEQ ID NO: 272353 - DNA, 1843 bp, Homo sapiens
ttcccctcctggtgttgccccaaagcctaggagcttggcagggtcccacacaggatggtccttgtaggagacaggtttgacaagttgctgaggtgcctgatgggccaggcacttgtcatgaaatgagtttgcatcctgggggagcctcttcttcactggaaacctggcaaggatccaatttcccctttgcctgatccccacaggagcatagcagatagggaggggggtcacccaggtggctcttcctgcttggcccccactttccagaccattccaggcagggagagctgctgagctgactgcatgagctgcccacatggaggacccagccaccccttatgtccggcaggcagcccttgggctgttgcaggaccgtggccagttcttggtattgctcaagtcccctgggccttcagactggcgggtgacttcaagggagcaaccatcctgggcctctcctgggacaaacacttgccttcacccactatcgatgtcttgctcagccctcagaggagcgtggttggcgtggattacttcatgccttgattctgccttcccggaaaccacggtggcagcaggcttggatgtcaccaagtcaccgtgtttcatgctatttctggaggttctcgcctttgtggcctcggaaaggaaggcgatctggtgctttggggaaagccctcgggatgctcctccagatggtcttcttcaggccttttgctcagcattggtctgatcagttctgccagctctgggccatgatctcttggcactggcgcggctttccttcaataattccataaactccagacttcgtgtcttttgcatggaaagcacgcggtgcccatttcatcgacaccgcaccccggagtccaaacgtcagccctgcgggtgttgggtttgttagggacaatttcgggctcaggtgcagggggcgcttccccagcgcgggcgcttcctgggccccatctgaggccgtgggctcctggcaggaggacctggagttttcagatccccgggaaggatgcatttcccccactctcgggcacaagctgccctttgctggcgttgggcacggatcatggcctcgcagaagcccgcgacagcgtggagcaggtggtgcccccgcccgggactcctggtgggtgatggctccgggaggccttggctgggacagagtggggcctccgggtcggtcagcggcccgagcccggctgcggctctcggaggcttgggtttggaagacaccgcctgccatcccgcggcgcctctcggggtccgctcccccggactggccctgcccaccgcgcgcgagtagtagcgggcggccaggagtcagtggcaggcgcggccggtgggatgccgggtaggaggctgcgctggagcccgctgggcagcgccgacccctaaggcagccgggcgggtgagcgagcagaggcgtgggcggctgaggggctgaggggctgaggcggctgaggcggctgaggggctgaggaggctgaggggctgaggggctgaggcggctgaggggctgaggggctgaggggcgggcagcctggccggtccctgccgcagggtccaccgcacgtcacgtggccgaatccctcgggctgctttctctctgggctgttttcttactgtgaacctcgtgggctcctgctcggtgtcctttcttactctgtctctgtttttgcattctattggcaagtattttatttaggatattttactgatataactgaggatgaactgtgttttgcagcattttgttttattacgcgttttctcctagattttggtatcatttttatgctgacttgattaaacattttggaaactttcctgg

SEQ ID NO: 272354 - DNA, 450 bp, Homo sapiens
tgatcgtgccactgcactccagcctgagcgacagagcaagaccctgtcttaaaaaacaataaacaaacaaaagactctctcccactgccagggccccttgggaattcaggtgtggtcacagcatgggggaggggaggcctggaagaaagagccatggactttggtcccttcctgtaataacctcagaggcaaggcttccttatccttattttatagaagggtaaactgaggccacaggtgagtttgtttttggggtggagcttcaccatgggtgtcatcccagggcctttgtgtccttttgggtctgtggggatagacagcaatgactaaggccaggcaaggtggctcacacctgtaatcccagccctttgggaggctgaggtgggtggatcacttcaggtcaggagtttgagaacagcctggccaacatgttgaaaccctgtcattact

SEQ ID NO: 272355 - DNA, 420 bp, Homo sapiens
ggcagtacatcaatagcagtataattaaggtaataggtagcgtgccatctaatcaagttacttactgtaataccaatgtgggttaacttgctttaacatcctctgaatactaattactattactttcagaattttataatatgcaatatattgaacagaatttaacgtagctgaataataattattataccaataaataaaatagttattacccaagaaacataccgtagcttgttttaatagatgacttcgaaggtactccagttacaaaccaccatgacattagagaatgtagcctatgtctcattttaaaagatgccttaatgtaaacatcatatcctctatctctaatatagtttgtgtaaggctgatttttatcagaaattgaaatttaacttaaaaatcaaggttttacatttg

SEQ ID NO: 272356 - DNA, 910 bp, Homo sapiens
agataatgattaaaactactctggaatttttgaatgctagagcattgtgagcatcatatgtattttgtgtttccatagttttacaaaggacgagcaaatactcaagagaaaattataaagagagctcaaagacttatttaaaagatgtcaaatgcttattatttttccccctcatctctcccatgagattctaaaaaaagtagaattttgcctgggtgcagtgactcacacctgtactcccagcacttttggaggctgaggcgggaggatcgcttgagctcaggagttggagaccagcctgggcaacatagacctcatctctacaaataatcaaaaaattagctgggcatggtggctcacatctgtggtcccggctactttgtaggctgaggtggtagaattgcttgagtccaggtggttgaggctgcagtgagtcatgatcacatcactgcactctaacctgctcaacaaagggagaccccgtctcaacagacaaaaacatggaatataaagcctaaactaaatgcacttttctcatgtgtacactgcttacaaattctactgtacttgaatcttcaagctaactcactttcagaaaaaaaatgttcaactgagccttggttcaaccatcattgttataatggtttcttttacctttgagaatagcatatgaaagtgggagagagattataggtatgagccactgtgcccggccgcaaccttcaattatttagataattgttatatctttagccttcctaaggctgttatgtcttcaagctttctaagcattaacatttgatggtttatgttatgtgtatcctaagtgactttctctgagtcccttgtgtaagggactatgtcttttatattgtatattgcttaggcacataaatgataagtttggcta

SEQ ID NO: 272357 - DNA, 373 bp, Homo sapiens
agcaccgggaagcaggggccgagccttccccgctctgtgcctgggggctctgggcactgtctacacctgggaggtggtcagcatatgtgcgtgggaacttgctggaaggaaggaatgacccttctagccatggaacggtggtcatccgtgagccacggcctcaggaggtgccttcctaatgtgcaggtgacgattgcctctgagctcaggcatgcagcttctgggatgcactctcctttcacggcaaagcattctgcataggaaaaaccgtctctgcgtctccaagctgtggcctagcccttcattcatcaaatgggatacaactttcatttcttattaaaatctggaagtcactctccatttgtaagatatc

SEQ ID NO: 272358 - DNA, 493 bp, Homo sapiens
tccctgggtctggctcccgctcggcctcaggtggctctgctccgtccttccttgccgcaggcgcagtccagtctctgcgagtccccgggatgcgagcccgactttgagccctcggttaccatgccactgctctccaccagatggcctcagatactagcgacttctttgggagcacgcttactcctcgagaaaggaacccagaggaagggatgggaggccagattgctgctggcgctcagcccagaccgaacctacagactcagcagaggcgacctgtgtgccccggtggcgttctctggcttcctgggttgggagggggggttactccctccccgcatcccccccatgaggtcgtctagttttgtcccaggttgggtggggactgtggtttttttccctcagactgtaagccttgggggaggggggcgtgcatataggtacataggcactgcgtcggcaccaaagagctaaataaaaggattgttgaattttc

SEQ ID NO: 272359 - DNA, 365 bp, Homo sapiens
cagtagaactttttatgataatggaaatgatctgtatctgtgctgtccaatatagtagccactagccatgtatggctattgagtacttaaatgtggctactgcacatgagctgaattttcagttttattttaatagccacagcattgggcagcacagacctcgagttaggggtttgtggttttcatgtggagaagatgacaatgggaagtgggggaagtgaatggctttcccattagcaccgcctactcaattcccagtagaaacagatgttagactgcgagtgggctaataaacagtaataaacgggagaaaatggaggggcattcttgcctatgttaatctataacattcctatgttaatctt

SEQ ID NO: 272360 - DNA, 476 bp, Homo sapiens
cagatgagcctcagttacaagactaatagcagagcttgagcgtctgctctctactttacctcgtagcctgttgtcatcacagtggggagagaggcttttataatttcatgggataaactggtggtaattatagatcattggtttaaaatatgaattgatgttaaaatggaatacatgatagaaaaaataaagataggctgggcacggtgtcttatgcctgtaatcccatcattttgggaggtggagatgggaggattgcttaagtctgagaagtttaaaaccagcctgggcaacatagtgagagcttatctctacaaaacaataaaaaaatttgccaggtatgttggtgtatacctgtagttcagctgctcaggaggctgaggccagaggatggtttgagtctgggagacagagggtgtgagccatgatcgtgccactgtactgcagcctgggcaacagaggaagacgttgtctca

SEQ ID NO: 272361 - DNA, 388 bp, Homo sapiens
atatagagtcacctacttgtaactgtgccttgtattctctgtcttccatctgttcttatgaatgaaatgttccgagctgtatccttgcaacttgtgcactagatcccattccttcccctactcaaagagtgattcagcaactttctcctctcccctgcagcatcactcccaccctctctattgggtcattcccacaaccagcttggtggaagcaacaatcagcccgctcccggattcttgcagtagcctcctacctggtctccttttagcccctgctccctttcactttattttcatcgcaatagccagaatgattccattaaaatccactcttgctcagaaccctccagaggcttctcattcactaagtataaaagttaaaatctct

SEQ ID NO: 272362 - DNA, 413 bp, Homo sapiens
tttttttgtgatggagtttcactcttgtgcgatcatggctcacggcaacctctggcctcacgggttcaagcgattctcctgcctctgcctcctgagtagctgggattacaggcatgcgccaccacgcctggctaattttgtatttttagtagagacggggtttctccatgtgggccaggctggtctcgaactcccgacctcatctgcccacctcggcggcctcccaaagtgctgggattacaggcgtaaaccaccgcgcttggccagaaatatgtagattttaaagtgaatgaaaataagaatctttaaattatcaaccaaaatttgtaagttaagtcactaaaaatgaaattagaggatctattgtaattttgatgcaatttttttgaagatactttccaaatagtattttt

SEQ ID NO: 272363 - DNA, 684 bp, Homo sapiens
tcattcttaaatgatagtttaaaagaatataaaatttcagtagaattgattttcccttacccttcactgtcttctgttatctaagatgttcatatagttgtcactacttggtagataaactgttttatctagtctcatggctttatgtctatctgtcaatgactaacaaatttctatcttgagcctgcatctttccccttgagtttgcactagaaggaccaactgcccacgtgacatccattcttgaatgcctgataggcatttcaaacgttaacatttcaaagccaaactcctccccaatcctgtacctccttcagtcttctttatctcagctaatatcaacctcagccttgcaatcactcaggtcagaaaccctgaagtatttcttcatgccctctgtctcatccccttctttccaatcattccatgaccatcatctaggtctcatagttttgtggttgtttccaggttctatccagttaccaagctcagaatcagaccttccaattttggtttcgagttcctatcccaaatattctatcctaaaatgatattcaggaaactgaagatgtaattattgaactattggatgattcagttcctttttttggttatcagggttagtctttctggttttgatatgttttcttttgttgttgttattattattatttttgccaggct

SEQ ID NO: 272364 - DNA, 536 bp, Homo sapiens
aaatagtaatacaataattgtgggataattcagtataacccacttttaacaatggatagaacattcagacagaaaacaggtaagcaaacagcagacttgaacagcgctatagacaacatggacctaacatgtatacaaaacattctacctgacagtggcagaatatatatttctctcatgcacagataggacattctccataatagatcacattatgtcacaaaacaagtcttaacaaatggaagactgaaaacataccaagtatcttttctgaccataatggaacaaaactagaaatcagtagcagaaggaatactggaaaattcacaaatatgtggaaatttaacatactcttgaataaccagtgagtcaaagaagaaatcaaaagggaaattagaaaatatcttcggatgaaagcacaatatattaaaacgtgggatatagcaaaagcagtactgagggaattttataacaataactaaatttaaaaagaaaaatttcaaataagctaatgttacacctcaaggaactagaaa

SEQ ID NO: 272365 - DNA, 326 bp, Homo sapiens
ctggatagctgaaggggaacaggcattgcctgctgtgtttatttttccaaactgcttgcattttggacaagcggctctaaatcaatgtggtggttaggggctccatcgtctggtttatctcgtattcagacctttccattcagccaagtgggtaaatggtcccgacttgtcttgtttgtgtgaccacctttttgctacacctgaaaaaagtaggtattggtctgtggagaccactctgattaaagcagagcatggttaagtagtaacctatgcagttgacccctactggtgaatttaaacttcttaaaaagtttttaagataaatg

SEQ ID NO: 272366 - DNA, 353 bp, Homo sapiens
tttttagtcggagtctcactctgtcacgcaggctgcagtgcagtggcacaatctcagctcactgcaagctccacctcccgggttcacaccattctcctgcctcagcctcccgaacagctgggactacaggcgcccgccaccatgcccggctaattttttgtatttttagtagagatggggtttcaccgtgttagccaggatggtctcgatctcctgacctcacgatccacctgcctcggcctcccaaagtgctgggattcaggcgtgagccactgcgcctggcaccaaataagaaaatatggtaattctttactatctttatccactcaaaaagcttcatttaaagttgatgg

SEQ ID NO: 272367 - DNA, 418 bp, Homo sapiens
taacatctttctgaaccaaagcccatccgagaactagatctgactatggaccaccaccctgggatcatggtttgcactccactgactgttcaatgtcttattccagtgcccatgggcacttcaaattgagcctgccccagaccatctcttccccaaacccacctctcctccccaccgtgtaccttatctcagttagcaaacttccttctaacctgctcacccaagctggaaatatggatgagggtgtcctttccttcctcctttccctcctcctcccacattcactaaactctaccaacataacttgctaaataaatcttacctattcttacttccccatcccttaccaccattattgtagcttgggctgctagcatctgttgcctggcccagtagcctttcaagagttttgactgat

SEQ ID NO: 272368 - DNA, 163 bp, Homo sapiens
cactcttaagtgtgaacaatcaagtatcaccagacatgtgaggaaagtctccaacataaaatattaaagattaaaataaacaaataaatgaataaaggcaacttggagtaacaaaaagtgcagtgaaaagaacacttaaacatattattgacctcaaaaaaaa

SEQ ID NO: 272369 - DNA, 447 bp, Homo sapiens
gccattcagaattcagcttattttttgccaccttgggaaaagctttcctgactccctgtggctgactcggggtgtgcttctataacattcctgtgcacaactctatcatagcatttacctctgtttttttctttgtttttgttttttcttagagagagtctcaaactcttgggctcaagcaatgcccccacctcagcctcccaaagtgctgggattacaggtgtgagccaccacacccagccttacctctcatttaattgtcaaaaaaaaaaggcttcaggccatgcatggtggttcactcctgtaattccagcactttgggaggccaaggtggaaggattgcttgaaccaggagatcaaggctgtgttaagcgatgctcacaccgccacactatagcctgggcaatagggcaaaaccttgtctcaaacaaaaaagaaaaaagagaa

SEQ ID NO: 272370 - DNA, 409 bp, Homo sapiens
tcctgccccagaactcacgatgcctgggcacactttgcaggcaaagtgtggaagccgggcagaatctagagtgcagtgctcactagctgtgagaccgtgaatggcctggcatttctgagtgtgaactcatccacatgtgctacatgggaacatctcactgccctaaagaaggattgcaagcaagtatgccctgagtgtggcctagcacatctcctgagctcggtacatattagtttccttattcccaataattcttatctcccctttccctctttggggacgtacgaaaaaaaaaaggttgctttgttatgtcatgtgtaagagagggttttccaaaagtcccaccaaagaacaaataattgcctttttatgggtttatccctccaattaaatttcaagtgccttgaga

SEQ ID NO: 272371 - DNA, 340 bp, Homo sapiens
taggaacggatcagtctaaccccaaatgtaatcctgaaacaggattacaaggaagcacagccgtctctatctaaatttaaatcccgaagttctcatttatttaaaaacatcctatgatttataaagccatgctcaggtgttttctcacagctcatgatcctttccctgcattgaacccaacagcagtatgctgtcacgattcacctgcagtaacgctttctcctgagtatttttctgcctttaggacttgaaagtgcttcagagcctgcgtttggtaacctttaggtccagttggagatttatttagtgtgcttcatcctggagttttcctcgtttcggt

SEQ ID NO: 272372 - DNA, 451 bp, Homo sapiens
ctttttgacttaaccttttttgatattagttatcatagcaacttactagggaatagagaattatttagatacacccaatatatatattctacaaaagttgtgggaaggaaacccagtattgctataatgaaaacaatataggtgacctgaggttttagtcttggctataccactgacaatcactttgtttctctagatgtcattttccttttctataaaaggaagggtggattagctcaagtccttgcaacttaataattttcttgacttgattatataacaggcatctgttaaaagcaggtaagtagtggccagtcacaatggcttacgcctgtaatcccagctttcagggagggagaggtgggaggatagcttgagcccaggagttcgagacctgcctgggcaatatagtgagactccgttctccacaaaaaagggagaaaaaaaagac

SEQ ID NO: 272373 - DNA, 305 bp, Homo sapiens
cagagcccacaggagttgctgatggcttccgtgagggggatgacagggaaggtgaggaatcaaggcagagtctcagctttgggatctgagattcattcaacaaataattaattcattgccacgtgccaggcctattctaaaagttgaggatatgaagacaacagtggtgatggcctcacgcagtaatcccagcactttgggatgttgaggcaggaggatctcttgagcctgggaggtggaggctgcagtgagccatgatttcaccactgcactccagcctgagtgacagagcaagaccctatctc

SEQ ID NO: 272374 - DNA, 868 bp, Homo sapiens
gtgttgttttaggtaatctcatcaataagagtgttttcttggaaaggaaccagtgagcagtgtttgtgatggagcaaagcacggggtatttacactgtggaggaaactgctccatgataataaaagataaaaacctaaaaaagattagtttggctgctaaagcattcctttcccagctataattatctctggcttttgtgaagttgctagcacagcaactaaacaattgctttacagagttagattagtggtgcaatttcttctctttcatctccccttccctccccacccccccaccaaattatggcactactttctgttctggaaagagattcctcacagcagtaaaatcaacactaatgtttattgctctactccaggatgtttttgttttgtttctcgtcatttaaaaagtattttaagttatataccagcagcttcaagtttaatgccattagaaattgccatcaggttcctaggatttagagatggaggaaggattatttggaattatgcttcagtatcgtattttagaaggggagatagaggccgggtgcggtggctcatgcctgtaatctcagcactttgggaggctgagttgggtggatcacctgagatcagacgtttgagaccagcctggccaacacgacggaaccccatctctactaaaaatacaaaaaagttagccgggcgtggtggcgcatgcctgtagtcccagctactcgggaggctcaggcaggagaatcgtttgaatccgggaggtggaggttgcagtgagccgatatcgtgccattgcactccagcctgggcaacaagagcaaaactccgtctcaaaaaaaaaaaaagaggctcacgcctgtaatcccag

SEQ ID NO: 272375 - DNA, 407 bp, Homo sapiens
caacagagagaagtgcttctctttctggaatgcccactggtgctactactaaggtctccagaacagaagccctctccttaggcagaacatccaccccaggtcctgctcaatccacaatatcaccagaaatctccacggaaaccatcactagaatttctactcccctcaccacgacaggatcagcagaaatgaccatcacccccaaaacaggtcattctggggcatcctcacaaggtacctttaccttggacacatcaagcagagcctcctggccaggaactcactcagctgcaactcacagatctccacactcagggatgaccactcctatgagcagaggtcctgaggatgtgtcatggccaagccgcccatcagtggaaaaaactagccctccatcttccctggtg

SEQ ID NO: 272376 - DNA, 189 bp, Homo sapiens
aaggtggaaagctctccaacccatcttctacagcacagcttcctgaacagggtataagtatgctgagatgcaggctgctctgggccccgagcaacctctccagttatcctcatatgcatgtatgaatactgtcatttttctgtgcgtgcagtgaaaatggcctcatctcataccatgactccacctcca

SEQ ID NO: 272377 - DNA, 198 bp, Homo sapiens
caacttcctctttttctttattctccattagttttacctatttagcagtgttttaagttgttagccaatcaggttcagtttaaattgtaatttctagctccagtcaatggagacaacacacagtagcaaggacaagctgcataaaggataaaaattgcttccctcttttctccagaaagtaaaattaccttactgaga

SEQ ID NO: 272378 - DNA, 249 bp, Homo sapiens
gaaaaaagtaagttattggtaataaaccctcaataaactagatatacattatcttagatggacatagacaaacagagtgttagtgaattagaagatggttctaaggaagtggcttagagaacagcatacaaattgactaggcacagtgtttcacgcttgtaatcctagcactttgagaggccgaggtgggcgaatcacctgaggtcaggagttcgagatcagcctggacaacatggtgaaaccccatct

SEQ ID NO: 272379 - DNA, 433 bp, Homo sapiens
caggggtcactgaaatgccatgggtatatccatacctataggctgaatgaatagaagtcactggatcctgaacatgtaagtatttttctaggttactaaataaaatgtctcccttttcctaagtttagtttgttccccccacctctcaccccaactctcatctgtcagtttctgtgctccaattagaagtacttgttagtatattctcactcatgggtgggaattgaacaatgagatcacatggacacaggaaggggaatatcacactctggggactgtggtggggtcgggggaggggggagggatagcattgggagatatacctaatgctagatgatgagttagggggtgcagcacaccagcatggcacatgtatacatatgtaactaaactgcacaatgtgcacatgtaccctaaaacttaaagtataata

SEQ ID NO: 272380 - DNA, 682 bp, Homo sapiens
cactctcttaaagctattcccattctgagctgtcactattcttggcagaagcttgtcttttatttcaagacaacatcattgtgcaaatgttgctaggtcccaagataaaaagcacagaatcaaaatgattccattttctgttagtgagtggccatcttcactagctccctccttcagaaccttactcaaaaatctttagttctgaacctttctggattaacctcactttgcccttcctactctgatctatgatccatgtctttttctcacacggatatgattagttaaatgtaaaatgacatggttcccctctctacccatttttcaagtgactcattcatccaacaaatacatgttgagtgctttctgcatgtcttatgtctgccacttagaatataatcagtgtacaaaacaaagacccttgccttcactgcactcatgttctagttgtgcgttgtgcgtgtctttatttctcaataagagtttcatggccctaccacctaaaaatgccacaaaacaacaatcccacaatcccattcagaaagtgaatgcatttaacttgaaacacgcagtataaatctaaaggagcagggtcaaataaatgaggctgaggctgtggctcatacttgtaatcccaccactttgggaggcccaggtaggatgttcacttgaggccaagagc

SEQ ID NO: 272381 - DNA, 440 bp, Homo sapiens
gcatttacttgctgtatgttttagtggatccttatcctttgcaaaaatttaattctagtcattaatctgtcacttagctcctgtgaccttgcctgtgtaaatacagttaacatcagctttatctacctcagtcattgtttgttgaaagagcatatgaaataataaaagagcatttgtgtttgtatggtgggtattggttccttctgctttctctacatggaaaagtgattgtcatttctatggtaggcttatttttaggcctattgtcttcatccccttaaatattggaaatctttgtaaattctcactcatacctaaagcagagaacctacgtgccatgtggtacttgttttttttttagtgtgtgtgggattcagaaattgttaataatgaatattcaagaaggtacttcagtttttatgttattgagataaataatg

SEQ ID NO: 272382 - DNA, 620 bp, Homo sapiens
  misc_feature (392)..(392): n is a, c, g, or t
  misc_feature (462)..(462): n is a, c, g, or t
gtatcgtatcatgtcatgctgttccagtgtaaacccggcgcctaccgggtcctgaattggaataagcctgcggatacatttaccacttgattagtactattatattatttactgtttgatatatctaagcatagttcttcaaatgcatactccctgagggaagaaactttgacttacatgtaccaccagagcaagcagcacaatgttggacaatacacatatttgctataatgggcaaccaaagaatctcatcactggggtcaggattagaaactctactataactcaatctcaggcaattagaatatatcctaaaataattctctgcattgcaataatcaagaattaacattaggtcgggcatggtggcaggagtaatcagaggtgttctngtgttgtgataagggtggagaggttaaaggagccacttattagtaatgttgatagtagaatgatggctanggtgacttcatatgagattgtttgggctactgctcgcagtgcgccgatcagggcgtagtttgagtttgatgctcaccctgatcagaggattgagtaaacgcctaggatacgaggtggtctagaataaataggaggcctaggttgaggtaatctgaggg

SEQ ID NO: 272383 - DNA, 412 bp, Homo sapiens
gcacggggctgaaaggaatgtgggtgctccgtctgcagctagtgagctcttggttgcctcactgtttactggaggtgcaaggtgcagaactgtgtgtgtcatatcccatcacttacctgttgattggttggcagagtatgagcgtacacgcatacgcgcatgcacacaaactttcctatttgcttatattacaaaccaaacaaaattaaagaataaaccagaaaccaatgaaaaagggttatagtctatatggggaagatgagatacaaagggtcagatctgaagcctgacttctcttctctgaatgtaccttgttttatagttttttactttgaatcatgtattgctttacataattataaagccaaactaagcccaaatcagaaagctattcttaaaaagcaagaacaaa

SEQ ID NO: 272384 - DNA, 432 bp, Homo sapiens
caatgagaactttaatatgactgaccttcaaatcccaagacaggcttgaagcacatccagactccctctgaaaaagactgctttgaagttcaaacgttttctgctgttgctttacttcacttatttattttggttacagcaactctaaaaagcttaaccaaaaagaaactgatggattaactccaaattcactcttggcccttctaaatgcagggcgatgaggaaaccctcagcccccctcagaggagaagttcccacttgctggccgtcactgcccttcctgcctggaaggagtccctccatgttgcaggttactttacaacacacacccacaccttttttcccttgaagctcatcaagtgaagttatcagctctttagagaaatcccttcaattcctcacagtatttaaaacaaattatttttacctgca

SEQ ID NO: 272385 - DNA, 471 bp, Homo sapiens
gaagtcagggtcttgccttatctagtcaggctggagtgcatgcagcgcagtcacggcatactgcagcctcagagacctcctggtttcaagtggtcctcccgccccaccctcctgagtagttaggactacaggcatgcactaatatttaaaactctttgtagagattaggtcttgttatgttgcccaggctggtgtagaactcctgggctcaaatgattcttctctctcagcctcccagagtgctggtattaaaggtgtgagccaccacaacccacctgttattaaatatctgaatgtttaagtctctgaaaaaaatgatggacaaggtaagatagatggataaaattgctgaaaacagctcatgatcaaaatagaaccctaaagagttatctgtatatccatgtgatttctgttatttgccatcataataccagaatcaaaatgaaaaataaatttcatgtaaatgaaaaa

SEQ ID NO: 272386 - DNA, 362 bp, Homo sapiens
tgtctacatgaggaagcgaaggtccagagaggggaacaaccaaagtcacagcgtgtcggttgtagaaagcatccaggatttctaatcctgatttaggccaaggttcgccagaaatcaaactcaaaagggaaaaagttgaagatctacaacaaatttaagtaactggggaacatccttcctccccaccatctgtgttggtgatctttgacctgaagtccctgaacaccctatagatgacggcatgtacatgtgagtatttcctgtgatcccaaactgtgaacagccactggctggtctgtgtctttgttgtcttcccaaagcttataaggaatccccaatacactggtctgctaagtgttttt

SEQ ID NO: 272387 - DNA, 1108 bp, Homo sapiens
ttttcaagttggctgactagggatgttggatgccaggtctcctcagaaagatcaaagttacaggtgaatgcccatgatttaaatggaaatctgagggaatgaagcaaggacctgttggagcacccatgggaagaacctggggcacaaaagaggaaagcagcaagagactgacagagattgtctccctagaaacctggaccacgaaaagggtggagaggagaaaactctgtgctaaatattactcctggaaaagtgcatttgcttcggagaaatctttatcatgggtctctaagaggaaggaacaatagcatcttctatgtgccgaggtagcgcaataatgaactctgttcaagtggatcaaaagccatcaaggtcaaaattaggcacaggctgtacaggaagcgtgattctggcatctgtttggtttctgggaaggcctcaggaaacttaaagtcatggaagaaggggaagggagagcaggcacgtcttacatgaccaaagcaggaagaagagagagaagtgtggaggtgctatacacttttaaacagccagatcttgtgagaactctgtcagaagaacagcactagggaaatggtgctaaaccattcttggggactccatccctgtgatacaatcacctcccaccaggccccacctccaacactgagaattacaactcaacatgagatttggatggggacacagatccaaaccatatcaaattttcacacctttcagtaaagctttatattttttaaggatatttaagtacttggaagtagaagtagagagtaaggggaatattgtacagccatcacagcctttgtctactaaagaagtcagtttcatgtgacaaatgttcattttaatattcgcttcttcagtccatctgggggtgtttccttatttctataagatgctgcttttcaaaaaaattaccgaaagcattctggaaatccaagagtaattgtgtgaactataagcattagaaaacacagacataagttgaaaatatttatgaacctaaatagatgtaaagctagtgactcatattttataatgtattcacagatgatatttcttaaataaagtaggcatttctttaaaa

SEQ ID NO: 272388 - DNA, 338 bp, Homo sapiens
taacagctattagtcagggtttactagagaaaagagctaataggatgtgtgtatgtatgtatatatatacatagagaggatttgtttaaggaattggctcatgtgattgtggagccttggcaagtcctaaccctgcagggtaggcccacaggctggagactcaaggaagagttctagttgagtccaaaggcagttggctggctgaatccctcctgttcagcagaggtcagtgttctgttaaggccatcaactgattggatgagtcccacccacattatggagggtggtccgctttactctaagtctgctcatttaaatgtaatcttatcttaaaaaaa

SEQ ID NO: 272389 - DNA, 537 bp, Homo sapiens
ggggcctaacagaacttgtagatagatgagtgtgagttgtaaaggaaagagtgagtgatcaagaattactcatagatttttaaacctccagcataattaggtgcacagtgacattgggaagaggtttagatgggaaaaatcacagttcttcgcttgtaattgaattcattactaacctcatctcgtttgtttttggggttgttccactggaaaaaggaaaaagctacttgtttctttgagttaggcaccaaggcaaaatcataatttatgatgtaggtgtgttgaaaatttttggattgttgtatttatatagcatatttatgctctagagcattcgtgttgtggtttacaatttaagcatgtgattaagacagaatagccactgaacttacaatagggcacagcagtattacaaaataactacacaaggttataaattaaaacctttgtttacgtaatttatatgctctttagagttaaactttaaaaaaaaagcttctaagtttctgcccagttttatgtcttgtaaaaaaaaaa

SEQ ID NO: 272390 - DNA, 319 bp, Homo sapiens
ttcagactgacatttccttctttggaatggtaaccaggccaatgaatcaagtgaaccaacagacctggtatatctgaatttcagtaaggaatttgattttttttttaatgatgagaacatggaccaagtacaaattagttgaaaacctatggcgctgaatgatgaattgatttcaaacatgaaacagatttttagacccaccaggctctgaattctctggaggtccacagtttcaatgaagatttagatgaagataaagaccaagactttcctatttgtagatgacaaaactgggagataaactatcagtcaaaagaat

SEQ ID NO: 272391 - DNA, 418 bp, Homo sapiens
agaaaagcttggataattgttctggtaagaactcaaccaattggtgtttgcctttggctgtgcatagggaatccttctcacttggtagttgttgggcagcatacggttttagggtgtttcagagtccttagtcttgttgagatttatccctcgactagaggggatcccggaggtctttcccaaaacttcccttagaaatggtcctaggcttactccaaacatgttcatccaccaacttttggagtcttccagcccaatgcggaggtgctggctgctggtatcttttgaaccgcagattccatttcttcctctgtaaaatggaaacagtgtcttctgttatgagaagaaattgaatcctattagccaaggactccagaaattgatgtgctttaagcaaatggggataaaaaggagacga

SEQ ID NO: 272392 - DNA, 397 bp, Homo sapiens
atagcccaagatggctgctggatcaccagccatcaggcaggtaaccatcaggaaagaggaaagacaaaagagagcatgcctgtgtacctgttaaccaagaagcattcctgaatgtcccacacagcaacttttgcttgcttttcattggccaagcttagccacttagcctgcctaactgcaaaggagactggagaatgaggtctgttatttgggtacaaaaatcaaatttctgttactaacggagaaagtggatactgggtagaccaagagccaagtctgcttcaaaaggtaactgtggaaaacacagtgtaatgaaaataaagcaatattattaaagtctagttagatatattgcttgctaagcctgagccttctctcccattattaaaaaaaaaaa

SEQ ID NO: 272393 - DNA, 308 bp, Homo sapiens
caggcttgatgactcagctaacccacttgcttcaaatattctgggagacctctggagcccgggaggacaaatctggtgtggattaagaaagagcagcttctatttttacctaacatgtcagctgcatatttcaatcctgacagcacatttgttttagagaaatttttatttacaatgcctagaacaaaaaagaacaaaggaagtggacaggttaagaaccaacccagcttgctaatggagttagaaaacacctcccagagattgccagagaaatttttatttacaatgcctagaacaaaaaaaaaaag

SEQ ID NO: 272394 - DNA, 350 bp, Homo sapiens
agatgggaactgttaaaataattaatcaggaggacatttacatgagtcaccttcagcacctttggttgctacctaagcaaatggaaaaccaactcaatgtaaacagtaaaatgaaaccagcgtaaccaatcagaaactgccagctaacttctaactagagactttaccaatcagaaactgacctctcaccagggactttctgctttaaccaaatattttctttgtcttgcttccatgagcaccttataaaagccccctcctctcctcccctcggagcgccaggctgcttgtggtctggtgctgcccgattcctgaatcatttaaagctcaaataaactcatgacatttta

SEQ ID NO: 272395 - DNA, 376 bp, Homo sapiens
ttcttcatccagtctatcattgatgggcatttgggttggttccaagtctttgttattgtgaatagtgctgcaataaacatgtgtgcatgtgtctttatagtagaatgatttataatcctttgaatatatacccaataatgggattactgggtcaaatggtatttctagttctagttccttgaggaatcgccacactgtcttccacaatggttgaactaatttgaaacatacatatttttatatcacaactattatagacatctcaaaatattgttgatgcttattactatttagaaaatacaatagttttttaacctgaggccagatcatgttatttcattcatcaataaacacatatatcacaactttaatattt

SEQ ID NO: 272396 - DNA, 321 bp, Homo sapiens
gccactgtgacagccttttttgggtacccacattcagtggatcccaagctcttgtgtggcatctaagatgaatgagatagcccagacacttgaaggatggtgaaggtggagaattgtgttaggcaatgggaaatgcctctcagcaaagaggggagccggagaggggacaggacagcaatacctaatgagcaattaaagtgacttactgagagtgaaggcttcttgcaggtcacagcagccatatgtcacatcagacataaggcactgaacagaagcaattcaacggaatcatgtcatccatcaggcaaaatacatgcagag

SEQ ID NO: 272397 - DNA, 436 bp, Homo sapiens
atccgcggaaatgcaagcacgcagcgccaagcccaacccagtaggtgccaggccctgggtgcaggcttcagcttcacgccacatcctctctctcttttcagtctctgagtgacttgactcagccagggagaggagatacctacacatccgcatgaaggcgcgtgggaggaagccgagaaatgacggatggcgcagggcctactgcagccgcacgtagactagctccttctttacgggcaaaaccccctacttgtctgcagtgggaaaggagtccgttcagggcaagctctgatcgctgagctatggatgtagatggtaactaggcgtctggaggtcattacacaccatattcggatggtggaaatcattgcttatttcaggacactaaaatggtccatttttatgtattaaagttattaagaatgaactggctggg

SEQ ID NO: 272398 - DNA, 498 bp, Homo sapiens
tcggccggtaccgatgtatcgcccaacacactttgtaaaaggactcttccatcaagagtgggaaaaccatgggggaggactaggacccatatgggaattattacctctcagggccgagaggacagaatggatataatctgaatcctgttaaattttctctaactgtttcttagctgcactgtttatggaaataccaggaccagtttatgtttgtggttttgggaaaaattatttgtgttggggattgttatccccaacacccaccccaaatatttcccaggtctcgctgagctctgccagtctgttttcactgccctttgaaactcataactaagacaccaaagcttccagatgcctccagatgcttccagatctgaccaagactgctgaggcagacaaagcatggaccacagcgatggggcatgagagagtggggctgccttccctctgccggggcagcagaggctgaggctgtgactgtgttgggcgataacatca

SEQ ID NO: 272399 - DNA, 496 bp, Homo sapiens
atatatttttgaatgaagttcaaggcatgtatttttatgtgttaaccaaaagatgcattcaaggatgttaatctcagcaggatttgtaatacacaaaaattgaaaaaaacctcaaatgtctatcaatggtagaatggaattttatacagcaatggaaatgcatgaactatgactattagcagcaacatgaatgattttcataaaaatagttttgagcaaagaatccagatataaaagagggcatgccctatgattctacgtatattaagtccaaacacaagcagtactatctatgatagtaaaatggtaggctaaacattggggagttattacattgacaacaacatgaaggggtttatgggattctggtaatgttttgtttcctgatctgggcactgggtaccaggatgtatttactttgtgaacatttaaccatctacgatttttggatttttctgggtatatgttatactttcaataaaacattttcatgaga

SEQ ID NO: 272400 - DNA, 522 bp, Homo sapiens
tgactactgctatgatcatcatcagaaattgtatcaaattgtggtgtgatacagttggtaggtatcccgtggtgttaaacaggtgcaaggtgtggctgaatggaaggggagtgaggctgggttgaagagtggtcccagagcagaccttcagcctggccacaccattgtcagatggctttgtccctctgccttctgttctgctgctaagtgaggaagagcacctcacgagtcacatttcagcaattgtatcactttttcctatcttgctgttgaccaaagtatattgagtgcactgtgtctttttattcgattgaacaaaggatggaatataatgatcaaacaatgaaatgagcacagtggaataatctttgttttcatacatgtaaagaatatctggccgggcacggtgggtcatgcctgtaatgccagccctttgggaggctgaggcatgtggatcatgcagtcaggagtttgagaccagcctggccaacatggtgaaaccccatctctactaaaaataca

SEQ ID NO: 272401 - DNA, 266 bp, Homo sapiens
tgtaaagatgaggtcttactatgctgcccagactggtctcaaacgcctggcctcaagtgatcctcccaccttggccttccaaagtgttgggattacaggtgtgagccattgctcctagctatttttctttatacctttgctcaagctgcttcctaggccagaattcttccattcatacttagctcattcatcacttccccctagaaaatcttcctttattttcctctctacacactcaacagtattggtacccttctctgttactc

SEQ ID NO: 272402 - DNA, 288 bp, Homo sapiens
ttgaataatggaacaataccaactagagaaaagacttgcagacactgattctttggggacattcaaccaaaaatgaggttatgtcgttgttcaacaaaaatgaggttaaactgagcacagtggtgcatgcctatagtcccagctacttgggaggctgaggcaggagggtcacttgagcccaggggttcgaggctgtagtgcactattattgcacctatgaatagccactgcacttcagcctggagaacatagggagactctatctcttaaaaaaaaaaaaaaagagag

SEQ ID NO: 272403 - DNA, 410 bp, Homo sapiens
gtccgcctcccacagcacccccggctccatgctttgaagcccggctggcccacacacacttctttaccccccagcctgaaacttcacctttttcgggtcacacaccgctttgaagcggtaatgaaaactgggaaccctctctccatgtcagtaatcatatgcacacagaattctgcatgcaacgtagtgggctcaatgcctcctgaggaccaccaatggtcccatccacattacacatccagtctctcaccagactatgaggctcatgaaaggtagagccatagaagtcgcggcgcagagcctgggcgggagtggagatggtttgtaaagacgtcttagggaacctggactttaaacttggaccattgtatttgtaaatttagcaaatgaagcaacagatgtgaaaactg

SEQ ID NO: 272404 - DNA, 621 bp, Homo sapiens
agtctgccctgtccttagcttctgcaggaggtgtggggaactctgccttctacaatgtgatgctgcacagagagctgtctgtcatcttcgaccaattccatggcattcaggacactgtgataggggaaggaacgcactttctcatcccatgggaaaagaaaccaattatttttgactgctgctcttgaccacattatgcaccaatcatcactgtgagcaaagattgtcaccatcacactgggcgtcctcttcccaccttgttgctggccaggtccttgcatcttccaattactggagaagccaatgaagaatgtgctgccatccatcactgcggagctcctcaagctgggggcggctcaggctgacgctggagaactgatcacgcagggagagctgggctccagacaggtgagcaattaacttcggagcaagcagcaacctttgggctcctcctggatgctgtgaccttggatctgaccttcgggaaggaatttgcagaagcagtggaaccaaagaggtggctcagcaggaagaagagagggccagatctgtggtggcaagggctgagcagcagaagacggcggccatcatctctgccgagggcgactccaaggccacgga

SEQ ID NO: 272405 - DNA, 428 bp, Homo sapiens
tttttttttttaagacagagtctcactctgtctcccaggctggagtgcagtggcgcaatctcagctcaccgtaacctccgcctcccaggctcaaaggattctactgcctcagcctcctgagtagctaggattacaggcatgcaccaccacgcctggctaatttttgtattttttagtacagacagggtgtcaccatgttggccaggctggtctcaaacttctggcctcaagcaatctgcccactttggcttcccaaagtgctgggattacaggtgtgagccactgcgcctggtctcttttcctaaagttcagttcaatttatataaaacgcaaacttctggccaataatccacaattgggtaattcacatatggctcatcaagaattggctgcattttagaatacaattttaagattaaatttagact

SEQ ID NO: 272406 - DNA, 437 bp, Homo sapiens
tcttttctagttttatgatctgagccaccctggcactagaaagtagcactgaaggatgctgaaggatgtgaaagtagagcaatttgcaaagtcacatttagctatgcattattagaaaagctttaagtgtgaaaaaatttaacttgctttaagttatgctaattctaaaacaaaaaccaaatgaattccaatttaattagaattaaatctaggagtaatagatggcttttcacaaatttttaaacatacagaaaaaagtagtgctttgagaaaaatgtcaacgagataatactagcctctaggatcatttatcattttcaatacagctagttagagacctcacagacagtgcttcccttaatggtcactcagcagggcctcgatccatctgtctccattaaaaggaagaggaagtgttttatttatagaatgacaaa

SEQ ID NO: 272407 - DNA, 356 bp, Homo sapiens
attcaattacctcccaccaggtcattcccacgacatgtggagattatgagagctacaattcaagatgagattagggtggagacatagccaaactatatcagagtacctatgtgatcagcccccaataaaaatcctgagcagcaaggctctaataagcttcaataattgatgtttcagatgtattatcataattcattgctgaggtaattaagtgcatcctgtgtgactccactgggactagattgttgaaagtttgcacctggtttccccatgactttgccctatgtgccttttctctttgctaattgtggttggtatcctttttctgtaataaatcatagccatgagtatgacta

SEQ ID NO: 272408 - DNA, 183 bp, Homo sapiens
aaaacaataccttctgttggcatattcaccagggaccaggatggttttagaacctgtctaggcattatgaactcacacctctgccctaaagaaagctggtaattacagattccaaacacgctaatacgtggcagtcactgctgtttgttttgcttattggtccaattacttgtttctttatta

SEQ ID NO: 272409 - DNA, 337 bp, Homo sapiens
gcattcaagtgtatgttggtcttgccaaaattatcaataccttctccgtaaataccactttcaagccttgtaggttaagccctgattatgtttgtaaaagtagcttgatctacatgtctacaattgttctctaatttgctttatccaaatggaaaaaaaaacacacaatattttaggccttgattttcatcatgaatttttaaaaatctaaaattgcctcttcattgtgttatttcaaaatcatgagatatcctttcattgcttctactgataaggttgtttgtaactcaaaatcataattggtagatcaacagaataaaattatgagatacaaata

SEQ ID NO: 272410 - DNA, 869 bp, Homo sapiens
tatgagaaattcaccttaccattattgtatcagaggtatgggaagcgccagacgttgaccaggcccacgaagccgccagccacggagatcaccaagtcgatcttgctagacgagaccacttctgcctctgcggaggttttccctcggccttgtcctcagaccgcgctctctggctcttccccagcgagggcttcaggatgtccttgtggaaatctttcagacactgcagcttctccttggtgaccatctcttcgctttcccacatggagatgaggaactaaggctcagagacgttaagcgacttaatcaaagttgcacagccagaatgtggtggtagaaaggtttttgacacgtgcctgaataatgatacaaaaaaggaaggggtctgtctgtgtttacataattttttcccttccctaagaaaacacacaaaaataaataatgagatgtagaaattaacattaacagctactttggatggtattttacccaggtttgcactaattattcctttctggaaatgaatttattgttatgcagcttacagtgaaaatgttaaagagaggttaatatctctcaaccacagattaaatgcctggaggccatgacctctctaaggagctaagaataatctatcagtgaaaacaaatataaggatttagaatggtattcttgtctattctttgtaacattttaaaatatagggcttctatttcaaatatgaataattatttttaacatctcatatcatatggcttttttattacgatagcaccaatacaatttatgtctgtaatagcaatatattaggatttataactaagttttaagcgctataattttaaataaattctacacaacaagataac

SEQ ID NO: 272411 - DNA, 710 bp, Homo sapiens
tgcctctttttataaggacaccagtcacattggattagaggcccaccctactccaatatcactttaattatatctgtaatgaccctattttcaaataaggtcacatcctgagttactgggagttaaaacttgaacatatgaatcaaggggacaacatttgtttcaaaggaaattgctcaccctcctctttcctattctccctttcctaagggccgcacacatacagagctgaacttgtatcgccgtgtagatgaagacaaacacctttaggagatggccgagaaacaaaatgggaaaccctcaggtctccaaatgactacaccaagcagaattgccccaccagcctgcaccattcatttctagactatgagcaagaagtacacttccatcttatttaaacaaccatatttggggtttttgttgttgttattgttgttgttataggagcttagcttttactctaagaaatacagctactcaactcacttcattaggatcttaactataatatcaaaacctcctaagcacagaataaaaaatacagtagagcaatatcatttatgatcatagatgcagagcttccaaatgaaatactagcatattcaaggaaagatatatataccatgacctagttgtgtttaatttctggaattcaaaaatggaatgtttgacataagaaaatctattaggccgggagcggtggctcacgc

SEQ ID NO: 272412 - DNA, 684 bp, Homo sapiens
gcaaaggactgaactctgaccaaccagaagaaaggaaaaactggagttcctttcccctagtgagcatacaaaggcttttcatccgctgaacccagcgcatctgctaccatttccctggtctccggtcagaactagtgactgtcccataaacaggttctgctggacttccagtcaagatggagcgggccgcacacatacagagctgaacttgtatcgccgtgtagatgaagacaaacacctttaggagatggccgagaaacaaaatgggaaaccctcaggtctccaaatgactacaccaagcagaattgccccaccagcctgcaccattcatttctagactatgagcaagaagtacacttccatcttatttaaacaaccatatttggggtttttgttgttgttattgttgttgttataggagcttagcttttactctaagaaatacagctactcaactcacttcattaggatcttaactataatatcaaaacctcctaagcacagaataaaaaatacagtagagcaatatcatttatgatcatagatgcagagcttccaaatgaaatactagcatattcaaggaaagatatatataccatgacctagttgtgtttaatttctggaattcaaaaatggaatgtttgacataagaaaatctattaggccgggagcggtggctcacgc

SEQ ID NO: 272413 - DNA, 532 bp, Homo sapiens
caggctcgagagctgtgagaaataaatgtctgttatttaagccactcagtctatggtagattgttacagtggcccaaaatgactgagacattttttcgtatcatcaatattgcatatgctttccactatgttcttgaaagtgtatattttaaaggttcgcgagcttgaaatggtatcttatttttttaatgcattaaatttaatataattttacactcctgcctcaatgcagtctacccatccaattttttttattggatagtgagattggtaatatcaaccacaaattatattaacagccatttcaagttattcttttaatatttgtattttttcttttaaaaacgattttagtgtttgcattttgttttataaccaaatgtttaacaactatttggatgtatctttatgttgaatttactcctgtgttactagataatcttttattatcatggcttaccaatttatgacccattaatcacagttatatcttaatatgttgaaataaatcttctagtaatttttttcaagt

SEQ ID NO: 272414 - DNA, 485 bp, Homo sapiens
actttctttacatctctaccctatcactactgggtctagtaatagtgattgggtctagtaacagtaattactattgtggtctagtaatttaaatgtaatacagatctgttaaactacatatataaaaggaaatctcaattcatttaggtgaaacccacaacaatatccttaaataattgcagaaatccagcatacagtttgaaagctaaaacttgttatgtatttttagattaagttataaatgtacgaatccatcaagttcagttcttcattcaaaataattgtctgaatgcacttaaactgatctggcattcaactgttactttcatttagtaacagctatatccttaagaaagtgggcagaaaataactggaagaaaaaaatttttaatccaccatctagtccttctaaatgctagaaattctctccagcaatttacttacagtgtacatagacatccaggtggctcactataaatttccta

SEQ ID NO: 272415 - DNA, 213 bp, Homo sapiens
accttgagcaaacagagatgagagagatgaatttctaggcacatagatctgagttaagaaggaaaaaatcattaccaacaccaaacagtatttactttggaaaaacagaatttgtgaaacagaatttgagaaacagaatttgtgaaacagaatttcactgttaacagggttgaatttcatctaatgtgaaatacctaaagggactggcttatc

SEQ ID NO: 272416 - DNA, 327 bp, Homo sapiens
gtcctactgtcaggatagaaccctgactcttacacggagagatgaggcatttggagacatgtgaccatcatttcaaaatgaggtcattaacacttttatatttcacatgtagaattgtcacttaaattcaaactgctgttttataattattttgtattagccacctttatatttaagatttatagccttcaataatttgggggaccatctcatgacctaggagtcgggctcattactatgtaatgtttgcttgtggggcccagacctcctaaaggggatttctgtaggaatccctcaagctgtctgtgctttagtgagcaccactat

SEQ ID NO: 272417 - DNA, 758 bp, Homo sapiens
atcccgtctcatgttgctccactgctggggtgggaggtgaggagtcatggaaggtatcagtgttcttacatccttagggcaccctggagacggacttacatattcaggccttcgcaagttattagaagactggtagggtgaaattgaccaaggtgtgagtgtttacaccatggtgatgggtgaatgctacagatcagagcttcctgtttttggagagctaatttacagacacaccatgacctgcaccccatgcacacatctctgcacaccatccctttttaccagtataacagataatatgcgcacttatgaacgtgcacacattcacatccctcttcttgtattttgctcttccaaaacctcacaagatgaaattactgttttctttttctttttttttgagacacagtctcgctctgtctcccaggctggagtgcagtggtgcactcagtgctgcctcagcctcctgagtagctgggattacaggcacctgccaccacgcctggctaatttttgcatttttagtagagatgggatttcaccagttggccaggctggtcttgaactcctgacctcaagtgatccgcccacctcggcctcccaaagtgcgaggattacagccatgagccatatgaggacaccaaggttgctcagacagtggagatctgtctgctcacataccttcagcttgtcctgacaactttctctttgcacatctggcttcctgatggactttcaatggatttttgcccctgttg

SEQ ID NO: 272418 - DNA, 668 bp, Homo sapiens
agcctattgagaactggttataaaatagaaaataaaatactggcaacggaaccagctttgaactgggtaaatacacaggcaatattaacaattctaactaaattaggacaagctgacaattgttggcttatgttaagtattttctttactgaatataagtacaatataactaaagttctaacagaaaactgcaatttgcttgaagaatttaaaacccaaggttatacagactgcatagagcatgaacaactaataaaaataaaaggaaataaagagttttgcaaagaaagacttgatacagctctattacaccagagccactgaatagagacctgaaaaccattttctttatagtaacagagctctttgttttcttcatactggacagtttagaacacagtcccatggcataaaatttggaaaatagaagagtttaaaaagaaaataaaaatcaccagcaatccaaccaccttgaagaatattgctgtattaatgttattcaactttttttttttttttttttttttggggggaaaggggtttcactcgatcacccaggctggattgcagtggtgcgatctcggctcactgcagccttcgccttctgggtccaagtgatcctcctgccttagcctctcgggtacctgggactataggattgcgccaca

SEQ ID NO: 272419 - DNA, 300 bp, Homo sapiens
tccatgaatgctgatggaacaaaaatcccaaggaaggaaatcaacctctctctctctttctctctctctctctctcactcacacacacaatagattttctgatgtattttaaaacttcgagaaatatatacttgtagtttggtgatgaattagtgatagcaagaacaaagaaaaactaagggccgggcacagtggctcacacctataatcccagcactttgggaggccgaggcaggcagatcacctgacatcaggagttcaagaccagcctggcaaacatggtgaaaccttgtttctact

SEQ ID NO: 272420 - DNA, 905 bp, Homo sapiens
gcaccttccacagtctggtgaaactcctaaagatcagacctttcattgatatatgagtacctactaagtaccagacactgtgctgaatacttggataaaatgtcacccaaatgtcatgccagacccttcctccttcctcaatccctacatacaatctttcatcaaatcctgtctctgctatctcctacttatctctttaatgatacactcaaggctttccgagcccattgcagcccccttagttcaataaggccaatagagacactatgatcctaaagcttataatgcagcatgagaaatacgagtgtgaaagtattaccattgtaaggtattgaacatgttctaggaaaatctaaccttgaaatgcatccttatcttctatgagccagaactctctagttttcctccacatccttctggtcactcctcagccttcactgaagttatatctttctctatccatcccttaatcatatcccaagtgttacatcacaagctttattttctcaaaccttcacatcctcccttaatcttgtccatacccatggtgtcaatactacatttatgctgactgctcctaatttcatctccatcccatatatctggagtttagatagagcagccagtattacgtggccatgtctgccccaggcatggaacttaccatatccatctcaaacttaaccatatcaataattgaacttattttcttctctcagacttttctgtgagttgtacactaatcacccttaatttagacactcatatgtcatcccagaccctcctgcctcagtccctacattcaatctatcacgaaatcctatctcttatacctcctgattctctctttgataatattctcatggttttctgagcccactgctaatcccttagttcacgcctcc

SEQ ID NO: 272421 - DNA, 757 bp, Homo sapiens
gccgggtcttctgggcatagggactcctagatgagtggggcaggggctgaggaatgcaaatgagatgtcagtgtgcccttccctcagcccattcaaagtctgtagccctggattgaatgaactggaggagaagcttatttgccaggggatgggaagcagaaacccaggtgtttggttacctggggcctgcctctccttcagcctgagatatggagagagcagggctggaaggactccctacccccacctcagcctcgcttcccgctctgcgtccctacttggctgtccttgcttcagtctgcccctgccccacctcccacctccagctactgccctacaagtcaaggaatgtttgggccccaggggtagagctgggggttggataagggtaagactgcacaggggccagatgggctggtttggagaagggtaatgagatcccaggaagagagaggaaccgtgccacatgactcagccaccaagcagccctatggagaggccaatgtggagagaaactgaggccttccaccaaaagccagcaccaacttgctatccatgtgagtgaaccagcttgcagtacagagtggtcaaccccagtcaagctttcagataactacaagcctagttgacatcttgactacaacttcaagagagacatcaaggcagaactgcttcgctaaactgctcttgaattcttgacccacagaaactgagagagagaataaatatttattgttgtttcaagtaactaaatcct

SEQ ID NO: 272422 - DNA, 520 bp, Homo sapiens
acagttgaggtacagagacagcgttcgcagtcagcttgctagaggacctacacgggctcctcaagttccgctgcttcctcctccaagcttgctagtattgaaaacccaggagtttggggtcattcatcaggaggattctgctccagtttgcccccttcttggtcctaggatactggagggccagagaaagcaagcttgaaacagagaggaacgggtcactttggtggaggaaattgggccaccaagcagccctatggagaggccaatgtggagagaaactgaggccttccaccaaaagccagcaccaacttgctatccatgtgagtgaaccagcttgcagtacagagtggtcaaccccagtcaagctttcagataactacaagcctagttgacatcttgactacaacttcaagagagacatcaaggcagaactgcttcgctaaactgctcttgaattcttgacccacagaaactgagagagagaataaatatttattgttgtttcaagtaactaaatcct

SEQ ID NO: 272423 - DNA, 618 bp, Homo sapiens
agaaggcacctgactttgtgttttatgccccacgtctgagaatcaacaagcggatcctgcagctctgcatgggcaaccatgagttgtatatgcgccgcaggaagcctgacaccatcgaggtgcagcagatgaatgcccaggcccgggaggagaagcatcagaagcagctggagcggcaacagctggaaacagagaagacaaggaatggagaaacagacctggagaagggccaaagctggaatatattttgggcccaagttgacccagatactggagggccagagaaagcaagcttgaaacagagaggaacgggtcactttggtggaggaaattgggccaccaagcagccctatggagaggccaatgtggagagaaactgaggccttccaccaaaagccagcaccaacttgctatccatgtgagtgaaccagcttgcagtacagagtggtcaaccccagtcaagctttcagataactacaagcctagttgacatcttgactacaacttcaagagagacatcaaggcagaactgcttcgctaaactgctcttgaattcttgacccacagaaactgagagagagaataaatatttattgttgtttcaagtaactaaatcct

SEQ ID NO: 272424 - DNA, 235 bp, Homo sapiens
tcaaagtgtaggcaaaaacctgcagagagtgaacagagtcctcatgggcccaaggagcatccaggaaaggcacttcaaaaaggtgggaaagcacagcactaggaaagaacaggatgcccaggcatttgtggacaatgctgccaaaggaaaaaggcttgagggtccagccccaagggagctggaacagcctcacagtccagccttctaggtaacaaatttaaaaacaaaatatttg

SEQ ID NO: 272425 - DNA, 470 bp, Homo sapiens
gctcattccgatcagggtgcatctgggaagtcgggcgactgtgtccatctcctgggtggaagaatgacccagggaagtgctccatggggaaggcggggcatgagagaagggaggggtggtcccgaggaccctttccatagacctgggagttcccggtgagcacgcggaaaggacgcggtgggagcggcaggtgcagagggaggacttgaaggttccatccctaacagaggacagcgtggccgagtactcatgcttccaaccctgcacagaggatagtgcatgcccagcatgcagactcgcttccatcgcgacacagaggacagcatggagcccagctcgagtgccgtccccccaccatgacagcgcagcatgggccttccaagccacagagccacagggaagccagtcctcctggaccgtgtgtggctgttttggagccagttgtgtcctgtgaagagcgcagcggccgc

SEQ ID NO: 272426 - DNA, 289 bp, Homo sapiens
cagattgtcttcatttccttgttgattggtttgaacctggggtcattatctctgctttgcaaatgaagaagagaaagaagctcaaaaaggacaagaaactttccccaaatcgaacaggcttgtcgtgacaaactgagatgaggtttgtcaagtgttcagcacagaaaatgctcaacatctccctctggatgtccagcagttacttcaaatgcatcccccaaggcagttcatcttccatgtaactataataatcacagtaaaaagctactgggagctgtctgtgttctgt

SEQ ID NO: 272427 - DNA, 507 bp, Homo sapiens
agaaatacttcagtgcatgccgtgtgcagcctagaagttacatatgcaattgtagatgaagctaactgaccaggcgacaccaggaggagcacgaggaccaagagaactaagtgggcaagatgcccaggcagtggacagaaaacagagaacaacaacatccaaagagccacctggagaacagatggggaccggggaccagaatgctcttcccaaatcaaatagaaaacaggaaggctgtccaaagatttggggggccaggagagtgagcaatacagaagggattgtgaccaccaagctccctttctagagaatgtgtccaaagcaggtccaggcagactgggggtgggagaggagaattcacattaaatatttatagtgtgcacaatgagttctagtgggaaatctcagaagatgccaccatttccaactttaaaatacccttcttcttcaatgtctgtatgtgtttttaggaatccaaatacaataaaatattcatcatggagagtt

SEQ ID NO: 272428 - DNA, 396 bp, Homo sapiens
ttccatgttctgcaaacactggcttttgagtgatctgaggagaatctctcatgacctttcacactggcatcatttttctcactccgtggggctcttagctctttgatatttgtttcttacctgtgataatactctggtaagaagggggaaaggagaagcctcaatggattacattcttttttaaaaaagtttcatgagattaaagcacatattgattgaatttttgaagtgctttatttaaaatagcattttattcattataaaagtgatataggcttatggtaaaaatagtttttaagacagaaaacaatagagaatatgaagcactaataatgccaccacttagaaatgacccttcttaaatttctggtgcaaaaaaatattcaaactctaagg

SEQ ID NO: 272429 - DNA, 375 bp, Homo sapiens
tgggccccggccccggagtatgtggcagacgaggtgtcttcctcggcggggtggggaaggggagaaggaaagggcagaggcatgccaggcaaaagcatttgtagtaaggggcactggggcgggcggtggcgggagagctgtgggacagagatgcgtgtaggtccccagcctcagaggatttgagaggagccccgaagcactgttacccagaaggtaccacagaacaggggtcctttaagttgttgcgtgaaaagaaggttccttggcgaagtaagcttagaaatgctgtgaatgattcccagccctttttccctcctcatattggagtcacagagcattggtagattaaaggctctgagaagtcctgcaaaaaaa

SEQ ID NO: 272430 - DNA, 450 bp, Homo sapiens
gtcttgaacattatttcacaccacacataaaaattaacttgaaatgagtcatagaattaaatatgagagctaaaattataaaattcttaggagcatacatatgtaaaaatattcccaacttttgggtaggacaatgttttagacaggatacaaaaagcacaaactttgaagaaaaaattgagattaaaaacttgaacacatggtggtaaaaaatatatatatacgtagtatgaaaaatactgttaggaaaatgaaaatgcaaaacatagattggaagaaaatattttcaatatactctccttgttccattttcccatgtcttaattttcagtttgatcataattttttgttagatcagtgttcattgtttacagtataataactttgttaaacatctcactgttgagctataattaaatttttttctttgactgttgtttttcctagagt

SEQ ID NO: 272431 - DNA, 460 bp, Homo sapiens
gtttaaggaactgagttttattaatgtgaaaaatatcctatatgtgttgttttgttttatttgagacaagaggcttgctctgtcacccaggttgaagggcagtggtgtgaacatggcttactgcagcttcaacctcctgggctgaagcagttctcccacttcagcctcccaagtagctgggaccacaggcacatgccactatgcctggctaaatttttttagattttttgtagagatagggtcttgccattgttcaccagcctgagcagcatggcaaaaaacccggtgtctacaaaaaattcaaaaattagtcgggcatgggggcgcacacctgtcttcccacctattcgggaggctaaggttggggagaattgcttgagcccgggaggtggaggttacattgaggtaagatcatgcctctgcactccagactgggtgacagagaaagaccctgtctcca

SEQ ID NO: 272432 - DNA, 342 bp, Homo sapiens
gttcctagaggtcacctgcattccttgccacatgaccccttccatcttgaaagccagcgacagagaccttcttgcgtgccaaacatcctcctacatcagatctctctctaacttcctcttttgctaccagccagagaaaactctctgcttttatttttatttatttttttatcttttgagacagagtctcactctgtcgcccaggatggagtgcaatggcgcaatctcggctcactacaacctccgcctcccaggttcaagtgattctcctgcctcagctactcggaaggctgaggcaggagaatggcatgaacctgggaggcggagcttgcactgagccga

SEQ ID NO: 272433 - DNA, 385 bp, Homo sapiens
ttaaaaagaggtaaaaataaaaaggaatttaaaaaacccaatttttgtttaattagaaaatgacaaggcccaacatacagataataggaatttgaaacaacaacaaaaccctataatcttagaaaatgttttatttaaatatataaaacaatattttaaaagtgaactgtggtacctaagcagcagctaacaccaggacataaataatataatactttaaagggagaaaactttttggctaggcaaaaccaggtgaaatgaaagatggtgatcagactttcttcacaattatactttatgcctgaagaaaatggattgaccattttcgagatacccaaagaaaaatgtgagctgaggttttcatatctaataaagttataagcat

SEQ ID NO: 272434 - DNA, 457 bp, Homo sapiens
tttttctgagaaattagaaattctattcctcctctccaaaccactaaaaaatagcctttccattagtgtgttataaggcagaaaaattttaccatttggaatttttcctttgagaaaagctttgttcctgaaagctatagttaaattccattgttaccttgtggtggtggagggatgagtggacttggtcttctgtccaagggagaaagagaaataactcatcaacccacgatcacctgttgctcattatattttcactgagagtagggtccagagagaaacacacctaagagaggtaaacttgaaggtgaggtaaaaacagaaagatttgtagcaggggcatctgacaagaattaatagttagaatgggatactgcagcagtggactttgaaaaacaggagtgcattgggcatttggaggtgggctgaagccaaagtgggtgcccaagtggggaag

SEQ ID NO: 272435 - DNA, 485 bp, Homo sapiens
gtgacttgaatgaggttaaccctcggcctggtgtcagtgatgagcacgtgcatttgtgtgcagctgaactgcatgtgaaccaatcaccttaaaaatgccatctgtggcctttcggcgggaaccgccatcttccagtaatgcacccaaatgcacacaaagggaaagaggagaggcaccgatacacgttctccggccttttagaaaagagtcgttcctctggccacgtatatgcgaacctataagaaaggtgatactgcagacatcaagggaatgggtgctgttcaaaaaggaagccccacaagtgttgccatcgctgaactggaagtcgcagtgttccccagcacgctgttggcattgttgtaaacaaacaagttaagggcaagattcttgccgagagaattaacttgtgtattgaacatgcgcggagcactctaagagccgagagagcttcctgaaacgcgtgaaggaaaatgatcagaaaaaga

SEQ ID NO: 272436 - DNA, 840 bp, Homo sapiens
caaaatccatgaagagtctcaaagaagccggatggatggagcctgctgcggatgccttttactctcgtagatcagggtgatttacattccacctgtagtctgcttgcaaacacacagagcagccttgcagctttgtgcctttagactcttggttttgcatttctccctgctcccttcttccttccagtaagctgcaacttttctgattgaaagggtgcaaggctaacacacggaatgactaactcaggatcacatactggcagtgggagaggcaggaggagcagctgccatcaattgccagggccaagtggatgataggatggatgctggtgcatgcggaggaggcagacgcaacgctcatctctaataatgatgtctgttccctcagaggcggctagagcatcacctcttcacgcaagtgtcttgaaactcagcttgaagatttcagcaaatgtgtcttacagagaagagaagagggagtcagcccatcgggattaaaaatatagaggcagtgacaacacacactcggcttcagttcttaggagagttttggttttgattttttttttttttttggagaagattttttttttaatggatctacactgttaactgagactctgttgagattcactggtttacttaaaaacttctcagggatgtctgtaaatttcagtgttatatgtcatgaaaactggtgtgggcagatctgttggttgaaataatttctactgtttcaaatactgaaggcaggaataattggtttatactgtgttttaaatagaagtattactggtaagtcccccaggacattaaaccttaaaaatcagttttaagcta

SEQ ID NO: 272437 - DNA, 1139 bp, Homo sapiens
gccccccagagcttggtggtgtcccaggacggtcctcccaggaaacattttgaataagttgctgaagtgcctgatggacgtggctctcgtcacgaaatgagtttggatccgagaagccctcttcttcatcggaaaacaggacaaagatgagctgcgtgcccataattccacgtttacgctgactcctccagtgcctcatcaatgaagtaagcaggcagctacgttctggatggctagcatgtaccgaaggcacaaaacctccagagttggcagagttaagtcctggcgtgcccgaggctatccaggggaacacgcgggacagacagcaccctcagcctgtccccatgaccctctgctccagtctgaggggcaggacaccatgagacctctcagacacagagtccaccctcgacatgacccggatgaaaggcaggagtgtgtgccctgcttttgccctcgaagctcgctgaaggggacccatctctgcaagcccacagccctacctgcagcatccacagcctcagagagcagcggggccccttacccctgaaccccctccaagagcatcaggacaacaagccttgagctgtggagacaagagaatcagtatccctggcccagggaggattccaggagaggacacgggcaggagccctggcccagagccagaaccaagagtccagccagaggcggctagagcatcacctcttcacgcaagtgtcttgaaactcagcttgaagatttcagcaaatgtgtcttacagagaagagaagagggagtcagcccatcgggattaaaaatatagaggcagtgacaacacacactcggcttcagttcttaggagagttttggttttgattttttttttttttttggagaagattttttttttaatggatctacactgttaactgagactctgttgagattcactggtttacttaaaaacttctcagggatgtctgtaaatttcagtgttatatgtcatgaaaactggtgtgggcagatctgttggttgaaataatttctactgtttcaaatactgaaggcaggaataattggtttatactgtgttttaaatagaagtattactggtaagtcccccaggacattaaaccttaaaaatcagttttaagcta

SEQ ID NO: 272438 - DNA, 286 bp, Homo sapiens
agtcatgtcagtaaatactgttttatgttagtaattcacctaattactaaattccttaagattacatcatctgaaggaatagtgtagtgtccaagtaactgtgcttctaagaacagctgattcacaggttgacagggtcagaaaaagtggctcttgttgaaagttatcttttctataacaaacattttttatggaatcttttgaattaaaatatgatgctgattatgtcttggcagtcttggaagcttagaattggccacggtatcacttagtgattgtggtgatt

SEQ ID NO: 272439 - DNA, 512 bp, Homo sapiens
gtagcatattcacaggtttggggatatggatgtggacatctttaggggccactgtttggcttactacactcttacacacacagagagagattcagtgtgatggttaattttaggtgtcaacttgatgggattgaggggttcctagacggctggtggagcactgtttctgagtgtgtctgtgagactgtttccagaggggactgatgtgtgagccagtggaccgagagaggaagactcgctctcagtgtaggtgggcgccatccaattggtcgggggcctagcaggaacaaacaggcagaggaaggggaatgtcctctttgcttcctttcctccttccagggtgagacgctttatcttctcctgcctttacacgtcacactgcaggttcttcagcttttgaactttggaacttacaccagcggccccctggggacctctcaggactaactgggggctgcactgtcagcttccctggttctgagatttcagacttggactgtgccatgctgcct

SEQ ID NO: 272440 - DNA, 379 bp, Homo sapiens
tgatccacccacctcagcctcccaaagtgctaggattacaggcatgagccaccacactcggcctatacctcttctttctttctcttgtctgattgtcctagctggtacctccacaacactgcatagcagtggggatagtaaatgtccttgttctgttcttgaacttaatggaaatgcttctggtgtttcctaattaagcttgatactagttttggagttgagaaagttatatttttatgatattgaagaattatccatctactttattttgtagagaagttttattaggaatgtatattgggttaggtgctattggtttaagtgcctcctgagtatggcagtaggaaatacacagctatacccatggagtatatttgta

SEQ ID NO: 272441 - DNA, 700 bp, Homo sapiens
agaagacactaagcctcattagtaatcagagaaatgcaatttgaaacaatttcacatttatgagactggcaagaatttcaagtcctcgaataataaatttggagaagctgccaaggaaggaagaactccgtatgcatacacactggaaaatgtgtacaagggtgcaactgtttttatagtagccagaaaaggtagaactagcctaaattcttatccaaaggagaatgtataaattatggaatactgtatcatagttaagaatgaactggatctacatgtatcatcatggataaatctcaaaatcataacattgaatatttggtgaacaaataaaattgcaaaagtacaaggatggtttgatgccagttatgaaaattttataagttcttttatatattgttaaaactatatatatactggccaggcgcagtggctcacgcttgtaatcccagcactttgggaggccaaggcagatggatcacctgaggtcaggagtttgagaccagcctgaccaacatgccgaaaccccatctctactaaaaatacaaaaattagctgggcatggtggtgcatgcctgtaatcccagctacttgggaagctgagacaggagaattgcttgaacccagaaggcggaggttgcagtgagccaagaccgtaccattgcactccagctggacgacaagagcaaaactccatctc

SEQ ID NO: 272442 - DNA, 291 bp, Homo sapiens
agagaaagccgcagtgggcttagcaagggcaggctgatgtgaggcggaaggtgagcacagcatttggggaggctagtgcaactgtccctaaagggcctgccctcagacagtggtggtgggaaagaagagaagggcctgatgcaagaggtgtctgaggggtagcattgatacaggactcagtggcccattggatggggacatggtgtgtgggctggtgtgtgtggtgtgttgagggcagaaagacacggcaggactgcatgaattatctgagtgccatggttggagggagag

SEQ ID NO: 272443 - DNA, 401 bp, Homo sapiens
tcataaacttgctcaaagtggctcagtaagttagtagcaaaccttcgagtggttttaatttgcttagggctattgcattagtatgttatctatgaaaactagaataaatgttgaagccatctgtcattaccacaaggaggtgaaaaagagactatcacctgctagacagtaaagctaaaaaataaaggtctcaaaacatgaaagaaatgtaaagctaaaaaataaaggtctcaaaacatgaaagaaatgtaaggacatatatttaaaagttgtcaaaggacaaagtctgtccttgatcagcttcctccaattattatttcaaaactaaacattagttgcatgaacttggctgttgcaacagaggtcagttaattaactgcttaccattaaataacaacaaa

SEQ ID NO: 272444 - DNA, 316 bp, Homo sapiens
ctgcctgggcaacagagcaagactctgtctcaaaaaaaaaaaaaaattattctaggctaggcacagtggctcacgcctgtaatccaagcactttggaaggctgaggcagggggattgcctgaagccaggagtaacaaagtaagatcctgtctctacaaaaaattataaaaattaggcacagtggtgcatgcctgttgtcctagctactaggaaggctgaggtgggaggactgctcgagtccaggagtttgagctgtcataggctaggatcacaccattgcactccaacttcggcaacagagtaatacccaatctat

SEQ ID NO: 272445 - DNA, 862 bp, Homo sapiens
acctaataaaagtatgcaatcattagctactaaaaactattaggtgaaaggatgatgcgctctgtaatagatggagcaagctgacatacaacaggaattacatagagtacatctgcaaaatattcttggtaaaaattacaccagagtctgatcaaacccctgtatttcaggtaaacttgtttacatgaagaacatatgaaatgacaacacagcggtacaatcagcagaatccagaaagtggaattttttttttttttttaagacggagtcttgctctgtcacccaggctggagtccagtggcgccactgcaagctccgcctcccgggttcacaccattctcctgcctcaccctcccgagtagctgaggcaggagaattgcttgacccaggaggtgcaggttgcagtgagccaagatcacgtcactgcactccagcctgggtgactgagactccctctcaagcaaatctgatgaaatatataaaaaaaactattagatctactaaatgagtttagcaaaggttcagaacatatgagcaatatgccataatcatttctatacactagcaaacaattggaaattaagtttttaaaatatcatttacagtacttcaaaatacataaaatacttatgggtaaatctaatcaaacaatgcacaaaacgtgtgcactgaaaaaaaaaaaaaaaatgcttaaagaaattaaagacctaatagagacatcaattgtagtcatgatgccaattttccccaaatttgctctacagattcaagtcaaatccagtaaaatccaagcagtttttctaagaactgactcatatgaaaatacaaaggactcagaagagttaaaaacaactttgaaaaa

SEQ ID NO: 272446 - DNA, 282 bp, Homo sapiens
tttaacttcccccgccccagatccatcaccagcttcaatacttctctatccaatacttcctattctcctttcacctttctcccctctcactttgttttgtttttgctgaggtgttttaaaacaaagcacaagcactgtatctttccacctataaatacttcactagatctctctcactgttaacccatttcccgtttgccccgagaaatgagtatgggcagcaagctgcacttttttttctaaacaggaaaggggtaaggactttttaaagaaacaaaacca

SEQ ID NO: 272447 - DNA, 453 bp, Homo sapiens
ctgatgcctctccctgagaaagtagtcagccccagagagtcccagttccaccttcttttgaaattatcttagaggtaaccaatggatcccctccaggagggactgtccatccccaccaggtgcagagaatgaaccactccttaagtttgcctggtaaatggtttggagtgtcactgctagacatggtggctgtgatgtcactactgtgtgtatcttgaaaggtcaataaagaatgagtaaaacatttgaagaggttcttattcaacaacaatatttgtttaaaggcttgccaaaaacacaaaacaaagccttaaaccccaaacctttaatagtataaaaataacaaggcttaagtcataaacattggatttccagaatttaaaaagataatttttgaaaaaggaattacatcaagaaaattttttttgaattgactgtcttctaaaacaaatt

SEQ ID NO: 272448 - DNA, 358 bp, Homo sapiens
gggggttgtggggttttcttctaagccttctcctatttatgggggtttagtattgattgttagcggtgtgtgtgtgtgtatgccaggtgtcttatatttgagaagagtctcacattaggtccgaagacacaaataggttgaaagtaaaaggatagaaaaacatattctgtgcaaatagtaaccaaaagagagctgaagtagctataccagtattagacaaaatagtctttaagtaaaaaaattgttacatatgtatacatgtgccacgctggtgtgctgcacccattaacttgtcatttagcattaggtatatctcctaatgctatccctgccccctccccccacccaaccagcagtt

SEQ ID NO: 272449 - DNA, 467 bp, Homo sapiens
aagctgcgtttggttctgtgtaccaatccattaaccagcccacagttttaagagaggcatggaatgatagaagtctcctcttagaaacagctctaaggtccagtgtaagctacttttcatttgagatgcccgtgacagacacagatgttatgtggttttctaagaagctctcataaccccaggattttggtgtaagaccatacactctgctaccagcaagtactttttgggcttgcttctggcaattctaatgaagactgaacacctggccatgtcacctgaagtgactttgatcctaaaaccaatatcatgaagtaagcatcgtcttttgcaatcataaggttgtatgtgcacagcagaattccaagtttcaatggaaatcgtatgtataatgcaatctgagaacagacatgaaagatacaagtaaacctcatagcctggtgcctcagtgctctcatgatacctgt

SEQ ID NO: 272450 - DNA, 417 bp, Homo sapiens
cgtctgaagaagttcttctgattttggtggtagttagacttgagcatacaatttcctgttgtttatagagatgtctgacttactaatcaatttaaatgcatctgcgtttttcagaaaacagaaaggaacaataaatacactatataaacactgggggataatgagtctctcccttcctccctctctttgacattcttcttcatttgtcccaaattcatcttctttctaccaaaattcacctaggaaaaaaaattgggttgattcaacaagattacattgactatgaagagacaataattttttaccttccttttcttgttttaaaaataagctgtgatgcagaaatcacatgatttattatagatgatggtaatcatggatgatatgatatctgaaattaacaaaggctgtcgcaaa

SEQ ID NO: 272451 - DNA, 314 bp, Homo sapiens
caatttatacattccaagaaaatcttccatttcatccaggtgaaacagaacctactggaatgaagctggcctcccatggaatgaagctagcctcccgtctccttgatttgaagcagcttctccacgttggttattatgccatttttctaaatctaacattttaaaatttgtgccttttctttctcttttgcttgacttctcagaggtttttttaatggtcttttcaaagaagtggttttgggttttatttatcaagtctacttttattatggctgttttaaaattaaatacatttatttcttgtttcccttaaa

SEQ ID NO: 272452 - DNA, 536 bp, Homo sapiens
cagggcccatctggctcttctcagtgaagaagcaagtttctgcatatgagactgtagtactcaatagattttcctttgccgcacagctaaagaaactaagctgagacaacaaaagtcattttattggcataggccttgcttgtaaaatgaattccacttttcttccatagctcataatgtttctccaaagtaattatctaagaaagatttagttctcttataaaatatagactaaacaacaactgaactagtttgcaatataaatgcagcaaatgatcacaatggtaaaccatgtggatgacaagtattttggaggcattaaaattgtattccaattagttccgaagtttatttgaactaaagtaagtctttaaccaaggagcgagatccagtttccttacagggagcttcaaaaaagcatactaaaaccacaaagaaagattataggcacttaaaggaaatgttatgtagattaaatgtcaactggacaagtcagattgaaggataggtttttgatatgtagcataaagaaaaac

SEQ ID NO: 272453 - DNA, 385 bp, Homo sapiens
  misc_feature (376)..(376): n is a, c, g, or t
  misc_feature (378)..(378): n is a, c, g, or t
ccgtatttctaaaaaataaaaaatacaaatacaactacaaactagcactagaccaacagtgactatgtaccatgaactgaggaatattattaattccaccatttgcatctgaggttaacaatatgtcaatgacttaaataacatcatatctctgagagtaatttctcctatatttccatgacaaatgttagataattttccattttttccattcaacaaaataaacaggaaatataattaaagagttcaattgaggattgggatttagaaaggaaggcaggaattaagaataatccttagttctcttcctaatttgcacctctctcactgatacatatgtattattttctttttatgtcttttttttctataactngngccggct

SEQ ID NO: 272454 - DNA, 407 bp, Homo sapiens
ccgtatttctaaaaaataaaaaatacaaatacaactacaaactagcactagaccaacagtgactatgtaccatgaactgaggaatattattaattccaccatttgcatctgaggttaacaatatgtcaatgacttaaataacatcatatctctgagagtaatttctcctatatttccatgacaaatgttagataattttccattttttccattcaacaaaataaacaggaaatataattaaagagttcaattgaggattgggatttagaaaggaaggcaggaattaagaataatccttagttctcttcctaatttgcacctctctcactgatacatatgtattattttctttttatgtcttttagaatctaataaacatgttttatattatataacaaactagaata

SEQ ID NO: 272455 - DNA, 265 bp, Homo sapiens
cacccttcaattccttttctttctgttttactcaggcacaatttctaggacatccttcctctggtctcattcacttctgctcaaactctttcactttttctttatatcttccaaccccttcctaaccattatctcttccataatttgacctcaacatatcttttcaactatttcttccgtaagtcatcctaagttagcccctactccaaactggtccttcactgttctccaaatatggtgggctctctccagccctccagccccc

SEQ ID NO: 272456 - DNA, 366 bp, Homo sapiens
gaggcatgagaattgcttgaactgaggaggtgggagttgcagtgacctgagatggcactatttgcactccagcctgggtgagagaatgagagtctgtctcaaaaaataaataaatataataaacaattttaatatatatagaggctaccataaaggagctactctacatactcattttttgagatcaaatttacttgataaacttaattttatgattacataaaagggcaaaaaaaaatcttttctgagagccaaggatacagcaaaacaggcaaaaatccctgccttgatagaatttacatttcaaagtaggacacagataactaaaatatagagcatgggagaaggtgctaagagatgtggggg

SEQ ID NO: 272457 - DNA, 288 bp, Homo sapiens
atctaaaaggggaccataaatatgtctcccagggctgttaacacaattaaataaagtacataaactacttggcagagctcttggctatcaaaaactctcaacaaatgttagttccttccattctctgttcaatcttatattctttgagataaatcaaaccatttctgaaggtgaggattgtctaagccacagcattttacttctctgtataaacctgctgattcaaggaacagcctaacgggttgagctctgtttacctggcatgagtgctgcctacatcccaatatc

SEQ ID NO: 272458 - DNA, 360 bp, Homo sapiens
aaaactggcatcaccaccttaaccacgtgacccaggtttacctctccagaaacgtgttgacagaggaggcgctgggaagagcgcagcaccccggaggttttcctgcccaacaatgcacaatctcattatgagaaaacattagacaacccaaatggaggaacattcctacaaggtaactgaccagtacccttcagaagtctcaaggtcacaaaagacaggaagactgaggaactgtcacagattaaggagacaatgactcctgtcacgtgaaatcctggattagatcttgggacagaaaaagagcatcagtggaaaaaccagtgaaacacgaataaactttctagtttagttcatagtaca

SEQ ID NO: 272459 - DNA, 450 bp, Homo sapiens
taggacgtacgcaccttagccatcaattaccactccccgccttgcccgggccgggcgcctgcctgacctacacgcccttcgccggcccgcggaaccggctccctcccgcgggcctcgggggggcttcagaaaccgctcggccgagctctgactgccgggcgagtgaccaggagatcgctcgctctctaagaagcagctttgttgagtcataattaataaactatgatgagatttggggtctgatgtaggtgtaattttcttcttgtgaatattttagtggaaagctgtagcagaggataagggtttgggaatagcgttaaaggtcagtagtagtagtggtagaatatgtagggctatgagggcgttttctcgtgtgaatgagggtttgatgttgttaatgtggtgggtgtattttcctcgttgtgtatacttagattagagagagtagag

SEQ ID NO: 272460 - DNA, 324 bp, Homo sapiens
cgaaccccccagagactggtttcaagccaatcccataacctctatgaccttctcaataagatattagtgaaattatttcataactttgtcaaagttaagttatagtttaagccgtatatatcttaatggcccatccagttcaattaggtcttcaagatgcttcatctcctattatagaagaactacttaccttccatgaccacacccttgtcattgttttcctaattagttccctggttctatacattatttctgtaatactcaacaaaactgaccaacaatagcaccatagatgcccaagaaatagagactgtctgaattatc

SEQ ID NO: 272461 - DNA, 595 bp, Homo sapiens
atatgtgaccagagattattttacatcttcctttcaatttagatgtcctttgtttttcttgcctaattgctctggctagaacttcgaacactatgttgaatagaagtggcaacagtagatatcctagtcttgttcctgatcttacagttttgaaaagctttttgtcttcactgttgtgtgatgttagctgttggtttttgcatatatggcatttattactttgaagttgtttccttcctggtttgttgagtgtctttatcatgaaagggtgtcaaagtctgttagatgctttttttgcataaattgagatgaccatgtcttttccttcttcattctgttaatgtggattacatttattttcatatgttgagccacccttgtattccaggtataaatcccacttgatgatgatgtataatcccttcaatatgctgttgaaaagccaggcgtgatggctcatgcctgtaatctgacttatttgggaggctgaggcaggaggattgcttaaggccaggagctcgaaacccatctgggcaacatagcaacaccccatttctaaatttaaaattttgaaaataaaaatttaaaaattgag

SEQ ID NO: 272462 - DNA, 160 bp, Homo sapiens
aaaaatggcttcccattggttctctggaagttcacctgaaagcaaggggacatctccgcccatctattggatctatggtgtcttgggtacttattttcagctacacacattcgcacacacttctctctttctaagtaaaagccacataattttcatgaat

SEQ ID NO: 272463 - DNA, 622 bp, Homo sapiens
aggtgctttttctgtctgccagagaaacattccagggtgctgtggctgcctcacctatccagggcgatgcagctccctggggacacaggtgcttcctggggagccctgagcacttctccgtgttgctggcctcacatccaattgggcaggcattggagtccgggcactgcctggagctcaccagaaggtgctttacagtggtccttggtttgtctctcagagggcttggtcccctctgctgtgaggctggactgcagctgtggtggcaagtgaccagatgtcactgagcagcctgaccatggtctaggtggtgcttggatgcatccacttggcttcctttggtcattgagtttcaagaagagaaactccaggagacggcttggccaggatcaggcaaaaacaatcatgccgaaaaagtggcagaaaagcttgaaggtctctcagtgaaggaggagaccaaggaggatgctgaggagaaacaataaatcgtcttattttatttccttttcctctctttcctttcctttttttaaaaaaaaatttaccctgcccctcttttttggtttgtttttattcttttgtttttacaagggatgttatatgaagagctgaattaaaaaaa

SEQ ID NO: 272464 - DNA, 1213 bp, Homo sapiens
cataatttggctctttgtatctgacctgtatttgcctgctagcatttatgtaccttttctttagttatcacaggaaatggagaccatctggcgaccactcttgttataatagagctgtgtggcatattattgtcactttcaatagtatattctgctttcaccccgtgttcttatattaagccctcaaaataataaatcacagtctgcttaatttacactaggtgtccctcttggtagctcatcccccagctgtggtttttcccttcagattcaagagtgaaattgggaacttgaaggaagatgtcaatatgtatgttttatttaaacgaataaatctttttcttatgaaagtttaaagtaatgatgaaagactgctatgctggcataatagaaaacatcctggattctcaataccagagttgagatctgggatatttacattggtctctgacattgcaccaggaattcagcagtcctttcctcaggtttacagagagctttaattatagtcttcttagtcatttctggtgatttcaaattaaacttgtcttttggaagtattttttttaaagttgttgatgacaggttagcacctggtaaaatggggaattttgaggacagtgagtggacaggacgggtatccaaaacattttacattgaaaacaaattcagaggaattcttagaattttctagaaccttttcccataactgaagagcaaacatattttgtcgaattatgatgatgctgttgtgaataacacagcaacagctaacatttctgttgtgtttatcatatgccagtcattgtagttagattatatgtcatccactctaattctcaaaacaatcgtgagagctaggtactacattctccattttatagatgaggaaactgaggctcagagatatttaataacttagacaggttcacttaactaggaagtgccagagccacaatttgaacccaggtaacttggtgctaaatcttttgctttttgctatctctaacacgaggcattgtttgcaaaatagtctgataactgtcttctgctcaattgggtgcttaatgtttattttctagatttccactaaaatatataaatagatatttcccctttgtaaaatagtaatttataacatcaccatctacaggcttttcaacttcatgtcttgatgtcatttaaatccttccgccaaaacaatctttctaaa

SEQ ID NO: 272465 - DNA, 487 bp, Homo sapiens
tttttttttggcagaaatttaaatataataacaaatactgtattcccactgtccagacttgaaaattaacatttttatttgtttcatctttatttttatttagaaatctgtagagttagtaagaataaatataaaagaaacatagttaaaggagaagaaataaaagaaggaacacattgtaatatatataacatcgtgtttgatccccaggcctaggcaagcccatttcctctgtgaatttggtatttatctttctgggattttttaaatgcttttaagccatatatgagtatgttagtccattcttggattgctataaagaaatacctgaggctggataatttataaagaaaagaggtttaattggttcattgttctgtaggctgtacacaaagcacagggctggcatctgcttctgatgagggcctcaggaagcatacaaccatggtggaaggtgaaggggagccagcatgtcacatggcaagaa

SEQ ID NO: 272466 - DNA, 975 bp, Homo sapiens
cagatgagaatactgatgttcagagcaaccgactgaacccctggaagtcactcatactgaaaatggcaaagcagtatctgcccctgctctgtccaatgctaacaggactgctgaggctcccctccacctcgcctcaagttgacattgggcctgtggaaatagacctctaagccagcctttcttgctagtttggttttagcctttcttggactcagctttgccatctgtgaaatatgtgagtcatctagatagtgtctgaaacctaccagctccaagtctatggtccacggatgggctgtgaggacaatcaagactgaggcaggttttcactcaagtcctggaatatctggtcatccttccagggttcttcatggcagggaaacaaaatcaacaactgaagaacatgaggttcaggagatttaagtctgagttccagtgttggctttgggtgcctctaatcaaccacaaatctatcccaagcccgaggcaggctggtcttactcaacatttatggggtcttgcagggcttatgagtgagctcatgtgggtgagctgtgggtaccacaggaccagcacagattgctccagcacattgtccagccacgagacagaatttccctcttacagatccattgaatagccctggcctgtgggtttgctgtaaagatgcaaaagccctgaagcattatctgccaaacctcagccctgaccatggttaggctgacatcaggggaggcagcaggagagggagagaaaagggtatctcattgtggaactggggcagtggtgggcaggggctgatgcaggaggggtgccatggcccaactgctcttcacccacggtccttacacagacctgatcctgctaattctgactcagctttcagactcagcctgcggacactcaatttttagtaataagcagtctcctcataatttactatatagcaaaataaatttttaaaagatattaata

SEQ ID NO: 272467 - DNA, 358 bp, Homo sapiens
cagtctaatgttaaatgagaaaaatcaactcaggacactgtcatctgcatttaatcaagacttctgtgtctcacacaagctttcaagatgggtagcggtaggggtgtgtgtttaggagtctcatgcaaacttcccattgccctgcagtggacaggtctatagatctccagttggagtacagaaatcttctagaagaattgtgactgtaaagccacttctataactcttactctgtgattctgatgcaaacataccattttgggttaatataagcaaagcttgtatctagaactatagctaaaagtatcaatgtggtgttattttttttctgacaataaaagcaatacataaatgtgca

SEQ ID NO: 272468 - DNA, 268 bp, Homo sapiens
gaaggggccttgcacagatcaatgatgacaggtacagcaccatcaactaacgagcattgagtcagcactgaggtcaagtggtggtgagtaggtaatgataggtgaaggaggcaatttcaaacatgttggcaacattttttacttacaagatttaaaagtcctttacgcagccgggcgtggtggctcacgcctgtaatcccagcactttgggaggccgaggtgggcagatcacgaggtcacgagttcgagaccagcctgaccaacatgg

SEQ ID NO: 272469 - DNA, 209 bp, Homo sapiens
tggggtccaaaacaaaccacctgttctgggatgctttgggcaacaaaacaacaaaggccccactacacaggaaaattccccgccgggtgcagtggctcacacctgtaatcccagcactttggaaggctgaggagggcggatcacctgagatcgggagttcgagaccagcctggccaacatggcgaaacccccgcctctactaaaaaaaa

SEQ ID NO: 272470 - DNA, 437 bp, Homo sapiens
tttaaaaatcaccttattccaacaaagttaaccctattctcaatattattaaattatatgctgctaaataatatcctaggtatttctataacaaatataacataaaagttataactcaaagttagatataaaatgccatcttctttatgaaaagaaattcacaattaccccctattgccagtgttttaatatttttaaaaaacttttttttctctttctttagagatggggtctcacactgacactgaggctggagtgcagtgggatgatcacagcttactgcaacctcgaattcctgggctcaagtgatcctcctgcctcagttttccaagtggctgaaactacaaggtgtgtgccaccacatccagctgaagaaacaattttatccagtattttactttgaccagcttaaattgtatttcagctcaagaaggaaa

SEQ ID NO: 272471 - DNA, 348 bp, Homo sapiens
tgatcttgagtttgatgactttttagatacaactcctaagacatgatccatgaaataactgataagctagacttcattaaaattaaaattttctactctgtaaaagccactgtcaagaaaatgaggccagatgcagtggctcatgcctgtaatcccagcactctgggaggctaaggtgggaggatcacttgaggccaggagtttgagaccagcctcagcaacatggcatgaccccatttccacacacacacacacacacacacaaaagtcgggcatggtggcacgtgcctgtagtcccagccacttagaagactgaggctggaagatttcttgagcccaggagctcaa

SEQ ID NO: 272472 - DNA, 719 bp, Homo sapiens
ctctttctccctctctccttacttttttctctttctctccttttaatttgctctattctctatatgggcctcgttccttctactgcaaataaggaaaatgaccacctggaaacccaaaaggcccaccacatcccagcagagccaccccagctgaaagaaacccagcttctctctccagcttctacacatcaatccaggccagaactccatctgacccttgtgagacatgcttccacacctcggtggaccactgaggctcgggaattcagcataatgatgggcacttctggggtcatgggccttccctgtagctaaggtgacaaaaggacagactggtctggaatgtccatgccagctggcttacatgcccagccattgatgctggctgctttctgggagctcagttgtgctctagaccagaaaacctccatgtggcctctccacatgaccctcatttctcagcatggtggctgcggcccaacggggagactctcatgagcaaagtttccaaaagaccaaagtggcagctgcgagcctcctcatggctgagcctcagcccccatgcagcatcagagccactgcagtcttggcttcccaggaggccagcccagaagcagcaagaaaggggacctggaaaccaggaggtttggttcgagggaaggccctctgatataatttggatatttatctccacccagatttcaagttaaattgcagtc

SEQ ID NO: 272473 - DNA, 207 bp, Homo sapiens
caaataattcttaagattgtttcaggtttaaccatcttcgtaacagctgcatccacagacttcaactacatgattacctctttgcccattctgctctttcttttctttcccgaataacctctttcagatacggttcaaggtagaaattttcctcttcatatttggtccactgctctttaggcaagatctgatgcttcatggacaggt

SEQ ID NO: 272474 - DNA, 321 bp, Homo sapiens
aaaggaactaggtatctagataaaaactgtttcctaagggaaaagcttagtctgtaccagatatatagaaggaaaatgaaagtccattttagggccaggctggtctcaaactcctgggctcaagctatccttcccaccttggcctttcaaagtgctgggattataggcatgagccaccatgcagaccttaatgcttatttctaagctggtctctgaatctatttcatgaacttgtataaattcccatctgtgtataagtttgtacccttacataaatcctcatttcaataaatgtggtttctagttactgtcaaaaactga

SEQ ID NO: 272475 - DNA, 177 bp, Homo sapiens
aggcagaaggggcccagacttgaggaaagggcaggggcaggggctggcaggcgagagaacctcgaagaatgggtggggccttgcacctcatacctaccctcatacccacatatgcacccaagcattctgcacctggctgatggttttgcctaaataaatgagccagccacaccgatt

SEQ ID NO: 272476 - DNA, 458 bp, Homo sapiens
gctctcccatcctactgtggggggttttaagtgtttcaaccttttgaggaagcagttttatatacctattaacattgtaaatccacatatccagtgacctaaccgtcccactcccacaaaactgacttacagagataggtgcatgtctgaacaaagatacatctacagggcaccattgtggcaccttttgtaacataaatagttggggaaaccatttgaattgttcatcaactcaaaatagacaaattgtgaaatacaaaatgtagtatgtgtgtgtatgtttatataaattgtttttgaagtttggaagaatacacagaatacttacaaccatagtatggtacacactattgattagtaatcaatcccattcctaattcccttaatattttgacacattcacttaaaaggtctttccactttccagcccctcttgcacagaggagtggtgacattct

SEQ ID NO: 272477 - DNA, 301 bp, Homo sapiens
ccaccctaagctgtggcatatgatgcactgaaactgacggtggcaacaacaaaacccaaacccaactcagctcctgacttattgcctcaaacctctacactaacttagaagagaagaggcatgtacactttcaggcataaaggctgtgtacgtctgtggctagtcttctgcataggtggaatgaataactttccaaaacacacgtacacatacgtacccacacacaccaaaccgtgatgcatcatattcaaaccgtcaaaaacaaaagataaagaaaaaataccgaaagcagccaagaaaa

SEQ ID NO: 272478 - DNA, 500 bp, Homo sapiens
tactatatatacatgttttcatgtcctagctactgtgaataatgctgcaatgaacataagggtgcagaaatcacttcaagatagtgatttcatttcctcatatatccagaagtaggattgctgggtcaactggtagttctatttttaatttttttgaaactttcatactgttttccataatagctgtatcaatttacatttccaccaatattgcacaaagtttcacttttttccacatcctcaccagcatttgttatgtattgtcttttcaataatcatcttaagaagtgagaggtgatatctcattgtggttttgatttgcatttccctgatgattagtgatgttgagcatttttcatgtacctattagccatgtccctgtttgtatgtcttctttgggaaaatgattattcccaaattattattatggactactttattagtccattttcatgctgctgataaagacatccccaagactgggcaatatacaaaagaaa

SEQ ID NO: 272479 - DNA, 974 bp, Homo sapiens
tgaacttatatttgtcaatcagggcatgacaaactttgcaatcctctcagggtaaaagaagtatataaaaattttcttataaatgcactatccctttaaaaatattttcctatgaacaagaaaagaagggctcagtaggtttatctgaagctactctgggttacaaaggagggcactggcaaaactgatattaaagagaagggatccacgttcccacactgtaggtattactgcgcatttgtctcctaatgaaaagtgaccttgtactccatgcacgagaccacacctcacataacaacatctgattttgagccttatatttcttaacagggatgaggacaggaccccgaatacagatgcttcagatgcttctgaaaatcatatttatgaagaagtgcttaagcactgaggatggccatccaaatggagagacgactgaagagatttgtgagtattgtcttcaacgtatctaaagaaagcatacaaacaaaggtgcttttcctctctctctctctccaacccttccttatttctttccttccattaaggaaaaaaaaaaaaagttctagaactgagaagtaggacaagggtttagaaataatgggaaagagctttcacttattcaaatataaaagtacttgctttggaaggtaataagcatcacatcactggaaatagtaattacaacgataataaaaataaccagtaactgagtacatactattttccagaagcggctaggtattcacatgtatttctcatttactctttactataattctatatgtagatgccatcgtaccattttgcaaacaagaaagtggaagtttagagagcttcaataattcaaggtcacacatagttactagaaaacagagacaaaatttgagtctagctttgcctgatttcacagtttacactaatctctttcttcctgttccctctcttgtctgcaccctgcaccaagccacagc

SEQ ID NO: 272480 - DNA, 458 bp, Homo sapiens
cagatacaaacagtggcaaagctgcatctgaagaggagcccaggaaggggccctgtcctggccccagaggagtccacacagcaccaccctccagaagtggctgggcccggggtcttgcaggcggcaccttttggtagattttgtttccctagaaaatggggaaaatatttcaagccaggtgaggggaggaagttaacactgaaatatgtattgtttttaaaaattaaatgcaaatgcatggaagctggttgtcctttctctgggtttggcactggcgtcctggaatccaaccgtgttggggtgcaggcgctatcagactctggatgatcctggctcgagcacacacatctaagggccaggctgggttcgcatggtgatctccgtcttgtatgtctgaatgttgacctgaaataaagattactgctgtaaaataaatgttttcactgcagaaaaaaaaa

SEQ ID NO: 272481 - DNA, 437 bp, Homo sapiens
gctgcaaaagactggaaaaagcagtttagagctttgggatcagaaacacttgtgtatgtaactacagggtggttccaaatgccatcagcaccgggcgtggtggctcacgcctgtaatcccagcactttgggaggccaaggcaggcagatcatttgaggtcaggagttcgagaccagtctggcgaacatggtgaaaccctgtctctactaaaacaaacaaacaaacaaacaaaaaactgggccaggcgcggtggctcatgtctgtaattccagcactttaggaggccgaggctggtggatcacctgaggtcaagagttcgagaccagcctgaccaacatgatgaaaccctgtctctactaagaatacaaaattaaccgggtgcggtggcacgcgcctgtagtcccagctactcgggaagctgaggcagaagaatcgct

SEQ ID NO: 272482 - DNA, 407 bp, Homo sapiens
tcagtggggggaaaccttggacaggctttcttgggcagaggtccctgcagctttcctcagtgtattgtgtccctggttaatagagaatggaggatggcggtgacttttaccaggcatgctgcctgcaaacggatggttaacaaggcataccctgcacagccctaaatccattaaaccttgattcaatacagcacatgcttctgtgacacagggtttcggctaaagttacagattaacagcatctcaaagcagaacaatttttcttcatacagatcgaaatggagtttcttatgtcttccttttctacatagacacagttacaatctgatctctctttcttttccccacagaaattcatgaccccatcctttccaatatgactttataaaaaatatttatcatccaaa

SEQ ID NO: 272483 - DNA, 317 bp, Homo sapiens
aaggaagaaagaaagaaaacaaaaacgttctcagcactacaacttctgccttgttctgttccagaacagtatgagctcagtactttttcagactctcaattttctacaactaataatttgctctttcagttagtggcaaaggcttaacgacaaaggttcatctttaatattagagaggcacttttaaaatttatgatgctaagccttttgttctggatatggtatgttgcacaggtctagggactgggatttcagatgtctattccgtacccttattcttttatttattaaatcttttagtgtgtatttttttctat

SEQ ID NO: 272484 - DNA, 670 bp, Homo sapiens
aatacttaaaatatcttaattttttgtattatgtgttaaaatcataatattttggtatttggggttagataaggtctattgttaaaatcaatcttaactttttactttttctcacgtgacgacaaggcagtgtgaaagttctcgtgcagctcacacaggccgcgctgctgtgtcgcttctcttaacgctctgaattcaggagcgagggcggcaagagcagtgttgggatgaggagcagtctgcacactggctgccctcctgggccctcaccccagcccctgtgctcctcccccttcccctgatgccagccctgctcctggatgcttcctcagcacttgctgcttccctctggggggtgaggagctgcacagcctcttcctgagctcttccatgtctgtggacgcctctcccagcctgaccagaggttggacctcaaggctcagacccctgtcctctatttccagctcaccgtgcagtgctaagcgcctgcatgtccaggggactgacctgaggagcaggtgctgtggcatcattcacaccaccagcagagtcccttccaagaggggtctggcccactcttccggttcagtgctcccattctgccaccacctgcctcccaaggctcctgtctgtcaggctcggtgctgggcgccagaggggcgcggccgca

SEQ ID NO: 272485 - DNA, 173 bp, Homo sapiens
aaaatgagtacctgcttccttgtactgtcaagattaagataagcagttagcactccctagaacatactaatttgtcaatattaatgatagctaacaattatcctgatattgaatgatggactccaaattatttattgtggcctaggaaaagtactaagaagtaattgatagca

SEQ ID NO: 272486 - DNA, 444 bp, Homo sapiens
tattgtatattactcatctaggcatggttacatttttcatcataatccaggtttatgatcatgaatagccacattcaggccaaagcacatttaccaaaaatagtgaattatggtctggatggaaaaatggacatgatttggattatttccttctaagaaggaagaatatgttcagtattatttgaaatagttgcattatgacaggcagaaatatctttaaaaggaaaaacaaaactcttatatagagagagaaaaaaaatggtacatataatttgggcaaccaaggtaggaaatggatttactatgagaaagtgttccactttcttgcaacttaaatcatggaatgatagatagttaaggattatcagtattctaattggcttaagatcaagcctgtcatcttgtaacaaaacttcagctactaaaaagtttaccaaaaaaaaa

SEQ ID NO: 272487 - DNA, 668 bp, Homo sapiens
ccatacaaaaattgatgcagagaaggcttggtgtagtcagactgataacagataaagcaaaaagctttactagaaataaagagggcagtttatgatgataaaaggtattattcatcaggaaggcataacaaccctgaatttgtattatccagtataacactttaagtaggagatttttaatacattgttgttggtaactgatagaacaagatgagaccaaaatttaaacatgaagaaagagaagacctcattaaccaatgttgaggtgaagaggatatcacaaaagcttatgagaagatattataaaaacttgatgtcagtccatttgaaatttagatgaagttatactattagaaaactacaacttaacagacacagcagaaaatagaaaatctgaatagtcctattaaacatgatccttagtggaaagagctacccactagttttgaagtctttgggatttacaaaagaaaaaaaaaaaaaaacaaaacaaaaaaacggaaactatccacaagcaaaactcctggtccagaaggtttcaccagtgaatctaccacacacgcataaaatcatgaccaaatcgcattccagaaatggaaaatctttttttgtttgttttcacaggatcttgccctgggctagagtgcaagtggtgcaatcatggctca

SEQ ID NO: 272488 - DNA, 726 bp, Homo sapiens
ccatacaaaaattgatgcagagaaggcttggtgtagtcagactgataacagataaagcaaaaagctttactagaaataaagagggcagtttatgatgataaaaggtattattcatcaggaaggcataacaaccctgaatttgtattatccagtataacactttaagtaggagatttttaatacattgttgttggtaactgatagaacaagatgagaccaaaatttaaaaaaaaatacctatataagacagcatacttaataaaattaaacctttgatgaggcggaccatgaagaaagagaagacctcattaaccaatgttgaggtgaagaggatatcacaaaagcttatgagaagatattataaaaacttgatgtcagtccatttgaaatttagatgaagttatactattagaaaactacaacttaacagacacagcagaaaatagaaaatctgaatagtcctattaaacatgatccttagtggaaagagctacccactagttttgaagtctttgggatttacaaaagaaaaaaaaaaaaaaacaaaacaaaaaaacggaaactatccacaagcaaaactcctggtccagaaggtttcaccagtgaatctaccacacacgcataaaatcatgaccaaatcgcattccagaaatggaaaatctttttttgtttgttttcacaggatcttgccctgggctagagtgcaagtggtgcaatcatggctca

SEQ ID NO: 272489 - DNA, 437 bp, Homo sapiens
caagatcagcctgagcaacatagtaagaccctgtctctccaaaaaaaaaaaaaaaaaaaaaaattagctgggcatagtggtgtgcagctataatcccagctactcaggaggctaagccaggaggattgctgagtccaggagtttgaggttgcagtgagctatgataccaccacagtactctagcctgggcgacagagcaagaccctgtctcagataaataaaaaccattcattctgttctaggcactgtgttaaagcaatactttacattcattgccttaatttaatcctcccaacttcccaataaaacctccatcttgtacatgaggaaacagagactgaagagtttgctctagagctagctagtaagtggtgggacctgcatccctccccagaaatgagtgaatctactgcctcatgaaccttttccttccatta

SEQ ID NO: 272490 - DNA, 374 bp, Homo sapiens
agctcatgggcactccggtgaccgccgtccctggcctgctgaggacctggggattccaagtgtcagccaacatgggacatagaggtgacttaattcacctgcttggactaataatcaactcagtcttttttttttgagaccctgtctcagataaataaaaaccattcattctgttctaggcactgtgttaaagcaatactttacattcattgccttaatttaatcctcccaacttcccaataaaacctccatcttgtacatgaggaaacagagactgaagagtttgctctagagctagctagtaagtggtgggacctgcatccctccccagaaatgagtgaatctactgcctcatgaaccttttccttccatta

SEQ ID NO: 272491 - DNA, 2054 bp, Homo sapiens
gggagaacttgcgttggctgaggctgggggatcgatacacagcctgcaggccccggggcagcctccatcccccaagccgagggggagttcgctggaaggtcatgcagccttcctggactcccgcaccggtacagcgcactgcatgtaatattacagcctggggcggcgaatttgggaaggagggagagggtcgttgtgagcaggttgcactcagctctggccctccggagggtgcacttcacgcctccagagaaggtccacagcctcctggtgctgaaaacctacgtccctccactggcgaaacatttgtgcagagcggacgatgggatgggggctggagaggagcaatgaaagggaggagacacaggcaagcctcaactcccccaactcgtcccgaatcgatcttcgttccaaccgcgcaggatggggcccagatggtttgcaaagcgcacactcgcacaacgcaatacacagaacaagattccgttgttacagcgcgtggtttactagatgctaaaagggtgggagtagcaggagggtcttaaacggcagccccaaggctctgctaaggacagagacaccccattgtggacggtttctccattgcaatatatttagcgttgggcgctggggtttttgcttcagtgtagctgctctgatcagttacagattggcgaccacgtggattccctcaagcatcctgatttgttcgttctctctctctctctctctctttctctctctctctcgtctctcttatttttcttttgtatttgccgcccccccttctttaatatgcataacggtctgcagaggtaataggcaggggactgaatgacaggctttatataactgtgtcaacagatttcttcccgccttctacccttgagaaaacatgaaccgggtgggttctgagtaacctcacttcaagcattcttcatttaacacaggtgggaggtctgcaggttgcaaggcagcagaaagaaggaagaatgtcttcgaatattgtgtggagtccccagactcaagcctctgagcagaaaaactccttgagaaatcatatagtttgtctctttgcctctagactagtccaaaaggagccagagcaagtcagaatttggtttattgttggagattttagggcgaaaatattaataataacatttttcagtgctttctgtgagcctaagtgctttatgtgcactcaattctctccaattctataagtttgattttacatatggggaaactgaggcttagaataatgtctaaagtcacacagctagtaagtagaagtgctaaaactcactggggtctgacagcaaatatccgttaaccatcctgctgatcataaaaagacattacgactcctgtaatcccagcactttgggaggccgaggcaggcggatcatgaggtcaggagatcgagaccattctggctaacactgaaaccccgtctctactaaaaatacaaaaaattagctgggcgaggtggcgggcgcctgtattcccagcttctcgggaggctgaggcaggagaatggcgtgaaccccggggggtggagcctgcagtgagccgagatcgcgccactgcactccagcctgggcgacagcaagactccgtctcaaaaaaaaaaaaaaaaaaaaaaagacattctgtgccttacacattaggtaccttaaattcgatgtgctttacttattttttattttaaattttcattcaacatatttttcttgaatacctaatacattcatatggttaaaaatttaaggccgggcacggtggctcacgcctgtaatcccagtactttgggaggctgagctgggcagatcacctgaggtcaggagttcaagaacagcctagccaacatggtgaaacccccgtctcgactaaaaatacaaaaattagcgggtgtggtggcgggtgcctgtaatcagctactcgggaggctgaggcaggggaatcacttgaacccggggggcggaggttgcagtgagccgaaatcgcaccactgcactccagcctgggcgacagagtgagactccatctct

SEQ ID NO: 272492 - DNA, 505 bp, Homo sapiens
cagtgccagagccagagctggatccggggccccagccggagccgaaacctgagccagagtccgcggcgggcgagcccggagcccacgagccgcagacgcagcgctgcccaggagaagtgggcaggagagagggccgcccgctgctccccgctgcgtccagggatggagggccccaccacccatggaattgctggcccctctgcgtggcccgggacttcagccgtggcttcgcgtcaagagggtatttttcctaaacgaaaccgcttcgttcgttcgttcgttcgttcgttcgggcagcaatgccgcagaaaagcagcagacgtcggtccgcgccctggctctcttcgccccggaccccgacgtcccgccgcagcgctcggaggtgcccccagcccaaggcagcctgctctcgccggcacaggtcgggctttttcttcccaggagagaaaccccaattcccttcgtaacgtccaataaagacattcccgcggcttcaaaaaaaaaa

SEQ ID NO: 272493 - DNA, 884 bp, Homo sapiens
cagtgccagagccagagctggatccggggccccagccggagccgaaacctgagccagagtccgcggcgggcgagcccggagcccacgagccgcagacgcagcgctgcccaggtggggtaagagacgctgggctaggggcgcagggtctccgcggtggaggggcgcagggaggtggcggccgagtcctgcgcagtttgctcctggcgtgtgtgggtccacccggcggcgcgggacagcgcaaggcgcggaaggtcaggagccttcgaggcagcgcgaggagctcgttcctgcgcccagggcacagtcatagccgccgtcaccgggtgctacctcacccaaccggcgggatcaaccctctgctttggctccgggcacctcaagagggtagcagcctcgggggcacgggccacggccccgcgaagggcacaacctgagaagcccgtggcagcccctcgcagcgtcgggtgacacagggctcccccacccccaggagaagtgggcaggagagagggccgcccgctgctccccgctgcgtccagggatggagggccccaccacccatggaattgctggcccctctgcgtggcccgggacttcagccgtggcttcgcgtcaagagggtatttttcctaaacgaaaccgcttcgttcgttcgttcgttcgttcgttcgggcagcaatgccgcagaaaagcagcagacgtcggtccgcgccctggctctcttcgccccggaccccgacgtcccgccgcagcgctcggaggtgcccccagcccaaggcagcctgctctcgccggcacaggtcgggctttttcttcccaggagagaaaccccaattcccttcgtaacgtccaataaagacattcccgcggcttcaaaaaaaaaa

SEQ ID NO: 272494 - DNA, 715 bp, Homo sapiens
ggcttaagcaatccttctgcctcagcctcccaagtagctgggactatagacacacaccaccacactcagcaaaagtgacaattgtttctaatacagacatccacacctggacatactgtgaaaattatattcattgggcatattagtgtccgttctttccaagatctgagttcataatgttttcttctgtaattgtaatgaaatatcaccatttcttgctagcattataccaaatccctctaggcaactgggtagcaggctatatgccaacctaggtttttggagatgacttgtatcttgtttgctattagagccaacatgttagaatttgtgatttgtcacagagtagaagacgagttcactcaagaagcacttatttatgagcacctacacaggtgatagaacagtcaaaagacaggagttctggcccttctggaactgacaatcttactagaaaaataaatgttaccacatcacttgaacaaaggcacaattatgcaatttgagttgtgttttgacttccttcccactaccttgtttttttgtttttgttttttgtttgttttgttttgtttttatgctggaggtgttgtgggagatggagttttgctcttgtcacccaggctggaggttgcagtgagccgagactgcaccattgcactcagcctgggccacaagagtgaaactctgtctcaaaaagaaaaaaaggaaaaaa

SEQ ID NO: 272495 - DNA, 329 bp, Homo sapiens
aatctgtgattgttccttagtctttccttatctttcatgatcttgacatttttatgagtattttgatgaatgctcctcagtttgggttggcatgatttttctcacaattagattgcgttatgcactttttggtaatgataccttagaagtgatgcattctctgggcatcataccagtgggtacatgatgctgatgtgtcttattactggtgatgttaaccttgatcatttgtcaagttggtgtctgtggaatttctctgctgtaaaggtactattttttcctctgtcactaataaatatcttaagggaggttcttcgagattatacaaa

SEQ ID NO: 272496 - DNA, 334 bp, Homo sapiens
ttttttttgcgacagagtctcacactgtcacccaggctggagtgcagtggcatgatcttggctcactgcaacccccacctcccaggttcaaacgattctcctgcctcagcctaccaagtagctgggattacaggtgcccgccaccatgcccagctaatttttggtatttttagtagagagaggagtttcactacgttggccaggctggtctcaaactcctgacctcgtgatccgcccgcctcggcctcccaaagtgctgggattacaggcgtgagccacaggcacccagccaatctagtatagttttatctaaattctttaaatatacacgccc

SEQ ID NO: 272497 - DNA, 370 bp, Homo sapiens
caggagagctgagatggggtggggatggatcaggccttgagagggtgcctggtaagccccgggaagggtagggaggaggaggagggagaggagagggcagtgcaagggcagcgacccccagccttgcccccgttttgagcacggggaaagtgtacacaggtagtgaggaaatgcctgcgtttgggtgcgtgttcatttctaatccattttcactttttgtgtattctttctatctactttttaaaggtttgtttcttttctaacttcctgttttagatgtatactttagtttctttatttatttttatttatttttttgagatggagtctctgttgacaggctggagcgcagtggcgtgatcttggctca

SEQ ID NO: 272498 - DNA, 355 bp, Homo sapiens
tcagaaatttggcaaaggtcttgatggagagaatgcttgggttggatgccctacccgctaattttgtccttgacaaacactaaagtctttgctttgttttctgtctccagcagcagcagcctcttgccaggggctgagccttgatacccacatttgtctggtgcccccaaaagagtggctgcagatcctggtgtcaattcacaggctttcatcttgtgctggatttcttttcaggttccttccctgggaagttttttgtttcctagtcacaaatattgacagaaattttactttgcctttcaggaacttttagcctagctctttaggcctccactcccctgactactcagctaaa

SEQ ID NO: 272499 - DNA, 478 bp, Homo sapiens
ttctttttttgacagtctcgctctgtcgcccaggatggagtgtagtggcgtaatctcagctcaccacaacctctgcctcctgggttcaagcaattctagtgcctcagcctcccaagtagctggaattacaagcgtgcgccacaatgcccaattaatttttgtatttttagtagagacggggttttgccatgttggtcaggctggtctcgatctcctgacctcaggtgatctgcctgccttggcctcccaaagtgctgggattacaggaatgagccactgcgcctggccagtttttaatactgttaatgctattcaaagatggaaaagaaagccttgaaagtatattcaatcatgaagactgcacttctacctaaaggctagggacgtagagagggcatccaagactgggtagtttaaacagtaatttttaattccttcactgggcatggtggctcacatctgtaataccaataactag

SEQ ID NO: 272500 - DNA, 875 bp, Homo sapiens
atcaaaactaagtcaagaaaaaataaaatatctgaaaagtcctgtaacaggagattgaactagtgattttaaaacttcctgcaaagaaaaagtccaggcccagatggcttcaattgtgcattctaccaaacatttaaagaaaaaaatagaattaatctttcacaaattcttccaaaattcaagtaggttcatcaatcacttcccaatacatttgatgaggccacattatcctcataccaaacccctcccaaaaaaatctcaagaaaactatagacccatatatatcccttaggaatattgatgcagaaatcctcaagaactgctacaaaatgaatccagtgacatgaaaaattatagactgatcaagtgggatgtatgctaaaaatgtaaggttaggactcctgactcaacatcattcaccatgttaatagaataaaggaaaaaaacacataaccacatcagtaaacacagaaaaagcatttgacaaaatgcaactcctcttcattataaaaacactcagaaactatgaatagaaaggaacttcctcaacctgataaagggcattaaatgaaaaacccacaactaacatcggacttaatggtgaaaggctgaatgcgtttcccccatgacatgacaaggatgtccattttcaacagacatttctgttcaacactgtacttactggaggttctcgttagggaatttaggcaggaaaaacaataagtggcaaaagaagtaaaactatattcccagataacatgatcatgtatatagaaaatcctaaggaatacacacacacataccctgttagactaaatgttgaacagttttgcagtatgcaagataaatgggcaataaataatgcaaacatgaag

SEQ ID NO: 272501 - DNA, 471 bp, Homo sapiens
tctgtttcacctgataggtcctaatttaatctagtatcaaggtctggtatcaatcatttctctctcaaaagcaaaaataataagacttttttttgttacatgagtcattttgtgaaactaattaacttcctgtggaacacaatgctctcccattattttttggccgaactatcaggtggttaactcctttatttatttcttctttttaaaaaattgtctaccaaactaaagttgagaaagaggagagggagggtcagagggtgtcacaattgttacccttctcaacattcatattattacttggttaccaaagacctcagcttgaaatgaaggaatattagctcaagttatggactctttgctgctttcaaattgtttttaactatgcaattgtcaaactttcttaggagtttctggagttcttcatttagtgctgagaaaataaataactttaattgatatatcaattta

SEQ ID NO: 272502 - DNA, 451 bp, Homo sapiens
agcatttcccctttggttctctctttccctcttggcctttcctgtacctctggcttcagggagggatgttcttctatcctggctgtctatcttcctccctccctgctccgtcttggctcctttcactggctcctctttctccctgcccttcaccctccacttcctacctgggggatactgtcaaccttcaagatgtagcacctgcccatccgtggttctcttccatggctgtgcattagaatcacctggggggcttccaaaaagtattgacttccaggcccctcccttaactcattaaatcagattccctaaatatgcagcctgggtgtctctgttgatcaaagctccacagaggctctggtgagcagtcaggatggagacctttaatttccgtgttaatgattccccaggggatctctccacttttgtccctccactgagccccacatgc

SEQ ID NO: 272503 - DNA, 398 bp, Homo sapiens
tttttgttttccatttgattgctgttttattttacattttttttgttttactagtatcttttctaggccttgaaaatgtattctttaaactttttgaggcacaatttacatagcacaaaattattttattctaagcatgcaatccagtgattttttttcataaatttacctagttttgtaactgtcactataatccaattttagaacattttttatcaccctgtaagatcttttatgcccatttaatctgcattagcactcccagtcccaggtaaccactaatctactttctgtctctatagatttacctttcctagatattttgtataaatggaattatatgatatgtggtcttttgtgtatgtcttctttcattaagtgtaatgttttcaggattc

SEQ ID NO: 272504 - DNA, 421 bp, Homo sapiens
tgctatgttgcccaggctggtcttgaattcctggcctcaaataatcctcccacctggcctcccaaagtgctgggattataggcaaaaactactgcacctggccctaattcataggttttaaatggtgcactgttttgagtagcacaatgaaaccttgagctgtcccattccatctggcctgggatgtgaatcattccttcgtttagtggctccacactgtatatgctacccgcccattagtcacttaatagccatcttggttatcagaccaactgtgagagtattgctgtgtttatgttaagtaacccttatattacttaatgattatccaaagcacgacagtagtgatgctggcaattcagatgtgccaaagagaaactgtaaagtgcctcctttaagtgaaaaggtaaaagctctcaac

SEQ ID NO: 272505 - DNA, 250 bp, Homo sapiens
cagatattgtaaggaaaaataagagtctgttggggagactgatcttcacctaatctttacaaaacatttttagaaaacctgcatgttttttcttaaactttcattgtactttaaaaaaaatccacatgtgtatcatcattacagtttgtgtgaattgcgaatgaggactctttcttctttctagtccatggctaaaagaaaccaaggctactatggcagtagcaaaatccatgtttcccaatcctaaaat

SEQ ID NO: 272506 - DNA, 393 bp, Homo sapiens
gcaccactgcactccagcctgggtgacagagcaagaatacatctcaaaaaaaattattgataattggtcattaataacttgttcctatagttgtgttagctctgttggattttgatttggccaatggttacactaattttgaataagcttattaataaagacaaaaattgaagaatgaatttggaataatcatttggaggaagccaaagggcactgtcgtatttcaaataaacgatgtcatcaatgaaatggtagtttcagataaatgtggtataatgaatgcaacaaatgtttattttcagttgcctagggattcaggtcaacatcctgaacagtgaagacagagcattttaaaggagactttgtagtggtgcttgggataactagagagag

SEQ ID NO: 272507 - DNA, 522 bp, Homo sapiens
cagggtggtggttgtctgtaactttaatccactgactgttgtactagggcagtttgggctagacactttggaggagctcctgtgaagggcatgaaggctcactgtagcagcagctcagttgtctttcagagttctgcccttaagagctggtttgcagtgctcatccttcttgctgatattttaaaataggtagaaacaggctgggcgcggtgactcatgcctttaatcccagtactttgggaggcctaggcgggcagatcacctgaggtcaggagttcgagaccagcctgaccaacatgttgaaaccccgtctctactagaaatacaaaaattagccaggcgtggtggtgcgcacctgtaatccagctactcaggaggctgagacaggagaatcatttgaagacaggagaatcgtttgaacccaggaggtggaggttgcagtggcagtgagccaagataccgccactgcactctagcctgggcaacagagcaagactccatctcaaaataaatacataaata

SEQ ID NO: 272508 - DNA, 1043 bp, Homo sapiens
ggaattgagaatacgttggagcaatacttcacatttttgaagtaaaatgatctccaaaccagaattctatacccagccaaactaccaatgaggaagctaccagaggatgtgcttcacccaaacaagggagtaaaccaagaagagggaaacagagaacactggacttaagaaatccaacaatgagaagcaaagggaatctcctggatgatgataaagagagagcccaggatgaaagctgtatgccagggaaagtcctgattagaccatgtgacaagtcttcaggaaagactgcttctggatgataaaatgaactgaatacctgttaagagacttggggggtcaaatttgcaataagtaccaaacaaagaagattaaaaaatgataagtcccaagggaaacaatatgttgtaaagaaaaagtagctatagtttgttcatgacataactgtaacttgccttgtacatgataatataaacaccgaatcttcctcactttgtgaaagaacaatattgggcaaatgcgcaggttttggaaagttccatgtgtagggggatggagggagaaattagcaaaatcctccttttctatagctaatacctataaagtgctacaacacccagaaaaaaaaaccaacacgaaagcatcacaaacaactacagaaacaaacgaaaacaaaatcaggagcacacatagagcaaaagacaagaaaaagaaccgaggcggcgcacgacagaataatgcccacaccaaggaaggacacaaagcaccagacgacaaaacaagaatataagcaaaaagaaaagaggggccccccaacaaaaatgatgaggagggttcacaaacaaaagaagagacaagcgacgagagaggacacgccgaatataaaaaagcaacgcagtcgaccgagcgaagagaaaaccaccgacagcagcggacaagagaacacctcggtgagaggaacgaccaccactatcgagagggggggcgggaagaagacacagagggagaggaacaaacaaaccaccacggaagaagaagagaga

SEQ ID NO: 272509 - DNA, 873 bp, Homo sapiens
ggaattgagaatacgttggagcaatacttcacatttttgaagtaaaatgatctccaaaccagaattctatacccagccaaactaccaatgaggaagctaccagaggatgtgcttcacccaaacaagggagtaaaccaagaagagggaaacagagaacactggacttaagaaatccaacaatgagaagcaaagggaatctcctggatgatgataaagagagagcccaggatgaaagctgtatgccagggaaagtcctgattagaccatgtgacaagtcttcaggaaagactgcttctggatgataaaatgaactgaatacctgttaagagacttggggggtcaaatttgcaataagtaccaaacaaagaagattaaaaaatgataagtcccaagggaaacaatatgttgtaaagaaaaagtagctatagtttgttcatgacataactgtaacttgccttgtacatgataatataaacaccgaatcttcctcactttgtgaaagaacaatattgggcaaatgcgcaggttttggaaagttccatgtgtagggggatggagggagaaattagcaaaatcctccttttctatagctaatacctataaagtgctacaacacccagacaggatacttctttgttgctttcattataatatccttgggtattgctgttggctatttcttaatactacttaaatattcacaagtgtacgacttgttttcccaacctaactataagctctttgatagttaatgcttctctatattatctgtagtggctggcatagtatgctacgcatagtatgtggtcagtttgagaaatattagttgaataaaataatagtgttggaacaaataaataatgactaaaactg

SEQ ID NO: 272510 - DNA, 498 bp, Homo sapiens
tatttggcctttagcatggagctgtctcctttcttaccatatgcaaagcaaattccaatgccgtggattttcccggccctgctagccacgtgtccctctttattactgtcacttcagcacagagtttccaagaaagagacacgtggaacagcctcatgttgaattctaaatcctactgatggacacaccaaatagcctcctgaccacaacagcatattccaagtcaaagttctccatgaatgttccttagcagactgaagacaaataaatacatgtcactttcttcttgaccccagagatagggacacgaagggataaacgtctttgggaatggcacccctgtaacctcagaatcactacttcatgaccaggtgcagtgactcttgcttgtaatcccagcactttgggagcccaggcaggagggtcatatgaggccaggagttccagatcagcctgggcacatatgaagaccctgtctctacaaaaatgaaaaataaa

SEQ ID NO: 272511 - DNA, 229 bp, Homo sapiens
gtgggttggagcccaacaccctactcccccagctgcccccagggataacagaagatgcttcctggaggaactgagaggaagaggtatgagggatggttcatgggtctctggaagagaccccactctccatgtcatgccctgcaaggtctgtggggaccccaagaagaagagacctgggtctgtgatttattttccagggaaacccatagagaagcagctagactcaaaa

SEQ ID NO: 272512 - DNA, 459 bp, Homo sapiens
agggtgtcttggcggtggccttggtaagagaaaggggcaaggggtataattgacaaggcactgaaagtattgaagtcagagccttgggaaggatctaccgaactctcggcggtccacgcggggacagacctcagcccgtgagccttgagctccacgcggggacagacctcagcccgtgagccttgagctccacgcggggacagacctcagcccgtgagccttgagctccacgcggggacagacctcagcccgtgagccttgagctccacgcggggacagacctcagcccgtgagccttgagcccagaaggagtggcagcctcaggacgtttgccaggtggcctggaatgtgagggaagcctcagccccgccaggaacagagctggcgctgagttcccggctcggcccgggtcagaagcgaggaaagtttgccggcgagtgtcctttgtgctgcgtggag

SEQ ID NO: 272513 - DNA, 421 bp, Homo sapiens
agggtgtcttggcggtggccttggtaagagaaaggggcaaggggtataattgacaaggcactgaaagtattgaagtcagagccttgggaaggatctaccgaactctcggcggtccacgcggggacagacctcagcccgtgagccttgagctccacgcggggacagacctcagcccgtgagccttgagctccacgcggggacagacctcagcccgtgagccttgagctccacgcggggacagacctcagcccgtgagccttgagcccagaaggagtggcagcctcaggacgtttgccaggtggcctggaatgtgagggaagcctcagccccgccaggaacagagctggcgctgagttcccggctcggcccgggtcagaagcgaggaaagtttgccggcgagtgtcctttgtgctgcgtggag

SEQ ID NO: 272514 - DNA, 354 bp, Homo sapiens
tgccactgcagttccgcctgccaggaccagtctttccctagaccttcccattcctgcctcttcctggcttggctgcctctttctggtgcttcaggtctcagatcaaatgtcacctcttcagagaggacttcattgaaatctctgcctaacacagcccgtatcaaggtcaacacttttctctttttagacttaggttttgatataaagaagtttcataaaaatgacttgggcagctatcatctgtttaaaaggtctgactttgttgaaataatttgggctttcctgttctttgagttttgataaaacaactgtaaaaccatctgcctttttaaaaaaaattgagattgatgtaaa

SEQ ID NO: 272515 - DNA, 544 bp, Homo sapiens
tctgtactatcacagtaagtgattaaaggtttgactgttactttcattgtggtttgtgttaatcagctattccgacacctggcagctcagctctctcctcctcagctgagctctcgacaattgctaactttctcatttcctcgaaggcactgttcaaatgtcactccaatgagtcccatcctaactaccttacataaaattagagaccacccctggctcttgaactctcaatgtcccttatcctacatcagactttcccacattagacttgtcactttgaaacatactatatactaattgattacggtattattaatgtttccccttatacccactaaaacgtaaactacataaagatgggctttaactactgtggctttaactattatattgcaagtcacataaaaaataaacaatatttgttgaaagaatgaatatacttgaaaaaaaggtgaaatttctgggaataagaactataattattcaaatactcagttgaagacttaaatagtagttcagacacagcaaaagcaaaaaaaaaaaa

SEQ ID NO: 272516 - DNA, 345 bp, Homo sapiens
tttttttctttgtttgtttcaatttcatttagttcagctctgatcttggttacttcttttcttgtgccgggtttgggttggtttgttcttctttctctagttctttgaggtgtggtcttagattgtctctttgtgctcattcagagcttttgatgtaggcatttaatactatgaactttcctcttagcactgcttttgctgtatccccttttgctgtaacagattaacagcagatttctcagcagaaaccttacaagctagaagggattggtgtcctatctttggcctccttaaacaaaacaattatcagtcaaaaattttgtttccagtgaaactaagtttcat

SEQ ID NO: 272517 - DNA, 349 bp, Homo sapiens
ttgagatggagtcttgccctgttgcccaggctggagtgcagtggcgtgatgtcaggtcactgcaacctccgcctcccaggttcaagtgattctcctgcctcagggattacaggcgcatgctatcacacccggctaattttcgtatttttagtagaaatggggtttctccatgtcggccaggccgaggtgggaggattgccggaggccaggagttcaagaccagcctgggtgacatagcaagactctatctctacttatattttaaaaatgtattgtaaattgacaatcataattgtgttgcctgttgttattttgaccaaaccatttgagagtaagttactattgtgac

SEQ ID NO: 272518 - DNA, 369 bp, Homo sapiens
ttttgccagttagaaaactaaataatagtatctcatttcaagttgcatttcattgattattagtcaaattgcatgtcttttcaaatggtttataggccatttatatttataatacttttctgtgaattccttgttcatattttttccccattaaaaatttttttatctaccctgggcaacatggagaaaccctagctctacaaaaaatacaaaaaattagccatatatggtggtgcacacctgtagtcccagctactctggcagctgaggtgggaggatcacctgagcccggggaggtcaaggccacagtgagccgtgattgtaccactgcacttcagcctgggtgacagaatgagagcctgtctcaaa

SEQ ID NO: 272519 - DNA, 338 bp, Homo sapiens
ggcggaggcaggagtacaccccagaggtgtgggtttggggcacagtctgttggtggaggctggagtgcacccagaggtgagggtttggggcacaatcttcacacaggctggagtgcaccccagaggtgagggtttggggcacagtctgttggtggaggctggagtacatccagaggtgcgggtttggggcacagtctgttggaggctggaatacacccagaggtgagggtttggggcacagttttcacacaggctgcagtgcaccccagaggtgagggtttggggcagaaacaatcccaaccccccacttcactaaatgggcatgagggtctcacgaa

SEQ ID NO: 272520 - DNA, 896 bp, Homo sapiens
atcatttctttgggttttgtatttgttattccacaataacctagtctaagccaaaacctgaaattcctttttttttaaatttttttctgtcgttaagctagcattggctactaaatcaaaaaaagtgttgggttgggcatggtggctcatgcctataatcccaacactttgggaggccgagacaggagggtcatttgagaccagcttgggcaaacatagcaagacccttactttacaaaaataaaataaaataaaaaattagccaggtgaggtggtatgaacctatagtcccagctactgaggagtctgagatgggaggattgcctgagctcaggacttcaagcttgcagtgatctatgactgtactacactccagcctggtcaacaaagcaagaccatatctctttaaaaaaaaaaaaaaagaaagaaagaaaaaagaaaagaaaaaattgtcaaaactagtaaattccattgggtatgtgtacatttttaaatggagaagaggcctcctaaaagaccacaatttctactttgtgtcaacatttatattgctcttttattaataggctactgtgttgtctctgaagcctttgaatagtatattaattcattaaaagcttgttattcagaaccttctaaaaaacaaactcttattagtacttaactgctcttgatctcctattcttactttcctgataccagttgataaatcagatgagctgtgatactccatatcaaactccagagctcacttgagagatttcaaagtgagttcatgcaaaggaactctataaataatcaatagatgtatactataagtaccttctcttttaaatcttgatagtatcagaattttaagttagtatatgaactgggttgttagctaaaacagtgga

SEQ ID NO: 272521 - DNA, 312 bp, Homo sapiens
taacagggggtagacagtagaggtttaagggaactgtttagtaaattaataggttgccatgtttaactcctctgtgtagttgagtttggtttacaaaagtagtagaatgtatttatttatgtttaccttacgacatttattcatgatgccaagggtgtgagttttatcctgctgtagacctatattactattttcttcagtttccatagactttcctgctagctctgacaagtcattttcctgaaatttggcaaacctcaaagagtatgactgaatcaatgccatctctatcaatatatatgaaatgatttt

SEQ ID NO: 272522 - DNA, 413 bp, Homo sapiens
ggaattttaggcatgagccaccgcacctggtggaaccacatgatcttgagcaagttgttttactcctcgatttgtccatattaaagagtaaagtgagttaggccaggtgcggtggctcatgcttgtggttccaacactttgggaggctgaggcaggaagattgcttgagcctgggagttcgagaccagcttgggcaacatagcgagaccgccccccctaccccgccccacctcccgctccccggctccatctctacaaaaaataagaaaattagctgggtgttgtggtgcatgcctgtagtctcagctactcaggaggctgaggcgggaggatcacatgagccgaggagtttgagattacagtgaactatgattgcagcctgggcaacacagcaagaccctgtctctataaaa

SEQ ID NO: 272523 - DNA, 319 bp, Homo sapiens
ataagaaaactgattcccagtcagagaataaaactccactaacaaagtctggcaaaccgcaggcaatacgtatttgctgaatattttgctttcaagctagcactttgagactcactactttggacggcactccccctccccacaaaacgacacgacactggctgacgtctctcccacccgccaggcagtgttaggccccgacaggcccgtgcaggtgggatcactgttatccccactagactgaggaggaagccggggacccgggcgattggccactcgggcgacctccacagtggagcaccaacagcgccgggaggcg

SEQ ID NO: 272524 - DNA, 350 bp, Homo sapiens
tttacccaattatttcagttcagggtctccagtggctgcagcctatcccagaagctcagggtgcaaggcaagaagtaatcgtgggaccaggcgccgtggctctcgcctgtaatcccagcactttgggaggcagaggctggtgaatcacttgaggtcaggggttccagactagcctggccaacatgatgaaacctcatctccactaaaaatacaaatattaattggatgtagtggtacatgcctgtaatcccagctactcgggaggctgaagcttgaacccggaggcagcggttgcagtgagctgagatcgtgatactgcactccagcctgggtgagggagtgagactcta

SEQ ID NO: 272525 - DNA, 1088 bp, Homo sapiens
tctcggctccctgcaacctctgcctcctgggttcaagcaattatcctgcctcagcctaccagttagctgggattacatgtgtgcgccaccgcgcccggctaatttttttatttttagtagaggcggggtttcaccatgttgaccaggctggtctcaagactactgacctcaagtgatccccccccccccccgcctcggcctcccaaagtgctgggattacagacgtgagccaccgtgcccagcggttttgcattttcaattgtggggcacggtgagaaaagacttgaagaaagcaagggagtgagatccatggaaatgtaggggggaaccttgcaggcctatggaacagccagtgcaaagggcctggggtgggagctgcctcagggtagccaggatggcaggaggcacagctgccgagaggaagcaggggccaggtcctgcaaggttagaggccatggctactcctgaacacattggcaggttttggagcagagaagtgacatgattttagttttctcaggatccctctggctgctgtgtggaggaagaggggagggtgagagcagggatacctcttaggaggctgtggtagtaatcccagggagcccggatgggagcagaggaggggacaggaattggattctggatgcattttggagggagcatgaaggaaagcggggtcaaaggttcctctgaggccttggctgcctctcttattcatctacatccattctgtcaaggacacctttcatttcttcttggcactgtctcaaggccaccacgctgctgcccacctgaccagcagtggcctttccaggccttccatcttctccccagcagcttatctctgcgtagccaggtcccatttcccacacacctttttttaaagtgtgttgcactgctctgggtgcaggactgtagcagtgaccagggcagctccagatgaagcttctgctcacaggaaccttttctactgaaacagatgatacctaaactctcagctgtgtgactttaagcaacttgcacaacctctctgtacttcagttgcctccatcttcaaatggggattaaaaagtgttgacatcata

SEQ ID NO: 272526 - DNA, 176 bp, Homo sapiens
tttttttacttgctcggtaaaataaattacccaacgctcagtttgttcatttgtaatttgggagaataatgccttcctctcaaagttgttttaggtttttacgtatatgcaaggttaagtgactgaaattactttgcaaattgtaaaatgcatatcaaggtgagtgattattttta

SEQ ID NO: 272527 - DNA, 484 bp, Homo sapiens
ggccagagtcaaagagtgtggagaaatcagaaccctcacacacagctggggaacacaaaatggcacagctgctctgacagcctggccggtcctctaacggccccacatggtcagcacaggacagcaattccacacctcggtatacacccaggagcaatggacacatacatccccaaatgcccatcgagtaggaatgtgtaggccaggtgcggtggcccacgcttgtattcccagcactttgggaggctgaggtgggcagatctcctgagctcaggagtttgagtccagtgtggccaacatggtaagaccccatctctacaaaaaatacagaaattagccgggcatggtggcacatgcctgcggtcccagctactcaggaggctaaggtgggaggactgcttgagccctggaggtggaggctgcagtgagccatgataacaccactgcactctagcctggatgacagagagagagaccctgtctc

SEQ ID NO: 272528 - DNA, 378 bp, Homo sapiens
tttggcaaacggataaactcttaaacatccacattcatctcaaggtagaacatttttatctatccagaagttttcctcatgtcccttctcagtcattctctgtcccagcaatcacttttaagaattttttcactttagattagttttgtttgagaatttcataaatggaatcacagtatattattgtgtttggcatcttatactcagcataaagtctgtacaatgtattatttttgcctgtatcagtaatttgttcctctttattgctaagtagtattctgttgtataatgtatactacaacttttttatcctttttccatttagttatttccaacagttggttattaaagataaaactgctgtgaacattgaggtac

SEQ ID NO: 272529 - DNA, 374 bp, Homo sapiens
actctctgttcgcaggtatctcttcttgagtctgtttctgggtctctcagtctctattcttcaagtctccctttgtgtcaccaagtgcttcccagcctagccactcctctacctctccatcagtctgccttacttccaatcaattcatccccatttttttctccttccctcttctgtttcttctccttaagtgactgttgatacagaactagatacatttttcttaggttggtggaatagactttcacattctctggtgtttagttctaaaattgattgaaaaatgtttgtattctttagtgttgtctgaatttcttataagagtatgtgtaattctttaaaactgtttattaaaatacgatgcctatattagt

SEQ ID NO: 272530 - DNA, 491 bp, Homo sapiens
tgtgcctagccatgtgctcaggtcattgttgactatgagtgcctcagtttccccttctgtaaaaagtggggtcaggcacaatcccgggcctgctcactgctccctcccccttacaagagctatggagcaaagggaggtggagatatttcttgaacacacaaagggaagggcagcttattttttggaagtcaccactcaagggcctcaagccctggctatcagcactgttcgagcttgtgtatacacgtgtccacacaaacgcgtgggtgttcacgtacctgcctactcacgtatgtcctcgggccaggccctgccctgtgaacctgtgagcacagccttccacgcctagcccagccctgaatgatatcccaccacagttgtgatgggccagcaactaaagcaacagcagcccctagtatgaagcacccagtgtatgccagacattattctgggtgctggaaacagaataaaacagacaaaaatccctgcct

SEQ ID NO: 272531 - DNA, 190 bp, Homo sapiens
cacccacccccggaaaaccaaactttattctcgagggcaactggacactgtattatgtcctgccgaacccccgcccttacttaggtagaggcgcataagtattctggccatgaaatacaccttctgttttatagagatttggcatatttgatatatgttctttggaatttatgaaatagaaaacccaaag

SEQ ID NO: 272532 - DNA, 385 bp, Homo sapiens
agcaccctatgaccacttgactacagaagacaaaattcaggtctgatttacagagggttctgccagataggctgggcactatctgaaatatgaatggctacttaagtctgaagcagtggcatgtgcaataccacagcaatgaatgaggcattccataagttcacaggtcatggtttaggcagacacactgcaggcctggaaggcaaatgagtatccagaataagtgtcgatcgcagtgagaacaaagtgctgccacttccattatgaaagtgatcttttgtaatcagtcacctgctagcaggtgactggccatgtttcccattttctgaaagagctggcctgatagaatggtgagatggcctttattttttattattgtggtaaa

SEQ ID NO: 272533 - DNA, 387 bp, Homo sapiens
gttcctctgaacccctctgtggactccatttggctccacccatagttaaaccatttcacaggctctcccatatcataccccttggaggattgtgagaacttgagacttccagctgcactctacaggaaccaagagcatctcaggaatgctgtagcttaatcttccattagtttttcataccactctgcagactttattatatggtggccacagtttagtgtagacatgacttcaaaaagtcccaaatattggctgaacgcggtggttcacacctgtcatcccagcattttgggaggctgaggcagacggatcacctgaggtcaggagttcaagactagcctggccaacatggtgaaaccccatctctactaaaaatacaaaaattaa

SEQ ID NO: 272534 - DNA, 374 bp, Homo sapiens
ttaattccacaatgtagttcaagttttccattaactaggacctgacctgttaagcagcagcactgtataagttaagaaaatacattatagccaagcatgggtggctcacgcctgtaatcccagcactttgggagactgaggcgggtggacaacttgggcccaggagtttgaaacaagcctgggaaacatggcgacagcctatctctacagaaaacacaaaatcagccaggtgtggctgcatgtgcctctaatcccagctgctcaggaggctgaggctagaggatggcttgagctgggagatggaggttgcactgagccaagattgcaccactgctctccagcctgggtgacagagctactcactctgtctcaaa

SEQ ID NO: 272535 - DNA, 217 bp, Homo sapiens
cggcacattagagctccactctgagggtgtaagccatgccatattttaattgtcattagcaataaaaaactagcagtgaggaaacccaacctccacacagaagagggcatgggccagggtcattaaccaggctgatccagcctctgacatgctgcatttatccttatttcacgtgtatgtgttcaaaccttataattggtagcttttactcacaggc

SEQ ID NO: 272536 - DNA, 415 bp, Homo sapiens
caaacactgaacggttttaagtggggcactatcaggatttaccattttggaaggtatgaagtttcacaagcacttccatgtatagtcaagttattggagctgtctccgtttagaaatggcttccagaaacactcctactatccactgagacaactcgcctggcatcagagacctagggtccagggtcagagatgggtcatgataaaagggcatcccttggggtgaggcaccagaagtctgcacagtggaatcaatatattccaaccaccagatgtagaaaatcttaagtgcaggatgtggttctcatccatctagtcacaacagaagttttcttcttcaggaatatacttaacaatgaagcatgtataattttatatacatcttacaataaaattattttgtgcatatcactgta

SEQ ID NO: 272537 - DNA, 821 bp, Homo sapiens
tactataatgcacttgaaattgtgtatgtgaccttatcaggcatttaaggaccataatctctccttgacctaagaaatcagcttgaagtaattcacttagatttcaaattttaatgtggatacccaaggctgcaaatctgttattcagtacctgctacacttttggggttgcctcttttatgcactgttagaattgctagaaatttagaagtccaattggaaagaagcatatcttgttagaaagtattcccagaaaatgaggaaggctacattttaactgtgtcttgattttacagggagaaaaataaagttaatattttgaggaaaaaataaggcttttaagatgacatgctatatagtagacaaatagtttaactcggtgcctacttcatgtacactggatgtgttaacatgaatttatgaccctcagtgactttttattaccaaaacagcttccttaaagcaaacacacacacatgcctctacagtattggaaaattccgtctccttagataaaacaattaggatttttcttgggccaactagaataattagggctgcagagttggagcctttatataaggagtttgcagctcatatccgaagagagaaatgtatttcgaaagtcaaaagtgtagttaagtgagaaagcagagtagtttcagcttttgcatttggagtgggtataatttactgtgttgtcataagatactggaaagatctttggaagaataggttcttaaagtgttttctcatgtgcccttactgacatttcccattgggccttcaagacaactccagtaaatacttaaattgatttt

SEQ ID NO: 272538 - DNA, 182 bp, Homo sapiens
cccggggccacagcaccttccggtttcaccactcaccaatgcatcgtttattaaagtttctttcaaaaagaatttttaagcctatgttgttgtacagctgtttctcgcttgcttttcttgccattgcacctgatctgctgctgacgtgcgggagggtcattaaaagattgacttaaatttga

SEQ ID NO: 272539 - DNA, 408 bp, Homo sapiens
gtctcaaaaaaaaaaaaaagaagagagaaaagaaattggacccttatctaacgccatccacagagtaaactccaaatgtggtctaagtggtggtgcctataatctcagcttcttagaaggctatggcaggctgggcacggtggctcacgcctgtaatcccagcacttttggaggccgaggtgggcagatcacctgaggcgggagtttgagaccagcctgaccaacatggagaaaccccgtctctactaaaaaatacaaaattagctgggtgtggtggcgcatgctgtagtcccagctgctcgggaggctgaggcaggagaatcacttgtacccgggaggcagaggtagcggtgaccgagatcgcgccattgcactccagcctgggcgacaagaacgaaactctgtctc

SEQ ID NO: 272540 - DNA, 493 bp, Homo sapiens
ctatgtacccacaaaaattaaagataaaaagaaatagtagatataatttctgcttttgaataggttattatttaaaaagaaaatagtggtcaaggcaagaaatatgtctttgcctatttgatatgctagaatggacagaaataatggcaaagtttcattcttgtgtatgtgtgagaatgtgtttgtgtatgtaacatatggaatttctggcatatatatggatatatatgaaattcctactaattttagaggtatagatctaaacttgttctggagttgagaattatgtcatccctcagagactatatttcacagaaatactgcttctggtcagaagtactgtggatcttaatattaaatcagattcttggccaggcacggtggcttttgcctgtaatcccagcactttgggaggccaaagtgggagaatcacttgagcccaggaattcaagaccagcctttgctacttagtaagacttcatctctgcaaaaa

SEQ ID NO: 272541 - DNA, 376 bp, Homo sapiens
cgcctactactactaaattcgcgggcgcttcgacgtttcattcttgtgtatgtgtgagaatgtgtttgtgtatgtaacatatggaatttctggcatatatatggatatatatgaaattcctactaattttagaggtatagatctaaacttgttctggagttgagaattatgtcatccctcagagactatatttcacagaaatactgcttctggtcagaagtactgtggatcttaatattaaatcagattcttggccaggcacggtggcttttgcctgtaatcccagcactttgggaggccaaagtgggagaatcacttgagcccaggaattcaagaccagcctttgctacttagtaagacttcatctctgcaaaaa

SEQ ID NO: 272542 - DNA, 583 bp, Homo sapiens
attaatcatctaaaatccaagcacagagaattcaattttagatggtctccagagcagaatttgatgtataatcttaattacaaatcatagataattaatattgtttacaaaatcagaatacgattagaggtagggatcctgcacacaccctattttcctccccagtgttctgaccgagagactaattaataattcaaggaacttacagtgaatgagaacccatggttttgcttaattatcagaacagctagatctgagaacagctgtctcccacatggatagacacttattccacccatttgcaggtagaatagctggcaataataagtccttcccattggatatgttgaaaggtgcctgccatggcatagttgccacaagagaggaagaaatggacacaaatgtaggctgttttcagggcagagggaaggtgggaggaaaccagcttgctggttttcacacaccctctggggaacacccatgcacctatgagatgggtttgtgttagcatcacctctgaaagattacccacccaggcaaagaaagtgacccatatgttttcactttcttggagtggagggca

SEQ ID NO: 272543 - DNA, 443 bp, Homo sapiens
aggccttgtccgttttgggattctgtatagcaaatattaataccttacttctatttggtctctgcagaactcaggtagtgcctctgttctcttaagtcaattatcactcctccatctcttcaattttataaaaattttataaattctcttgaatgttttagtttcccattcttttctctatcttagctcttttgtatttttacctttttatactcctttactgtgaatttaatgtggttaggggaagaagatgttgaaatagaatcatggagtcaatctgccatttttcagaaatactattttagtggcatgtgcttgtagtcccagctactcagggggctgagataggaggatcatgtgagaccaggaattcaagcctgccgtgggctattattgcaccactccattccagcctaggggacagagcatgacttggctcaaga

SEQ ID NO: 272544 - DNA, 459 bp, Homo sapiens
aatcttagacaatcccccaacaccactccccagtttatgtatacatactttcaacaacagccagtagtagtgaaaaccttgagatgcacccatagtaacctcctgcactggtgtagatgcccctgtgacaggttgtttctcctccagaccatgcccaccaaagtcaaagccacatgggagcctctgagctcagagccactgtatggggtctccatgcacaagggcagcagctccctgtcctttctgttggtgaggtggggaattcagttcttttgaataaggctgagtttattcaatactgattctgctggctgaccagtgataccttaagactttatttcttgcattgtaatatttatcctggttttgatatgatttgttgtgcaaatgtgtttaactcttgggtatattttttttctttttttgttgtcataaacatcatctaaaaccaaattttta

SEQ ID NO: 272545 - DNA, 233 bp, Homo sapiens
aaaattaaagtcattaggttgcttttccatcacctccctccatccacactcattctcttctcttccagccccaaagatgatgtttccttcctcttgttcaaaaccaacttatcatgtgagctctcagttcatttcccacctctttcagaagcttattccatcaggaacttcttacatatatttttaacctttctctcttaactacctcctcagattacaatctctactcctta

SEQ ID NO: 272546 - DNA, 250 bp, Homo sapiens
aagagggaggaggacatagcctaggttgtacccaacactttctctttatctcaagatgccccattgtagttactaggatgccccattctagaactacaatgggataaagagaaagtcactgttaagtggcaggggaaagagctggggcagccaaggtcatctggggatttgtcctcctacaactaaccttcccagttcaatcccttctttattttgaatattgctaataaggaataaggacaatatacag

SEQ ID NO: 272547 - DNA, 564 bp, Homo sapiens
cggcccgcctcgtcgagggttccgctgagctgctcacaagggcgtgcggaggcccgcggccggccctggcccctgtggtggcagcagctggctggcttcccgggcggctacctccagctgcagctgtcggtgctatttgcagctctccacatcctgagagctggacgccgaggaccgctccctggagggcgtgcgtaaaatgcagcagcggagcggtgaggagattaccggaaaaactgggagcggagtcaggctcgttctggagcagggagaggcttgggaagttgcgaaacgttgacctgcagggtcttgaggaactgtcggcctgggctgtccccgtgggtcattgaacattaatcagccaccagtcctcgaccaagccaaccgaaatagagtcagcaggcagaatgacgaatacagtttgaaagggaacgaacttactcttattctctccttggaaaggcctttccagactctcgaactcacccctgtcacattaccctgttgtgttatctttgtgggcctgcgcagcacctgaaatgatctgtcttaggtatgtgtgtg

SEQ ID NO: 272548 - DNA, 517 bp, Homo sapiens
cgactcagcaaggtggagacgctgcgcgccgccatccgctacataaagtacctgcaagagctgctgagctcggcccccgacggctcgacgccccccgcttcccgcggcctcccgggcaccgggccctgccccgcgccgcccgccaccccccgtcccgaccgccctggcgacggcgaggcccgggcgccctcctccctggtgccggagtcatccgagtcctcctgcttctccccgtcgcctttcttggagtcggaggaatcctggcattgatcgggcctgtggccgcccccggcttggaggatgatccgccggccccgtcccactttcgggagcagcgggaggctgttgggtcacccgcgatgcgccgcaggacggtgactgtaggaggtccgcggcgctcccgtgtctgcgacaccctccctcctccaccagcttggggcggaagtgcagggcagcgggtacgatgggcacgatagagacctaggagctccgtgggtgaagcgaggggcagggcctg

SEQ ID NO: 272549 - DNA, 562 bp, Homo sapiens
gtcctccgatgaattttgatgcagaaatctttgtaagatggtctgtattcattttgagtatcagagaactacaagccgaaggcaaagtggcaatgccagcccctgtgtgtttatctaagtgccaccacttggccaaggcactccataaggtcacagcgacaggctttgtggggagacccccagcggtgcagcagaggccagtgtgagccccaatcgcttgctctgctgtgagtcttgtcatggaaagctgggggtgtggagagcacaggttgtgtcaggtgggattgcaggaagatttcagggagcgcactgtcaggtgtgcagttgcaccccacgccccccagccccgggtctcaggcagcagggagaggactcgcaggctctcccactgtccagaatgccctctgcttggcaaaacaacttctgctaataagagcttgcattatgtatttttttttctgatgacaggattttggaatctgtaaattgaattttatcttcatcatattgaattatttcttttcttataaggccgaggacttcttacaattaagatacaaaa

SEQ ID NO: 272550 - DNA, 273 bp, Homo sapiens
gtgggagctgggagaggtgggaaatggccagaagcaacatccaggagcaccaggcatcccttgcttaccgtcctcacccttgcgcagcaggcagtatcagccctgcctgaaacttgctctgcagattgtgggaagagagcggatccatgttctagacccaacaaacgaacacgtgcagttcccaagccttcctcactccctgtttatgggagactccttgtttctcacatttcttttagtcttagagacaatttggtcaggagacatgggttt

SEQ ID NO: 272551 - DNA, 455 bp, Homo sapiens
gtcatgagtctttcagtcgtaatcagtgagagaggggctgaagtagactaatgacgccaaaccaggacttttctacctatctttggagaatccatgttaaaacaaacaaacaaacaaacaaacaaaaaaaacctactttggtaggtagtcttttctcacctgcctttcagccttgaggctggtttagtttcacaactatatagttgtgctgctcctaaatcttgtcacaggttttacctcgtgttacagttcttttagcacttatcttcagttccttagtagattataaactcaatgagattgaaactatggatgttatatgtctctcccctaacattgtattacatacttagtagctattacctaactgaattgattaattacctaactgaattgaggttcagtaaagccatttttaaattaaatattttaattcaccctgattaaatgtaaaa

SEQ ID NO: 272552 - DNA, 386 bp, Homo sapiens
ggcttacccagctgtaaagtggggttgcccttttggtgaagaatgtgaattctgtcaggttgggccagataacatagctgtcaggtggcgctcactattccaaactctcccagttcccctcatttttcactgattttcacacattaatccagactggatgttttctcagtgactgaggtgtttggtgtggcagctgactggttctgtcaatggggaagttaccgaggtctgaggtgggtcaccctggggcggtggttgccaacataggggagggttgcagtggcctttggaggcctggacctgggtggagggctcactttaggctagaggccttaatctggtgtttcttttgacatactcaggtaggagtgacatttgaaaagaac

SEQ ID NO: 272553 - DNA, 507 bp, Homo sapiens
cagttatgaataaagctggtgtaaacacgtatgcagcttttgtgtggacatacattttttaatcagttggaaaaatacctaggaatgtgattgctggtttgtgtgctatgaatatgtttagttttatgcctgctaaactgtcttctaaagtggttgtaccattttgcattcctagcagcaatgaatgtgtgttcctcttgttccacacccttgccagcaattgttattgtccattttttgggattttagctattttaataggtgtgcatagtatcttgttgctaaaatttgcactttcttttttttttttttctttttttttgagacagagtctcactcttgttgcctaggctggagtgcaatagcacgatttcggctcactgcaacctctgcctcccaggagaatggcgtgaacccgggaggcggagcttgcagtgagccgagatcccgccactgcactccagcctgggcgacagagcgagactccgtctcaaaaaaaaaaaaaaa

SEQ ID NO: 272554 - DNA, 407 bp, Homo sapiens
acaatggttatagtctcattacaaaaaaaaggattattgtgcatcttatatcatatggatccagtcgtttccatttaatctctttatttttatagcagcatagccctataatactgctaattaaggtaccaagttagagtgaacattgttttcatcctgtgaaatgtctatgtttcaaaatatttcatgtatgtgaggatgggggagtaaaatctcagccagatttttgagcccctaagtctcttctcaataacattttagaattttaggcatttttagaagatatagtctcttttttagtgtaagttttatttaagtccacattaaaaatacattggcatggtctaaactttaaacaattcaacaagctgacagccaaatcatgaattaactcccattcacaattg

SEQ ID NO: 272555 - DNA, 411 bp, Homo sapiens
  misc_feature (387)..(387): n is a, c, g, or t
  misc_feature (411)..(411): n is a, c, g, or t
acagtcacaaggcaccatcttggaaagagggaatgggaccctcaccagatacaaatgccagtgccctgatcttggacttcccagcctccagaactgtctccctattccttgggacacaactgtattgaaattagaccaactaatacttctacaaagacttctgagtgttgaagtgaaaggaagagttgcacgtctcttattttaaatcaaaagctagacatgatgaagcttagtgagaaaggtctgtagaaagataagatgggccaaaagctaggcctcttgcatcagctaactgtggtgtgaatgcaaaggaaaagcttttgaggaaaatgaaaattctactccagtgaacacacaaatgaccagaaagcataacagccttattgnctgaaaagaagaaagtttgagtgn

SEQ ID NO: 272556 - DNA, 473 bp, Homo sapiens
gctgtcctgtgcatggtaagacttctagcagcatccccgaactccacccactgtatgccagcagcactccccatcccccaagtcatgacagtctgtcttcagacagtgccaaatttccccagggggcaaaatctccagttgggaaccatcactttagagaaatgcaaagaggcaagagattgttcttcttttttcttttttaataataagccttgtagaacaatttgcctctttcatctatgtgcatgtcacacttttataaaaataagaacgaaagagagagagagagaagctcatgaatcattgataatgaattcatctgtaggaaaagccttgttaaaaaacaacaggccaggcacagtgactcatgcctataatcctatcagtttgggagactgaggcgggacgaccacttgagcccaggagttctagtccagccttggcaacatagtaagatcctctctctatcaaaa

SEQ ID NO: 272557 - DNA, 497 bp, Homo sapiens
tttctacccctatgtaaaaccaggggcttgaactatgacaagccctctcacctaaccttggtgtgaatggatgggctttgaggagtccttgaatccctgaaactgtgcaaaagtctgcgtgcatttgtgtgcacactcaggctcacatttctgcaaggagaggagctggtgtccttgtccagttctcaaaggaatctgcaaacaacaaaaggtacagattttgtgaactaggtcagaggttggcaaatggttttttgtaaagagcccaaatggtcaatatttccagctttacgggccacacagtctctgttgcaactacttgactctgctggggtagtgagaaagcagtcccaaacagtgcatgaacagaggggtgtgggttccagtaaaactttgtttagggacactgaaatgtgaattttctgtcattttcatgtgtcaagaaatgttgttcttcctttagaaatgatccattttcgatgatttaaaaatgtaaa

SEQ ID NO: 272558 - DNA, 338 bp, Homo sapiens
atttcttcatttgaactacttgtttttgtgtctttctaaaaagtagactccccacagtgagatttgaattgcatgagaaaatgtgttctctttaattaactatgggctactcatgtaaattgtgatattttattatgaatgcacatattgagagatcccagtgaaacctctggagaaagaagtagctgttttctgtgggtgctttctagtgttttcacacaagctgaaaaggaaaccttaaaacttgtaactattttggagtgcattttgttgaatagcatataacttgatcaagagcttttaatgaaactaataaaataattgtgtttccaaaaacc

SEQ ID NO: 272559 - DNA, 213 bp, Homo sapiens
ggccccagtcaaaactatgggcctggcacaaaggtgcacttcaggcacacatttcaaatctgtcagtgctgggaggaagcagatgtaaacaaaataagacccaccaactggaaaagagagcatgccctgactagaggcaatgacatcttaatcctccagaaggcaccacaaatcccacagacataaccaaggatgtttccccctcaaaacccc

SEQ ID NO: 272560 - DNA, 236 bp, Homo sapiens
gtatggaggtgctcatggtggtggaggtgctcgtggtggtggaggtgcccgtggtggtggaggtgctcgtggtggtggaggtgcccgtggtggtggaggtgctcgtggtggtggaggtgctcgtggtggaggtgctcttagtatggaggtgctcatggtggtggaggtgctcgtggtggtggaggtgcccgtggtggtggaggtgctcgtagtatggaggtgcccgtggtggtgga

SEQ ID NO: 272561 - DNA, 429 bp, Homo sapiens
cagacatgtctttataaacttggctatccattttccagtctgtaggaaaagagaagctgtaagttggagaaaaggctagtggttgggtggtgagtcataagcaataagatttgatgtcagtgatgacaggcctgtcctcttatgatagattccttgagccccctgctgaccacaaagctttggctggctagaccacaagtctgtctccctcaatgacaatttttgtagctcaatatggatcctattttgtgtgagttgcatttggagatttgttgtttatctgctgtatttgccttaggtgggacagtgaaatcaacctaatgtagtggaaggaagtaggtattacatccttaattccttgatatacatccttttattatgtggtactcccgggatgtggtttttcagatttggagaagaatagttaaa

SEQ ID NO: 272562 - DNA, 291 bp, Homo sapiens
cactggcctgagggctgggaaactgggtccctccgttttcccatcattgaagggaagggtgggactagatctggggacacgcaggcagagcacacagaatgaggtgggccaggtaggtaatgtcacggccccgagggcctgcactttgcgccagccagttgttgcctggcttgagtttgggccgatgctaccatgttatctgattttgcaagagaaactggaaacctggatttttaaaatgtgaaatctcctgttttttcaaatgttggcaactaattaaacatttttaaa

SEQ ID NO: 272563 - DNA, 3109 bp, Homo sapiens
tcccacccccaggctccgcgttcccgccggccccagctccagccccgcagcccaccgtgcaaacatgcttagacagagaagagattaacttcagtggcttcccactaattacagagattaagaagtggctgcctgaactattttccaaaggatacacattacaaattattgaatagggcagctaaccaagaagatcctattggtttggggggaacacaacttccagcagccacaagggatgctgctactcaggtgccaactgaaacaagctcctccacagaaggtttcgtttaggttttgtgtcgtgatggggaaacagcaaagcaaactcaaacacagcacttataaatacgggcctgatgaaattatagaagagagaattcaaactaaagcttttcaagagtatagcccagctcacatggataccgtctctgtcgtggctgctttgaactcagacctttgtgtctctggagggaaagataagacagttgtggcctataattggaaaactggaaatgtggtgaaaaggttcaaaggacatgaacatgagatcaccaaggtagcctgtattcccaaatccagccagttcttcagtgcctctcgtgacaggatggtcatgatgtgggacttgcacggttcctcacaaccaaggcagcaattgtgtggccatgccatggtggtcaccggattggctgtgagtccagactcatcacagctgtgcactggctctcgggacaacaccctgcttctgtgggatgtggtgacaggacagagtgtggaaagagcatctgtctccaggaacgtggtcactcacctgtgctgggtccccagagaaccatacatactacagacctctgaagataaaaccctcagattatgggacagtcgggggctgcaggtagctcatatgtttcctgcaaagcagcacattcagacctactgtgaagtcagtgtggatggacacaagtgtatctcctgcagcaatggctttggaggagaaggctgtgaagccacgttgtgggacctaagacagactcgaaacagaatatgtgagtataaggggcatttccagactgtcgcatcctgcgtctttctaccaagagcattggccttgatgcctttaattgctacctcatcacatgattgcaaggtgaagatttggaaccaagatactggagcctgccttttcaccttgtctctggatggatcaggacccttgacttctctggctgttggtgacgccatctccttattgtgtgcaagttttaacagaggaattcacttactcagaatggaccacagccaagggctggaactgcaggaagtggcagcattctgaggccaagagacactcactggacaatatcaaaccatggctcctcctcagcatggctttgtgtctttcccagttatcttgaggggagtgggatgtagggctggtattctttgcttaggttcatttacaagatgtatcagtgttgtaagtccaataatttaagtccagtgattcaaaatcaggtatagagtccagaaacatggactacacataaggttctctatttaagttaaatacaaatgcaactttttagtgagcttttaggactactcttcaaaaaaagtgtattgctcagaatgatgacctgtaaatgtaagagtggcaggcctctgtctgtgaaagtcagaacacagggctcgagcctctggaactgaccctttgcaagtctttacaaaagaaaaaaggcagtggggagagagagtgttttggttacatcagaaataattgagatgggaaagaatagtgcagctccatagaggagacggactgtagacaatgagattaagcttcaatcactgctcctcagcaatgtgaagaatcaaagtcagggcaagaaagcgaaagcttggacttctattcaaagtggcagcagagtgggagggcggtacccttctagcccagtgctgctgagcttgtgtgaaaatcagacctgagatggcttgaagcagccaagaaccacatgggcattgcccagaattacaggagttagcacaccagctctacagataagaaaacattgaaattcaaagattaaggccaaaaatatctcacttgcaattttaatattttcatttggatttatataaatgaaacatatatatgttttggaatggccagagtgaggcaaaggggatccctgaaatctgaggcgggagaatcgcttgaacccaggaggcggaggttgcggtgagccgagattgtgccattgcactccagcctgggcaacaagagcgaaactccatctcaataaataaataaataagtaaatgccaggaaaggtggtgacaaatggtagccataattatttattgtcctctctgtccagactaaatgttcccttttccatattaaacatttaccattctgcgtgagccactgcgcccggcctccttcatccattcttagatcttatcctctaaacctttagtcatcgtttcactctcctttgattccttgttatgggtctttcaactctggaaagacaaagagatagtgggagaggaagcccggtcactgagcatctacagagggctaaatatatttattctcatttgttattcccaatattctctgtattgtgatttccatttcacagatgaggaagctgagggctagaaacatgcagtactttgcccaaagtcacacacatattaagaagagctgaggtatgaatctgggtctgcctgactcaaagcccaaacgctttcctttgcatcgtgtcacaaagtcatagaccatgacattgtttgtatcttcaagaccagttattaactttctggctccaaggagatcccctgcccaagtgcctaggggcagtagacagctgtctcagggacagtcgtagcatgtgctggattattagtgcagcagctgacactttttcccagaagggagagaggcagcaagtcagaaagttcacgggaatgagttgggagggggtcccagggaagggggacaggctgccaggagaaggaaagtacacgggagaaaatagtggggctctgatgagttagtagggttctgttaccaataaaattgtttccataaactgta

SEQ ID NO: 272564 - DNA, 2879 bp, Homo sapiens
tcccacccccaggctccgcgttcccgccggccccagctccagccccgcagcccaccgtgcaaacatgcttagacagagaagagattaacttcagtggcttcccactaattacagagattaagaagtggctgcctgaactattttccaaaggatacacattacaaattattgaatagggcagctaaccaagaagatcctattggtttggggggaacacaacttccagcagccacaagggatgctgctactcaggtgccaactgaaacaagctcctccacagaaggtttcgtttaggttttgtgtcgtgatggggaaacagcaaagcaaactcaaacacagcacttataaatacgggcctgatgaaattatagaagagagaattcaaactaaagcttttcaagagtatagcccagctcacatggataccgtctctgtcgtggctgctttgaactcagacctttgtgtctctggagggaaagataaggtagcctgtattcccaaatccagccagttcttcagtgcctctcgtgacaggatggtcatgatgtgggacttgcacggttcctcacaaccaaggcagcaattgtgtggccatgccatggtggtcaccggattggctgtgagtccagactcatcacagctgtgcactggctctcgggacaacaccctgcttctgtgggatgtggtgacaggacagagtgtggaaagagcatctgtctccaggaacgtggtcactcacctgtgctgggtccccagagaaccatacatactacagacctctgaagataaaaccctcagattatgggacagtcgggggctgcaggtagctcatatgtttcctgcaaagcagcacattcagacctactgtgaagtcagtgtggatggacacaagtgtatctcctgcagcaatggctttggaggagaaggctgtgaagccacgttgtgggacctaagacagactcgaaacagaatatgtgagtataaggggcatttccagactgtcgcatcctgcgtctttctaccaagagcattggccttgatgcctttaattgctacctcatcacatgattgcaaggtgaagatttggaaccaagatactggagcctgccttttcaccttgtctctggatggatcaggacccttgacttctctggctgttggtgacgccatctccttattgtgtgcaagttttaacagaggaattcacttactcagaatggaccacagccaagggctggaactgcaggaagtggcagcattctgaggccaagagacactcactggacaatatcaaaccatggctcctcctcagcatggctttgtgtctttcccagttatcttgaggggagtgggatgtagggctggtattctttgcttaggttcatttacaagatgtatcagtgttgtaagtccaataatttaagtccagtgattcaaaatcaggtatagagtccagaaacatggactacacataaggttctctatttaagttaaatacaaatgcaactttttagtgagcttttaggactactcttcaaaaaaagtgtattgctcagaatgatgacctgtaaatgtaagagtggcaggcctctgtctgtgaaagtcagaacacagggctcgagcctctggaactgaccctttgcaagtctttacaaaagaaaaaaggcagtggggagagagagtgttttggttacatcagaaataattgagatgggaaagaatagtgcagctccatagaggagacggactgtagacaatgagattaagcttcaatcactgctcctcagcaatgtgaagaatcaaagtcagggcaagaaagcgaaagcttggacttctattcaaagtggcagcagagtgggagggcggtacccttctagcccagtgctgctgagcttgtgtgaaaatcagacctgagatggcttgaagcagccaagaaccacatgggcattgcccagaattacaggagttagcacaccagctctacagataagaaaacattgaaattcaaagattaaggccaaaaatatctcacttgcaattttaatattttcatttggatttatataaatgaaacatatatatgttttggaatggccagagtgaggcaaaggggatccctgaaatcgtgttagccaggatggtctcaatctcctgacctcgtgatccgcccgcctaagtgctgggattacaggcgtgagccactgcgcccggcctccttcatccattcttagatcttatcctctaaacctttagtcatcgtttcactctcctttgattccttgttatgggtctttcaactctggaaagacaaagagatagtgggagaggaagcccggtcactgagcatctacagagggctaaatatatttattctcatttgttattcccaatattctctgtattgtgatttccatttcacagatgaggaagctgagggctagaaacatgcagtactttgcccaaagtcacacacatattaagaagagctgaggtatgaatctgggtctgcctgactcaaagcccaaacgctttcctttgcatcgtgtcacaaagtcatagaccatgacattgtttgtatcttcaagaccagttattaactttctggctccaaggagatcccctgcccaagtgcctaggggcagtagacagctgtctcagggacagtcgtagcatgtgctggattattagtgcagcagctgacactttttcccagaagggagagaggcagcaagtcagaaagttcacgggaatgagttgggagggggtcccagggaagggggacaggctgccaggagaaggaaagtacacgggagaaaatagtggggctctgatgagttagtagggttctgttaccaataaaattgtttccataaactgta

SEQ ID NO: 272565 - DNA, 2919 bp, Homo sapiens
tcccacccccaggctccgcgttcccgccggccccagctccagccccgcagcccaccgtgcaaacatgcttagacagagaagagattaacttcagtggcttcccactaattacagagattaagaagtggctgcctgaactattttccaaaggatacacattacaaattattgaatagggcagctaaccaagaagatcctattggtttggggggaacacaacttccagcagccacaagggatgctgctactcaggtgccaactgaaacaagctcctccacagaaggtttcgtttaggttttgtgtcgtgatggggaaacagcaaagcaaactcaaacacagcacttataaatacgggcctgatgaaattatagaagagagaattcaaactaaagcttttcaagagtatagcccagctcacatggataccgtctctgtcgtggctgctttgaactcagacctttgtgtctctggagggaaagataagacagttgtggcctataattggaaaactggaaatgtggtgaaaaggttcaaaggacatgaacatgagatcaccaaggtagcctgtattcccaaatccagccagttcttcagtgcctctcgtgacaggatggtcatgatgtgggacttgcacggttcctcacaaccaaggcagcaattgtgtggccatgccatggtggtcaccggattggctgtgagtccagactcatcacagctgtgcactggctctcgggacaacaccctgcttctgtgggatgtggtgacaggacagagtgtggaaagagcatctgtctccaggaacgtggtcactcacctgtgctgggtccccagagaaccatacatactacagacctctgaagataaaaccctcagattatgggacagtcgggggctgcaggtagctcatatgtttcctgcaaagcagcacattcagacctactgtgaagtcagtgtggatggacacaagtgtatctcctgcagcaatggctttggaggagaaggctgtgaagccacgttgtgggacctaagacagactcgaaacagaatatgtgagtataaggggcatttccagactgtcgcatcctgcgtctttctaccaagagcattggccttgatgcctttaattgctacctcatcacatgattgcaaggtgaagatttggaaccaagatactggagcctgccttttcaccttgtctctggatggatcaggacccttgacttctctggctgttggtgacgccatctccttattgtgtgcaagttttaacagaggaattcacttactcagaatggaccacagccaagggctggaactgcaggaagtggcagcattctgaggccaagagacactcactggacaatatcaaaccatggctcctcctcagcatggctttgtgtctttcccagttatcttgaggggagtgggatgtagggctggtattctttgcttaggttcatttacaagatgtatcagtgttgtaagtccaataatttaagtccagtgattcaaaatcaggtatagagtccagaaacatggactacacataaggttctctatttaagttaaatacaaatgcaactttttagtgagcttttaggactactcttcaaaaaaagtgtattgctcagaatgatgacctgtaaatgtaagagtggcaggcctctgtctgtgaaagtcagaacacagggctcgagcctctggaactgaccctttgcaagtctttacaaaagaaaaaaggcagtggggagagagagtgttttggttacatcagaaataattgagatgggaaagaatagtgcagctccatagaggagacggactgtagacaatgagattaagcttcaatcactgctcctcagcaatgtgaagaatcaaagtcagggcaagaaagcgaaagcttggacttctattcaaagtggcagcagagtgggagggcggtacccttctagcccagtgctgctgagcttgtgtgaaaatcagacctgagatggcttgaagcagccaagaaccacatgggcattgcccagaattacaggagttagcacaccagctctacagataagaaaacattgaaattcaaagattaaggccaaaaatatctcacttgcaattttaatattttcatttggatttatataaatgaaacatatatatgttttggaatggccagagtgaggcaaaggggatccctgaaataacattagaacatacaggaaaaacgaggcaggcagatcactttaggtcaggagttcaagaccagcctgtacgtgcgtgcctgtagtcccagctactcgggaggctgagatgggagaatcacttgaacctgggaggcagagtttgcagtgagctgagattgtgccactgcactccagtctgtgtgacagaatgagaccttgtcttgaaaaaaaaaaaaacaaaaaaccacatacaggaaaaaagagagggatggagtcaactgtgccccagacattaagcccccttcagtgaggaggggcaaggtgctcaggcctgcctgtgtggcccccaggagtcagacctcagcctcatgctcacaggtccattttcctccagggaaaatggagttctttctgccttcagagatgcccacacataaggcacatgaggctgttggtgacaccatcaccaacactggagattccctttctgacaagtcccagccaaagaaagattttgcatttgtcttctctgtcctctgcttgtctctgataccagtggctgacagccaccttccttcttccctctcttggtgtgatcatggctaactgcagcctcaatcaccagctactcaggaggctgaggcaggagaatcgcttcaaccggggaggcagaggttgcagtgagctgagattgtgccattgcactccagcctaggcaacagagagagactctatctca

SEQ ID NO: 272566 - DNA, 3079 bp, Homo sapiens
tcccacccccaggctccgcgttcccgccggccccagctccagccccgcagcccaccgtgcaaacatgcttagacagagaagagattaacttcagtggcttcccactaattacagagattaagaagtggctgcctgaactattttccaaaggatacacattacaaattattgaatagggcagctaaccaagaagatcctattggtttggggggaacacaacttccagcagccacaagggatgctgctactcaggtgccaactgaaacaagctcctccacagaaggtttcgtttaggttttgtgtcgtgatggggaaacagcaaagcaaactcaaacacagcacttataaatacgggcctgatgaaattatagaagagagaattcaaactaaagcttttcaagagtatagcccagctcacatggataccgtctctgtcgtggctgctttgaactcagacctttgtgtctctggagggaaagataagacagttgtggcctataattggaaaactggaaatgtggtgaaaaggttcaaaggacatgaacatgagatcaccaaggtagcctgtattcccaaatccagccagttcttcagtgcctctcgtgacaggatggtcatgatgtgggacttgcacggttcctcacaaccaaggcagcaattgtgtggccatgccatggtggtcaccggattggctgtgagtccagactcatcacagctgtgcactggctctcgggacaacaccctgcttctgtgggatgtggtgacaggacagagtgtggaaagagcatctgtctccaggaacgtggtcactcacctgtgctgggtccccagagaaccatacatactacagacctctgaagataaaaccctcagattatgggacagtcgggggctgcaggtagctcatatgtttcctgcaaagcagcacattcagacctactgtgaagtcagtgtggatggacacaagtgtatctcctgcagcaatggctttggaggagaaggctgtgaagccacgttgtgggacctaagacagactcgaaacagaatatgtgagtataaggggcatttccagactgtcgcatcctgcgtctttctaccaagagcattggccttgatgcctttaattgctacctcatcacatgattgcaaggtgaagatttggaaccaagatactggagcctgccttttcaccttgtctctggatggatcaggacccttgacttctctggctgttggtgacgccatctccttattgtgtgcaagttttaacagaggaattcacttactcagaatggaccacagccaagggctggaactgcaggaagtggcagcattctgaggccaagagacactcactggacaatatcaaaccatggctcctcctcagcatggctttgtgtctttcccagttatcttgaggggagtgggatgtagggctggtattctttgcttaggttcatttacaagatgtatcagtgttgtaagtccaataatttaagtccagtgattcaaaatcaggtatagagtccagaaacatggactacacataaggttctctatttaagttaaatacaaatgcaactttttagtgagcttttaggactactcttcaaaaaaagtgtattgctcagaatgatgacctgtaaatgtaagagtggcaggcctctgtctgtgaaagtcagaacacagggctcgagcctctggaactgaccctttgcaagtctttacaaaagaaaaaaggcagtggggagagagagtgttttggttacatcagaaataattgagatgggaaagaatagtgcagctccatagaggagacggactgtagacaatgagattaagcttcaatcactgctcctcagcaatgtgaagaatcaaagtcagggcaagaaagcgaaagcttggacttctattcaaagtggcagcagagtgggagggcggtacccttctagcccagtgctgctgagcttgtgtgaaaatcagacctgagatggcttgaagcagccaagaaccacatgggcattgcccagaattacaggagttagcacaccagctctacagataagaaaacattgaaattcaaagattaaggccaaaaatatctcacttgcaattttaatattttcatttggatttatataaatgaaacatatatatgttttggaatggccagagtgaggcaaaggggatccctgaaatcgtgttagccaggatggtctcaatctcctgacctcgtgatccgcccgcctaagtgctgggattacaggcgtgagccactgcgcccggcctccttcatccattcttagatcttatcctctaaacctttagtcatcgtttcactctcctttgattccttgttatgggtctttcaactctggaaagacaaagagatagtgggagaggaagcccggtcactgagcatctacagagggctaaatatatttattctcatttgttattcccaatattctctgtattgtgatttccatttcacagatgaggaagctgagggctagaaacatgcagtactttgcccaaagtcacacacatattaagaagagctgaggtatgaatctgggtctgcctgactcaaagcccaaacgctttcctttgcatcgtgtcacaaagtcatagaccatgacattgtttgtatcttcaagaccagttattaactttctggctccaaggagatcccctgcccaagtgcctaggggcagtagacagctgtctcagggacagtcgtagcatgtgctggattattagtgcagcagctgacactttttcccagaagggagagaggcagcaagtcagaaagttcacgggaatgagttgggagggggtcccagggaagggggacaggctgccaggagaaggaaagtacacgggagaaaatagtggggctctgatgagttagtagggttctgttaccaataaaattgtttccataaactgtacatgtgcttgatgtcaaattatctatgcattttaagtagaaaatagattagtaaattctagtgtttgtagaggactttttttagtctgatatgccctaatcagatactctcagcacctaagatac

SEQ ID NO: 272567 - DNA, 545 bp, Homo sapiens
ttcccgccggccccagctccagccccgcagcccaccggtgggtactgagcctgaggtgggagaaaggggcatagcggcagactaggagcgggcaaccctcgccctttggtcgaagcggagagcggttatgagggccaaccttgggctgggtggcgctaggttcccatcttcggggactcttctccccgctttccacatacacataaaaaataagctttaggccgggcgcggtggctcacgcctggaatcctagcactgtgggaggccgaggcgggtggattgcctgagctcaggagttcgagaccatcctgggcaacacagtgaaaccctgtctctactaaaatacaaaaaattagccgggagtggtgccgtgcgcctgtagctacttgggaagctgaagcaggagaactgctagaacccgggaggcggaggttgcagtgagccgagatcgcgccactgcactccagcctgggtgacagagcgagactcgagactccgtctcttgaaaacaaaaacaaaaacaaattaagctttagttgttcata

SEQ ID NO: 272568 - DNA, 2954 bp, Homo sapiens
tcccacccccaggctccgcgttcccgccggccccagctccagccccgcagcccaccgtgcaaacatgcttagacagagaagagattaacttcagtggcttcccactaattacagagattaagaagtggctgcctgaactattttccaaaggatacacattacaaattattgaatagggcagctaaccaagaagatcctattggtttggggggaacacaacttccagcagccacaagggatgctgctactcaggtgccaactgaaacaagctcctccacagaaggtttcgtttaggttttgtgtcgtgatggggaaacagcaaagcaaactcaaacacagcacttataaatacgggcctgatgaaattatagaagagagaattcaaactaaagcttttcaagagtatagcccagctcacatggataccgtctctgtcgtggctgctttgaactcagacctttgtgtctctggagggaaagataagacagttgtggcctataattggaaaactggaaatgtggtgaaaaggttcaaaggacatgaacatgagatcaccaaggtagcctgtattcccaaatccagccagttcttcagtgcctctcgtgacaggatggtcatgatgtgggacttgcacggttcctcacaaccaaggcagcaattgtgtggccatgccatggtggtcaccggattggctgtgagtccagactcatcacagctgtgcactggctctcgggacaacaccctgcttctgtgggatgtggtgacaggacagagtgtggaaagagcatctgtctccaggaacgtggtcactcacctgtgctgggtccccagagaaccatacatactacagacctctgaagataaaaccctcagattatgggacagtcgggggctgcaggtagctcatatgtttcctgcaaagcagcacattcagacctactgtgaagtcagtgtggatggacacaagtgtatctcctgcagcaatggctttggaggagaaggctgtgaagccacgttgtgggacctaagacagactcgaaacagaatatgtgagtataaggggcatttccagactgtcgcatcctgcgtctttctaccaagagcattggccttgatgcctttaattgctacctcatcacatgattgcaaggtgaagatttggaaccaagatactggagcctgccttttcaccttgtctctggatggatcaggacccttgacttctctggctgttggtgacgccatctccttattgtgtgcaagttttaacagaggaattcacttactcagaatggaccacagccaagggctggaactgcaggaagtggcagcattctgaggccaagagacactcactggacaatatcaaaccatggctcctcctcagcatggctttgtgtctttcccagttatcttgaggggagtgggatgtagggctggtattctttgcttaggttcatttacaagatgtatcagtgttgtaagtccaataatttaagtccagtgattcaaaatcaggtatagagtccagaaacatggactacacataaggttctctatttaagttaaatacaaatgcaactttttagtgagcttttaggactactcttcaaaaaaagtgtattgctcagaatgatgacctgtaaatgtaagagtggcaggcctctgtctgtgaaagtcagaacacagggctcgagcctctggaactgaccctttgcaagtctttacaaaagaaaaaaggcagtggggagagagagtgttttggttacatcagaaataattgagatgggaaagaatagtgcagctccatagaggagacggactgtagacaatgagattaagcttcaatcactgctcctcagcaatgtgaagaatcaaagtcagggcaagaaagcgaaagcttggacttctattcaaagtggcagcagagtgggagggcggtacccttctagcccagtgctgctgagcttgtgtgaaaatcagacctgagatggcttgaagcagccaagaaccacatgggcattgcccagaattacaggagttagcacaccagctctacagataagaaaacattgaaattcaaagattaaggccaaaaatatctcacttgcaattttaatattttcatttggatttatataaatgaaacatatatatgttttggaatggccagagtgaggcaaaggggatccctgaaatcgtgttagccaggatggtctcaatctcctgacctcgtgatccgcccgcctaagtgctgggattacaggcgtgagccactgcgcccggcctccttcatccattcttagatcttatcctctaaacctttagtcatcgtttcactctcctttgattccttgttatgggtctttcaactctggaaagacaaagagatagtgggagaggaagcccggtcactgagcatctacagagggctaaatatatttattctcatttgttattcccaatattctctgtattgtgatttccatttcacagatgaggaagctgagggctagaaacatgcagtactttgcccaaagtcacacacatattaagaagagctgaggtatgaatctgggtctgcctgactcaaagcccaaacgctttcctttgcatcgtgtcacaaagtcatagaccatgacattgtttgtatcttcaagaccagttattaactttctggctccaaggagatcccctgcccaagtgcctaggggcagtagacagctgtctcagggacagtcgtagcatgtgctggattattagtgcagcagctgacactttttcccagaagggagagaggcagcaagtcagaaagttcacgggaatgagttgggagggggtcccagggaagggggacaggctgccaggagaaggaaagtacacgggagaaaatagtggggctctgatgagttagtagggttctgttaccaataaaattgtttccataaactgta

SEQ ID NO: 272569 - DNA, 436 bp, Homo sapiens
tgaagaatcaagatagtgggtataacttgagtgccaaacttctctcttagacaaccagtagtcacatgctctctatctttggtcctactgatgttaattttaaacacctcccattccataatgcttgtaaggtttttctccacagcaaatattctgtgaaatctattattttatagagtcatgtgtcaatgagaggaatacgttctgagaaatgcatcattaggtgattttgtcattgtgcaaacatcatacagtggacttacacgaacctagatgctgtagcctactacacacctcgcctataaagtctgttgttcctaggctacaaacctgtacagcatgttactgtcctgaatactgtaggcagctggaacacaatggtagctgtgtatctaaactatctaaatgtagaaaaggtgctataaaaatatggtat

SEQ ID NO: 272570 - DNA, 539 bp, Homo sapiens
  misc_feature (349)..(349): n is a, c, g, or t
tttatgtttcatatatgtaataaaaaactgaaaaacaaaaaaagcagtccaggacggtccttgcttccctgctggctcggactgagccgcagcacctgaagtgcacaaacccttttcatctgaaccgcagccaggcgggcccccccttctagatgtattgatttcttttttgacactaactataggattaatacaaaaatttgtcttgctcctttgctaagccattttcacctgccacaaccattcagaaccctgacactgccatctattttattctctgtccttccagcttggtgtcatctagaaatgacctccaatatcttcacctcgtgccgaattcggagagggncgactccacaacatcattcactcacagcctgatgacaagagaggcaggcgtgaaatccgagtccttcatcttttggaacagatacgcgcttactgtgaaacctgttgggagtggcaggaagctcatgaaccaggcatggaccaggacaaaaatccaatgccagctcctgttgaacatcagatctgtcctg

SEQ ID NO: 272571 - DNA, 302 bp, Homo sapiens
agccgagatcataccactgcactccagcctggaaaaaaaaagaattgacatttccatctttgtaaaaaatagttgaaggccgagtgcagtggctcatgcctgtaatcccagcactctgggagaccaaggtgggacgattgcttgaggccaggtgtttaagaccagcctaggcaacgtagagagattgcatctctacaaaaaaaaaatttttttgaattagccaggcgtggtggcacatgcctgtagaggaagctgagacaggaggattgcttaaggccaggtgttcaaggttacagtgagca

SEQ ID NO: 272572 - DNA, 285 bp, Homo sapiens
ttcagaaccatgtcagaagaagagaaagagaagttcatacccctgggacccagaggcagagagcttgcctaagactgccaaccagataaaaaagtattctcacctaccccccagcatcaggctaactgctgtcaagatacatattatttgcaagagatattgcaagagacatgctgtttctgaggcatagcacaaaaggaaaacttaaggttgaggatgaaatcatcatcagagaaacatcctctgcaagccaacccctaccctcaacacaaggtatcaccagag

SEQ ID NO: 272573 - DNA, 1039 bp, Homo sapiens
actggaggacctaaaccaagtatgacgatatgttagtgaagattttgctggttgaggcatagtacattttaacttatatttcaggaattgttctcaagcaggaacactcttttacatatttatttcaggcttgtcactctcataaacgaggcagcaaacccaaaatattggctcttcttataaataggcgcctttatataaagaacataaaactctataagactaatttcacaccaacacaggcagcttcataataagtaaccacctctccctccccactaaaaaagataaaaacaaagtataattagtctttcttattagatttttgtctttgatgatattacgtatttatgtgtagggtagtaatcacaatttatccttcatcttcattgtagttgaatcaaataaaagtattctttattcaaataatgtgaagttgggtgtctcaaaccttcatttaatgaattgatgaaaggtttaagacaaaattcacgttggagggaaattaagttacatacaaaaacactggttttaactgtgggacaatatttggattagaaaaccatctctagatataacctacttatatttatttttaaatggtattttattttttaaaataacaaaacccaatgttgtcttatttccactttgattgtaaaatgacattcaatgcttaataccaaaatatatatatatatacacatttgaaattatcaacggtcctttttttttggtttatattgaaaatattgtgaagggaaaaagacaagcttcaagttataatgttaatttgaaggtaaccggcctttcaagaattaatttcagccaaagcaataatcattatttaccagcgtgtgacatttttatcactcatcatattagcaaatttccattgaaaatgctaaaatggttcgtcataaggcagataactgctcgagctgtaaaaatgaccaacacaagtgccggtactcaaacattaaattatactgtaattaataaagacagttaaactgtctactagcaacagcaatttagg

SEQ ID NO: 272574 - DNA, 790 bp, Homo sapiens
gcagcagagaagggaccaacccaggctcttatgcctcatgccctctgcccactgttcattgccctgatcagccaaaccccacaggagccctcgatgtgccactgtgggtgagtcttgtggccacagggctacagaggtgaccacacagcacccatcattgcagggattgtaggacaaggtgcatccacatgtctcagaacaacgcaaccatcgccacctggtgagggccaggggcagcgtgtggcctcaggggtctgcacctctgggtgtgggatctgcctttttttcatttttattttattttttgtagagatgggggtctcactgtattccccaggctggtctcgaactcctggatgccaatgatcctcccaccttggcctcccaaaatgctgggattataggcgtgaaccactgtacccagctccgcttaaaaaaaaaacaaaaaaacagattggttgttttagagcagttttaggtttataaaaataccgagcagatagtgcagagagttcccatgtacccctcccacgcccaggttctcacattatttatattttgcattcgtgtggtgtgttggttgcacctgactcaactctacgttggtactgttactaacagccatagtttccattagggttcttggtgttgcacattctttgagtttggacaaaagtataatgaatgtgtctgccgttggagtgtcacagagtggtgtcactgccctaaaattcctccatgctccccctgttcatccctccatgacctttggcagccacagctcttctca

SEQ ID NO: 272575 - DNA, 339 bp, Homo sapiens
aagccatgattcaaaaccaggcattcttagtgcccagcatggggtcaacactgacctgcttggctttggtacctctttaattgcattcgtactaagcactcagtcagtcataaccattctcttctcccttgtggtaattaatggtggtggtggtggagaatctacgggattaggcttcagttaattcttttttttttttttttggagacggagtcttgccctgtcgcccaggctggagggcaatagcatgatctcaggaggcaaaggttgtggtgagcggagatccaccactgcactccagcctgggtgatagaacgagactcgacctcaaaaaaaaaa

SEQ ID NO: 272576 - DNA, 448 bp, Homo sapiens
gcagctgagaggcgaggcgaggccaggcccgggtgggattgggcggagcctgcgcttccctccgcctcgctcccagctcgtctcgttttggaggctagacctgccgtggagactggaagaactcagctatctggaaatagattgtgtcccggcagagggaaagtttgttgatgattagatccaggaaaattcctgctattaaaattaattttaaatcggctgtaggggcgctcgcatgtggtcctagctacccggatgctgaggtgggaggatcgcttgagcccatgaggtggaggctgcagtgagccgaggtcgtgcgctgcactcccgcctgggcatgagagagaaaccttgcgcctaataaatacataatcataaataacaaattggaaataaataattaaaataaataaatataaatgaataataaacactagtttccggaatt

SEQ ID NO: 272577 - DNA, 666 bp, Homo sapiens
ccactgttgtatatgcagtccatcattgaccaaaacatggtttgtgccaaatgatagtatttccaaacgttgatgcattttgatctgtagccacctcagttattcaaaccttagctgtacctgttttccggaggtaagtatcaccatccaggtgattaggtaacctatactttgctgaattgacatctccatatggtggcacactgcttaagaatgtagactgtattgttagaactgagttggagtctggttcttttgttgtatttgggcatcatctataaagtagcaataataatttacctactctagcagatgaatagagtaatacatgtaaagtgcttagcatatcgcctcccacatagtaagcattctgtgtatgatgattcattattaccatcacaaattcgtttattctctcttatatgagaaaacctccaaaactgtaatgctttaccatactccccattctagagaaagttagagaatctgtctggcctcgcagtagttatagggaggcagcatagagaatctagaaactttctgctgcttttaaagtcaggggtcagggttctaccatatggtggtttcatattttaatttaaagtaggtgtgtgtgtttgtagagacaacgtctcactctgttgcccaggctagattgcagtggcc

SEQ ID NO: 272578 - DNA, 414 bp, Homo sapiens
ttctgtgagctctcagagctctccagaccagaaataggatgatgatgactaaaggggaaatcaaagcatatctgaggatttcttaaggcattcttaattgtattaataagtaacttattagagatgattaagaaaaagttgtgggtggatgcagtggctcacacctataatcccagcactttgggaggatcacttgaggccaggaatttaagaccagcctgggcaacatagtgagacccagtctctaaagaaatacaaaaattagccaggcgtggtggcatgcacctgtagtcccagctacttgggaggctgaggtgggaggatggcttgagcccaggagttggaggctgcagtgagctatgattgtgccactgcacttccagcctgggcaacagagtgagaccctgtctcaca

SEQ ID NO: 272579 - DNA, 295 bp, Homo sapiens
tgcaggagcgccaggactcaggcctgggtcctcctcacctctccacgctcacttcctcggagatctcatcatttttgcggtctcatcacatccagcaccacccgtatgtcggcagctcccagtttcctccagcccggtcctctctcccagtccttggacgcatctatccaatcacctatttggcatttccacctgggtcttcagtggacagctcaaacatggtcggtccaaaatgagctcctgctcttttgcctcaaaccccatcctccgcccagtcttctccctccttccagct

SEQ ID NO: 272580 - DNA, 310 bp, Homo sapiens
gtgggacgcatctctactcccaactactcaggaggctgaggcgggaggattgctggagcctggaaggttggggctgcacggagccctgatcctgccactgcactccagtctgggcgacagagtgagaccctgcctcaaaaataatcataaatactgagtttggggaggttcattatgattgacgcacttgagttactgatttgggtcgagggttcagtgaagctttggtttacatcttgtgcagctaaccacgttgagcacagagcatgagacttcatcatgaggaggtaggattaaggattaggcttct

SEQ ID NO: 272581 - DNA, 434 bp, Homo sapiens
cactaaatgtccaatatgctgcacataagtaccccaaagttagcacagaattgttccatggctgtcatatatgttaaaaatcattaaaagttcattttttctctcattatgggaaggatacatgctcctactagtaaatttagtaggtagaaaaaaattatcactatctagactgctttccatttagtctttatgcatagctttctgtctgcctatttttaccttgtgtttgtaacttactattataaaatatgcgtctctgtgcattgtcaacattatttacaataacatggagtggattgacacgtattctctatatttggattaaaggagatagagtatgtgaaattaaatgggagaagtatctgatacataacaggcaatacaaatattatcacatagcgtcaacttatttgtgaatattgaaagctcca

SEQ ID NO: 272582 - DNA, 834 bp, Homo sapiens
ccctggaggcagttgcttccctgaggagggtccggctgcggccagggtgttgggaaaacaacattagcccgttacataacacaggcatggaaatgtattcgtgttgaagctttgccaattttagaagaacagattgctgctgaaaccgaatcaggagttatgttgcaatcaatgttgatcagcggtcaaagcattccagatgaacttgtcataaagctaatgttggagaagctcaactccccagaagtctgtcactttggttatattatcactgaaataccatcactttcacaggatgccatgactaccttacagcaaatagaattaattaaaaacttaaacctgaaacctgatgttataatcaatataaagtgtcctgactatgatttgtgccagagaatttctgggcaaagacagcacaataatacgggatacatatacagtagagaccagtgggatcctgaagtcattgagaatcataggaaaaagaagaaagaagcccaaaaggacggaaaaggagaagaggaagaagaggaagaagagcaagaagaagaagaggcatttattgccgaaatgcagatggtggctgaaattcttcatcatctagttcagaggcctgaagattatttggaaaatgttgaaaacattgttaagctttataaggaaacaattctccaaactttagaagaagtaatggctgaacacaatccccagtatctcattgagctaaatggaaataaaccagcagaggagctctttatgatcgtatggatcgattaaatatctgaactaaaaagaggaggtatttaaacaaattcaggtgcaaaggagacc

SEQ ID NO: 272583 - DNA, 1011 bp, Homo sapiens
ccctggaggcagttgcttccctgaggagggtccggctgcggccagtattttgtgtcatgacttctcaagagaagacagaagagtatccttttgcagatatatttgatgaagatgaaactgaaaggaattttttgttgtccaaacctgtttgctttgttgtatttgggaaaccaggtgttgggaaaacaacattagcccgttacataacacaggcatggaaatgtattcgtgttgaagctttgccaattttagaagaacagattgctgctgaaaccgaatcaggagttatgttgcaatcaatgttgatcagcggtcaaagcattccagatgaacttgtcataaagctaatgttggagaagctcaactccccagaagtctgtcactttggttatattatcactgaaataccatcactttcacaggatgccatgactaccttacagcaaatagaattaattaaaaacttaaacctgaaacctgatgttataatcaatataaagtgtcctgactatgatttgtgccagagaatttctgggcaaagacagcacaataatacgggatacatatacagtagagaccagtgggatcctgaagtcattgagaatcataggaaaaagaagaaagaagcccaaaaggacggaaaaggagaagaggaagaagaggaagaagagcaagaagaagaagaggcatttattgccgaaatgcagatggtggctgaaattcttcatcatctagttcagaggcctgaagattatttggaaaatgttgaaaacattgttaagctttataaggaaacaattctccaaactttagaagaagtaatggctgaacacaatccccagtatctcattgagctaaatggaaataaaccagcagaggagctctttatggtgagtgcagtgttaagcaggaatacttcacagcatggaaaatttaaatctattgacagtattgtacttcttttaataaacagaagcatatttatatttgaacaccattatctttgaacaa

SEQ ID NO: 272584 - DNA, 1040 bp, Homo sapiens
atcatagagaggtcgggtagaggctcccgggacctgcgtgctgccgagagaggaagcgaagggcaccatctttgtattttgtgtcatgacttctcaagagaagacagaagagtatccttttgcagatatatttgatgaagatgaaactgaaaggaattttttgttgtccaaacctgtttgctttgttgtatttgggaaaccaggtgttgggaaaacaacattagcccgttacataacacaggcatggaaatgtattcgtgttgaagctttgccaattttagaagaacagattgctgctgaaaccgaatcaggagttatgttgcaatcaatgttgatcagcggtcaaagcattccagatgaacttgtcataaagctaatgttggagaagctcaactccccagaagtctgtcactttggttatattatcactgaaataccatcactttcacaggatgccatgactaccttacagcaaatagaattaattaaaaacttaaacctgaaacctgatgttataatcaatataaagtgtcctgactatgatttgtgccagagaatttctgggcaaagacagcacaataatacgggatacatatacagtagagaccagtgggatcctgaagtcattgagaatcataggaaaaagaagaaagaagcccaaaaggacggaaaaggagaagaggaagaagaggaagaagagcaagaagaagaagaggcatttattgccgaaatgcagatggtggctgaaattcttcatcatctagttcagaggcctgaagattatttggaaaatgttgaaaacattgttaagctttataaggaaacaattctccaaactttagaagaagtaatggctgaacacaatccccagtatctcattgagctaaatggaaataaaccagcagaggagctctttatggtgagtgcagtgttaagcaggaatacttcacagcatggaaaatttaaatctattgacagtattgtacttcttttaataaacagaagcatatttatatttgaacaccattatctttgaacaa

SEQ ID NO: 272585 - DNA, 373 bp, Homo sapiens
ctggagccctgccctcaacccccaagcctggagcagttccggcccaacccagctctccaggtgctccatccagaaccctgaccaggtgctgcaggccatcttgggagttctggcctacccagaagggccggggtgttcactcttggactcatgaagtgactcggagcattaattttggaggccacataaacacgaatttaaatcctagctccactatttacctcctgtgtggccttgggcaagttatataacctctctgaacctgttagctcatctgtaaaaaggagaaaatagaataattttcctctttgagtaattgggaagatttagcaagacaacatgtttgataaactctgcctcaccacctccgaaa

SEQ ID NO: 272586 - DNA, 516 bp, Homo sapiens
ttttcttttttttaacttttttttttaccttttagtgtaaaactgaacatagaaaataaattcatgaagaagggatattttctgagggtgtccagggctgcccaacacctcttgtctaccttctctgtcatagccccatttaaaacactctctctggatgaatacaccaaacctcacagtctttgctctcttgctaggaagaggagcaagagcgtgtttcactcttggctcctgcttacacacctgccgtccaatggaaactactacttaagacatttaaaaatagttgtggtgatagcatgttgtgttttggttggtgatgccagttagtctctgaaaactttctgtgatgagtgtaaaattctacaccttaatctcctttcttgtaggatctgggaagcagtatgcacttgattgcaccaaagattttacgttcatagaaaatttctggcatctgtgtgaagaaagtaaactatatcttccatttaaacaaataaaatatctttttgataaaag

SEQ ID NO: 272587 - DNA, 350 bp, Homo sapiens
aactccagggccattgttttcctgttctccccgctccaaggcctctcctctctccttggcccaactctctgacagtgatgcagttctgaaggccagacgtccaaaatcagaatggcatttgcttgaaggatccaggggagaatccctccttgcttcttccagcttctggtggctcatggcaataccttgacttgtagacatatccctccaatctctacttatgccttcatatcaccttctcttctcttatgagaacagttgtcattggatttaggacccaccctaatcgaagatgatctcacatgtagtttaattacatctataaaatatgcttttcagtaaggtcactt

SEQ ID NO: 272588 - DNA, 405 bp, Homo sapiens
tcaaacggcaagaaagaaagtgtgatgtgtctgtgaatctgctgaatgggccgaggggtgtttttaaaagatcatattgcggggaagaagcaggcactgcagaaacctatggattggggtgctaaaacctacgagcttcccaggaagctgccttttgggagcccgaactatcccagaactttttcctagtagcagatcacaatcaccgtctcttctgtgagcccgcttcaagccagcaatgaaaggacacttctgcacgccagcagtaagagtaggaaaccccactctccctacaacataagggctacacatttgagatcctctcagaggactttttaaaaaaataacatctttcatttatgcttgagcagggagaagagtcattaaaaagaagagatttttaaa

SEQ ID NO: 272589 - DNA, 509 bp, Homo sapiens
gattatgtgatagttctatttttaattttttttaggaacttctatactgttctccatagtggctatattaatttatattcccaccaacagtgttcagagattcctctttgttcccatccttgctagttattgcctgtcttttttgatataagccattttaactagggcaagatgatatttcattgtagttttctctgattagtgatgatcattttttcatatgcctgtttgtcatttgcacgtcttcttttgagaaatgtctattcagatctctggtgcattttacaatagaattttttttttttttttgctattgatttgttgaagcttcttatatattctaattattaattcctgtcagatggatactttgcaaatatttctcccattctgtggtttgttcattttgttgattgtttcctgtgcagttttttagcttgctgtaatcccatttgtctatttttgttgcttttattgcctgtggttttgaggtcttacacaaaaaaatc

SEQ ID NO: 272590 - DNA, 509 bp, Homo sapiens
ctatatattatataatagtgttttatcaatgtgaaatatcctgagtgataattttattgtgatatgtaggggaaaacatttgttcttaggaaacacatgctaaatactaaagaaaatatgaagtttatgatgccagcaatcaactatcaaatggttcagtaaactaaacaataatctagtgttctctgttattattcttgcaatttttcctaagtttgaaaattttcaaaataatacatttgaggaaaagttaacaaggaaacagtctgctcttgtaacagctcactctctcctaaagacaagctaaccggaagccatatccccagccgtgatgtgaggagcacagattcagcaaggaaagttagagatgactcctaagtgtaatggcaccagactgataaagataagtcatgttcctgaaccaggataatctctctttacccactaaatgtaacgacatgatccttctgagttgtaataaatcctatattcataaattagcctaaaaa

SEQ ID NO: 272591 - DNA, 425 bp, Homo sapiens
aagattcaatagaggttcaaaaactttgcacaggtcacaatataaatggttaattttcaaagaaagaatctgaatggagtgtctatattgtgtttatgtggagaagatgtattcccatctttgccaatgcttattttaaaaattcattttaatccaagagaaaataaggtgtgaaaaacaaggaacatgtgaaagaggaccaatgactgtttccccaattattttttagaagtctcagaatcatggagactcaaaatcacttcttacaatctggtaaccaaatttcatatcttggcagttggatgcggtaagagccacagagaaaccacctgatttttgtttcagaaccatattgtatttgcttaaacgtgttttaaaagcctccaaataaataaattgtcagtccaaaccattagcagacagat

SEQ ID NO: 272592 - DNA, 447 bp, Homo sapiens
atcctctaaaacatgcaacaggtactttcattactttacacaatttctttgcaccaaaaacactgccacagggcactcaaatgttgacagaaactattagccccagacaataaatagcctctgccttatttaacattaggtgctaatgaggccaaggttctatcttgatgatgacatttaactttacctttagctcccaattgatctcaaatacaaatactatttcttacaagaagaaattagggctaggatagtatctgtttttactgcatctactgttcctcctgtaaccttcacttcgcaaaagtgtgatttattttttaagggagcataccaaaaataaggtagaaccttggaaatctctcaaattttgacagtactgcataaataccgattttaatatggataaagacatagagaaagatgtgcagttctcaataaaaaaaa

SEQ ID NO: 272593 - DNA, 383 bp, Homo sapiens
gagccagcaaggtttggctggttagattctccagctcagtggcacaatgcccggggttggagccttctgatgtcattctcgtggctgcagtggagtttggtgcagggtggcaagcagttagcataagtggcaactcctaaacttataatagtgttaccttgggctgccttagttcttgctgttctttagccttctcatcaattctgtgaattatcagtatccttccaatgaattgcttttctgttatttgcaatctgaaccctgttttgtacaaaaggaaaatgaggacatccctttttaagaaacacttgggatgttcaagaatcttattttcctggtagtttaagaactcctttgatagagtgagtgctttgtttgacaaa

SEQ ID NO: 272594 - DNA, 361 bp, Homo sapiens
gtaaccacaaagcaaaaacctatagtagatatacaaaagatgaagagaaaggaatccaggcatataattacagaaaatcaccaaatcacaaaggaagacagcaagagaggaagaaaggaacaaaggatctgcattaaaaacaaaacgaaaacagaaaacagtgaacacaaaggcaataataaacctttacctatcaacaattgcctcggatataaatggattaaattatccaatttaaaaacatatatagtcagtgaatggattttttttaagacccagctagctgtatgtgccctgtgagagactcacttccagtataaggacacacacagactaaaagtgaaggaataaaatatggtat

SEQ ID NO: 272595 - DNA, 485 bp, Homo sapiens
catggtttgtgggtaggggttgtgcattcactactgcttctcttggctgtaggtgaaggtttctttggctctgtgctgatactgggtgcaccatcacccaccccctttgtttcttctcctgggtcaagtcatttgcctaatcagtcccaatgtaggaacctggatacttcagttcaaggtgctgaattcaccgtgcttttcattcaggggaagacagctgcttctcattgggcatcttggcctgcccacttcacgtcactttttgtaaaatccacaccactccaggaatatccattacttaacttcgcctgaaataaacagaaggctcattacacttatcatgggctcacttacttcgcctataatgaaggtgccatggaaatgctagtggatgacgtggtccattttcttagggatgagatagaaaaatggtgtatggctttttaatttaattaaaatttttagtttggtttaaatttacattg

SEQ ID NO: 272596 - DNA, 459 bp, Homo sapiens
ctctatcaaataatgtttgctgatgtttaacatgggaatacatccacttcctccatcctgtcgataatgataatgcacaggtggttgtttcttacttgttttgtaaccccttataaagctaccgtgtcattcctcagcattctcttttaactaaatcgtttcatttccttcttgtttgttttactttttggcacagaacaatccagcactttaattttgttaaattttcgttgagaaactttaaaataattcctttttgttaccatcttagagatgtggcttttcatctaacaagcagttactgggtgtctcctgtgtgccagccctaggaatattaaggcgattgaaacacaagtcctgggagctcacagtctcatgaggaggccaaatctagcccatttcctgatgtggaacatgataggtatatttgctttttttttgagagagagagaggaaaaa

SEQ ID NO: 272597 - DNA, 764 bp, Homo sapiens
ggacctgacgtccatcagaccacgggataggactaagggcaagtaaaacagaagaagatggtgtatacaaatgtgatagtgaaggctgtgaccgtatatatgcaacccggtcgaatctcctccgacacatttttaataagcataatgacaaacataaggctcatttgattcgtccaagaaggttaacaccaggccaggaaaatatgtcaagcaaggcaaaccaagaaaaatcaaagtctaaacatcgggggacgaagcacagcagatgtggaaaggaaggaataaaaatgcccaagaccaaacgaaagaaaaaaaataatttagaaaacaagaatgcaaagatggtgcagatggaagaaaataagccttattctctgatgggagcaagatgcgttcgtcccatcagcagggatgccatgataaagagacaggctggggccatagtgccacagggggcacaattcacaggaaggcctcaattccctggtcagagttttcattaagcccaggttcttgtgtggagcctttccctggcctagaaacaactaaaaggtcaggattaagttccagtgcccacttattcttccccatcctggaaaacaacgacagagcagcaatatatttctggagcaacattaagttctggtgctcactgtaagtcttccccagagcaggaaataacaacaggacaatgaatcacttccactgcagtgttttagttctggtgctcattataggtcctcccctgatgggacgaagactgg

SEQ ID NO: 272598 - DNA, 581 bp, Homo sapiens
ggccaacatggtgaaaccccctctctactgaaaatataaaaattagccgggcgtggtagtgcatgcctgtaatcccaactgctagggaggctgaggcaggataattgccaggggatggaggtggcaatgagccacagttggcgccactgcaccactgcactccagcctgggcgacagagcaagactccatctcaaaaatcaattagtcaatcagtcaataaaatagcttctctaactttacttttatcccaagggtagaaatttttcgccagagttggggtcagaattccctagcgtgaacactaaatggttaataaagttagtaaatttttcttatgttcttagtcttacttcctctgttactaagtcaagacttcgtgatgtaaatgatattccctgttatgttttccaaaagacatcatattctaattgtaacattaatatattttgtaaatttttttctttaaaaaaaaaagaaaaactcctaaggagtcataaaattctggtaagtcaaatgttgcctcaaggctactggttggttacccttgctaattgctttctttccaaatcttattattaaa

SEQ ID NO: 272599 - DNA, 296 bp, Homo sapiens
ggatgatggatgctttcaagtggggtccccatgagcctctggtgacctcacttcctcagtgacctcttctgatgttccccaaagcccggtagaaaggaagaaatcacatggaatcctgctggctggacctttgaaatataccgaggactcagctccttcctccaggtccaggctgccgtcctgggattcgcataactatttttcctgcatgcagcactccagcagctgctttatggtccccgggatcctgatcttacttcctctaaagtctgttctcctcccaggagcccagtcat

SEQ ID NO: 272600 - DNA, 469 bp, Homo sapiens
ctcttatttaataggcttataatttcttcaataacatttctatgattttaaaaacacagactatgattcttcgtgacactatgtagggactctggatgaatcacccagcattctcaaggacatatattttagtcacattgcatttatatgatgctttatggattttaaatacatttatgcatatgatctcagctaatcctcacaataaccctgagatgtagataaaatcgtacaagcactttgccagcttaaggagccagtttgcctcaatgatctcaaaaccattctttgctgtcaagttcactgtggcatctttggggacaatcccatggctaccatagtccttggtaattcaggtggcgctaaatttttcttatcaccttgcctattttcattgtttcaaatgcctacttttaaccacacattcaagtttttaatcaaaaatataatttaatctaatttaaagtta

SEQ ID NO: 272601 - DNA, 526 bp, Homo sapiens
ctgattaaccctagtttactggttttaagaaaaatgtggaaaaatgaaaacacaaaatgtacacattcacaaggacagctcttgaactccccaagagtatattcttgagccctggtagagcagctgggttgggttggccttaaaagatgtagtagtaagttatactagagagaacaggctttgaagttagacagccctgtgttcaaatctgtgtactgacattttcttgccttctaatcttgatataaatgcctaacctttctaggccataatcttcttatctctaatatgtccatagtggacctcaaaagagaggttcagattatgtcatagctctataatgtgctgactgggtgaccttggcaagtagcttagcttctctgagcctgtttttctcttgtgaaatgggaatgcttatgtcataggattgttgggagatgtactcaggagtgtacctgtgaaacatagtgggttgatcacatgtgcttgtctctgttccatctaaaaggacagagaagggagttta

SEQ ID NO: 272602 - DNA, 339 bp, Homo sapiens
gaagactgggctgagggaggtttaaggttggattgtttttttttcctgacattaaaaagattcccataaaatgtgtatctgtaccatcagttaaaaaaacaaaaacaggccgggcatggtggctcatgcctgtaatcccagcactttgggaggctgaggcggacggatcacgaagtcaagagatcaagaccgtcttggccaacatagtgaagccccgtctctactaaaaaacataaaaataaaaaaattagcagagcgtgcctgtagtcccagctacttgggaggctgaggcaggagaatcacttgaacctgggaggcggaggttgcagtgagccaaga

SEQ ID NO: 272603 - DNA, 415 bp, Homo sapiens
attctccaaaacctgtggatccattgaaagagtctggaaatctgtgtccatcacatcctgcctccctccccacctctaccttagatgaggctcagaatccttgtcaggggagcagatatcaaagggtcaccctgcgactgcttggccttgaggcaaacactgggaaggactccatagctttccttctgaagtggaggcaggcagcactttcacttggaccccccatcagcatctctgaggcccaccacggctgttgcacacacatcctctctgcccaaacacagaccaaaatatcccagcagcaaagaaacaaagtcttttctctgtgttctcactacttacctggaagaaactgacattgccaaagtgagctttcctataaacccagaggaaacctttgaaaaggaaaataaac

SEQ ID NO: 272604 - DNA, 458 bp, Homo sapiens
agataatgaattggttccctactgttcttcaaaggtgaccaattagagtattttttgattaaatatttcatcttaagataattatatgttctcatgcagtgtaagaaataatacagagagatctggtgtacctttcacccagtttcctccaatggtaccatcttatataactatagtacggtttcacagctggaaaattgagcattcatatgacccacttgtttttgtctgatttcaccagttttatattattcatttgtgtgtctgtgtatatatttagttctgtacaattttgccacaaatgtagatttgtgtaatcactggatttaaaaaagtcttcatgaactcatggatttaaatatattttatggccaggcatggtggctcatgcccacaatcccagcactttgggaagccgaagcaggatgttcgcctgaggccaggagttcaagaccagc

SEQ ID NO: 272605 - DNA, 314 bp, Homo sapiens
aagaacagtttcaggtttagagaaaaaacagagcagattagctgggcatggtggtatgcacctgtagtcccagcttattcatatgcttatttgccatctgcgtatctttttgtgaggtgtctgttcagacctcttgcccacttttcaatcgggttgttttcttattgttgagtcttaacagattagcttaatcagattggcttcgggaggctaaggcgagaggatcgcttgagcgcgggaggcggaggttgcagtgagttgagatcacaccactgcactctagcctaggtgacagagagagaccctgtctcaga

SEQ ID NO: 272606 - DNA, 376 bp, Homo sapiens
ttttcagtcagagaaaccatgtacaaagcatctaatgtgagagtgctatggtctgaatgttgacaaccacccccctccaaattcataggttgaaatgtaattcacagtatgatactattaaaagttaaggtctctggaaggtgattatgtcatgaatacagagccttcatgaaggagattggtgcctttataaaggatgcctgagggggttggtttgtcccttccaccatatgacgactccaccatgtgaagaagaagatgggtctatgaactaggaaatagggcctcatcatatatggaatatgtgagcactttgatctgggacttagcttccagaactgtgaaaaataaatttctgtcatttataagctactta

SEQ ID NO: 272607 - DNA, 360 bp, Homo sapiens
ctccaccaccaccacctagagagaatgagcaggaaacctcagaagaaatggcacccaaaagagccagaagtgtcgcctcagccagctaaggttggaaccacttaccaacgcccagaatcacgtctttccaatcaaacccaatgactgttcatctctgggtttcagtttcctggtttgtaaactcccatgagtaaacaatctctgattatcccgaccacagagagggttcaatcaggtgtgctggtggtcttcaatcaaacatggatttacctcccctattctattcttcaaagagggtgacaaatctgcaactcacttgaaatccatcaataaaaaagattaataaacagatatatgata

SEQ ID NO: 272608 - DNA, 452 bp, Homo sapiens
tttgttggccaaaaggtagaaaaagcccaaatgtacatcaggagtagagtagatttttatatattgtatattgtggtatgttcataaaacataattctttacagcagtgaaataaatgagtcacagcttcaagctccagcttgaatggatctcacaacataatgttaagcaagaagccagacacaaaaagaatacatatggtagtactccgcttatataaagttaaaaaacatgcaagcccgctgctggaagtcaaggtagcggcttcatgtggggaggaagaagaaaggtgattaggaagagaacgagggctttgggatgcttctgggtcatgttctgcttcttgacatggatggttacatgaatgtgttcacttcctgatcattcgttgagccgtacaagcaaatgtgcctactttttgtatctttgtaatgctccaataagatttttta

SEQ ID NO: 272609 - DNA, 376 bp, Homo sapiens
ggaattcaaatggaatactagcaaaatcaatcaaatacaaaacactattggaggaatttaggggaaaaagattgaaatttatagaaaacaaacagcaaagtgacagaagttgttcctaatcaaaaatcattttgaatgtaaatgtatttaatccaccaactgaaagagagattggcagaatggattttaaaaacatgacctaactacatgctatctacaggtgacttaaatccaaaggcacaacgagatttacagtgaaaggatggaaaaatattttccatgcattagtaaccaacagaaagctggcatggctgagattgtgccattgcactccagtctgggcaacaagagcaaaactctgtctcaaaaaaaaaaa

SEQ ID NO: 272610 - DNA, 374 bp, Homo sapiens
cttcaggaaatgacatttgggctgaaatctgaaggatcagttggagggagtcaaagaatttaaggaacttgaagacctgcagacaaaggaaagtttaagtgcaaagttcctgaggcaaggaagagtttaaggtatttcaggaaccatggtcagatgatactgagcaagtgagggagaggtaagcaggagccagaacgtgctgggtcttgaagaccaaaataagtactttggattttattctaagtacaatggaaaatcactgacggtttttgaacagaaggatggcatgatctgaattacatttcaaaaagatgactggctgctgagaggtgaggagcatagtacagtcagaaggccactgctgtgctctgaag

SEQ ID NO: 272611 - DNA, 454 bp, Homo sapiens
acgtgtcaaagaaattatcaccctatgcacaccccactccaagaaaggctaagaaaacaagtcctatgagcggaggtcggagcaacctcttttccgaagcctgaacacaatagatggcaaactattgtccaccttcagctcgctccaaatgccagcagttgcaggagtatgagctgcaacagctcggcacgactagtccaaagacgagcactggaatataagaaaatggtcctggcgcatcctaccctcccccatcgatcaccctcaaacaagtcagttacccggctggtccccacccccctctgcgggccgccaccgcccgcctgggcccggctcgcagaaggtaggagcccggaccggcagagccgaggctccatgtgagccgcgcgggaggcgcagagggggctgcaccggacggaaggttgcaccggtggcgggcgcaagcagcggccgc

SEQ ID NO: 272612 - DNA, 428 bp, Homo sapiens
gtggagatggttggagagtagctgagagagacagaagagtccctgagggctgggggtgagaacatgagagagactggggagtaattcagtgaaattcgtgattttggtggtgtgtcgtgggtgcctggaactgagtccagctggaatctagagaagtttcgagagtagctgaaagagacacaagagtccctgtgggctgagggcaaagacctgagagagaccagggaggacctccgtgaagtctgtgagtctgtaggtgattccggagtgtgggaggctgactccctctgaaacctgggcgtggtgggagagtagctgggacagacaggagagtcccagggggctgggggtgaagacatgagagagactggggagtaactcagtgaaactgctgagtttgtaggtaattcctgggtgcctgcaagtga

SEQ ID NO: 272613 - DNA, 407 bp, Homo sapiens
gggctggccccttctggcacttggggacaagcttctcctcctcgggcggcggtcgcagccttgtggggcacctgtgtgggtctttctgaacgccagctggaatgagagcttttcccgcaggcgaggcgtgcacagaaaagatgcttcgtccttccctcggtgtctgtagcacgatcggaaaggggcccgtcaaggaaaggggttggagtgttgggagcctggggcaggagggtggggtagacgctaggcggctcaagacctgccctgaggaagcagaaggagcgtggggggaccttcggagggcacaggagaggcagtgggaaggccacagttcttctcaggataaaacagccccaaggcccccatgtcttgcatttaacattcttggatgtttctgaccgaagaga

SEQ ID NO: 272614 - DNA, 566 bp, Homo sapiens
tctcaaataaaaaagaaagaacattcgtcactgttggaggcatgagactgtggaggcaggtgcgttgaggccaggagtggaagagggagacaagacagaagggtagtccagtcttgagtttgctttgtggggagtggtggagaggcaaaaacggatctcagagtgaccttcgagtaaagaagacatggggctgtgtggagtggctcacacccataatcccagcactttgggaggtggaggtgggaggatcacttgaggccaggagttcaagacccacctgggcaacatagcaagatcccatctctataaaaatttaaaaaattagctgggtgtggtggtgtgcacctgtaatcccgggtacttgggaggctaaggatggcccgcaagggggtgctgtgcttggactggggaatggccaactgcccagcaatagggagatgacttcgagaagcaaagataggaaggttaagcttgataagacaagaaatgcagcagatgtaatccaaaggcaaaggggggacctgtagcttgaattaagaagtggtgtgggctgggcgcagtgactc

SEQ ID NO: 272615 - DNA, 1045 bp, Homo sapiens
ctcacatcccagtctctgatcagggaaagcagggcacagccttgggaagaatggataagcatggtgtgaagacccccttgtggaagaaggaaacggaagagctccgggccgaggacgcggagcaagaggaagggaaggaggggtcggaggacgaggacgaggacaaccagaggccgctggaggacagcgcgacggagggcgaggagccgccgcgggtagcggaggagggcgaaggccgcgagcggcgctcagtgtcctactgcccgctgcgccaggagtccagcacccagcaggtggcgctgctgcggcgcgcggacagcggcttctggggctggctcggccccttagcgctgctgggcggcctaacagctcccaccgacaggaagcggagcctcccggaggagccgtgcgtgctggagatccggcgacgaccgccgcgccgcgggggctgtgcttgctgcgagctcctcttctgcaagaaatgcaggagtctgcacagccacccagcctatgtggcgcactgcgttctggatcacccggatctgggtaagggcggggggccgctgggaactcctgagcgcccccgctcccagcctttgtgccctccatcatttcctggccccagaccccctaccgaccttctctcttggagcgcggagccctcttcgacgcattccgcaggaccgccccttctcagctgctgcccagagcgcccccatccgtcaagaaggcccactgttggtgcttggttcccatctgtcacctagcgcccccagtgcagagcccagcataacctagagcccgctgtcaacagcgcccaccgagggctccccgcccccacgcagcaccagcgccaccgcacacctgactctgtccgctcacacagcctcaccttcacctcttgggtatttcagatccgctctggcccagtgggcagaggcatcgcctagagaaaataacctcagggttccctcatccctctgacaaacctgcctctttccctgaaaccattcaataaaacctctgatcaaagtgtcaaaaattt

SEQ ID NO: 272616 - DNA, 1077 bp, Homo sapiens
ctcacatcccagtctctgatcagggaaagcagggcacagccttgggaagaatggataagcatgcaggactgccctgacctcctcccggcccgcaggtgtgaagacccccttgtggaagaaggaaacggaagagctccgggccgaggacgcggagcaagaggaagggaaggaggggtcggaggacgaggacgaggacaaccagaggccgctggaggacagcgcgacggagggcgaggagccgccgcgggtagcggaggagggcgaaggccgcgagcggcgctcagtgtcctactgcccgctgcgccaggagtccagcacccagcaggtggcgctgctgcggcgcgcggacagcggcttctggggctggctcggccccttagcgctgctgggcggcctaacagctcccaccgacaggaagcggagcctcccggaggagccgtgcgtgctggagatccggcgacgaccgccgcgccgcgggggctgtgcttgctgcgagctcctcttctgcaagaaatgcaggagtctgcacagccacccagcctatgtggcgcactgcgttctggatcacccggatctgggtaagggcggggggccgctgggaactcctgagcgcccccgctcccagcctttgtgccctccatcatttcctggccccagaccccctaccgaccttctctcttggagcgcggagccctcttcgacgcattccgcaggaccgccccttctcagctgctgcccagagcgcccccatccgtcaagaaggcccactgttggtgcttggttcccatctgtcacctagcgcccccagtgcagagcccagcataacctagagcccgctgtcaacagcgcccaccgagggctccccgcccccacgcagcaccagcgccaccgcacacctgactctgtccgctcacacagcctcaccttcacctcttgggtatttcagatccgctctggcccagtgggcagaggcatcgcctagagaaaataacctcagggttccctcatccctctgacaaacctgcctctttccctgaaaccattcaataaaacctctgatcaaagtgtcaaaaattt

SEQ ID NO: 272617 - DNA, 246 bp, Homo sapiens
ccagtcactccaggctttccgggcaccggaggatgagagaagccctatgctcaggaaagtcacggtggtcactgcctgtcccatgggattacgatggcccaagggtgacaaccgcagaggacctgactcaggagggaaagggctcatgacagccaatcatgcattctcttcccagtgcccctcccagcagcctcccagtggcagcacgaaacaggccacagtaagggtgtttacaccatgggaatg

SEQ ID NO: 272618 - DNA, 210 bp, Homo sapiens
ttttctacaagatttaagaggctaatacattacaaaacaattagactaaaagctaatattactgtaactttggtttgcaatttcacgttttgttttccatataatttaagagactaatgcattttaaaaaccaatttttagatcctgtttttaaacatataatgtacaggccgggcgctgcggctcacgcctgtaatcccagcactttgg

SEQ ID NO: 272619 - DNA, 263 bp, Homo sapiens
ccataggttccctgtgaaggctgaatctaaggagacttagccttgatctagaccaggctgggaatggggctggtctggactacatatttttagcctaattctcaagccctgctgaaattagccaaaaaatagagaagatctgccctagctctgtgtgtcctagctggagaactgtggtaccattgttaatgaccagtcacggctccagattgctttgtttggttgcccaaaccagctgggagaaatgagctgccaaggagagc

SEQ ID NO: 272620 - DNA, 492 bp, Homo sapiens
tactgatagagcatggatgcaggattaatcaaatctgtagccttagagacaggaggcattcctgcctttctggtttgcagacatggagggctgaaaaggatgggggtggggcatggtagtggagattgttagccagtgggttaatggttaatccctgcaacatgccagagatacacctaatctttgatgagacctactgctcagaatgaataatggttaaccattccttacctttgactaagaccatatacctttcatagtttgttttttaaagtatgtggaactgtgaagtttttttttcttttgcaaataacatttgcatatcacagaagttttatgactcattcttggtaaagaaagcaggtgatatccatgaatggtttgtcatcttttagagacgagtagaatgattgctatcgaattttcatttaacttaaacacagctgtgtagagacaatataaagtggtcctttcctcagtacaaaacatgga

SEQ ID NO: 272621 - DNA, 350 bp, Homo sapiens
tatttccttcttaagcaagaggcagataccagtgtcttcacattatttccagaggcaagaagtcctatagtttacgctgagtcacagagttaacagatccacatggctacccaaatagaaacagtgtaactggcttttaaattcaactatttttattaacactttaaattgaagttaataaaataaaatgcttaccaattgaggataatagcacattgataaagcttcagaaagattcataaaggccataattgtttgcataatagaagctcagcatccctattgaaataaaaagtactgattatcttcccagtaagtatggctgagtaggcgtagaaacaatcttatta

SEQ ID NO: 272622 - DNA, 430 bp, Homo sapiens
aatctgcctgcctcagcctcccaaaatgctgggattacagatgtgctcaagagagcaattttagatcagtcatgtcaaagcagacatttccaaatcaagacaaaagctgactttctctaacataatatgttattaattttaagagttcgttattaggtatcatctctggagtaaataggatgtctatgcattttttaaaatctatataatttgaggttttacaattttaacatataagtaatccctcaagtatgtattgtacgctttagttgtccacatactttcacatcagttatttgagaaattgtatataatcagatggaaataaatgagggagtttttttggatttttttttaatccaaactttgtactgcaaatattataagcttatcactgtttttctgccttgattaaagtaactaaatgtac

SEQ ID NO: 272623 - DNA, 596 bp, Homo sapiens
ctgaagggtcctatatatagcatataataagtgttcagcaaacatttattcaactgaatactctacgagctgaccttacatggtctgaggtggagctctgggtcaaagccattctcctaccctgctcaggagatcactttttgctccacctgggcagtggtcatctttatcaatacacaaagaagtccactgataaagagggacttcttcaactctttctcaaccttttccttctaagaccaaggcttgaataggatgggctccctggagtctaagtaataagtatttcaaatatctttactgtaacaaatcttagtatctaccagaagctattctgaagatgaggaaacaaaagtactggcaattcctgacctgaatgccaggttaactcaagggaccaatcgactcccagtacaatagaaactgcaaagccataattttaactcttattatgatacagaaaggaaaacaaaagaatggtttatttaaagactaaaactgcctattttatgaagtcactgtttacattgttggaaactcaattttgcagtcctctaaaacaagttttttctccagaccacttaaggtaaaagaaa

SEQ ID NO: 272624 - DNA, 263 bp, Homo sapiens
gtaattttgttaagcagtaaacaacgtggaagacaggttggtcaggagataagcagttgattccgtgttttttgaagagaacttttatgatagtaggaagaggagggcagtgctggtcctgtagtgcagtcgtgtagtactgtttgctgtgggacaagaggaaggaacagactggcaggaagggactgcagcatggaagggtgctaagtgcgtcactgagtgataagggtgctaagtgcaggaaggcccactggatgggcagg

SEQ ID NO: 272625 - DNA, 395 bp, Homo sapiens
ttttgaagtattttgattaccactctacttgtgtgaataacttttattttccagtgacctatggttttattttgatctagttttttgaaacttttgacatctttgtcatgttcccccaggatgaaaatcctaaattaagtctttttgtattaaataattagacttatttggcagattctttgtaaagtattatcaaatgataattgatactagatctttctgttacaattatgggtacattattgacataaatgttccaaaacttatataaatttacaaaaagctaatttgttatcagtcataactttgattactatattaaatcttaagttatatttgtaggggtatgttattaatgtgaatattctaaagatgatataaaatttatgaaagcc

SEQ ID NO: 272626 - DNA, 432 bp, Homo sapiens
aagacatgatggccatgaagagggaatacaaagatgatttcatgtgtcaaatttctaatgagctcctactatgtgttcagcctagggatacaaatacatggtccacagctggaaagaaaatgacacagaatgggctgggtgcagtggctcgtgcctgtaatcccagcactttggtaggctgaggcggtggattacctgaggtcaggagttcaagaccagcctggccaacatagtgaaaccccatctctaccaaaaatacaaaacttggccgggtggggcggcacacgcctgtagtcccagctactagagaggctgagacaggagaactggttgaacccgggaggtggaggttgtagtgagctgaaaccacgccattgcactctagcctgggtgacagagcgagactctgtttcaaaaaaaaaaaaagaaaaa

SEQ ID NO: 272627 - DNA, 1185 bp, Homo sapiens
gtgtcacttaatgggatatgttctgagaaatgtgttattaggccattttgttattgtgagaacattgtagagagtaccacacaaacctagatggtgtagcctactacgctcctagactatatggtatagcctattgctcctaggttacaaacctgtactgcatgttactgtactgaataccttcagaaattgtaatataatggtaagtatgtatctaaacatatctaaacatagaaaagttacagtaaaaatactggcatcaaaactccgttagatcttaagggaccactgttgtataatgtggtctgctattgaccgaatggtgcatgagtgtatatgatacctcatgagtgatttaggaaatcttctgtgatgattttgagtatacattatttcactgtcgttatctttagttcctaacatctcctaaaatatgccttatgtactggaatcttgttgcattctatacttaagtaagttatctggaaacaagtacaaatatatgttctcattttattttattttgaactcagggtctcactcttttgctcaggctggagtacagtggcacaaacatggctcactgcagccttgacctacctcctgggctcaagagatcttccccatcccagctcccgagtagctgggaccacaggcctgtgccacaatgcttgaccaatttttttaaatttttgtggagatcgggtcttgccacattgtccaggctggtattgaactcctgagcttgggtgatcctcctgccatagcctcccaacgtgctgggattacaggcttaagccactacatccggacagtgctctttatttttaattgaagtggtttaatctctcagcagcagtctttcctaaaataattgcaagacaaaaacaaattctcaaatttgatggcatgaagataagaatctatataatcttaccaaaatctattgaagataaagaaaaaaaatcattcagattgctgattgttttgattttgttgattttgggttgccaaattgtcagtcagtcacctatttgtcttgccaaagacaaaatttttttttcccacctaaccctttccccaagcatcttaaatcagttagtgattcttttggtattcattagtcaaaaatgaagatgtttaaggggaactaccttgttactgcttcacatggccctctttgta

SEQ ID NO: 272628 - DNA, 467 bp, Homo sapiens
agtgcctggctccatccagggtctgaagcatccgaggcggaaagaacttgttccccagtcctttgccagcgtgcgcccccacttagtgcggaagcgtccgcggacgcctcgcagcgaggcgtcgccacttagctcgcccgctcttggggtttctctgactgttgtttccacagaccccaggtttcttttaaaggcttgttgactcactcttctcattcctttcatttcccttccagccccttataaacgagcttctgtggtttccaccaaaaatgcccctgtgtgtctgaattctggcgacactcacttctcccagagtgttctgcaacgcagtttctaatgcgcccagagctaagctttgcgggagtgccttttgaagaaacgagcgctgaaccttctttccacctgtcccccaagttttctccatgggtctttgggtgttggaataaaacccaaactggacaaag

SEQ ID NO: 272629 - DNA, 299 bp, Homo sapiens
gtgtgtttgtgtgtgtgtgagagagagagagagagagaacttccaggcttccagttccctcctccagccacattcaatttcttcccatccttcccatctctctccttgaaagtcccagtggggaaaggtgatctcaccaggcttcaagctgctgcctggatggctctgagcagggctggctgtttcaccccaagctgagcaccatctgatcacctagaggcagtgctggggcaggctgagctctgacctgtaggagggatgctgacagtggctatgtcaagatgggagcctggcttctg

SEQ ID NO: 272630 - DNA, 339 bp, Homo sapiens
ttttttttttctcctctagcaacgccagcctgagatagctaccccagcccgagaaacacaccacttctcagtactaatttctgtcttagtctgtttatacaaccatacgaaatacttgagactgggtagcttataaacaacagaaactatgagttttgaaggatgaaagtccatggtcacagttctggcagattcagtttctggtgaaggcctttcagctgggaggccttgtgccttgcaaaagggtgccttttagctgtgtcctcacatggcagaagggaaatatgctatgtcctcacatggtagaaggcagaggggcagaagggcctgaactcattc

SEQ ID NO: 272631 - DNA, 967 bp, Homo sapiens
cactagaagctcttgggagcatgtggacagttgtggctgctcctgagctgacactaactgctcatgactcctctgtgggagaagtaggtggtttcctagaggaagaagtttgggtaatgaagccacagagatttgctgatacatttgctaggcacgacttctggtcatttagaaagctattttgtggcttcatcaataaggtattccccagctgtgttactccttcgcatgttatctctttccctggaattgaaggcttcctggtctgaggcaaggacaattattccctcactgtcaaccctgatctctggctgcagtaatgagtagaggaaatgaagaaataagaatggaagcataatcatttgtccgaggtcacagagggagatgattacacagctggaatgtaagcctcagtactttactgaatccttggctttgtccatgggcccagctacaggcataaagcttttctcttccccagcagtgacttcgagtaccagctttcaaatttatttgacattgaatctaagctttgtgaccagtatgtagaaggagaagaaggggaggaattacttatcctttggcatacattagcatgcaaataaatcctttctctgcattgtggaagggtctgaaattatcacatatacaatgtatcttttatcaatggccttgcatacaaattttactttgaagaatccagatttagaggtcttctccaaacatttgcattgtttctttttcttaggatcagaacttctacctattgtcattttaagaaaaaagatcatgaattaattaatttattcattatttacacccttatattctttcccaaatgttttaatgtggcttacattgtatacatgtacacaataaatatttatatttaaataagttataatcacagaatgagaatattattacaaccactcatactcattcaaatagcttgattatatcattg

SEQ ID NO: 272632 - DNA, 999 bp, Homo sapiens
cactagaagctcttgggagcatgtggacagttgtggctgctcctgagctgacactaactgctcatgactcctctgtgggagaagtaggtggtttcctagaggaagaagtttgggtaatgaagccacagagatttgctgatacatttgctaggcacgacttctggtcatttagaaagctattttgtggcttcatcaataaggtattccccagctgtgttactccttcgcatgttatctctttccctggaattgaaggcttcctggtctgaggcaaggacaattattccctcactgtcaaccctgatctctggctgcagtaatgagtagaggaaatgaagaaataagaatggaagcataatcatttgtccgaggtcacagagggagatgattacacagctggaataaactctcctccttcaatacctgactacttgcaccatccagcagatatcctctactaccaagtctcaacagatggttcagctggtctttaatgaacaaaaggcatttgtgtaatggactcttattgctcaagaagaatttcttccttcctgaaacatgaggagaaactgacaaaaactgtctccttgaccaaaccctagtcagttgcctataagccctgtaggctgtgaccttagtgtctatccttatcagacacgcattacacaaccatagcaacagtcttgctaagttggtttaaccagaacccctacccttgatatctgatttaatttataattcccctgagtccccgaggtgacatccattcatcctggccagctttcaataagaatcctattggattatttagctagaaatcaccccttacacttaatgcttccttttagtaattttgcatccactaaccccgacttgctcgttggtataaaatcacaagttgtccgtgttgtgtttgggactgattacaattcctatattgagggtctcttttcccatattgcaatagttcctggattaaaatctgcttttgcccattga

SEQ ID NO: 272633 - DNA, 864 bp, Homo sapiens
tatatagtcacagtgcctgtaaccacaccaggaagttagtattgccaccaggcctcacactgtgtgcagtgatgtttcacaggctcacccactgtatatagtgatatttctagtccccttcagtcaggaacggtcccttgcctttctgtctttcctgaccttgacccctccagagcatgtggccgccccttaggctgtctggtatttgctggtgactaggcccagcatgggctttgttgggaggagcaccgtagtgggacacctggtccttgccaggtgcccttttatcaccgggttaaaaaggtgccggtcaggtttttccattgtaaaataattactttgtgcccagattaaatagtaatgaggctgggcgtggtggttcatgcctgtaatcccaggactttgagaggctgaggtgggcggatcactggagctcaggagtgtgagaccagctcaggcaacatagcaaaatcccatctctaccaaaaatttaaaaataaccaggtgtggtggtgtgtgcctgtaatcccagctacttgagaggctgaggtgggaggattgcttgcacccaggaggcggaggtggcagtgagccgagatcatgcccctgtactccagcctaggctacagagagagaccgtatctcaaccaaaaaaaaaaaaaaaaattaatagtgagtgcctgggcaacatagcatgaccttgtttctactaaaaagaaaaacatcagccgggcatggtggtgttggtcccagctacttgggaggcctaagtctaggaggttgaggttgcagtgagctgtgattgcatcattgcactccagcctaggcaacaggatacgatcctgtctcaaaaaaaaaaaattg

SEQ ID NO: 272634 - DNA, 377 bp, Homo sapiens
aggctggagtgcattgacgtggtctccgctcaatgcaatctccactccaaggattgaagtgattctcctgcctcggccccttgggtggttgggattacaggcatgtgccacccacccggctaatttttgtatttttagtcagagagagaccgtatctcaaccaaaaaaaaaaaaaaaaattaatagtgagtgcctgggcaacatagcatgaccttgtttctactaaaaagaaaaacatcagccgggcatggtggtgttggtcccagctacttgggaggcctaagtctaggaggttgaggttgcagtgagctgtgattgcatcattgcactccagcctaggcaacaggatacgatcctgtctcaaaaaaaaaaaattg

SEQ ID NO: 272635 - DNA, 309 bp, Homo sapiens
ttacaggtgtgagccactgcacctggccttttcttccaaaacaatgcaaattcattgcccaaagacttaaccagagagagaccgtatctcaaccaaaaaaaaaaaaaaaaattaatagtgagtgcctgggcaacatagcatgaccttgtttctactaaaaagaaaaacatcagccgggcatggtggtgttggtcccagctacttgggaggcctaagtctaggaggttgaggttgcagtgagctgtgattgcatcattgcactccagcctaggcaacaggatacgatcctgtctcaaaaaaaaaaaattg

SEQ ID NO: 272636 - DNA, 353 bp, Homo sapiens
atagctacttggtattgggcttaagtcctgggtaatgaaataatcaatacaacaaacccccatgatgtgagtttacctatgtaacaaacctgcacatgtaaccctaaacctaaaataaaagttaaaaaataagataaaataaaatgaaaatattacctaccaggcagatatacggtgaatatttaacaagataataatgtatactacttagtaccttgaaggccagtttatatttgaaatatagttaacttttctccaccatcagctggcatgcctaaattgtgttatttcaaatgctggttttcctgggtactaatagtgctgtatataaaatgattccatggtcaaataca

SEQ ID NO: 272637 - DNA, 174 bp, Homo sapiens
agctcctgggcaagcacaggctctcctggggcctcagcccgcgaccccttgtaaggtaagaggtgactactgccctagataatatcttttttttttaaattaaaaaattgtttttagagacagcatgaaggcccttcgtggcatgatagttacacaaatctatacatgtgatta

SEQ ID NO: 272638 - DNA, 416 bp, Homo sapiens
tgtgatctaagagtgatttgcctgtcaccattgctttcaagatatactccagaacttgaaataaaggttccttaaagattatctttcttggctgggtgtggtggctcacacttgtaagcccagtgctttgggaagtcaagtgatcctccctccttagcctcccaaatagctgggactgcaggcacgcgccaccatgttggctagtttaaaaaaaaattatagagatgggagtctcactgtgttgcccaggctggtctccatctcttgacctcaagtgatcctcctgccttggcttcccaaagtgctaggattatagccatgagccactgcacccaaccgaatttgcttttattaccttctccaaattgtgaaagtaataggtgttcattgaagaaaaatagaatgtaagaagtttt

SEQ ID NO: 272639 - DNA, 452 bp, Homo sapiens
gatgattcttcctaaaacgtaaattggatcatgcctctcccccaacagtctcatgcctatggaagggaatcctgtcccccaaggggttctccctcctgtctcctccaagaaccaggcagtgtggggtggggcagcaggacccagggtctcagagctggggcctccccagcctcacttggggcctccaaggctaagttctgtgacctccagggcccaagagtgagttcctctggctgctccagaaagtgaagagagaagagccaaccccggctcgggccacgagccccgaggcactgaccacagccagagcaggcctgctggaagctccgtccctgctgcagatccctgcgccacatgatatcagcaattgctgcaatttcgccctaagtactcttgtttcccctaataatccacgtttcatctccacaataaacattgttagaactcttaaa

SEQ ID NO: 272640 - DNA, 384 bp, Homo sapiens
gagacccagcgttctctgctgtcagtttcctggccctttgcttctttatatcacctcaaactcaccttcaaaaaggaagtaaacaagaaagtcagaatatctatcatatggactacaatttgtgagaaaaggagagcaaaagagagggcctggtggtcgctttctaccccaaagagccatatgcactgagaacggctgagaacctcctctgccaacccagcagcagccttcctaacaccttgtgtttgagaaatgagagacctactgtttattatcacaggtccaggtggtaaaaatccaaagtttatccaagcagatatcttcaatcgtaataccaaatgacaataaattgaggtaaaatgttgctgttgcaaatctacaaat

SEQ ID NO: 272641 - DNA, 284 bp, Homo sapiens
agatgactggtttccctaagctgccaacactgtgattatctgagtgtcaatgacccataggcagtcacagtggtcccgagagccccgtccctgatgcctgggagctctcagtctagtgaagtttggccttgcatatttatagtttatccactctaacatctgggaagtgaagactctggttgctattccactgctcctagccccacactttacggctgttctgatttcccttctctgaagctcttgttcactgaaaggatatcagctttttgctacacccctga

SEQ ID NO: 272642 - DNA, 456 bp, Homo sapiens
gacccctctccttcttgcacccttttctccagcttccctggtttccctgatgttccttaaatgtgacaagctcactcctgccccagggtctttgcaccattggttttcctgcctgcagtactttttgcagatggccccgagacttgcttcctcattttttcagagttctgctcaatatcagcgtctccataataccttccttgactgccctgttatcaatggcaaccccatgtccccagagcttcctatgcccttaagctgcattttaaaatttcacagcatgtatccccatctcattttctatattcgcttgttcgtttattgcccatctcaccggctagaacctgagttccatgaaagtgagaactgtatgcccagctcacctctgcagctgggaagaggccctgctaaaggaatgaatgagactctgctcaataaatatttatagattaaacc

SEQ ID NO: 272643 - DNA, 302 bp, Homo sapiens
attaagttggtattaaccttgtcttttcagatgatgccactgaaaggtaaacataccattctgacatgcatgaaaatgaaacgacaaattgatacacgcagtgcttggaatggatggagtccttctaatgagtgattacctgtggtataactatattgattgtgtttgtacatgtcaaatggggctggcgaggatgaacttgaagaaatcaatcttggaacctgctaggacagcagcctcctggtttcacagtactaaatcatgacttcaaaattttgaagtaaaagaaaactgcaaaactt

SEQ ID NO: 272644 - DNA, 241 bp, Homo sapiens
tgagcaggtgtatgtaatttgtgtgagcatgtgtgtgtgagtaggcgtatgtaattgtgtgagcatgtgtgtgtgagtaggtgtatgtaatcatgtttgtgagcatgtatgtgtatgtgtgagcatgtgtatgtaatttgtgagcatgtgtgtgtgtgagcaggtgcatgtaatcgtgtatgtgggaggtgtatgtaatcgtgtgtgagcatgtgtatgggtaaacgtgtatgagcatgtg

SEQ ID NO: 272645 - DNA, 420 bp, Homo sapiens
gtacatggtagctacaggaaagtagttttttcatcagataaacttagatttgaatcttctggttatgacctgaggcatgtttctaaactctgaaagcctcagtttcttcctctgtccagcagagatagtaattaccttttttggggtttttggacaattaaatgagatacaacctacaaaaggttgaacacaaggcctgaggtgcccaaaactttaagtacatatcatgggaaaccagcgcccttgggttgaaggaagtctggcccgtgggttcctctgggtggacttgccacggtgctttatatgtacaatggaaagagagtgtctggggggccaggggagactttcttatgacttgcagaagttgtgtttggcattatgataagcttttcagtaataaaaccaaaatgcctattaaat

SEQ ID NO: 272646 - DNA, 301 bp, Homo sapiens
gaaaatcattggaaactgttgaattagatgtcctagctctaaaaagttctattaattattaattatacctctacactgagtaatttatagtaatagcttgaatgaccacattcagataatcctgggctatttaaggtcatgttgccaaaaaaaaacttaataggaataattattaaagatgtaattatttgcatttcagttcctgactagctcttacaatttggacatgtgtaaatttcagcttttaaattttggtttgtgtttgaaaaataaaagcatttctcagctgaactattaaaaa

SEQ ID NO: 272647 - DNA, 445 bp, Homo sapiens
cacttcctggctgtgtgagcttgggcaagtcacttaccttctctgtgcctgtttcttcacatgtaaaataggctattgcacggaagaaacaagttggtatatttaaagcaattagaatagtccctggcatggaggcagggtggccgtgctggggaacatctggcattgtattagggcggccctcagctgtggtgtggcagcctctgggcagcacagaatccaatcctaaagggccaccctggagtgattgaggaatccaggctggaaagtagcagcaggaatgggggtgggggtagacagggtcaggctcctagttagtctctgtccttcctactcttaggccttggtagaatctagatgcattaattcaaggaatatttattgattaggtgccatgtgccaggatgctctaggggctggggaaacccaatgggaaaaaaaacaa

SEQ ID NO: 272648 - DNA, 476 bp, Homo sapiens
ataagacccatgtgcagatgtctgaggaaatgcttcttgtttcaaggatcccacagtggggctgcaggggcttatctactctccctcaaggcagggagaagctcagtgtccccaggatgtggaatcacactcagccctacagggactggggagcccaaagtatctgcccactttgggtccagtctcctcccgtgggcctccaagcggccctccatcatgcaagcttcgctctggtcttgcaccctccaagaagtgcttgccagctccctctgttcttctgtatcccccaaagcacccattgcagggtgggggaaacagcatgtgatcaggaaaaccttactgtatggtgtgtaaataggataccatggtctggaaaacccaatattctgtttaaaagtgaaagagttactataaaggccatatgtcagcttccaattttcaaaagacaaagaaatacacactgctaaagttcagtg

SEQ ID NO: 272649 - DNA, 293 bp, Homo sapiens
aaagaaaacttcattaattaaccactttcgtatgtaatatcacaatcttattctagcattcttctcttaaagtgtttacgggccaggcacagtggctcacatctgtagtcccagcacttagggaggctgagggaggattgcctgagcccaggagtttgaaactagcctgggcaatatagcaagatcttgtctctactaaaaatttaaaaaatcagcagggcatagtagtgtgtgcctgtagttgcatttacttgggaggctgaagcaataggattgcttgagcccaggaggaa

SEQ ID NO: 272650 - DNA, 365 bp, Homo sapiens
aaggggtctaacccagatgagatgattatgaaacaaaaaggttccccaaggtggctcctatctgcacatcattttgtgcctgaaggagttatttaattctgtcttgagctggcaaaaggaatgttccaggctttagtgatgatgaaagggtggaagcatcagtttaaataactccccttcctaaggtatataatgtgcctttcacggtgtggagggaatttgtttgtggcagttgttgtttgggttttagtttttaccttgttttcatttcggtgtctttagttttcatttttctcatccacaactagaaatctctcaaataattgtcttccctgaataaattcatcaggcttttgcagctattc

SEQ ID NO: 272651 - DNA, 285 bp, Homo sapiens
ctcactggagccaaaccatgtggcagaaactcctgaaattggtggaaaaagtggaatatggcagattgggtaggtaggagaacaattttggagattttgtttctcatgttaaaatgtctgcattttatttgctgtaccctgcctactctggttttaaggattttttgacttctttgaaaagcactgaataatctcttttccaggtctagattttttgatgagtactgtgtaaaattgtcaatattcaatggattatttaataataaattaagaattacactcata

SEQ ID NO: 272652 - DNA, 518 bp, Homo sapiens
atttaatcaatttcatgacatgttaaaggtagtgaaccaaaaatctatagcatatatatttcaaagaaatgaggtggattgcctttgagattgtgcaaaagataggatgtccttcgttgctggaaatgtttaacatagcattggaagttctgaacatcactctgcgggcagaagaaaattaaggctgtgtaaaatgtaggaagacagatagtgactgcagatgaaataatctaaatactggacaagactgcagccactgcaggcccaaagcctgggtttaaatccaagctttgcactttgaagctgtgtggtcttcacctctcccggtgtctgattcccgctctgtaacatgaaataaataagaaccaacctccagatgtaaataagtgaacacatgagaagcacttagaatcgtgcctagaacatagtaagcaactcaatgaatgtcatttctcattacatttgttaatgtttttatccagcccaatggcagtaaaacatcaatgctcaaagagccc

SEQ ID NO: 272653 - DNA, 361 bp, Homo sapiens
agtcggtttaactcccaaagactagtttctttcctcctggagattaggaaatcaacagaatggcctgtttcagcttacataatcgtggaaccatagaattttaggaatgaaagaagctttgcgatccttggtcccaactcttacactcaggagttccaagaagtttaggtgacatgaccaaggttatacagtaaagcccatgtctcccaccccatctttcctccttttccctaggaaacaaatggctttctaatacctcacattcagagttgattttcttttatacccgtttcctcaggttccctttgttctgaatcaatgtctaaccttttgggaaacaaacacctttctggaatggaag

SEQ ID NO: 272654 - DNA, 407 bp, Homo sapiens
agggatctgagccacagagaggttaggtaacttacccaaggctaaacagctggcaacacaggaaatcaggcacttgaggctgtgcacctaacctttgcactcatcaggcagagaagacttccagccaagaggcctttgtgggccctcatggttgtacaaaccagagtttgctccacagaggtgaattcagcctgctgagcattaaaaggaagtgtttcttgcctgtttctccacctacctccactgaaacttagcaattcccatccgtcaaagtgatttcctctcctcccaaccctcccttttggatgtccagagcagctgccaggagttaaacccctttgggagaaatcaaatgctcactgttgacaatttatgatgaagtgttgccctctccaaatcaactactg

SEQ ID NO: 272655 - DNA, 312 bp, Homo sapiens
tccttatgcccttagtgtggactctggacagagcaatggactaatgagggcgttgggattctagtccgtgctccgtcacgggtgagtccatactacaggcaaatgtatctccctgggtctctctggtctgcacactgaaggggctgcactctatagcccaagcctccacggctccagactccttgaactgaggctgaccgaggcgcatgcacgatcgaggggctcgagcaccaagcgcggctggcccccaggatcggggtctcgcggcacaaagggcgacagggcagccaggccgcgcccacgccccgtgcc

SEQ ID NO: 272656 - DNA, 218 bp, Homo sapiens
gattgattgtggagccctaattaccacggggacaatcctactggcagcctctgcctgagtttcagtccaaagcaaagaactctcggccgagtttagctacatccagtgtaatcttggggaggtctctgtgtatgtttgagactcggtttcccagtctgtgaaatgcgggtactgatgacacctgtcctgtaagggctgtcgccggactgtgtgctggg

SEQ ID NO: 272657 - DNA, 270 bp, Homo sapiens
actgagtgggggaagccccactcaggatagtcttgaaaggtagtggcaaggggaaatcctcccagcaagtagtattccaggaagtccacatggtcagccattttgtgtggaaagaagaagtggcctgcagttagatagacacacagggactcatgggcagtgtgatatatcttggccaggggtcttcgaaggtgaacacttgagaagattggtgagcaacaagggctatgaacatatggaaataaatgaacttatggaagtgagcacaaa

SEQ ID NO: 272658 - DNA, 431 bp, Homo sapiens
ccacggaagtggggcccgtatgattctcggcagacactctcgctcacacacaggccgcaccagcacacgctgtattctaaacctcctacagccttgagaatccttcccttgaaaagcagcacgatttaaaaggagctcccaaggccgggcgcagcggctcacgcctctgatcccagcactgtgggaggccgaagcgggcagatcacgaggtcaggagtttgagaccagcctgaccaacacggagaaaccctgtctatactaaaaatacaaaattagccaggtgtggtggtgggcacatgtaattccagctacttgggaggctgaggtaggagaaatgcttgaactcaagaggcggaggttgcagtgagctgagatcacgtgactgcactacagcctgggagacagtctccatctcaaaaaaaaaaaactcc

SEQ ID NO: 272659 - DNA, 276 bp, Homo sapiens
cacgcctgttatcccagcactctgggaagtcgaggtgggtggatcatttgatcaccgttctgggattacaggcaatgagccaccacacccagcctgaacaagtcacttttgatgctaccatttccatgtttacaaagtgaaaagtaaatcagtcagagtatattagttgcaaacaacagaaacaactctagctagcctgagagaaaaaaaaggtagagggttagtctcctggagagatttggggacctcaaaggaaagattatacaatgtgcctcc

SEQ ID NO: 272660 - DNA, 407 bp, Homo sapiens
gcctctacagaagtttctttacaaattgtaatgtgtaggttcgtcctttatttctttcttatgaaggtgcacgaattggctttactttctggggttgaattttgtataaactcggttgaggaggcttgtcagtttcccttctaacagtaaggtgcttgattaatgtgagagaaaaaaattaatgttggtcattttcagttacaataccaaaattttttctgcatactttactctgagttacttttatatttaatttgaaaggccattgtaggagataaattatcacattttaagttactgtaaatcaatagcttaggtagaaattcatttagtcagatccttcagatattctaggaatttccccttttcacctgcacttcacttctgtgaaaaataaaccgttcatc

SEQ ID NO: 272661 - DNA, 284 bp, Homo sapiens
acaggcaccaacttgggccaatgccaggccacaggtcagactcccaggcctgggactcctctgcccacccacaacaaccactgatgctcctcagcaagagccaacttctggctatgaacgcagcagcacccaggatacagcaaggtgaatgctaggcactcgtcccacagcctggggtgtaggggaggtcagagatacacacaaatcaaactctctcctcactatatatatatatatatatatatatatatacacacacacacacacacacacacacacacaca

SEQ ID NO: 272662 - DNA, 443 bp, Homo sapiens
ctgctccttggctatcccaaccctcttgaggcacagggaaatcaattcccctttctgaaaggcaacatctaccagtaatttctggggactccagtagaaacataccggtctccccaaagagaagagactagataaatacagccaaactaagacccgtggaaaggtcccagcggaagagggaatcgtctctgttcgtccgcccccaggaggccagacttgggacctgtcacttggaaaattctcttgatctccattccccttgtgagggcgggcccacagaagggcaaaccgtcccgggacgtgcccccttccctcgccacctgccagggacagcttcgaacgaggcgggaggacagatgcctacttcagtgttgggaagggaaaggggaaaagaaagatgcaaggacctaagccaaggcgcaaagtccctcagattgcggccg

SEQ ID NO: 272663 - DNA, 369 bp, Homo sapiens
gagctcaggtgggcttggagttgacctgtgatgaagctcgcccctgtgggtgtgaggtgtccacaaggcttcctgtcactgctgcatgtgatctgtagctggttcgcctaggctatgttttgttttctgtattttttttacatcctaagtcttaacttttctttgggatgaaaacacctttgctatctatagacacacttacctgtgtatttggtggcgaaggaaagaacaccttatgtttcttccaggtgtcttttagtcccaaaattcacaaaaatcgcctagtgctaatgtgtctgtcacttgaaagaatattgcataaaatgatttaacgtgtgaagattttaaataaagatcttgttcatgaaa

SEQ ID NO: 272664 - DNA, 406 bp, Homo sapiens
attctagatttcataacttggatatgaaactgtacttcccagtctccaaaataagcttcactgttttctggaacgtgaattagattcagaaagccccttactgcctttagattattgcagcctccccagtgggccccagggatccaggaaaaatatctttgtttttcacctagtcctctcctcagcttttagagggactcttagatctatgtttatgaaaagacttttattagttcttatagttgtagtaatgcatgtttattgtagaaaatttcaaaaatgtagatgaataagaagaataaaacaatcactcagtgtaaaaaacaaaaaaccctgaaaaagtaccattaatattctggagtatatcatccagctagttttagctgtatatacatagagccaaaaa

SEQ ID NO: 272665 - DNA, 144 bp, Homo sapiens
actggcatcaggcactgtgcatatattgtcccccactcaatcagagcatctgtgctattaatatttgctcttttttgtttgtttgtttgtttttggtaaaaggtctttattttttaaagagatccgtaataccaaaaaaaaaaa

SEQ ID NO: 272666 - DNA, 350 bp, Homo sapiens
ctcagttggcacatctataaagtggggctcatcacgccttcctcctagacaggcctaaagctggaatggtacaatgtgcagctgccaggcacattgcacagcatctggcctgtccctagactccttcagttccccctttagctgtggaggagagatggccaggcagaggtgggtggcagggagagaactgagaagccccaagctgaagggaaaacgggggagtccttggtgtccctcccttaccccctccttccatgccaagatagttgctccctgttggtttggagtcagttgcttatctgactctaaaccttcaaaagcctgggtaatgtaccaagaccccatctctt

SEQ ID NO: 272667 - DNA, 500 bp, Homo sapiens
ataataaatattagaggagaaataaatcaaatagagaattaactattgaaaaatcaacaaaactaagacatgatttattgacaaaaaaataaacaaaattctcaaatccttagctacagtagctaaggaaaaagaagattcaaataaaatcagaaatgaaagagaagacattacaaagatgcttcacatagaaaaggataacagataaaattatcaacaattttgtgccaacaaaattgataacctggaagaaataaataaattcctaggaacatacaatttaccacttctaagaagaaataaaaagcctgaatagaccaattacaaataaaaagattggggtagtaataaaaaccttttaacaaagaaaagcccaagacagccaggtgtggtggctcatgcctataatcctagaactttgggaggctgagggaggcagatcacttgagcccagaagtttaaaatgagcctgggaaacatggtaaaaactcgtatctaca

SEQ ID NO: 272668 - DNA, 519 bp, Homo sapiens
tcctttcaggtccatgaagctgattgcttttaaatgtaggtcccttaggagatgacttcatctcaatcttccaatcctctcattttatatatagagagaaacttagtctcaccatcttttataattttctacagaaattaaagtttctcttctgaattataaagtcatgataaaacgtatcttccaaaggacgtaggaattgatctgaaatttcatcaaaagtttatctcaaacgttaaatcatgatcattctggggcacttccacattccagatctacaagtgtcaaagctaagggaactgaacaaaatatatagaactgtatatctcagaaaagagaagtagcagcagttgacaggaagagcaacatcctcaattttcaagatatttacaaagtttgtgtgtgtttttctcttcctaagttccctcttcaaagaaaattattcctccccagttccaataaacttttgctgaccagcacaacctgtccacctttgctattaaagggacaaaaagtaag

SEQ ID NO: 272669 - DNA, 400 bp, Homo sapiens
aaagcagatagattatggcaagtgcacacctggctaccagtgctttctgcaccaggtcctcaagcagggaatgaagagtcttagaaccaatggattccactcctttggatgacctcctggatgactggctccaggccctggagccctcagaatatggatggagagggaaataagcagtgcaagtttgtagacttggtggctcctgcctcctcccctccctggctcagtgaggacgacccccgccactggctctactttccagctgatcacagctatttacctgtcccagtcttgagtaaggcacaaaatatttacagaaaacagatgtctttcagaggacttgctgctaagtgtaatagtgaagattacttgcattactgctactttccaatcaattaaa

SEQ ID NO: 272670 - DNA, 442 bp, Homo sapiens
ttgccacaggattaaaatggtccatgttttagaagcattagttttattctttgatgagtaattaaaaatttttaatataaaaagacacagggatcattgtgagatcaaggtaaagttgacaggaacttaaaagataaatttggttatatactttgaaaggtttcctatattctagagagttactttagtggagaggtttagtttgcaatatgggatattttcagattttaccattcagtaaatagaaaagtaacaattacattggccaattttagtcatttttctgtctcatttgagcagatctgataactttgtatgttttacaaagtgttgtttggatgtttgagttattggtcattaagagataacattttagggaggccaagacggatggatcacgaggtcaggagatcgagaccgtcctgactccatctcaaaaaaa

SEQ ID NO: 272671 - DNA, 367 bp, Homo sapiens
tggtcgagctcttcccagcctagcagccatgagtttcacactaaatcctggcccaccccacagaagggccctgggtgcacacagtcctcccagccaagcgatttggtgacgctgtgacgtgtttcaggaagttcaattttaactctgttcccacccttcgctccaggacttataattctataaattaatcctgagttaattatcccaaatgcaaagatttacatgcaaagatgtttccccaaagctttcacttggtacatccacagatacacacacccacatataaacaaggagtaggtgcaggcaacctgatgcccagcagaggctgattccaacactggacaggatgacctcaggggcatacaca

SEQ ID NO: 272672 - DNA, 398 bp, Homo sapiens
agtgtttgctgttgctgtcttgaaattttaataattttaaaacaaggagccctgtgttttcatatttcattggcccagaaagttctatatgtggttccacggtctggcattatttaacacagctgagcaaactcaatgtttcagggatttcacttctagataaaaacccaactgcagctcatatctatattcaccaaaagatattacagaaatatttatctcaacatattgtctattattcataacaggcaaaaatctggaaacaatcccattttcatcaccaatgaagaaacaaatgaattgagctatattcatacaaagaaatactacacagtgaagaaaattcatagtctagtgctataaattatagtgaactaatatcaccaacataatattag

SEQ ID NO: 272673 - DNA, 401 bp, Homo sapiens
acgcatgcagaatttattgcctttttctggccaaacctgattccaattaggttaacttcctctgttaactacctcctctcctccccaacctgaagttgtgacatgttgtctctgctgtagcgtccagatggccaaagcatggggcagggctgaccctgatgccccatgccaggcccctgcccctagcccctgcagccatctgggtccgtgtggatccatgtgggatctcagtagctgcccccttccagttccccacagaggaggaaaaacgtcagaaaagggaagtggggttaagatggtgcagacgagttagtgggtgcagcgcaccagcatggcacatgtatacatatgtaactaacctgcacaatgtgcacatgtaccctaaaacctaaagtataata

SEQ ID NO: 272674 - DNA, 309 bp, Homo sapiens
gatcctggataagaagctgagaaccatccaagagtcctggtccaaggacacagtgagctccacaatggacttgagcacgtccactccacgagaagcagaggaggaacctctggtgcctgagatgtcccatgacacaatccgacttcagcttaataggaaattgaacattttctggagagaaaagcgctctgggaatagatgagagtggagaagaggaggtctatgcctctctgtgcaatgctgcctgctgcccctggccctgcctgtcccatccccatggctcactaagcccactgtggctccctgtcc

SEQ ID NO: 272675 - DNA, 987 bp, Homo sapiens
aaaggactgtaagatgacttcaaaggcttaagggtaagccactgggcagatgctagctttgttttaggagagagaagaaatcagtttgggacatgtttatcttgaagtcctccagggcatccacaagacaaacacatctgcgggacagagatgccaggatgggcagggagctccaggacagagagatttggtagtcacccacctagagatgctggctgatgctggaagaaaaacgagagcagaggactaaactttggggaacccctagtttagaaagcaggaggaaaatttaagggaaaaaagaacgggacacaaaggagcacaaagcaccttttcaacctgctctcatatgtttcacaactctcagagactaaataacctgccaaaaggtcacaatcagcagtgggacacatgggaaaaaaaaaaaaaaatcaaggactaatggcaatgtgtaacaataaaatatctgaaatttttacccacaaaaatttaccctggagaaataaactggagaaagggggtggagggggtgtggcacataaaaagttttccctctggcattaactctaatagtgaaaaataaaacctaaatttctagctgaggaatagttaaatgtatcacaaaaagccatcataaaagaaaaaatttactacctaaacttttaaaacttcataattgggggaagaacattaaagtaatatggcaaagggtcaacatttattgattgattgacaggacagggtcttgctttgtcacccaggctggagtgcagtggcacaatctcaactcactgcaacctctacctcccagtctcaagcgatcctcccacctcagcctcctgagtagttgggactataggcatgccaccctgcccaactaatttttgtgtattttgtagagacggggttttgccatgttgcccaggctggtctcaaactcctggactcgagcaatctgacctgcccatcttggcctcacaaagggct

SEQ ID NO: 272676 - DNA, 557 bp, Homo sapiens
tccttttcaggacttggaagctaaggcccagagaggaggagaaacttgatcaaagtcaatcagacaatgcagaatcgagaaaagtacctggacctctatgcccatgcttctagcagccagcctcctaaaatacctctagttgaagccaaagttagaatccttctacgaaactacaggattaaaatggaatggttacatgacccaggcttgaccaatcagatcatccaaaccctttgccacagtgattggtccagggatacatgcatgagccagctcaggtaaatgagactcaattataagaattttgttagcgcaattgggaaaaagaagttttctttccatgagaactatcagctataagaatgttggatgcttccatctgctggagtccatgaagaaggtccatgaaaatgaagccagcacaacaacacagagctaagacatacaaagagatggagattaaattgaatggaacttttaagcccctacatgcccttgaagccagatatccctgaacttttaatttatattagttgataaagtccttctttagctta

SEQ ID NO: 272677 - DNA, 535 bp, Homo sapiens
aggtgtctggctttggcagccagttctccccagactgcgtcttgcttcatatgtgccctttagataagagggcctaacaggctaatgggagcctaatggtaagtggggctagactcagactagaaatttggcaggacgatgccccgggatctaggctgttccattactattcccaaaaggggaacaatgctgaatagagatctgaagtagaatcagcctgtccctgggacagggtaaggggagaggtggggagtgagagggctcaagacaaatgatgatacaccttgttcagatctcctcttcaaggtctctgcagacagaaaagtgccattctcggcagcccccgggacagttccacgtcaggctcatccctccctgtacccaccatggcctaaaacgcaggtttgactgtactaggaatcagggatgtttgcactcagctacagtatatctccatagccatgtgtcagtgacttcagcgttccaaaaacctggaaagaaatctgctgtccaaacaaatccgaaatatttgcaa

SEQ ID NO: 272678 - DNA, 309 bp, Homo sapiens
tcgtctgttcattcggcaaacactcatgggctgcctgtcttgtgccaagccctgtgggggccctggggacacaggcatgctccccgcccccaggtagctcagagcaggtgggaggcagctgatcactaccaggctggatgaagtgggcaggcagtgtgagtccagggaggccttcctccccgtcccgtcctggggcgagggagggctctggcagggctgaaggccgactgggcaggagggcatagaaaggaggaacattctatcccctgcgggaggaacaggaggtttccagtaccccctccctctgtc

SEQ ID NO: 272679 - DNA, 147 bp, Homo sapiens
agggtaggggtcccaggagcttgcctggggctgttgcttggagctgttctggggggaggcagggatggggtaggagggcatagaaaggaggaacattctatcccctgcgggaggaacaggaggtttccagtaccccctccctctgtc

SEQ ID NO: 272680 - DNA, 409 bp, Homo sapiens
ttcattttttatcatgagtactctttgtttattactagcattgcaagttctcccctgaggcgcagagcccagaagacatcagcgtggaatgaaaagagtcaaggatggagcccccacaggacttagcaagaatgccaagtaagggctgtataggagggtggccagcacaggccctgaggcctgggaggaaggggaagggcttggaggctttgcagaccctcagactcttgggcctcgagcagtacccgcagacacaagtcctagtgctggaatattgtgcacacatctgctgcagaatgccttgggagccaaaggatttgatgaagctcaaatcagagtagatagaaagcaattatgtttttgcatcctcagctcctgccaccctgcacctccctggggatgcacttgt

SEQ ID NO: 272681 - DNA, 624 bp, Homo sapiens
gtgattctggaatttgctatttgatacaagcaaacgaagagatggaaggggctgttcaccactcagtctgcaagcaagcctgtcgtgcccatctgccaagaggagtccttgtgtgcctccaaaatggcctggtccttaacttgatctgcttggactgattgcaaacagtggcttagcttcctctagaccagagtacattctgtgctcccaaaacagaatgctacacatgggaacaagggaaagggaggctttgagaggtcagccagcaaggcccctgcttcaagcctaaaaccaacgtaattaggtgaagattgagcaggataaggctttgcaaggaacatccctgccacgtcaaggtgatcccaggtacgtgaattggctccttttgagtcttcctacaactcttggaggcaaatagggcgggtattattactctagttctaccaagggagaaactaagttctagaagtcaactaaggaagttatgtaacttactggcggacaggacacaagaaacctcaaattcctgacatctgttccagtttttcccatcaccccatgttgcccttcagcagggcttaagcaaaacagccaacgcaagtcctagcctttccagctgggctg

SEQ ID NO: 272682 - DNA, 647 bp, Homo sapiens
gtgattctggaatttgctatttgatacaagcaaacgaagagatggaaggggctgttcaccactcagtctgcaagcaagcctgtcgtgcccatctgccaagaggagtccttgtgtgcctccaaaatggcctggtccttaacttgatctgcttggactgattgcaaacagtggcttagcttcctctagaccagagtacattctgtgctcccaaaacagaatgctacacatgggaacaagggaaagggaggctttgagaggtcagccagcaaggcccctgcttcaagcctaaaaccaacgtaattaggtgaagattgagcaggataaggctttgcaaggaacatccctgccacgtcaaggtgatcccagcattgcaagttctcccctgaggcgcagagcccagaagacatcagcgtggaatgaaaagagtcaaggatggagcccccacaggacttagcaagaatgccaagtacatcgtgctgtctcctcccgcctccatgctggtgcatatgccgcccttcctccctggaatgccctcgtcttccagaggctgcttcatttgagagccttctctgattcatccaggcaaattaacagataataactgttttagctactaaatattaaactctctcaaggcagggtctata

SEQ ID NO: 272683 - DNA, 359 bp, Homo sapiens
tctacgatggcagccccccttttcattcatgtggcaactttaaaaaaatatttgctctatcaggttttgtctaactcttgcttcctccttaagtcctaggttacatgttcattactcattaacagcttcctggtgcccagactaggttagatcaccctgttctgagctcctatatttgcctttcttagcattcatcacatactcgtagacatttgccatgagctaccttccttgtcagcctgaaggcttcaaaagtgaccctgtctgctgtgttcatcactgtacccagggggagtgtcaaaataacagaggcctagtgagtgctctataattgtttgttgaactaacaattgaatttt

SEQ ID NO: 272684 - DNA, 490 bp, Homo sapiens
agcaactgaatatgaggttagaatgtgaaactgaatttaaaggtgtaacttgggcctgactgaaatatagcaatttagcagaagtgggattaattatgtagccttacctagttgtacacaagatcaggctgggactgaaattctacaatatgactccataccaccaaaagaattccagccctctgagcagtaggaaagagagttttgttttcttgtaaccagaacataaacttttgatagtcataacctttatttcagtctataaatttagatattgatggggttcaaaacattctatccccaaatatggcaccatggaatttgagcaaacggcaaaagtagaaagatcaccctttgactttctcctgccctcctcctctgaaatcaggtcaagagcccctcatttgagaggtgctgtccctatgcccagaggaaagaacatccttatctataaagacacaaatatataaaaaataatctgaacagtagg

SEQ ID NO: 272685 - DNA, 202 bp, Homo sapiens
ctcaatcccttccactggtagcaaaggccctggatccctgtcttctgccaagatggtgccaaatagctcaaccatacaaaggaaatggatataaaacttaattgggacccagagacatctaatctctaagttaaagcaccactccttttactcataaccattggaggcatcccaaagtctagaaaagccgaaatgaccctca

SEQ ID NO: 272686 - DNA, 369 bp, Homo sapiens
gcatgtccacctgcataattatgaccagtgtattgaaagcacatttcatttagttttgcaacagccgatgaggtagattctaccaacattgttttacggaagaacaaatggaagcctggaaaaataaattgtctacctcacacacttcgcaggtggtaaacacaggatttgaactaagacatacttgattttaaagtgtttgcttttcctttgcactactgcatctgcgatgtttgcactcagacactctagaatatttggtgttgcatgtttttgccccaagaaagaacccattaaaatgaaactttccagttcgtaagctttgccctcaagaagggaaagaacttcttgcaaggtttctgaaacaaa

SEQ ID NO: 272687 - DNA, 249 bp, Homo sapiens
ttgtcattttaattctttctttaagaaaagactcgggaataaaacaatggcatttttaagaagaaagacacagtcatcccagggtttaacagcagcagcctctcaaagaggccgtaaacaacaaggctgtctctatccgcccgttgtccggtgtctcggacctcacaggagcccttttcaagcatctatttattggccacgcacattgtggcccaaacaaagctcgcctgggcctaaccccacacacca

SEQ ID NO: 272688 - DNA, 152 bp, Homo sapiens
tggggagcaaacttgattatgtttaaagtcacatacttggagagtttatgattttatgtagtatgagagaactcttctagctagctaacattaatgaaggggtctggacatatgattctaaatttctgacaggtagtaactttaaaccagaa

SEQ ID NO: 272689 - DNA, 459 bp, Homo sapiens
cattattagccccaattttagctgaggaaactgaagctcaaagagattaacttacctattcaatgtccacagacggcaggtagagtcaggatctgaatccaggtctttttaattctgtgctctttttactatatcacaaataaagttcttttatctgcattcttttaaaacatgtttttggatattagagtaatacaaatatcattctagaaaatttggaaaatataaagcagtataaaaggataatgaaaataaaaatcagttgtgatcttgccacctagaaacaatcactgttaaaatgttggtgtatttcttctcaattttttttcaatgcatataatgaaagcaaaagcaaatatttgttgagcacttgctttgttccagacattgtccttagctcctttcttgtgtaatttattttattatcatagaaaatcaataaagtgagtattgttatta

SEQ ID NO: 272690 - DNA, 423 bp, Homo sapiens
gaagctgcatcatctaatattctgttctcacttatttggcaaacattatttgagtgttgctatgtgtcagatacagtgctaagcagggattacactgtgaacaagttaggatcattaggcacaaatccttaaggaggttatactccgatgtatgggtcacaaactttctgttaggggccagacagtaaatatttaagctttacaggtcatttggtctctgtcacaactactcacttctgtcttgtatcacaaaagcagccataggcaatgtgtaaagagataaatgttactctgttccaatacagctttatttatggacacatttgaatttcatataattttcacatgtcacaagatatttttttgtttgttttcccaaccatttgaaactgtcaaaataattcttagcttgcaatctattat

SEQ ID NO: 272691 - DNA, 389 bp, Homo sapiens
atagtgtgcaccagaaagccagtgcccggttccttgggatcttagacacggtatcagaatcttaaactagcagtccagaaaatcctcagtcttcttctatgagatatttccaccattcatggtgtaccccgcatagatgtttgttcctgtactcctatgatacccttcagtgtttggggaacacagcattgttggacctataggggagactacaggtttccaagtcattatctatgtttaaattctgctcccctcagacaagtacttaattctttaagggttcctttaagggattctttaagattactctaagatgcagagtaataactacctttccgggttgttgataatattatcaataaagtgtgtaaaacacctcaaacagtagt

SEQ ID NO: 272692 - DNA, 510 bp, Homo sapiens
gccccacctcccacattggggattacaattgaaagtgagatttgctgagggacacagatctgaaccatatcaagacaatatagtgagaccccatttctacagaaaacttaaaaaattagtcacttgtggtggcacatgccagtagtctttgtttcttgtgaggctgaggtggtaggatcagttgagcccaggagttaaaggttacagtgaattacgatcataccactgcactacagcctgggtgacagagtgagaccctactggaaaaaaaaaataaaccaatattgatccattattattaacccaagtcatattttattcagattcccatactttttagctgatgggagcaagatgcgcgcatgttgcgcccatcagcagaagctcaaaagacagagaatggccataacctagaaaaatctaaaatcgggaaaaactctcccacccaaagagccaaagaggtgggcctgcacagcggcaagtgctgctgtgcacagaagacaggaaccg

SEQ ID NO: 272693 - DNA, 459 bp, Homo sapiens
acatccgagattctgaattcttttatcaggggtgtggcctgtgcattgagagtttttaaagctctccaggtgattttaatatgcaattagatttgagaaccatgattttagacttaaggggctttagaagtaaatgtctttaaattctgtgataatacatcattcataggctattcaggctgtactaaaacatagagaaaaaacaaagacaattattgagttcattttatgaagcaagaacaatcttaataacaaaagataaaaacctttaaaaagacgcgaagctatgatctttttatgaatataggtgtaaaatcacaaaatattataaaaatattttaaccacatattaaaagagtaggctaaatagaatttactttaggaattgaagaatggtttaatattgggaaatttattattgtaatgcctgggcaacagagcgagactccgtctccaaaa

SEQ ID NO: 272694 - DNA, 384 bp, Homo sapiens
cagcaagagcccaagacttgttttgcatactaactttattcctgacttcatcttattttctctaaccttattctcctttacctgattttccttacctaataattttatcatatactaccttgggtataacagtaaatctcataaaatctcttttgaaaaactaaaaaaataaatacaaaatacaaatggaagttaatgtatattataaatagctctctaatttatttgtaatgtgcaattccctaacttctttctaaggcaagcccctacatttattctcttgattccatcctttcccatctcctctgcaccttgctcagctgcttatttgtgttccttttcttatggctgtctcatccacaggatcctccactcagaaatatt

SEQ ID NO: 272695 - DNA, 644 bp, Homo sapiens
gagatgcggccgcttcgccctctgcagtcaagatgctgggcgcgtcgaggactgggatttcaaatatgcgtgcattagagaatgattttttcaattctcccccaagaaaaactgttcagtttggtggaactgtgacagaagtcttgctgaagtacaaaacgggtgaaacaaatgactttgagttgttgaagaaccagctgttagatccagacataaaggtaattaattttgtgtttgatcattagcaaaattattgccactttatacagacatagtttgctctttgggtcccattctgttctgcagaacttgctctctccatggtcctcccttactttaatctggtggttctcaaccagggacagttttaccccctagaagacatttggtgatggctgcagatatttttgtcacaattgggaggaaagggtgctactggcatttagtgggtgaatgacagagatgctgctaaacatctcacagtgcacagggcagcctcccataaccaagagtgatccagccccaaatgacaacagtgttgaggctgggaaaccctgctctaatgcttcctttctattagattactacctctttcctccatgctgcatgcaactcttttgtctctttaaagctaaaacaaacca

SEQ ID NO: 272696 - DNA, 735 bp, Homo sapiens
gagatgcggccgcttcgccctctgcagtcaagatgctgggcgcgtcgaggactgggatttcaaatatgcgtgcattagagaatgattttttcaattctcccccaagaaaaactgttcagtttggtggaactgtgacagaagtcttgctgaagtacaaaacgggtgaaacaaatgactttgagttgttgaagaaccagctgttagatccagacataaaggggatgaccagatcatcaactggctgctagaattccgttcttctatcatgtacttgacaaaagactttgagcaacttatcagtattatattgagattgccttggttgaatagaagtcaaacagtagtggaagagtatttggcttttcttggtaatcttgtatcagcacagactgttttcctcagaccgtgtctcagcatgattgcttcccattttgtgcctccccgagtgatcattaaggaaggcgatgtagatgtttcagattctgatgatgaagatgataatcttcctgcaaattttgacacatgtcacagagccttgcaaataatagcaagatatgtaccattgacaccgtggtttctcatgccaatactggtggaaaaatttccatttgttcgaaaatcagagagaacactggaatgttacgttcataacttactaaggattagtgtatattttccaaccttgaggcatgaaattctggagcttattattgaaaaactactcaagttggatgt

SEQ ID NO: 272697 - DNA, 467 bp, Homo sapiens
ctgtggacccagctacttgagaggctgaggcagaagaattgcttgagcccaggaattcgaggctgcagtgagctatgactgcaccactccactccagcctgggcaacatagcaagacccctgtctgtaaaaacaaaaaaagtggtatagtatctacttggtcctgcccatttagcaagcatgagatgctaaagctctcattatttgttgctaagttctctgtgaatctgagtcagctggttattttccctcttcacagaggaggtatgtgcttctctgtgcttggcagtctgggtgaggagcaaggtggcgaggtgctactaaggccaaatacaaggtctgcctcccttccatgacagtctgcagacatggtttcagggccaggtctgggcactgcttgaaacagtactttctgaaggaaagtatcacagaaggaaactgccttgtaagaataaaaggagaacttca

SEQ ID NO: 272698 - DNA, 461 bp, Homo sapiens
aggccaaggagcaaaaagaagaggtgacctgtagactatatgatcaccaggcaagcaaggggcggggcccaactcatagtcctgcgctcatttaggggtacaagagccttcaagctcctttagtcattcagcttatttatttattctattaaacacaactatattcttaatgtatattattcaagccatacataattagtgggagcaaaaggtgaagtgtccactactctcctctcgatgccacttctgttctcgatgccacttgactaccgcaatgagacacctgaagcaagaggcagatgtgattgagttaaggctcttgagatgggggaattattctagatgctcaggtgggccccaaaatgtaatcacccgtgtccttatcagaaggaggcaggggtggatttaacactctcaccccttttgctcagcattttataaacctatgtgtatttgcacaa

SEQ ID NO: 272699 - DNA, 375 bp, Homo sapiens
cattttcttggagattaacatcaggatcctcttgatttatgcaaatttatgcagccagcctgaatttctccccagaaaatgggtttttatttttttaaccacatggtcaagttgcaaattttccaaacttttaatgtcttctttccttttaaacataaattccaatttcaaaccatctctttgtgaatgcatgtgactgtacacttttagaaactgccaggtcagggcgtggtggtgcatgcctgtaatcccagctacttgagaggctgaggcaggagaatcgcttgaacctgggagctagaggttgcagtgagccaaaatcacaccactgcactccagtctgggtgacagagcgagactccgtctcaaaaaaaa

SEQ ID NO: 272700 - DNA, 225 bp, Homo sapiens
taaataatgagatgaactaaggatattcccctagataatacttaagtgacccttaccccaaaatagtattgaaagaatgtactaccatcattttaccttatttttgagtttctgatactttttttcagagtctcccctcaccaaaaattgttcttttttaacttgtattttaggttcaagggtacatgtgcaggtttgctatatagataaattgtgtgtcatggg

SEQ ID NO: 272701 - DNA, 381 bp, Homo sapiens
gccataaaaaatgatgagttcatgtcttttgtagggacatggatgaaattggaaatcatcattctcagtaaactatcgccaagaacaaaaaaccaaacaccgcatattctcaggatagtattgggagatatacctaatgctagatgacgagttagtgggtgcagcgcaccagcatggcacatgtatacatatgtaactaacctgcacaatgtgcacatgtaccctaaaacttaaaagtataataaataaatttaaaaaaaaaagattacaagttcttcagtgtaagcaaaatatcatggactcaaaaagtcatgagatgtgatcaaaagccaatgagccagaaaaggcaaatatggctgtacaagttgctcatttctgtga

SEQ ID NO: 272702 - DNA, 433 bp, Homo sapiens
ctttggaaaataggaattgctttgcaaaaaatactgagttttcagtgaaaattaattacactataaatctgaaagtaatattttctaatacattttctgtaactaaattttacacttttcacatattttatattttccttaaaaactttccaaattgttgtttttttttctgagtgttgcttaaaaatcatgtttttgcaattaaactaaagagcttctgcacagcaaaagaaactaccatcagagtgaacaggcaacctacagaatgggagaaaatttttgcaacctactcatctgacaaagggctaatatccagaatctgcaaagaactcaaacaaatttacaggaaaaaaacaaccccatcaaaaagtgggcaaaggatatgaacagacacttctcaaaagaggacatttatgcagccaaaaaacacatg

SEQ ID NO: 272703 - DNA, 562 bp, Homo sapiens
tgcttcaggaaggaaaataagcacatgtcaacttgggtcagatcaagcatttcaagagtagtgctcacagactcttagtaagaataaaaagtaaaaaccagaacagaatagttcttacaaaatctaccttcataaaccagaaataaacatgataagttagcctctaatgtaagttagaggcatgcataaaatgcatgaaatgcaactctggttttcaatagtttctttgccttttaaaacaagtctaatgattgaaagccttggcccctttgatttttaaatattgcgctcaaagcgatcatgccacagcgatgtcaaaatatgaaaactaagcatgcataaaacaaaaggtgaatgagaacagagatgtaaattgggtaggtgacttggtcaagtccatagagctcatcgagagcacagccagaagaaagaatgggaaaagttcaagaattccattgttctcactctcctaagattgaaagaatcctaatatgacacaagcaggtcagcttttaaacttaacctcagaaatagtatgatttcaaagacaataatttttctt

SEQ ID NO: 272704 - DNA, 360 bp, Homo sapiens
ggtgatgcaggcactcttttaacttaacaagtggcattactcaaagttgtgcatttgccaggagctctgcccagctgccttcgttgtttggagagccaactgcttgactcctatatgtaaaattctgggggcaagcattctatcttcatctacccccaattcaattaagcacttggccagacattgggcaggtcccaaactcttcatggtgacattttgctcagtctgtggtagggtcatctgaacactcgtaggtcctggggagcgcttcattttagacaatcctgacattctatttatattcaacaagtctgtatcacttacgaaataaaatatatccagagccatagaaggaaaaag

SEQ ID NO: 272705 - DNA, 201 bp, Homo sapiens
aaatattctccatggtcttcatggcctaatggttttaagttatacacacagtatttcacttaaaatattatggaaagcagcacctggagctttaaacaagttacttagtttatatctgtagtttataaatcatgatgtgttaaactttattatgatcttacaatttgaatttaattcttttataatgtctctaggtcctcc

SEQ ID NO: 272706 - DNA, 564 bp, Homo sapiens
agttatgggctgacattcatggtcttgcaggcaaaactcaagttcctaggtaggactgagaagtggcatgagccactgtgctcagcctcagtttattttttactcataaataactcagatttgatttcttcttatgggtttgctggaagtaaaaatcacattcacaaccactgaagccagacatttgattactcttaacaattaacagtattatttattaggaaagtaatgctgtaagagtcagcaaaatggggcctggcttcccggggctttgtcctagtcagcaacttgccttgcactgccctcttcctgccacctgtgtccagcctgagcaagaaaagatctgatgctcagggaatccctcattgggaaaatttaaatatggaccgtatagtagatgataatattgaaattaggttatctttttattagatgtgatgatggtaatgtgataatgtaggtgaatgttcttatttttaggtgaggcgtggggaatgtttccggatggaatattctatgtcttcaacttactttcaaaaaaacaatacagcaagtcctcaaata

SEQ ID NO: 272707 - DNA, 398 bp, Homo sapiens
aaaggaaagagagaaagagacaggaagtcaaagagacagagaaagagacagagagaggaagaaacagagagtcaaagagaaagagacaaagagaaggagtcagagagaaagagggacagacacagaaagtcagagagtcagaaagagaggaagagacaaagaagaagtcaaagagaaagagagatggaagtagtaaggaaaaaacagtgtatcccattcctttaaaagccagagtaaatttctgtctacccagccaaggcatgtttttcttaggtggaacatcaacctatatctgcctccccactaactggacgggcacctgcaccttagtctttctaagtcccaacattaacattgccccaggaaatcagaccttatcagtacccctcaaagctcaa

SEQ ID NO: 272708 - DNA, 413 bp, Homo sapiens
ccctttaataacctgcagcttattgggaagcctctgcttaagtcatgtctagggatgagggcctcccctgaggagtggtgacactttttggacagggttttattgttggaattctccccattaagttaaagccttttatcaccaaaccaaaaggcactgcctcagtgacccttattatgatccataaggcacttctataactttcctaggtttacaataagaacaggagtgtactatcctaattagatattaaggcattagtgttactagttctattaataccattattttgaccaaaatcctcaattccagacagatgtctactttcctcagccatttatctttctcaggctgtgctttcagacaagtatctttatattatatgtagaataaaaagagaattagactaagag

SEQ ID NO: 272709 - DNA, 116 bp, Homo sapiens
caagaaaagggctttacttgcgctggagaagacttccgctcatgcacggccctcactaacttggagctgagctgcttgctgtacacgagctgtgcacccaagtgagcctctgtagt

SEQ ID NO: 272710 - DNA, 652 bp, Homo sapiens
ttgggaatagaatcaggagcccagagccacggagtgggaggatgcacaaataatagcatcaattaacgtgttattgcaagagaaggtaagtgctctgaaggaaagggtcaaggttctgtgagagtatgtaacaaaggaatgctaagagtttcttgcaataactcttagttacaataatttgtggcgcattcttgtaaaattacagcttatacttctgtagcacttgcactttataaagcactttcatccgtattatttcacttgctttggctgcgcaatagaatatttattatgatgatgtcctcttacagacacagaggcttggagaaattaagaaactgggtaagttcctttacaagtaagcggcagacagaatttaaacctaggtctgtcaaattccctacccctactcccattttgggcaagattttaaaaaacaaaatatttcattcacacggaaaagtagaggataatataacttctccaggttaagaaacaaacatcacctatacatttgaaaagccggtatatcccttcctgagggcatttccctccttcctttctcagaggtcaccactttgctgactttggtatttatcaatcccatgcctattttaatactttacatacagcatatatccagaaaggaaaa

SEQ ID NO: 272711 - DNA, 427 bp, Homo sapiens
acttaaacacaaaactccttcgagcactggttctcgaagtgtgatcctcagaccagcggcagcaacagcacccatgacttactaaaaatgtgcattctgtggctgggctcgacggcccatgcctgtaatcccagcgctttgggaggccgaggcaggaggatggcttgagcccaggaggtcgaggctgcagtgagccatgatcatgacactgcactccaggctgataacagagtgagaccctgtctcaaaaacaaaacatattctgagaccggaccccagactcactgaatcagaaattctaggggcaggacccaggaatctgaggggtgtgagtgtgtgtgtgtgtgtgtgtgtgtgtgtgtgtgtgtgtgtgtgtgtttgagatggagttttgctccagcctgggcaacaagagcaaaactgtccc

SEQ ID NO: 272712 - DNA, 405 bp, Homo sapiens
caagaaatgttatttttaaaaacatttgatatatactcagtataacaaaaaatgtaagatgtttctatgtacttttaactgtcatcaaataggtggaatatgtttagtgatggctgtactgctaggggaaaaagaatggcaagaaaaatagtaggaagagaggattttataaaggtagttttaaaatattcaaatattcaaatattcgaggtatattatgaagaaaaatacaaaaattccagcatcttttaaagtagtattgattactgtcataaatattgttattttatcccagcgtgcatgaatgtgtttgtgttctccccacccgcttctttctttctctctctctttcaaaccagaaatatgcttactctctgagtatatgagtaacacatgcctattgta

SEQ ID NO: 272713 - DNA, 455 bp, Homo sapiens
ttatctatatctgttccaaacgggaaataatccaaataccagtcaacagtagataaagattcttgaacatgtttgacttgtatattcttgactttttaatgtggaaattgagacctcaaactcactataccataggggtggaattccagcaattctctgtacaacccctgcacaattccaagaagaaggcaaaagaagagagacgtggatattttgcttagttagccgtcttgaactttcccttatttttattcctctgcttttaggaaatcccacttgaaaagtagctattttctcctttgcaagtctatctttttcaacaaaaatcttaagcaaaatataaaaagccaataccaattgattcctaaaatgaatctatcaagtttcactttttttttttcctgaggaagccgagcatattgactcattctagaccctaaaaatatgcctacatc

SEQ ID NO: 272714 - DNA, 283 bp, Homo sapiens
aaagggcaagcaggcgtggggaccacagtggccttactgtggagtcagacactctgtgcgccaggagttcccaacatgctagtcctgaaaatgcaatacaacaagaacacagtctgaaaacctgacactgaatccatgggacaacccagaaccaatgggtgctgcacccacataccttctgctcaggggaagggcccgtttcaaggagcacaaaggcaaagcctcaccagatcagaggaaaagaggcaaagggatgggacagttcccaacaggctaataagaa

SEQ ID NO: 272715 - DNA, 270 bp, Homo sapiens
actgtaaactttaacaaaatttggtgttgaaacagctttaggctacatggaaaatacttgagtaactatagaaatatatgctgtcaaattattatatgtgatataatttaatatcctgtatttatattcatgttttatagattttatttattccgttaatttttgtttctgtcaaaatttgatgaaagaaatgtttctcatcacgtataaattgatgatcttctgactaagcctatttggtagccccagattgagcactatgaagttttt

SEQ ID NO: 272716 - DNA, 385 bp, Homo sapiens
aaataatcaacaaaaaaattacctccaccctaaacaatagagatttgtctcatatatatataaaacatttaggggtgggcagcccagagatgctgccactgctggatgatgccactagggatctagaatcttttcatctcctcacactgtcatactcagcctgtaagctaccctcccagatttgtaccctcataggaacaagatggctgctgctctgccaagcctttcatccatgttccaggcagtaagaaaaggggaagacaatagggcaaagggagaaacaggaacaagtgtctgtatcaagaaaataggcgtgagccactgcacctggccctttatttgttttttaattctccctaagaagtttaaggtacaaataatcaac

SEQ ID NO: 272717 - DNA, 393 bp, Homo sapiens
gccacaccttcgcctttgccctagatgggccttctgcctggaatcctgtgccctttctcctactctctcggaagctgtcttccttagccatcagaattattcctgattcgggccaagcacagtggctcacacctgtaatcccagcactttgggagtccgaggcgggtggatcacctgaggacaggagttcgagaccagcctggccaacatagcgaaacccggtctctactaaaaatacaaaaactagctgggcgttgtggcatgtgcttgtaatcccagctactagggaggctgaggcaggagaatcacttgaacctgggaggcggaggttgcagtgagccgagatcgtgccactgcactccagcctgggcaacagagcaagactccgtctca

SEQ ID NO: 272718 - DNA, 490 bp, Homo sapiens
gaaagcaatacacccactgcaaacaaagtatttcactttacgtagtgcctgccctttagcagaagagggatgctgacaaaatcaggtttagctgaaaggatcaagactaaacgtttcatttccaaagtgagggaatgtgagtcgttgaacctaaacttccatacaataaattgctgcgtgcgttagtttctagctcttaaccttaagtttctatgttgaaagaggaagtcgaatacgtaagtcattgaactgagtcagaacctccgtatctggcagttgaaataaagaccctgtgtatgacttgttgcaagggatcaaagtaaaaagaaccctcggtgtggggggtgggggggtgggggcgtgagggaggtgtgcagcagaaattaaatttaaaaaagtattaacagagttttggatagagggagagaggggattggagtggtccctgatttggagttggtgaaaactaaataaagaaaagtttatattg

SEQ ID NO: 272719 - DNA, 331 bp, Homo sapiens
cccccaaggtgtccagttcgacatagcttttaacatagcttttcaaggccaggcgtggtggctcacacctgtaatcccagcacttcgggaggccgaggcaggtggatcacaagttcaggagattgagaccatcctggttaacacggtgaaaccccgtctctactaaaaatacaaaaaacaattagccaggtgtggtggcggtcacctgtagtcccagctactcgggaggctgaggcaggagaatggcgtgaacccgggaggcggagcttgcagtgagccgagatcatgccactgcactccagcctgggcaacagagcgagactccgtctca

SEQ ID NO: 272720 - DNA, 207 bp, Homo sapiens
tgtatcacatgaggctcttaaggctaaatttaagttataagggtctgcagatgccctcaaggccgactttgactttggtgttcgtacttctgtgagtagcttcatggtttccagtttgttattctgatagaaatactaatattaaatgtcatttctgtattttttataatttatacttaaatatttgattaacacagcttacatatt

SEQ ID NO: 272721 - DNA, 573 bp, Homo sapiens
ctgagaacacacaggcaggcaacaccttaaaatcccatctcagtcagcaatgactcctcatagggccaccacgagcttaaatgtcacttaaatgtccctatttgccagcctggacttcggtgtggtgatatcatggtgcattcccaggagggaagtgcttggtcaagacttctgcttgggttcgactgtcggttctggtttcacatgcactgtgtgaacacgcttcatacagagggtcagcaccgcactgtgtgaacatgcttcatgcagagagcctgtactgcaccaggtgaacacacttcatacagagagtcagcaccgcaccgtgtgaacatgcttcatacagagagtcagcaccgcactgtgtgaacacgcttcatacagagagtcagcaccgcaccgtgtgaacacacttcatacagagagtcagtactgcaccgtgtgaacatgcttcatacagaagatcagcacctcactgtgtgaacacacttcatacagaaggtcagcaatgcaccgtgtgaacacacttcatacagagagtcagcactgcactgtgtgaacatgcttcataca

SEQ ID NO: 272722 - DNA, 416 bp, Homo sapiens
catttcctctgtgaagtcttcctcactttccctggcggagcaagtttttccttttgtagcacttgatacgtctcatcttttaccaccttctcattgtattataggtatttacccacatgtttatctagtttagtggttttcagccaggggcaattttgccccactttggatgtttggcaatgtttggaaatatttttgtttggcacatgcgagtagagggtggtgctggcagctagtgggtagaggctatggagttgccaaacatcctacaatgcacagatggctctccacaacaaagaattctccctctctgaatgtcaggattgctgagattcagaaactgctttgtccatgacatttgagggcagggagcttgcagctacacatataagacataataaatggtaaacatatca

SEQ ID NO: 272723 - DNA, 665 bp, Homo sapiens
gctgtcaagcagagagctaaggactgtgcgaagcaactggtgtgaagcgttatccaagggccggggcaatggctcatgcctgtattctcagcacttcgggaggccgaggcaggaggattgcttgagcccaagagttccagaccagcctgggaaacaaaatgagaccccctctttgcaaaaaaatacaaaactagccaagcatggtggcacacctgtggtcccagctacgtgggaggctgaggctggaggatcatttgaacctgggagcttgagactgcagtgagctatgatcgcaccactgcactccagcctggaagacagtgagaccctttctagtaatttctaatttctatatatatataatcacacatcctggcagggacatgtcagccacgcgtgtggggggcgggggaaggggacgcacatgcccgcaggcctaggaaccaggcagcaccagctcacgtctgggggccatggggacctgggggcaatggttgaggactcaaaaccgacgccacccagctgaaaggctcccactggccagagctggaacagctttagtcatgaaactaacagtattgaatgtaacccaaagtacaaaacaaacatctctaagtccacgctgccgaaagtatttggataaattaataaatgagagaggagac

SEQ ID NO: 272724 - DNA, 348 bp, Homo sapiens
ccaggagacagtttggctgagggaagtaatggaagatcagtgtgtgccggaattggggcttggtactgaggtaaggtggagggagatgggagaggctgggcttggctgcttgcttggtggcgtgacctcaggcaggtcactcaccctcggcaagcctcagttcctcagctgtagcgtggcgccaggctaaccgatgcctttcttcctagctagttgaggactggcaatgaagaagccactattttatgtatttatttagagatggggtcttgctatgctgcccaggctggtctcaaattgctggcctcaagcccattattttgaacataaagctttaaacaaatgtca

SEQ ID NO: 272725 - DNA, 312 bp, Homo sapiens
taaatgaaaatgaaaatatgactcatcaaaatttgtgggttgcagcatacccacatttggtcattagacaacatacttccaaacaacacatgggtcaaagaagtctcaagataaattttaaaaaatattttgaactaaataaaaatgaaaatatggcttatcaaaatgtatgggatgcagcaaaagcagtgctagaggaaaatttatagtattgaatgaatatattagaaaagaagaaatatgtaaaattaaaaatctaagcttccaccttaggaaactagagaaagaagaattacataaacctaaaacaga

SEQ ID NO: 272726 - DNA, 430 bp, Homo sapiens
ccctaacaaatggccacaatcaactactacaaatttctcctaattagttttagtctgcacttctgtcacctttaggagagagccaaagattttaaccttcaaaattatcagcaatgcatgtcagaaagcatttcaaagaagagtcaaagtgcatgtagaaactaattgctgtatctgaaagtgctgtttgaagaatttttcagtcttcagagaagcaagttccccaccccttgggaaaactagtcttcaaactaaaagtttccccaaatcatatacctgagaaaaatgttaaaacagacttacccaaaaaggcaaagaaataaaactgtaagaataaataaatcagaaatcagatgtctctcccctgtttaaaatcctccaacagcttcctactttacttggaataaaacgcaattcctttaccatcacc

SEQ ID NO: 272727 - DNA, 457 bp, Homo sapiens
tttttagtagacacgggggtttcaccatgttggccaggctggtctcaaactcctgacctcaagtgatcgcccaccttgacctcccaaagtgctgagattacaggcttgagccaccgcatctggcctattccacttttttaatgaatgtgtttacagctattaatttctctcagcactgttttgctgcatctcatatgttttggtatgctgtgtttgtattttcataaatcttaaggtattttccagtttcccttgtattccttctttgacctattgttgttgtttaaaagtgtgtggtttaatttctacatatttgtgagttttccagttttccttctgttattgatttctagtttcattccattgtggtcagaaaatatattttgtatttcagtctttttaaatgtgttagtgtttgtgttgtggcctaacatacagtctgtcctgtagaatgttc

SEQ ID NO: 272728 - DNA, 303 bp, Homo sapiens
aagaaagcagcagggcatttttaaagtgttgaaagaaaaaactgtccatctagaattctgtttccagggaaaatacccttcaagaatgaagctgaagtaaggccattctcaaataaagaaaactaagggaattcatgggctgcacacctactctaaaattagaattgttaaagatcttcagacagaaaggaaatgagactagaagataacctggaacatccgggctgaaggaagagcaacagaagttgtaaatataatagactattcttctcctcgagttctttaaaacatttctgacaattg

SEQ ID NO: 272729 - DNA, 534 bp, Homo sapiens
aagactgagcattagactggattttttcaatagtcttagcaggactatggttaatgtgaactacagtgctgtttatgttgtcttgaaaaattgtactgatggtaaaaataaacaaagataaggggatgagatactgtaatcatatgggagatcttgaattaaagagttatctaatcaatgacataaatagtattaggaagtgaaattgatacaaacataccttgttttttgtcctttgctttattgcacgtcacagatagttttttacaaattgaaggtttgtggcaaccctgcattaagcaagtctgttggcaccattttcccaacagcatgtgctcactttgtgtctctgtgtcacattttggtaggtctcacaatatttcaaacttttattactattattattattattattattgttatctgttatggtgatctgcctttagtatttttgatgttactgttgtaattgttttggggcatcacggaccacaaccatctaagaagacaaacaataaatgtatttgttctaac

SEQ ID NO: 272730 - DNA, 397 bp, Homo sapiens
ggcttctgcctccatcccaaatcctgcctgcacatctgggaggggaggaaaagacccccatggggccacaacagatggggacagggtgggagcagagggaaaggaggagaggagaggaagtcaagaagaaaaataaaaacaagcagcagagaccatctgaatcccgggaggcaggcaacatgcaaagcccagagacacaaccggttcagctcacgtcgcaaattgagtgctgccagaagccagcaagccaggagggacggaggagcgagggccacatggctgtgtcctttcagaccgtgtaggacaatgctcttccagaccagctctgaactggttcctgaggtcagggcagacactacactgagggtcactggagcaaccagacagaagctggggc

SEQ ID NO: 272731 - DNA, 296 bp, Homo sapiens
tggtgagggccttcttcctcatcataacatggtggaggacatcacatggcaagaggtcaagagcttgccagctcagatctctctttttcttcttataaagccaccattctcatcagagggcctcatctgatggccttatctaatcctgattttttcccaaaggccccaccttcaaatgccatcaacacacgaatttggggattaaatttccaacacatgaaatttgggggacacattcaaaccacagcatgccaaaagtctttggcatcaatagtgaccttattcatgtgactgca

SEQ ID NO: 272732 - DNA, 269 bp, Homo sapiens
aaacattcagattactactgtaaactctgttaactttttttttttaaatagaggttcaggaaaatctcaagaaactgaaatttagaatattggactacctataaaaaagcagtataaagggtgcctgaaatcgaactgctcactgacatttgtagggaggtttgatttataacaaataagttgatcaaagaagagtgattgttccaagttagagatctttgtgtgggttagggagtccgattgtaattggatgggaaataaatattttt

SEQ ID NO: 272733 - DNA, 510 bp, Homo sapiens
tggttttctagagaatgaagatctagaaaacaaggatacctctttattggcttctgccaccgatccagaaccctgctcctcaccccacagaggccacagatggtatctccagtgagtaaggatgccacggaagatctgcggaaagcaactggtcctttggaggctcaggccttggtgaaacaggatttgctgcctgcagaccaggcccaggtcctcaatgagatggctaagtatcaagttccacagaggtctggggacatcgttatgatccagtctgaacatacaggagctatagatgttctttcagctgatttggaatctgcagatcttctgggggaccacaggaaagtctccccacctctgatggctcctccatgcatctggacctttgccaaggtgaaggaattcaaaagcaagctgggcaaagagaagaacagccgtctggtggtgaagcgtggtgaggtggtgaccatccgggtacctactcatccagaggggaagcgtgtctgc

SEQ ID NO: 272734 - DNA, 341 bp, Homo sapiens
tcttaatgtgatttaaataccgtgactgagttgcattcagtatctgcctggtcaccaagtccaatgcgacatcctcctctatagagatgtattctagcaaaagacttctgcatccaccatctggccccagactaagaacacatctcactgaatgacacataacccagtgggatgcaccaaatttgcttaaccatgagcacatcatcttctcataacaaaagctgaatatgaccctaattttatattctgtaaactctgttgtggaaattattaaaacaactgtcttctgggtagtcctgtaaacattcactgatcttttttcctttattgaagccacaatt

SEQ ID NO: 272735 - DNA, 437 bp, Homo sapiens
cccggtggggcgccgcgagccgactgtcggtgtttgcagaagggcaagtatagtttaggagcgtcctgaagttccaggggcaaataggcccccagatgagctaagttgtaagcagaacgctgttcctttggccaaggctgttgctgcacgggcttttcaaaagcgactcattatgaagaagaataaatatgtgggctcatgaagcaaaattatctttgggatgaggcaggttcacttggtagactactggcagtggcgagagaagggaaatgggggctgatacccagccgtgggctatgtgggtggggctctatatatgtccatacaggggtaactccgaaggttttaaaaatgagtaaggaatcattaacaaatatttaactgtcttcctagtgccagaaataaccaccttaaatgggaaacattttagttgagca

SEQ ID NO: 272736 - DNA, 601 bp, Homo sapiens
ccctgcctcctccgagctgcctcctgatacccacttcctcctcagtactgtgcagggagggagccgcagctacagaggatttcatgttcccagcacagctgcttgctggctctgctgtttcaggcaagttagttaacctgagtctcaactcctccactcatcctgcacatgtttattgagcgtctgctatgtggaacctacattctagccggggaggcagagagggtgtagtaacctcagtaagcagtggcagtggaaatcatgtttggaggtgacccatcctaaggagctggataagggcgattggaagtcggggcagctgaagtgggcaggcagcagtataaaacagggtggacagggctgggcatggtggctcacacctataatcctagcactttgggaggccgaggcaggcagatcacttgagcccaggagtttaagaccagcctgggcaacagagggagaccccatctctacaaaaaatacaaacattagctgggtgtggtggcatacacccgtagttctagctgctctggagggctgaggtgggaggattgtttgagcccaggcaggtcgaggctgcagtgagctgtgatcgtgc

SEQ ID NO: 272737 - DNA, 462 bp, Homo sapiens
actgatcctgagctccccaggcaagcagcatgtgggtaaggacggttctccgtgttgtggtcaccacggggtaaagagcgcctccaaaatgattatagaactggaactgcagtacagtgggagtatttgtccattttgtaaaggacaaagcattcctctaaaaaaaagtgagcacaataaaattcccacgcaaatgcgagtgtttaggtcaaattgtgacctcctgggtattatttaggcgtttacatatacattatattattacttccaaggaattccaaatgtacttaaaaaaataaagttcaaattaaatgaatatatatgtatgtacacacacatatatacacacatattcatgtaatcattccctatgagtttatcatagttgtgttaataataaattcttagttaaaattcacccccacataccttaccttacattaagaagaaagaaatctgaaa

SEQ ID NO: 272738 - DNA, 1142 bp, Homo sapiens
gtgagaacctcagctgcaagtgagactggaaaaatggctctcagagttcccgcctctgcagtagaggaagacactccagaaggagttgagaatgggtgctgagtgcctcttcaggatgtctgtcacacctcaggaaacctgccaggaataccaaagggagtgaaaaatccaaggaatacttgtcattgaaattagggcccacctggataatccatgatgatctcatctcaagatccttaacttaatgacatctgcagagactggtttatcaaataagggactgtggctatatcgctgacctcaagaaaacctgcggacaaaatctgctaaagaagtatcagcatctatttcaaaagttagccattattttaagaagactgtgctggaagacgggtatttaacacaaacagatgcaaaagatacggggtttcaccgtgttgaccagactgattttgaacttctgggctcaatcagtccacctgcctcggcctcccaaagtgctgagattataggtgtgagcccctgcgcctggccagggatgccgttcttcactctccaattgagcagccattatatatcaggcactataggagttcctggaggatactggtctgaagttagcatgatcttgactcaagaaacttatagtcctgataagaacttccaccagaattccagataaggcagcacaggccttgctgtttgcccatgtccatgcggtcagctctcttgggtaccgtggcatgcagatgcagacgctcacccaagacaccctgtagtgctgattactggctgaagacactgaatatctgatatagtttggatgtttgacccctccaaatctcatgttgaaactagattcccagtgttggaggtggggcccggtgggaggtgtttggattgtgggattggatcccttatggccatcttggtgccatccttgtggtaatgagcaagttctttatctactagttcctgagcgatctggttgctaaaaagagtctagcagcatcatccgctccctctcctcctctcttaccatgtgatatgcacacaccggctacccttcacctactgctccagcaccacgcttcatgtacagcctgtagaactctgagccaaataaacctcttttctttata

SEQ ID NO: 272739 - DNA, 1197 bp, Homo sapiens
gtgagaacctcagctgcaagtgagactggaaaaatggctctcagagttcccgcctctgcagtagaggaagacactccagaaggagttgagaatgggtgctgagtgcctcttcaggatgtctgtcacacctcaggaaacctgccaggaataccaaagggagtgaaaaatccaaggaatacttgtcattgaaattagggcccacctggataatccatgatgatctcatctcaagatccttaacttaatgacatctgcagagactggtttatcaaataagggactgtggctatatcgctgacctcaagaaaacctgcggacaaaatctgctaaagaagtatcagcatctatttcaaaagttagccattattttaagaagactgtgctggaagacgggtatttaacacaaacagatgcaaaagatacggggtttcaccgtgttgaccagactgattttgaacttctgggctcaatcagtccacctgcctcggcctcccaaagtgctgagattataggtgtgagcccctgcgcctggccagggatgccgttcttcactctccacactccaaccagcaatgaaggagatctgaggtctcggcatcctcattcacacctgattgagcagccattatatatcaggcactataggagttcctggaggatactggtctgaagttagcatgatcttgactcaagaaacttatagtcctgataagaacttccaccagaattccagataaggcagcacaggccttgctgtttgcccatgtccatgcggtcagctctcttgggtaccgtggcatgcagatgcagacgctcacccaagacaccctgtagtgctgattactggctgaagacactgaatatctgatatagtttggatgtttgacccctccaaatctcatgttgaaactagattcccagtgttggaggtggggcccggtgggaggtgtttggattgtgggattggatcccttatggccatcttggtgccatccttgtggtaatgagcaagttctttatctactagttcctgagcgatctggttgctaaaaagagtctagcagcatcatccgctccctctcctcctctcttaccatgtgatatgcacacaccggctacccttcacctactgctccagcaccacgcttcatgtacagcctgtagaactctgagccaaataaacctcttttctttata

SEQ ID NO: 272740 - DNA, 632 bp, Homo sapiens
gaaaactttccagaaagaagagaaaatataatgaatacttgtcattgaaattagggcccacctggataatccatgatgatctcatctcaagatccttaacttaatgacatctgcagagactggtttatcaaataaggaaggacatgttcacttccccttctgccatgattgtaagtttcctgaggcctccccagccatgtggaacggtgagtcaattagacctctttcctttataaattacccagtctcaagtatttcttcataacagcatgaaatgagctaatacagtggagtatattgcatggtgaaaatttaatatttttaattgtatagttaaaacacgggcgaggacctggattaaagagtagtatatatatattatatgttctgaaaagcaaaattatgcaatcaaaaagaaaagagaggggaagagagaaagaaaggagaaagcagagaagtagaattaacagttaggtagataatgggtgaaggagaagagtataaatggtcataccagacaatagaatgttcagtaagaagaaaaggaagttagaagggattaaaatggaataaatacaaccactggaacaaacatacaaacattctgaaatgccaaaagaaatgaaaaaaaa

SEQ ID NO: 272741 - DNA, 519 bp, Homo sapiens
gtgagaacctcagctgcaagtgagactggaaaaatggctctcagagttcccgcctctgcagtagaggaagacactccagaaggagttgagaatgggtgctgagtgcctcttcaggatgtctgtcacacctcaggaaacctgccaggaataccaaagggagtgaaaaatccaagggttgggaagccctgggacattgaagttacaactggacgataaaaacagagttttttccttgtgacgtgaccactgtgatgtaaagctgtatctccttcatttcatcaagaaattcttaaaattctcccccaacgtgctttcatctttcccttcattgccaactctgtgaatacttgtcattgaaattagggcccacctggataatccatgatgatctcatctcaagatccttaacttaatgacatctgcagagactggtttatcaaataagggactgtggctatatcgctgacctcaagaaaacctgcggacaaaatctgctaaagaagtatcagcatctatttc

SEQ ID NO: 272742 - DNA, 416 bp, Homo sapiens
gtgagaacctcagctgcaagtgagactggaaaaatggctctcagagttcccgcctctgcagtagaggaagacactccagaaggagttgagaatgggtgctgagtgcctcttcaggatgtctgtcacacctcaggaaacctgccaggaataccaaagggagtgaaaaatccaagggttgggaagccctgggacattgaagttacaactggacgataaaaacagagttttttccttgtgacgtgaccactgtgatgtaaagctgtatctccttcatttcatcaagaaattcttaagaagtaccacgccttttctttgaatctgattctcctccaagaagcaatgcttctctgaggctttcacctttgctcacatcaaagcccccacactgaataaataccatccttacatgcccttcc

SEQ ID NO: 272743 - DNA, 466 bp, Homo sapiens
gtgagaacctcagctgcaagtgagactggaaaaatggctctcagagttcccgcctctgcagtagaggaagacactccagaaggagttgagaatgggtgctgagtgcctcttcaggatgtctgtcacacctcaggaaacctgccaggaataccaaagggagtgaaaaatccaagggttgggaagccctgggacattgaagttacaactggacgataaaaacagagttttttccttgtgacgtgaccactgtgatgtaaagctgtatctccttcatttcatcaagaaattcttaaaattctcccccaacgtgctttcatctttcccttcattgccaactctgtaagaagtaccacgccttttctttgaatctgattctcctccaagaagcaatgcttctctgaggctttcacctttgctcacatcaaagcccccacactgaataaataccatccttacatgcccttcc

SEQ ID NO: 272744 - DNA, 823 bp, Homo sapiens
gctaggccgaaacgcctgtatttaaagggatagtaactcggactcgttctgcaatatccccacaagggcctgactgagcgagcgagcatggacggccgcggggctttctggacagtggccattcccagagccaggcaggaaggcctcgggaggctggggctcccgttcccggtgaagcggacgccgccagcgccccagaacccaggaggaagcacacaggccccacagagagtggttggcaagagtcactcggggattaggatgccggccaaatcgcggaatttgaggctggaatccaagctcaacaggactgctgtgtgtgaagcactcaagagggcccctacaaccaacctgccaggagtcggctcctgaaaacagggtcggaaaaggggtctggcactcttcctcatgcttacgagatggctgctggaattccaggaatcacatgcaaattctagtcaggagcaaagaggaagagacacagtgaaaaggggtatacagcggcagaaggaagctcctcaaatgaactctgctagaactctagccagtagcttctccttctatcacagtggccagaactgtgacaagtgaccatccttaggggaaaaaagatgctgagaaatgtgaattttgttgccaccttacattttcaaaggagttccattcgtaagtacagaacgctcagagaagaggcagcagatctaggatatggagcagcagctcttaagggcacagtgggaaggtttcaagactgaggaggatcttggatttgggtaggggaaggcagttcacagtattgtggaggaaatgctgtgaaagagaa

SEQ ID NO: 272745 - DNA, 576 bp, Homo sapiens
gctaggccgaaacgcctgtatttaaagggatagtaactcggactcgttctgcaatatccccacaagggcctgactgagcgagcgagcatggacggccgcggggctttctggacagtggccattcccagagccaggcaggaaggcctcgggaggctggggctcccgttcccggtgaagcggacgccgccagcgccccagaacccaggaggaagcacacaggccccacagagagtggttggcaagagtcactcggggattaggatgccggccaaatcgcggaatttgaggctggaatccaagctcaacaggactgctgtgtgtgaagcactcaagagggcccctacaaccaacctgccaggagtcggctcctgaaaacagggtcggaaaagatctcagtcctctatctgtgaaacggaattcggccttgcctgtccacgaaatgaagacaaggcatctcgtgtgtgttaagatgaaacaagatcttagcaagagagtaatgatttcttttttaaaacattttttactgtagtaaaatgtactataacgtaaaattaccatttcaatcatttgtaagtt

SEQ ID NO: 272746 - DNA, 790 bp, Homo sapiens
gctaggccgaaacgcctgtatttaaagggatagtaactcggactcgttctgcaatatccccacaagggcctgactgagcgagcgagcatggacggccgcggggctttctggacagtggccattcccagagccaggcaggaaggcctcgggaggctggggctcccgttcccggtgaagcggacgccgccagcgccccagaacccaggaggaagcacacaggccccacagagagtggttggcaagagtcactcggggattaggatgccggccaaatcgcggaatttgaggctggaatccaagctcaacaggactgctgtgtgtgaagcactcaagagggcccctacaaccaacctgccaggagtcggctcctgaaaacagggtcggaaaaggtcagtgcccatcagactcgagctgtcggcaaaaagctggagaggttaggagctttgtctatctcaagggtaacaaactgctttgaccctgagggctctgaagacgactttccctcaccgcagctctcaagacaacagggatcagactcagaaagacactgcctgtataaggctcttgtttgtcttgtttttaattcctgccctctgcctccagatctcagtcctctatctgtgaaacggaattcggccttgcctgtccacgaaatgaagacaaggcatctcgtgtgtgttaagatgaaacaagatcttagcaagagagtaatgatttcttttttaaaacattttttactgtagtaaaatgtactataacgtaaaattaccatttcaatcatttgtaagtt

SEQ ID NO: 272747 - DNA, 635 bp, Homo sapiens
cgggaccgccagtgctgtctcctcgtcagatgctgcttctggtctccccgcagaagatgccactggagttgccttttcaaggatggggacatttgaaggccctggacgctcagctctgaggctggctgggatctcactagcaccccctggtggaggccggagccaggctgacgcgggaaagtggggcacggaagcgctgcggattggaccggcggcagctaggccgaaacgcctgtatttaaagggatagtaactcggactcgttctgcaatatccccacaagggcctgactgagcgagcgagcatggacggccgcggggctttctggacagtggccattcccagagccaggcaggaaggcctcgggaggctggggctcccgttcccggtgaagcggacgccgccagcgccccagaacccaggaggaagcacacaggccccacagagagtggttggcaagagtcactcggggattaggatgccggccaaatcgcggaatttgaggctggaatccaagctcaacaggaaagtagtgaaatacaaatggggaaaacagggctctggagcggggagggagctggtgccggcatttcccaccaacgccggtttaggaagacgggaccgatgccggccgc

SEQ ID NO: 272748 - DNA, 420 bp, Homo sapiens
cagttcctctaacatctcataactgatgtttagaaaagaagcctatacactgaaaagaacagttctactgaaagaagcagcctgaaatattcttcagccataactagtcctgactcagactagtatattcaaaagaccagtgtcagtttccaggaggcctctgccatcatgttcagattctatgcttgctggttacagaagatataaaaaaatgcaatgctacattattacacgcattttcaaaagtctgtctatcctactctatcttacctcctagttctagacaacacagtttagagttaagcattctataaatctaaatgtttccaacattttaataacatctttgtttttttcattgtttctcatgtcttaactctgatgtttagaaataaatatcaacaatatattgatacaaaa

SEQ ID NO: 272749 - DNA, 506 bp, Homo sapiens
gtgagacatcagacactgattgtgaaattggaagatcacatttatgttgttttcagccactaaatttggagcaatttgtcacagctgggtagaaaaccaacacaatttcatttaaagacacttgaactctgatttttctcaatagtgaaataattctgagcaaatatgggtttacagaatcacaatctcataatactgagagcttaaaaagcctcgggggttgaactggtccactgttgagcataaggtgggtaagacagtgttatcccactttagggattgtccaactgaggccaagaaggcaagcgacttgcaggaagccagtgggagcagagcgtgagcccaattgccttgtccctgctgctgggagcaccgagccgtcttcagtgacacagcctccagctctacccagggcttctcacggcttctgggaacaccaggtcctcttactaaaagcccgcctaggaaaattgcctaggtaaagttgttggctttcgctcgtgccg

SEQ ID NO: 272750 - DNA, 583 bp, Homo sapiens
cacggggtgcggaactcccaaatatagagaaatggtatgggtgctggctggcacagagtacgggatgcagccatcagcccccttcccaccactcccttctgctccagacagaaaactaggaatcaccttagattctcttcttccctcacttaggacatcaacaagcagttgatctccaaaacagtcttgactctctccaccttttgtctccagtgtcaatagcttcctatggccaacgctgttcattccatctggattactgtgattgcctcctaacttctctttcctcttccacacactcttctttccagtctgcattccccaaagcagcaggaacaggtttctctgtaagtcatcctataaaacttctgtgctttaatgccttcagtggcttcttttttgcaccaagaataaaatctggaatctgcatgttggcctctgaggagtatgatcttatgtctccttcttctgcgtaggatgtgattttttttttttttttttggctgaggcaggaaatttgtttgaccctgggaggctgaggttgcattgacccgaattcgccccttggcaccccagttgggcc

SEQ ID NO: 272751 - DNA, 1031 bp, Homo sapiens
agtctcgccctgttgtccaggctggagtacagtggcgccatcttggctaactgcaacctccacctccccggttcaagcaattctcctacctcagcctcctgagtagctgggactacaggcagccgccaccatgaccagctaatttttttttttacttttagtagagatggggtttcaccatgttagccaggatggtctcgaactcctgaccttgtgatccgcccacctcagcctccctaggtgctgggattacaggcgtgagcaaccacccggccttattgttcttatattaaaacaaaagaacctagaaaaaattgcttggttaaattgtagagaggaagggagggaaggaaaatgaaggcttttcttctttgttctttaaaagtccaagcactttctttcagaatcaaaatgtagagaggcagtcagtcttggagcatgcttttgcattttaggatactactcattaattcagttttaaagcattcactgggttgagcacaattttaaaaaggttctgactcacccagatcctgtttgaagctcaactcattttgattgaaagagatttgagacaagaatttcagaagagaaaaatgtgtgttacacctggacatatatacacatgtaacagggattgtattccttctagtctaagacaagagattctatggtaaattatttaaaaaaattagttttttttctagcattgtattgtcaccagaaagaagagtgctgaattctctgtttctgcatttcccaataataaatctcctaggagagataactttttgcagttgtgccccccacccattttctctgtggcttgctttatttcccacatatgaatacacacacagcagatacatcatgcacaaactttttttaatgtgtaatctgtaaatctaggcccattaagttttcattgaagttgggaaactgttgaggacttacttttgttcttcaccatgcgtgcactttgccaaggatctttggtaaccaataaaacgatcatgttcactctgaaaaaa

SEQ ID NO: 272752 - DNA, 633 bp, Homo sapiens
tcccacctcagcctcctgagtagctgggattacaggcacacgctaccacgcccagcttatttttgtatttttagtagagatggagtttcaccatgttggccaggctggtctcaaactcctgacttcaagtgatccgcccatcttggcctcccaaagtgttgggattataggcatgagccaccatccccggccgataattactctttatttccccgtactcccactttggggcacttaatctctctaccctcagtttctttatctgtacaatggggcacccacttaatctgaatagcagtgtaaagtagtatctcatgaagttgttacaaggattaaataagttgggtactacatataaatatgcattggcacctactaatttctcagatgttacctgtgacatttatactgcttaccaggaatatattcatgggttcagagagtatcccgatatctctctgtatattaagtagactcctacccaaaattcattttaaatgagcagggtctatggttggtattaaaggagtagtagttctcactgaaggtcaggcttgcatatttgaggtcacttcagcagtctggactgtagcacctttaccctgtctacctcacctcccttagcagctcagc

SEQ ID NO: 272753 - DNA, 1020 bp, Homo sapiens
gggcttttattattttaactggaaatttgaaacaccatattaacaaacaagttttttttctaattgcctatttttattggggtttatattgaaatgtgcactttatgcgtttattttcatgagagaatgtgtgcatggttatgatgttttttaaggaatgccattggcatcctcctttgtatgtctcctgaggagggaaaaccatagcaatgtcgactctacgaaaagtatcttcctttaattaccctggaaagggaggcaaacaacagcttcccccgttttcagagtgctgtcatacagttttagttatttatataaaagaaacctgtcacttaaagttgatttaaacctggtaaattgctcttccttccatcagtagtttataggagctgtgtgctttagctttctctttttatctaagcttccagaaagctcagaactaagatgtctgcttaaaagttcagcatagcccaggtgttccagtagttacctacgtaattcattatttggtttataaaatacataagattggaaaaggaattaggtagactaatgaatttctattttatctccagtagacatgtcattttagtgttatacagtttgatggaaatatatataccattttatatacacactgatttagtcatcttaaaatccttcacaaccaaattattattaaatgaaataatagtttcatagaagctttaaagtatcaggcctttcatttactcttctgattgtagtaaatgattaaaactctggtaataaataggaaaaaaacaatgccaagcccaagcaatctgtgttgctatttatcaattccttggtatcttttctttttttaaaaaaaaaaaaggtagggggtgagggcattcgttcattttatgctgacctttagtagagcataatcatcaagttgagcttgtaaatatgacctgttttctttagccctggaagctctagaataacagagtgcttttaaaaaaaaaattaacttttaatttaaatttaattaaa

SEQ ID NO: 272754 - DNA, 119 bp, Homo sapiens
ccagtacctggctgagctgctgaagctgcactacatgcaggaatctccagggaccagccaccccatgctcaggtttgactatgtccccagctttttgtataaaatctgaggtcggtccc

SEQ ID NO: 272755 - DNA, 294 bp, Homo sapiens
gtgagggcactgcatggcgagagggtaacctggatcacaccaatgtgggatgcttgttgccaggctccacacacagtggataaaaccagccttctctcgtgagtgaggcctagacctgcagggtgggaagaggcaggactgggagaaggggggctgggaggaagatgacatcggatctgtctgcagaaatcatctgtcaagagtcagaaggtgtcagatcttgctgaatggtgggtgggtggtctctgcatcacctactggtcacccagtagggcgagaagggtcagaggggag

SEQ ID NO: 272756 - DNA, 271 bp, Homo sapiens
ccaaatgctagagaaacagtgttaagagtgacaacactaaaagtcttacactctgatggtgctagttgccgccgaattgcttcccctaccagttccttaagtttcttcttatgatcccggctggttttcttatagaaataaagatctttttccaactgctggattttatcttcatatgttttgaaagtttccataatgccttctccatcttgttctatacaacaaaaatttgcatttaaaatcagttttaaataaatgatgcaaaattatg

SEQ ID NO: 272757 - DNA, 437 bp, Homo sapiens
taaaaatgaaatatgataacagatggagggattaattctacctaaggaaaaggcttcatagaagaaatgacctttaagaagaaacctggaaaattagtaaggacaaaggttgttcccggtggagggaacagtgtaaacaaacacctggaggctagagagggcacagcatggcagggaatttgagtagtcaaagtgctggagcattagtggcagaaatgaagcagaaaatagagattgggatctctatataaagcctggaatgccatgctgaggagtgtatactttaatctgcaagcaaggcatgtgtattacagattgaaacattaggatgatcatggtagttattagagctattcactgaatattgctagttcttcacacttctaagcctatattaggactacatacttctctgtatacctttgaggtgagtcaaa

SEQ ID NO: 272758 - DNA, 385 bp, Homo sapiens
caggttcaagcgattctcccgtctcagcctcccaagtagctgggactacaggcacccgccaccacgcccggctaatttttgtatttttagtagagacggggtttcaccatattggccaggctggtcttgaactcttgaccatgtgatccacctgcctcggcctcccaaagtgctgggattacaggcgtgagccactatgcctggcctatgatgtggtttctaactagtaaaacagagactgatttacatgtatataaagtttcaattttcactgtcatgatattcaatcatttggaagttactggtatgatttaggactaggatactttcttaattaaggaaaactttgtgtatacatataggaaatcagaaattaaagctgtca

SEQ ID NO: 272759 - DNA, 405 bp, Homo sapiens
gtccaactgacctgggtctgaagggaaataataatatctaccttgtaaggatttaaaacatttcatctatggccaggtgcggtggctcacccctgtaatcccagcactttgggaggccgaggcgggcagatcacctgaggtggggagttcgagaccagcctgaccaacatggagaaacccggtctctactaaaaatacaaaattagccgggcatggtggcgcatacctgtaatcccagctactcaggaggctgaggcaggagaatctcttgaacctgggagacagaggttgcggtaagccaagatcgcgccactgcactccagcctgggcaataacagcaaaactccgtctcaaaaacaaacaaacaaacaaacaaacctttcatccaataaatatctatcaaat

SEQ ID NO: 272760 - DNA, 311 bp, Homo sapiens
cccccacgctctccagtcccagatctcatcagagctggctgagtccccaggccacccgccaattacaccacttttttgccaatccccttcatgtccagcctccacacccaccaactgagatcatcttgcccttctctgccagagatactccaagaggtgacagcaaagtcacggtcactttctcagcacctgccccagacacatgggctcttgttcacactcaagccaaacagacagaggctcagcatggttaggcaatttgccccaaggccacaaagaacttctgggacagccatgcttctccctctaca

SEQ ID NO: 272761 - DNA, 190 bp, Homo sapiens
atagccggggggtagaggatgacattattgaaaatagcgcagtgggtgtacatcccttcggtcatcttgttcctaatatcgtggggtgggagcggatggtatgactcccaatatcgcagggggcagagacctcccctgtgatactgtccctaacatccaaaggtggagaggatgatatttcttccaattt

SEQ ID NO: 272762 - DNA, 363 bp, Homo sapiens
ggtttttgtctgttttaacctaaaaggttattgcactattaacaggtaaaaaattctcttctgaccaaatacatgtatttctagcataatatattctctctctctctctggataaaatttattagcatatcagcataaacataatttttgtaaggtcagacaagagatttgaagtgtaattcaaggggaatttgtattaacgtaatgaaacattctgctgtgaagtttactagcaatgcctcactctgggttatcatttctgactcctcccatttcctttctcacccgtcacctggccctcattcattctctgtcctagaagataacctctaaaaccagtgacagtccatccagcctgctgtt

SEQ ID NO: 272763 - DNA, 515 bp, Homo sapiens
cagggcttggactctgagagtgggtgaatggagcaggtcaatttgctcaagatgtcagttggattgagcaggccaggcattgtggtggagtctccatcatcagcgatggggaatgcacagtaaagactgttaggtgtcagcacagaaatgagtcttctcacttgggctgtcctcacatgccttttgctaggaagtggttttggcctcttttggtgcattctttctcacatgtcaatttagaggaaggaactaatgatttgaaggcaaggtctggccttcaacagtgaagtcaaaatgagactgcaggtccactgattgcaccgttcagtgcttttgactctgaagattgttttatcagtccagctcactgggctggttcatttacttaacaaatatacacagagctcctattatcacccaaattcattctgcgcactgaggatgtcctggtgaacaggttgacaatgtgcctgctcttatatttgaatgagggaaactgacaaggatgttggcaa

SEQ ID NO: 272764 - DNA, 209 bp, Homo sapiens
ccacagccgggtggcaccagctgtccgctgaccttagatctatacccagtgtcgctgggaaacacacgccatgctaactggcctcactttaacttcacaatcacaattttccagcccacaaactgcctggaaactgatcacactttttaatatgatgttcctttcccccactgtccaaaatgactatttcaaaagaccccttttttata

SEQ ID NO: 272765 - DNA, 402 bp, Homo sapiens
cagctgtgtggctttgcataaactgacttttcttctctgaacctcgtctttaacatggggctaaaactttcacagaactgaagggaagatgaaaggaaaggcctagtagggtgtgtgacccatagttggaaacctagtcctggaaccaaaaggacaccacaggagaggcaggactcccaagcgccggtgctttctaccctcccgaatcgctctataggattagagggtttaggtttgggaggagtttcttgacctcttgtttatgagtttttacgactaaaatgcaatgccagttttcagtccggggacaaactgcctagttatggatgaattttaccccttttttccccgtgtctttttggaatattctgcttattaatgcttccaataactagcagatgg

SEQ ID NO: 272766 - DNA, 585 bp, Homo sapiens
ggccctaaaggccaagaattgggcccgaggcaaaacaacaacaacgacaaaaaaaaacaaacatctctcctaaaattagaagcaaaaatcctttatagagcattaacaaatcttgtaatacaccatgaaaaagtaggatttattccaaataagcaatcttagttcccagaatagacctaacaatcttgaaaaatcttgaaaaataaaattggaggatttacatacttctcaactttataatgtactataaaataatcaagatagtgcagtattgacatattgatcaatgtgacataaattaagagtccagaaataaactcctatacctgtggataaattgatttttgacaaagctgctaaggcaattcaatgagggaaggatagtattttctataaatggtgatggaccacttgtttagtcatatgcaaaaagatggatttagactcttacaccttatacaaaaattaacttcaaatggacaatagacctaaatgtaagagctaaaccccaaaaagtatagaaaaatcttttttgtccttaggtaaggcagagtccttagatatgacaccaatagcataatcctt

SEQ ID NO: 272767 - DNA, 498 bp, Homo sapiens
ctatttacttcatcaattgcctcttaatgtgcttggtttgctagttcttctctttccactttttctattgtcccctgggctgtaccctcctaaaacacctctttgaggatgttattcatcagctcagaattctagcagtttttgctgccctgcatgatagtgtctagaaaaagctaaatcttttcttgtctgctctccctttaggaaagggagtcatagttacaaccagtgaaaatggtggatgtggtctctagaaacatgtgccaatgcctgttaaaagaaacttgtatatcttccaatctgatgaggtggctggtgccacctgttctccttccttactgccatgaatttgtttacagaggagctgcagcagccattttgcaaccatcagggaataaccaagatgctgctcttgaccttgagcaactgaacaaatgatactacttctagattccttgtttatgtaagaaaaataaacctttgtttaagccacagcaa

SEQ ID NO: 272768 - DNA, 664 bp, Homo sapiens
tcccccttccttcccattggttgctaaataaaactgataactgacactcaaatagccatcttgaacaataagatagaaatcacatgttaagatggggctacatggttgaaagaacctgggtccctgatcatgaccaaaccaccataagaaagcctggacagctcaaacttcatttgcattagagagaaataaacttgtttaaactgcttttatttttagttttctgtcattcccagccaaatctaatcctaaccaatacagacgcttttgaaaattactggtaagaggcagaaggaagtattttgcttaaaattcataaactataaaataaacagaaagttgtaggaaaaaagtaggtagtggaacaaaaggtataagaaatgacaatgaaaaaacctgtggagctctgtttgtgtatttctagaggtcctactgtcacttgacacttaatgtatccaaccaattattctccctcccaaatgctttcctcttctacatgctttgtatctgttcaaggtacaaccattttttttttttttttttttttttaagacaaaaagagtctcactctgtcacccaggctagagagcagtggcatgatcatggctcactgcaatctcgacttcctgggcccaagtgattctcccacctcacccccgcccca

SEQ ID NO: 272769 - DNA, 360 bp, Homo sapiens
cccagaattaaaaaaaaaaaagtcaaaagtgaaagaggcttgccaaaaatcaccattaagtagcagagcatgatcagaactcaacttggctggctgactggtgcgcttttattataaataattttcaaacttaaaaaaccttatatagaaccttaccatataaaatgatatatttggtagattgttactataagattataaaataattttttaaaatcaaagagttaaatggttacaattgtcaatcatcctcaacacacaatctacgtctgttttcttttgattcaaaatattaagaattaagtggttgtaagttgtcacttttttctgtagcctactttaatagttgaggaatcctgg

SEQ ID NO: 272770 - DNA, 446 bp, Homo sapiens
ggacatatccatttagcattatatcttcttgtttacagaacattctatgcagtttcttatatggaccactcatggagctgttcagattttcatacaaaaagaggttgtttttttttctggcaatattatctgtcacaattatcccttcacttagtagttagaagtcggggggtgctaagagcaatttccacagatgctttgtttgtggagaaaagtaggatggcccctctgcttgtcttagtgcagagcaaggaatggcttcgaagccattccttgagtactgaggtctctgtgtagtcttacttcttttctgaatttttcagagtcttctgatagttgcttgatatattttgtctatggttttcagttctatgtagtagaaagaatagagtatctccccccagtcctctaagtagaaataaaaattaatataaaaaattaagtaa

SEQ ID NO: 272771 - DNA, 1051 bp, Homo sapiens
agcgggcgcgtgcgcagcggttgcctgggcgaccggggaagcgttgggctgtaaagactagggcgccagcggctggcgaagaaggaaagagggtactctctggctgggctggggccgtagcgacgtccgccgcgaacctgggccccccaaagctgcggggcgttcggtgtcgccgaagtaaacatgcaccctgagccctcggagcctgcgacaggtggtgcagcagagctggattgcgcgcaggagcccggcgtggaggagtctgcgggtgaccacgggagcgcaggccgagggggctgcaaggaagaaattaatgatcctaaggaaatatgtgtgggttcttctgacacatcctaccacagccagcagaaacagagtggtgataatgggtcaggtggtcacttcgcacacccaagagaagacagggaagatcggggccccagaatgactaaaagttccctgcaaaaactctgcaagcagcacaagctttatattaccccagcattgaatgatacgctgtatttacactttaaaggttttgatcgcattgagaacctggaagagtacacagggctgcgctgtctctggctgcagagcaatggaatacagaaaatcgaaaacctggaggcccaaactgagttgcgttgcctcttcttgcaaatgaacttgctccgtaaaattgagaacctggaacctctgcagaaactggatgctcttaacctcagcaacaattacatcaagaccattgaaaacctctcctgcctcccagtcctgaacacattgcagatggcccacaatcacctggagaccgtggaggacattcagcatctacaagagtgtttgaggctttgtgtccttgacctttcgcacaacaagctgagtgacccaatatggcctcaatatgtgccgccagtgtttccgtcagtacgcgaaggatatcggtttcattaagttggactaaatgctcttccttcagaggattatccggggcatctactcaatgtaaaaccatgataattctttgtatataaaataaacatttgaaaaaacc

SEQ ID NO: 272772 - DNA, 1365 bp, Homo sapiens
agcgggcgcgtgcgcagcggttgcctgggcgaccggggaagcgttgggctgtaaagactagggcgccagcggctggcgaagaaggaaagagggtactctctggctgggctggggccgtagcgacgtccgccgcgaacctgggccccccaaagctgcggggcgttcggtgtcgccgaagtaaacatgcaccctgagccctcggagcctgcgacaggtggtgcagcagagctggattgcgcgcaggagcccggcgtggaggagtctgcgggtgaccacgggagcgcaggccgagggggctgcaaggaaggtgccgactgccccccagggagggcggtgggcgaggggcagacacggctaggcgctccagcccccttcccacaccacatacccgatcttcacagccaaataataacaataataataatggtagcaagcaacgctctgcagtaggggcttctctcgccatttcgtactgaggaggaaacatacttaagaggttacaaaacttgcaccaaacagataaccctcggctagtcagtgacagaagagacttggccgggtgcggtggctcaacgcctgtaattccagcactttgggaggccgaggcgggcggatcatcagaaattaatgatcctaaggaaatatgtgtgggttcttctgacacatcctaccacagccagcagaaacagagtggtgataatgggtcaggtggtcacttcgcacacccaagagaagacagggaagatcggggccccagaatgactaaaagttccctgcaaaaactctgcaagcagcacaagctttatattaccccagcattgaatgatacgctgtatttacactttaaaggttttgatcgcattgagaacctggaagagtacacagggctgcgctgtctctggctgcagagcaatggaatacagaaaatcgaaaacctggaggcccaaactgagttgcgttgcctcttcttgcaaatgaacttgctccgtaaaattgagaacctggaacctctgcagaaactggatgctcttaacctcagcaacaattacatcaagaccattgaaaacctctcctgcctcccagtcctgaacacattgcagatggcccacaatcacctggagaccgtggaggacattcagcatctacaagagtgtttgaggctttgtgtccttgacctttcgcacaacaagctgagtgacccaatatggcctcaatatgtgccgccagtgtttccgtcagtacgcgaaggatatcggtttcattaagttggactaaatgctcttccttcagaggattatccggggcatctactcaatgtaaaaccatgataattctttgtatataaaataaacatttgaaaaaacc

SEQ ID NO: 272773 - DNA, 1055 bp, Homo sapiens
agcgggcgcgtgcgcagcggttgcctgggcgaccggggaagcgttgggctgtaaagactagggcgccagcggctggcgaagaaggaaagagggtactctctggctgggctggggccgtagcgacgtccgccgcgaacctgggccccccaaagctgcggggcgttcggtgtcgccgaagtaaacatgcaccctgagccctcggagcctgcgacaggtggtgcagcagagctggattgcgcgcaggagcccggcgtggaggagtctgcgggtgaccacgggagcgcaggccgagggggctgcaaggaagaaattaatgatcctaaggaaatatgtgtgggttcttctgacacatcctaccacagccagcagaaacagagtggtgataatgggtcaggtggtcacttcgcacacccaagagaagacagggaagatcggggccccagaatgactaaaagttccctgcaaaaactctgcaagcagcacaagctttatattaccccagcattgaatgatacgctgtatttacactttaaaggttttgatcgcattgagaacctggaagagtacacagggctgcgctgtctctggctgcagagcaatggaatacagaaaatcgaaaacctggaggcccaaactgagttgcgttgcctcttcttgcaaatgaacttgctccgtaaaattgagaacctggaacctctgcagaaactggatgctcttaacctcagcaacaattacatcaagaccattgaaaacctctcctgcctcccagtcctgaacacattgcagatggcccacaatcacctggagaccgtggaggacattcagcatctacaagagtgtttgaggctttgtgtccttgacctttcgcacaacaagctgagtgaccctgcaagaaggcctgggctgacctcgtgaatgtcctctgctaatagctacccccatcctccacccccagccctgagccagattttggtctctgggcaaatctttcaatggccgggggatctcttttccaacatgtattacaggagcaagagtgagttctttgggaagaa

SEQ ID NO: 272774 - DNA, 386 bp, Homo sapiens
caatctaagaagtttttgtttactaagtggacttggggcagaaccataggcgggggaaggcaggaggccacttcctttgctggcagtgtggcttcccttcagatgacattcttcacagtgggctgcagagaccagagatttttgttcttcccatggggattggggtaggggaagtgggaggggaacatgtgaggaggagccaaaaggccagtggtttgtccctggtggctctagcccggtgtgggtccaacctgtgtgtgtgcgagacctcccacacgagccctggagccagcagtgccttgcatatgatggaggggagtgggactgtagcaagaagagggctcatgagcagaggcagaaagaagttcaaggaaaacggtggaagt

SEQ ID NO: 272775 - DNA, 1215 bp, Homo sapiens
acagtaagcaaagatcactccacttcactccagcctgggcaaaagagtgagacatatcaaaaaataaacaaataaataaataaataagtggcagttcatcatttaactccaaagactttgcgtacatttctactgaaaacaatctgagctgattagaaccctgccattttatagcctttagctcgatctccgaccgttcatttaaaaaaattctacttcaggccgggcatggtggctcaagcctgtaatcccatcactgtaggaggccaaagtgggcagatcacttaaggtcaggagtttgagaccagcctggccaccatggtgaaaccccatctctactaaaaatacaaaaattagccgggcttggtggtgagcacctgtaatcccaccctgccgagtggcaggctgaggcaggagaatcgcttgagcccaagagccggaggttgcagtgagccaagcttgcaccattgcactccagcctaggcaacagagtgtgactccatctcaagaaaaaaaaaattctatttcattttacaatatgcagatatatgtccatacacatgcataatataaatgtataccatatttgtgagaatatgcatatatgtacacattagatacacaatacaagcacaatacatatgtcttttgcccaagatacagcattttgtaaaggagacaggaatttagtaatatatgttccagaaacagtacacaagagaattcgccgagatgagaaagttgtcactaggaatggggagtggtaagatgtagaaggtataattgttcttaaagttctactgccaactctttccaattaattacccactctgccatgctttatggacaggaggttgtcggacactgtcaattaataaatatttgagcatgatacactgcttggagctcctctaatataggagagtgatatcctagtgcatgttacagagggagtgtccacacagttcctattgtcatttgatgagttacttttcaggggccttgtacctgagcaagttgtcctctttttgatggatttcagattgagttacctgcattgtcttgagattgcagcgtgtttcctccactgtacggcgtagtcagcagatctattagttaaactccagtgggccctcagtcactaaatctatcctctgtgttgaaggctttctgcatttgcctttcaataaaggtttagaataactccttctctgt

SEQ ID NO: 272776 - DNA, 482 bp, Homo sapiens
cagcttgaagttccagtttaatttttggtagttgtgtgatgcgcatccgttagttgagctagagctgcttctcagaattttaaggccagagacttctctggcacctgtggggaattttaataaacaaagtacttgtccctaaagaatcttttgtaaatgactttttgcagtgtaaaaatctgtgtaccgtgaagtgttttctttctagcttccctttaggtagttcaactgggcatctgttaaatctcagtgaaaattatttcaaaagcagatcctgggggaaacggaaagttcatttaggaatactcatagatagaaaatctcccgactgggcacggttgtttacacctgtaatcccagcgctttgggaggccaaggtgggaggcttgcataaacccatgagtttgaggttacagtgaacgatgattgcaccactgcactccagcttaggcaacaaagcaggatcctgtctcttaaaaaaa

SEQ ID NO: 272777 - DNA, 685 bp, Homo sapiens
agggtttctctcctgtgtgggttctctgatgtactgtgagggatgacttgtggtagaacattttctcacattcattacattcatagggtttctcccctgtgtgaattctctgatgttctctaagttttgacttcacagagaaggatttttgacattcattgcattcaaagggtctctctcctgtgtgagttcactgatgattaatgaagtttggcttctgggagaaagttttcccacattccttacactcatagggtttctcgccagtatgtattctctgatgtacttttagagctgacctatcaccaaaggctttctgacattcattacatccatagggtttctctcctgtgtgtgttctctgatgtacatgaagatttgacttctcacagaagttttttccacattcattacattcataggttttgtcccgtgtgtgttctttgatgtactgcaaggcatgacctatatccaaaagttttcccacattcagtgcattcatagggtttctctcctctgtgtatcctctgctgtaggataaaagaggatttatggctgaaggttttcccacattcactacattcatagagtttttcttctgtatctgttttctgatatacagaatgctttggcttacagcaaaatgtactagcatactgattaattttataggcattctttccta

SEQ ID NO: 272778 - DNA, 131 bp, Homo sapiens
actcccccaggccaacccaccatggggatttgaggagtgaagaccccagcacatatcatagcgcctggtcacctcgccccacacgcttccctcagacccaggccctgcccctcttcccacagtcccctcag

SEQ ID NO: 272779 - DNA, 593 bp, Homo sapiens
gcttaataaaaattatgactggacaaatatcagacttttaagattttaaaaataatagaaaagtaaaaatagatttcccagggaagtccctctcctaaatcttatatggttttgctgcttctgtgaaatctttctttggagtaacttgatagcatagatttttgcttttgcttttgtttttaactggattcatagaagggcactgaattagaaattcagtggattcatggagcatgaactttcataaaaaagaaactttgctctgaaaaaaaaatggcaaatataaacgaaagaatgggaacactggatgtccatttcattatgtaatttaagtcttacattagatattgcaccctcatttaaaaataaaaataaaaaaaacagaatagtgtgagcactctgaaatcatctgcagcacttttaagggttaaacctgctgaacccattcttagtcagagaatggcaccaaagagtacagctcaccccttaagcttggctagttctaaacctgtgatatcctcaggttgtcagagcagtcatgcactccattttcacccccctcccacccagttaataggatccattcatagcta

SEQ ID NO: 272780 - DNA, 195 bp, Homo sapiens
ttcaaatccacaacctcattgaattcgcactgcgctgcagcgtggtgggtattagccctatctaaaataagatgatgtgggagctggcgagtcgcgggccagggatgctgaaaagattatgtacagtgcagagcgttgtacccgagcaggttaaaggtgccgcaaaagacagctattgttattttgatgtgcagc

SEQ ID NO: 272781 - DNA, 1976 bp, Homo sapiens
tttctaacttaaaagatttttctggagaagatagatttaagaatgttgaattactccaacaattgttttgaaccaagataattttttttcatatcatgtgaggcttcaaggatttgaggctacacatgttagattccaaattcttttaaaatgctttcctgatttaataacaaacagcattttccttctttttaatatgtctatcttgagatatggtttaaatgaaacagatcttgaaagggtctctgagaaggaaattttcatggcatgtcctctagcaccagacttgactgcaccaggtcaggggataaacagcactttgcagatgagtgtgctttattttgaggccctcagacacttcatgagacccctgtattctggaattcactgcctcactactgctgatatacacaatgctatgaaaaatggggaaccattactcatatatttgctaattatgatacctctcacctcttcccctcttttcccatcctcttctcttttcccccaaccaaataaaaaactaaaacaaatacatatatttgttttattttttgcttatttagttttactgtcttattccttaatgtgtgcacctgtagtctcagctactctggaggtttaggcaggaggatcacttgagcccaggagttctgggctgtagtgcactgtgctgatccactaagttctgcatcagtatggtgacctcctgggagtgggggaccaccaggttgcctaaggagtggtgaacaggtcctggttagaaacagagcaggtgaaaactcctgggctgattaatagtgggatagcacttgtgaatagccactgcacttcagcctgggcaacatagcaagattttgtctcttaaaaaaaaaaacaagtaagttgcaaaccacatatccgacaagggactagtgtttagaatatctaaagaactttaaaaatttaacaattaaaacacaatcaggaaatgaacaaaatacatgaagaacaatttcacgaagaggatacacagatagcggataagcacatgagaaaatatttaacaacattaacaattagggaaatgcaacgtaaaacccacaataagatattactacacacctgccaaaatggctaagataaaaaatggcaacaccatcaaattttggaaagaatgccgagaaactgcacctcttataattgctggagggaatttaaaatggcacagccactctggaaagcagtttggcagtttcttgtaaaactaaacatgcaattgccatatgacccagcagttgcactcacaggcatttatcccagagaaatgaaaacttgtgttcacacagaaacctgtacacaaacgttcatcacagtttcatttacaatagccagaaactagaaaccacccaaatgtccttcaaggggcgaataattaaactgtgatacatccataccatagactactccccagcaataaaagaaacaaatcattcgtgcaacaacttggatgatctccagggaataatgctgagtgaaaaacaccaatcctaaaaggttacatactatgtgattcaatatctgtaactttcttgaaatgataaaattgtgtaagtaaggaacatatcagtggttaacagggattagagatggagtttgggagagaggagagaagtgggtgtggttataaaagggcaacacaagggttccttatagtgatggaagtgaagcattctgtgccttgactgtggcgatgattacatgaaaactacagatgggatgaaatttcacagaactaccacacaatcaaaggactgtatggaaaatgagtgaattttgagtaagatcagtggatgacatctatctgaatatcctggttgtgacattgtggtataatattgcaagatgttaccattgggggtaactaggtaaggggtacacgggataattctgtattatttctacaactatatgtaaatctacatttatctcagtta

SEQ ID NO: 272782 - DNA, 364 bp, Homo sapiens
tagacagtcttgctctgttgccaggctgaagtgcagtggcgcgatctcaactcactgcaacctcttcctcctgagttcaagcgattcccctgcctcagcctccggacgagtagctgggactacaggtgtgcaccaccacacccagctaattttttgtattttagtagagacggggtttcaccatgttggccaggatggtctcgatctcctgacattgtgatctgcccgcctcagcctcccaaagtgctgggattacaggcgtgagccaccgcgcccggctgcttcagcatcttttataatctaagcttgttagtgagatacatttctgccatatttaattggaacaatgtttgaggtgggagtg

SEQ ID NO: 272783 - DNA, 209 bp, Homo sapiens
gccagggctctgcccaatctccccaccccgagactctgcgggctccgttctcaccccatttcggcttgccagttcccttgtgactgccaacagggatgccctggcctcagggagtgtggcggtgacagagatctcaaagcttgccaggtccactgtggtgtccttggggtgtgctgaagccgatgccaagcttttgacatagtaatcct

SEQ ID NO: 272784 - DNA, 286 bp, Homo sapiens
gaagaatgggatgtctatctcttggtttgataattattaaattttacatcattttatgagaaattatttaatgagtacaatgtacactgttcggttgatggttactctaagagcccagacttcaccactatgcaaaatatccatgtaacaaaactgcacttgtactccttaaatttataagaattttaaaaaagaaatagaacaaatactgaaagaaaagttttgtttgtaaaatattatatcttgctaattgcaaacatataataacattggggtgtatatgaat

SEQ ID NO: 272785 - DNA, 1682 bp, Homo sapiens
cacacgagctgatctgatcgccggcgacatcactcaggagaccggccgggcgcgtggcccctgcaggcgaggcgaggaggccaggccaagttctccgtgcgcccctgcacccttccaggctctcgcacccgcaactggcacagagtaacaaccccaggctgttgggaacgtaagtgcgccctggcggctctgccctcagtccgggctgcagcgctctgagcgcctttctatctgtccgtcggtcctgcacagcgcaacgatgccagcccgccttgagacctgcatctccgacctcgactgcgccagcagcagcggcagtgacctatccggcttcctcaccgacgaggaagactgtgccagactccaacaggcagcctccgcttcggggccgcccgcgccggcccgcaggggcgcgcccaatatctcccgggcgtctgaggttccaggggcacaggacgacgagcaggagaggcggcggcgccgcggccggacgcgggtccgctccgaggcgctgctgcactcgctgcgcaggagccggcgcgtcaaggccaacgatcgcgagcgcaaccgcatgcacaacttgaacgcggccctggacgcactgcgcagcgtgctgccctcgttccccgacgacaccaagctcaccaaaatcgagacgctgcgcttcgcctacaactacatctgggctctggccgagacactgcgcctggcggatcaagggctgcccggaggcggtgcccgggagcgcctcctgccgccgcagtgcgtcccctgcctgcccggtcccccaagccccgccagcgacgcggagtcctggggctcaggtgccgccgccgcctccccgctctctgaccccagtagcccagccgcctccgaagacttcacctaccgccccggcgaccctgttttctccttcccaagcctgcccaaagacttgctccacacaacgccctgtttcattccttaccactaggccctttgtagacactgttactttccccctcccctagtcagcaggcaatagatggggccccagctgccgcctcgggaccccctctccaggcggagggaggaagcgggagctttaaagcagtcggggatacctgagccgcttgttaggtcgccgcaccctcgcggcggatgtctcttggtctgtttctccggccctcagcccagcgcccctcctgcccgcccctagacggcctttccttttgcactttctgaactccacaaaacctcctttgtgactggctcagaactgaccccagccaccacttcagtgtgatttagaaaagggacagatcagcccctgaagacgaggtgaaaagtcaattttacaatttgtagaactctaatgaagaaaaacgagcatgaaaattcggtttgagccggctgacaatacaatgaaaaggcttaaaaagcagagacaaggagtgggcttcatgcattatggatcccgacccccaccactgcagactcgctctaggaagaactggagactcttgcttagctattcaggcacagggctggagagtactttaatttattcaagatgcttcattcatatgaaaatgtatttttgtacataaagagtttattctattatgagctatcaaagtttacatttttgtactgcagacgcttcatgtaaataaaaactaaaaataagtcgccaagtttct

SEQ ID NO: 272786 - DNA, 455 bp, Homo sapiens
tcagcctcaggcatgtgccactatgtctggctaatttttttatttttactttttgtagagacaggcatggtggtgcgcacctgtagtcccagctacttgggaggctgaggtgagaggattttgagcctgggaggtcaaggctgcagtgatggcttcactgcactccagcttaggtgacaaagtgagacccagtctcaaaaaaaaacaccacacatgaaaaacctcagaacacaaaaacaggctgcttctgacaaaggcagcacagctagaccatcatccacaagagaagctagattgttacaaggcatctctccatcccctcgcagctggtggtgggcactggcatttaatccagggtgtggggcagcatgggagaacagacttgatttaatcccagacaatattccaacagcccagcccactatggtaatcagattgattctaataaataagca

SEQ ID NO: 272787 - DNA, 303 bp, Homo sapiens
cagccttcttgccttgagcagtggaccccaaacctggagcccccttccctctcccacaccctacctctcaacccatcagccggtcctgtgggctgccgtccaaacaagacctggaatccggcacctcccagtgccacgttgacctcctccaggtctgagccccattctcaagggcctggactggtgaagtagctcctcactcacctccatgcccacggcagctggagggatgctttatcaaccatcaaaccccgttcctcttctgctccatcccctggcctcagtgccgcaggatctttgcac

SEQ ID NO: 272788 - DNA, 87 bp, Homo sapiens
ctgatttttaaacctaatgttgtatcataaacatttacattaacataaatgatttaagtaaataaagtggtttaaaggaaacccagt

SEQ ID NO: 272789 - DNA, 352 bp, Homo sapiens
ctgcggaccggacggcgcagtgccgctgcgggttgcctcctgggactgcccgcatggatctgccgcacctcctttttctcacgccactggccagggcagggtttcagacgcctctgtccagtgcgatggcgtgaagagagcccaggaagggtcggaagcctgtgctgggcagaggctgggtacgatgggctcaggagcagcaggctgtggctacagccctcggaccctgcccaagacacgctggtctacatacgccaactttcccactgttacttttccctgtatcagatgcgggaataaacctttctatagctaccctaaataaggggccttgttcttgttctggcctttt

SEQ ID NO: 272790 - DNA, 486 bp, Homo sapiens
gcatattgagcacctcttttgtgccaagtgcttttttgggtgccatctcaattaatcttcacaatagttctatgaagtagaaagtaatattcctatcttcacgttcggaaacaggttcagtaaagtgaagttgtagttggtcacatagctagttagtggcacagtcaagatagatacaatcaggtctatctgtccctgcagcttgatcacctaacaggcttgacacctgtgcgtcactggcagtacagagataattaaggtgttctcttcctactctctttaaactgttgggatttgctacacttggtgtggggttaaggggtaatttacttgaccgtggtggatacgtaggctctgttgtagaagaattgtgggttttgttgttttgttttgtttttttgagatggagtctcgctctgtcacccaggctgagattgtgccattgcacactacagcctgggcaatagtgtgagactctgtcaaaaa

SEQ ID NO: 272791 - DNA, 509 bp, Homo sapiens
cgagctcggtaccccagtccgttcgactgagcctcctgagtatctgggactacaggtgccaccaccatgctcggctaattttttgaatttttagtagagacggagtttcaccgtgtcagccagcctggtctcaaactcctgacctcaagtgatccacccacctcggcctcccaaagtgctgggattccagttaatgagcactgctcctggcctccacatttctaaaatcgaagttctgatcttttcctctggacctgccccacctgcatcttccccatctcagttaacgtcagttgcatccttcaggtgctcaggccgaaatcctcagcaccgttctttattctcctctcacattttgcaccaggaaattctgctggctctaaggccatcaaactgtgcccagaatgtggcccctcctcagcatctccagtgctaccaccgagatggtccacgatgccatcatctctcacctgcactactacaggtctccctgtttccagctcagcccc

SEQ ID NO: 272792 - DNA, 449 bp, Homo sapiens
ctcggtacaccactagtgtaggcatacttaacactactactgtactatacacttaaaaatggttaaggtggtaaattttatgttgtgtgattttaccagtgaaatatctcccaaagtgctgggattccagttaatgagcactgctcctggcctccacatttctaaaatcgaagttctgatcttttcctctggacctgccccacctgcatcttccccatctcagttaacgtcagttgcatccttcaggtgctcaggccgaaatcctcagcaccgttctttattctcctctcacattttgcaccaggaaattctgctggctctaaggccatcaaactgtgcccagaatgtggcccctcctcagcatctccagtgctaccaccgagatggtccacgatgccatcatctctcacctgcactactacaggtctccctgtttccagctcagcccc

SEQ ID NO: 272793 - DNA, 431 bp, Homo sapiens
ttcacgtgattctcctgcctcagcctcctgagtatctgggactacaggtgccaccaccatgctcggctaattttttgaatttttagtagagacggagtttcaccgtgtcagccagcctggtctcaaactcctgacctcaagtgatccacccacctcggcctcccaaagtgctgggattccagttaatgagcactgctcctggcctccacatttctaaaatcgaagttctgatcttttcctctggacctgccccacctgcatcttccccatctcagttaacgtcagttgcatccttcaggtgctcaggccgaaatcctcagcaccgttctttattctcctctcacattttgcaccaggaaattctgctggctctaaggccatcaaactgtgcccagaatgtggcccctcctcagcatctccagtgctaccac

SEQ ID NO: 272794 - DNA, 585 bp, Homo sapiens
acagggattgtgtatagtctcactgctacctcctccttctactcccccaggtcttggtttggactttgatgatagcatttactgaaacgggcctggagcctgtcgaacagcccgctgtggcagggcagggaccacctttgttcatctcagtatcccctgaactagcagagtgtctggcctgcagtgggatcgcagagaatgtggaattgacctaaatttaaatttcaagttctggacacaagcctcccaaagtgctgggattccagttaatgagcactgctcctggcctccacatttctaaaatcgaagttctgatcttttcctctggacctgccccacctgcatcttccccatctcagttaacgtcagttgcatccttcaggtgctcaggccgaaatcctcagcaccgttctttattctcctctcacattttgcaccaggaaattctgctggctctaaggccatcaaactgtgcccagaatgtggcccctcctcagcatctccagtgctaccaccgagatggtccacgatgccatcatctctcacctgcactactacaggtctccctgtttccagctcagcccc

SEQ ID NO: 272795 - DNA, 503 bp, Homo sapiens
atagaaatgttcaattcatcatgcaaaaatttttacataggtagacctcttcactatcccaagtttattttatttccatctacgcacactcattcaaaacatgcatgcaatgtatgtaggcatgcatgcacacatgcacacactcacacacacactcctcagtacatgaaaattaaagctaagtagtcataattggtcaccttttgccttataatttggattttaggaaaaataaccctctcctattttcctccttttgagaaaactgtagagaaatatattagcattctcaaatgtattggcctcatgtattttctttcttcccttgcatgtaaaccttgtagtcttgccaaggttttctaatatttgcatgtcaaacacagattatcaaccccctgggctggattcacactggcctcttggctttttacaaaacgttgcatagccttgtcactagcttgatgttaaagcaaataatgctagcatccttagtaaggcctttg

SEQ ID NO: 272796 - DNA, 286 bp, Homo sapiens
gcatgtgctcattccactcaacttggttccacctcacctaactagaaaacccttctgtcacatctttgccacacctttcttttccttaaatttcctagccctcactttcagccgtcattttgccctcagtcacaggagtcaccatcagcagctcagagtggggagagtttctattttccttggttgcttggtaatcccccactgttactgctgaggttctttcagatgtgggcagctgtgtttctggcctcttctattgaaattctaaatatagtttctaaccaaa

SEQ ID NO: 272797 - DNA, 359 bp, Homo sapiens
catttttatcatacaagcccctcatttccatgccctgccctttctccagttcattcttctccccaagatggcagaaaatcctcctttcaggccgggcgcggtggctcacgcctgtaatcccagcactttgggaggccgaggcaggcggatcacgaggtcaggagatcgagaccacggtgaaaccccgtctctactaaaaatacaaaaaattagccgggcgcagtggcgggcgcctgtagtcccagctactcgggaggctgaggcaggagaatggcgtgaatccggaaggcggagcttgcagtgagcggagatcgcgccacagcactcccgcctgggcgacagaacgagactccgtctca

SEQ ID NO: 272798 - DNA, 516 bp, Homo sapiens
tgcatgtggatgggcttccttgcttggaatctgctctcttctccctttatcctactttgcagaacttctgaagtagctttaagccgctgtctggctctgtgaccctgggagagccacttgctttgttaaacatcgattttcctgtctgtaaagtgaagggacaggaccctttcagctgacacattctgtgaaataagattttatttttacattttgataaagcatattaggggctttatagtaggatgtgatttaaggaatttgcttattctaattgagacacaatggtggggagtgggggtcggggactacacaggtgcattttctgaacatttataaaatgaaaaagatggaggcttggctagaatggttaatccccttttcattcctctaattctatgacaatttttcttaaaaaaccaaacacaaccaaaataagagtggacagttgagaattacctttaggttcccatgaccctgaagactgtatttggccttggatccattaaaaaaaaa

SEQ ID NO: 272799 - DNA, 178 bp, Homo sapiens
acagtttacagttttcaatctgtttactagcagtctctggcatcttctacacacagtcaaaccaaccacagcttgccctcccgtcagcccaggcagctgcggaccgctttctgattgatgtgaatcctcctcactgcacgtctcctcattcttactgatttggccaagccatactgcg

SEQ ID NO: 272800 - DNA, 202 bp, Homo sapiens
ctattaacaggtgaattgatgtttattacacataaattatacagataagtaaaaataaaaattttaaatatcccataattctagtacccgtaggccacaattgtatgttttgtaaaatctttcagacatttctacaaaaaataggttcatacctattaagttataatctacttttttcacttaaaaattggaagtatcttac

SEQ ID NO: 272801 - DNA, 277 bp, Homo sapiens
agttttccctgttcgtgggagggtcgtagttgatgactaaagaaagctgctgcacatcaatgcctctgggcagcaggtcagtggtaatcaaaactctgctagagccagaacgatactccctcatgaccacatctcgttccttttggtccatatctccatgcatggcagagacagtaaaatcttgggcatgcatcttctgggttagccagtcctccttccttcaggtgttgatgaagatgactgcctgggtgatggtcagggtttcattcaagtcaca

SEQ ID NO: 272802 - DNA, 407 bp, Homo sapiens
ctctatcactacatatacgctatcactacatatactctatcactgcatatactctatcactgcatataccctatcactgcatataccctatcactacatatactctatcactgcatatactctatcactacatatacactatcactacatatactctatcactgcatatactctaccactgcatatactctatcactgcatatactctatcactgcatatactctacatatatgctatcactacatatactctatcactgcatatactctatcactgcatacactctacatatatgctatcactgcatatactctatcactgcatacactctatcactgcatacactctatcactgcatacactctatcactacatatatgctatcactgcatatactctatcactg

SEQ ID NO: 272803 - DNA, 379 bp, Homo sapiens
aggctccctactcccattgcacctgtacctggaccttgtggaccctccagaagatgaagtccaatccagaaagccgtgatcatggttggatcacaatcctgtgattttcttcttccccacaccatttctgttgctttcggagagctgagcagatcctaagcacacgactcccacacagacatgcacggccatccattaatcagtattgagtatctacggacagcacagccctacgctgggctctcaccaggcagacaaatatttagtcatgaaaatgatttccaaatccagcagcacttaagcagaaatagcatttcttagaacaggaaaaaataataataaattaacaaacccgaggactgtctagagaatcagacat

SEQ ID NO: 272804 - DNA, 418 bp, Homo sapiens
atgggttcttctggagtcttctgaacctgctgggcatttctgactggatgaaaattaacaaaagtctatgttcatcctgatgaaaattagcagcagttcatcttagtttaattgccacaacgtgcagctatgagaaggctgataaagaaaagaaaactcaaatcttacaaaaatctatcagcataaaaggacaagagctttacaagatagataagagaaaaaaatcatttgccaaacctcggggcaggttctgagggagaatgtacaactttattttgatggcaggaatatatttgctggatgaaaaaaaaaatcctgccttggcatcatgggtactgtttgtagcctacaacttgaggtttttgcactggggactgaaaaagttatcagtgttaataaaaagaagttttcctgagaa

SEQ ID NO: 272805 - DNA, 489 bp, Homo sapiens
acatcagggaatacattgggaaaagggcctcccagcatgtgagtcagagcatcacagaagagattgagaccctgatgggagtcctggacaaggacgatggggagagcaccgccagcagcgggggtgggtactggaagatttaaaagctgccccctccatctcaccacctacaaactctcacacgtcctggaagatggggggaccctctccaccatcaccacttggctgaaggtggtccagacgtgaagccaaggattccagggcgcacagccttgggcaggactaatggacttaaaaaacataggctcaacaaaatccacttcacaacccagatggttcacatcacaccctctttcaaggacccagagcagccactggaagagaaggagtaggaacgctctcttaaagtctacttatcctattccttcaaattaagaccaaagtccaatgtatttaggtaaaaaataatttcttttagaaaatgctaag

SEQ ID NO: 272806 - DNA, 483 bp, Homo sapiens
acaaattttagtcctggaggatgctaatacagtttaaaaaaaaaaaacttgagacaaaataagtttaacagtttatttgagccaagagagctgcactctgcagggtgaacagcaagattctatagatgaaacacccaagagaggtagagaaattacttgattggctacagctaggcattttggcttatttgggtatgatccagtggctagaggttagttagtggtttctgataggttaagcttaagttttattttactgtttatgttgaattgggttttggcctgcttacctgggggctatagctacagtgacaacctcaggctaatggcctcagtatttgctttaaagatatatattggccgggtgctgtggctcacgcccgttaccctagcactttgggaggccaagaccggtggattgcctgagctcaggagtttgagaccagcctgggcaacatggtaaaaccccatctatacttcaaa

SEQ ID NO: 272807 - DNA, 460 bp, Homo sapiens
attgaatattcttacacatttatttggtgaagaacttttatttcaaattatgaaagaaaaaaatacttgctagaattctgatttgaagtgctttcaaattctgtgttaatttggagctgacaccctttaatattgagtcctggctttgagggtctggtgcgtttcctccattcactgaagttttattttacatctctcagtaaagctttatggattagggtcttcagaagccttacttgtttttctggctctattttcttgtccagaaactccaccactgtgctaaagagacagtggtggaggtgctgggcgtgctgcttttctcctggctctaatgggaaggccaagaggcaggtcagggtcagactccaccttgagtctggcattggctgttggcatcatgaggaccccacgtattgtactttgataaagttaataaatggaattctcctttacctca

SEQ ID NO: 272808 - DNA, 407 bp, Homo sapiens
tttctcactgctcttttgcatatgtaattctgcttgactgcagttcttgcctattccttcttggacaatgtttcccagaaaatcttgtcatctgtcacttgtaattatcttggcacgaccgtttcttttctgaaaggtaccgcttacatgctgcctcctggaggcgcttttttctgattcttttctctcttagtctccttattccccataaataattgttcactcctcttaacaggaaataatctttgtctatgcatctgttatggctgtctcaatctgctactcggtatttgtatacctattaacgtctctgttggaagctccttgcaagctaagtccatgtctgattaatcaggatttacagtatctagcactaaccagagctttaaaaaaataataataaaata

SEQ ID NO: 272809 - DNA, 763 bp, Homo sapiens
ttaaaaatatgttatttacaatttttttgtaattgatttttgctttacatgagagtgtatagagccatctactttacagttgaatcttctttatagatattaatccagtggaaaaatttgaaacgttttctgatacagggtcttgctctgttgccaggctggagtgcagtggcacgatcctggctcactgcaatcttgaactcctggactcagggaatcctaccacctcagccttctgagtagctaggactacaggcccatgccaccaaacctcaccaattttttgttttaagagacagagtcttgggccaggcacagtggctcacgcctgtaatcccagcactttgggaggccgaggtgggcggatcatgaggtcaggagattgagatcatcctggctaatacggtgaaaccccgtctctactaaaaatacaaaaaattggccgggtgttgtggcgggcgcctgtggtcacagctacttgggaggctgaggcaggagaatggcatgaacccgggaggcggagcttgcagtgagcagagatggtgccactgcactccagcctgggtgacagtgacactccatctcaaaaaaaaaaaagaaaaagaaaaagtgtaaatctatggtttttaatgggactgaaagtcagcaaaatatcaatgacaattatgattatgactgggtgttctgctaataggctattgatgtttggatgactaataaagacgtacacaattcataattataatatatgcatttcataaaa

SEQ ID NO: 272810 - DNA, 597 bp, Homo sapiens
tacctgactgcaagagtgaagtgagatgaagcttgtaacatgccagcactgtgtctggcccacagtagccacttgtcagtgtgtgatggtgtagctggcaggaacgtgtggacagtggtatggtgcggtcagactgagcgtacagagcaatgggagagataagctaactgagttagccaggtgtgtgggtatccagcagtgtgtgttgaacacctgtatgcaaagtcctgcctggaagctctgttcagggaacttctgaggccgtcctggctacagttgcagagccaggaaccagggtaatgcagaaagaatgggaggaggaggaactgttaggggtgtggaaggcacagttaggattagggggtgacagtaagtagccaaagccaccttctgcagcccagctgggtctgtgacctgctaccaccctctttttgtaagaatacttcttttagttgaaaaagtaaaacttgggcattgtttaaaaaaagagaaaaagaaggaagagtataaagggtactttagcaaaaagtgctcttgcctctctccctccctcctgtatggttgaaggccgagtcagctcggtagaatgactgtcac

SEQ ID NO: 272811 - DNA, 380 bp, Homo sapiens
ggtaaagttattttaaaaattctgtatctgtatctttctggcaaagttattttaaaaattccctacctgtgtctttcttcagctaccttttaattggtgacatctccatcaaagaagtagaagtccataaaagaaaataaagcttttgggaacactgaccccattttctaaagtttgtgttctctgattggccattcccagctttctacttgcataaactctgtattctgatccttttgatggcttcaggttgacaatgtcaagagaggcaatttagcagagtagtcactagtttaccagtgattttcctcagcaggagttagcctaggatttttaaactacattttccctctcccctatccctatctccctagaagaat

SEQ ID NO: 272812 - DNA, 472 bp, Homo sapiens
gtcatgtatcactttctaaatatatgaaattgctcataggatatcattacctcaaattcaactgtgctcaaaatgaaacctgtgatcatttttcccaacatgatcctctttctgttttctccagtttagtttgtgcctccaaaattcagcccttcacacaaactagaaatgggagagtcaagcttgacagtttctaatctcgccctctgtcttagactgctaagacaaaatactgtagattgggtggcttgagcagcagactttgatttctccagttctggaggcctgcaagtccaagatcaaaatgctttcagatttggttcctgatgaggtctgtattaatccattttcatactgctatgaagaaatacccaagactgggtaatttataaataaagagaggtttaatggattcccagttccacacagctggggaggcctcacaatcacagtggaaggtgaaagaggagca

SEQ ID NO: 272813 - DNA, 772 bp, Homo sapiens
agattcttccaggccaggcgtggaagtggcataaacacttctgtccacattctgttgtccagatcacagtcagatggcccccctccccacaggggactgggaaatgtccctcattgggctgccacttcccagcagcagctctgttgtgactattaggagttcactatatattctgattactcatcccttatcaggtatataatgtgcaaatgttttcccccattccatgggcttatgaagttcattttgcctattttttcttttgtaacatgagcctttggtgccctgactatatctcttttgacaataaaatattttccttcttttttacagctaaaattgagaataaactaggttttatagaaattcctaaaagtcagttgctgtattaatctatcctaaagatccatattgagtgggaagaaaaagggaaaacaactttcatctttaaaattactttatgtagaaggttcttggttatctcatagactgtggcttcacacattaagctaattgataatatgctaagtttttaagaatcttttaaaaacttggtctgataggattctgtaattgagctaatcgattctattgtcaatctaaaaaaagatatcagagaaaaatatctctgaatttaatgaatgaattagggagtaagcaaagaggattataatttgggatgcacagccatggcgagccacaggtgcacccgaaaaggggaaaggaagaggaagcttttatttggcagacagggagaggttcacataagctg

SEQ ID NO: 272814 - DNA, 425 bp, Homo sapiens
accagtagccccagggtgttacttgaatataatatggttaatttgttagttgttaatgggatgaatctggaaccagtgccagcttttattttatttccagcaaatttagctcttgcttttgcaactgtgtagataaggggtcagcaaacttacactgaaaaaggccaggaagtattttaggttttgctcaccagattgactatgtcataatactcatttctgtcattgaagtcaaaaagcagccatagacagtatgttgacaaatggatgtggctgcgtttcaataaaactttacaaaaacaggatgcaggctggatttagcccatgggctatggtttgccaattgctggtatagataaaaatcaaactcggctatcagaaaattataaatcaaatattctcctgggtggtgagggaaaatagag

SEQ ID NO: 272815 - DNA, 470 bp, Homo sapiens
acaccaatctaagacaggaaatgacttgcctgaggtcacaccttgttcgggagagagccaggacaagattctgggactttggactccgtgtgctgtgtttgtgactccctactgccatagtgatgactagggtcagctggggtggcccagtgtcagcttgggtcaaaggcagatcaggtgcttgtggtggttaaagcccaaagggaaagacaatcctcttttcaataataacggggagctgggcatgtcccattctgaacgtgaaccatgggagctgagggcccttaggccttcgaaggccatgcccgggaagcagccactctctctcctacagaacatcaactttggagtctccaggtttaaatcctggctgtaccacataccattagtgacaactagggcaaagtaccttgaacctcagtttccttctctgtaacttcggaataaaaacattaatattgtagtatagt

SEQ ID NO: 272816 - DNA, 259 bp, Homo sapiens
gaagaaactataccaagaaagtatacattgaaaccaaggtgaaagaattttcaaaaagggagatatgatacagaacactgcaaaaaagtcaaaagaattttggttgatgaactaacattggattcagcaacactgaggtcattagtgtctttgaagagggcaatttcgtgtagtggtaaaatgatagtactgggtccattatagttcttgagaaaatcatcaatagtatttcttttcttttctttctttttttttttaa

SEQ ID NO: 272817 - DNA, 512 bp, Homo sapiens
ggagaactgcttgaacccgggaggcagaggttgcagtgagccaagatggcggcattgcaagccagcctgggggacaaggctgagacttcatatcacaacaaaacaaaagaaaaaaccaaaacagaacaaaaaaactgcaggaaaaaaaattaaatagttggagtggccttagggtgtgccaaaatattctttaatataactatgccattacattttattccttaatctaaatatttgagctcagaaaccttagtacattatcttttatgacaaggtaaaataaaatcacctaaagttattattgggttatcttcctaatattatgagaagattttttgtatataattcttattcttgcccagcagaagtacaaatcaactttagatcttagaatggatgtgaaattaaaatagtaaaatcctagtatttcctcgtattgtgcaatcgaattttattaaaggccagaataaattttcatgtagtcaatgtaaatattgcttatttatgtaact

SEQ ID NO: 272818 - DNA, 750 bp, Homo sapiens
tggggtcagggcctgggccatggagcttgcagaggcaaggatgaagatgaggaatggatgcctgtcaccaagttgggctacctggtcaaggacatgaagatcaagtccctggaggaaatctagcccttctccttgaccatcgaggagtctgagatcattgactttttcctgggggcatctctcaaggatgaggttttgaagaccacgcccgtgcaaaagcagacctgcgctgaccagcataccaggttcaagaaacctgtgtttgcatttcagatgtctcttaacttactgaggaaatcattaccaacctcactgggtggacaggaggatgaacaggagaacttcagcaaattgtagttcttgttctatccctgaactaacccaacattcaaagtcactcatctgatgcttcccacctggcaccctgcacttgtatgtatttttccattcatattcatttctgcctcttcatctagattacacagcaacaatgtaaattaatgactactcaagagtcagacagacatgagttcaaatcctacctttgctacttactacatgtgtgtcctgaggcaagataaagcctctgagctcagtttctctgtcagtaaaaaggacctatctcctagtgttataggattaaatcagatgatacatgtaaaatctttagcttgggggtctgtcacgtaactgagcaatgggtgactatgttgtaattattacaccctcctgacatgcacacggtaggag

SEQ ID NO: 272819 - DNA, 729 bp, Homo sapiens
tggggtcagggcctgggccatggagcttgcagaggcaaggatgaagatgaggaatggatgcctgtcaccaagttgggctacctggtcaaggacatgaagatcaagtccctggaggaaatctagcccttctccttgaccatcgaggagtctgagatcattgactttttcctgggggcatctctcaaggatgaggttttgaagaccacgcccgtgcaaaagcagacctgcgctgaccagcataccaggttcaagatgtctcttaacttactgaggaaatcattaccaacctcactgggtggacaggaggatgaacaggagaacttcagcaaattgtagttcttgttctatccctgaactaacccaacattcaaagtcactcatctgatgcttcccacctggcaccctgcacttgtatgtatttttccattcatattcatttctgcctcttcatctagattacacagcaacaatgtaaattaatgactactcaagagtcagacagacatgagttcaaatcctacctttgctacttactacatgtgtgtcctgaggcaagataaagcctctgagctcagtttctctgtcagtaaaaaggacctatctcctagtgttataggattaaatcagatgatacatgtaaaatctttagcttgggggtctgtcacgtaactgagcaatgggtgactatgttgtaattattacaccctcctgacatgcacacggtaggag

SEQ ID NO: 272820 - DNA, 550 bp, Homo sapiens
ctatgaagctcaagcaggataattacaaagaaactacaactaggcacatcattgtaaaactgctgaaaaaccaaggcagagagaagtaagcagatttacgaaggggaaagagaagagattacttcaaaagagatgcaataagagctatattgtttcatagaaacaatgaaattcagatccttaaagggcagaaagaagtatttccaacctagaaattctatatatacccagcgaaaatatctcttaaaaagatatccaaggctgggcgtgacggctcacgcctataatcccaatactttgggaggccaaggcaggtggataacctgaggtcaggagttcgagacaagcctggccaacatggagaaaccctgtctatactaaaaatacaaaaattagccgggcgtggtggcatgtgcctgtaatcccagctactagggaggctgaggcaggagaatcacttgaatccaggaggtggagattgcagtgagccaagatcatgccactgcactccagcctgggcaatggagcaagactctatctcaaaaaaaaa

SEQ ID NO: 272821 - DNA, 510 bp, Homo sapiens
aagcagttaatacagactcaacttactaaactcagggataagagaagtgacaacactactgaccttctagaaataaaaaggatagcaaagaaatactatgaacaattatatgccagcaaattagataacctacatgtagaggagaaattcctagaaagatgcaaagggccaaaatagactcaagaagaaatagaatatctgaatagacttataagtaaatacactgaatttgtaacataaaaattttccacaaagaaaagcccaagaacagatgacttctctggaggattctatcaaatgttttaaagtctaattaccaccaatccttcacaaattcttccaaaaaacagaagggactagaacacttcccactgagtctgtattaactgcttgccaagcagttaatacagactcaccaagccacagacttgtcttccacaagcacgttcttaccttagccacgaagtgaccaagccacacgtactacaggttgaactcaaagatatgtac

SEQ ID NO: 272822 - DNA, 292 bp, Homo sapiens
ccacagtataatgaatatgatgatcttaaatctactgttaacagtttaaaaccattatttgggtcataaagaggaagcagtcactgagaattcagtctatgtattttttcttttttcttgtttttgaagagacctttttcactgacaggatctcattctgtcacccaggctgcagtgcagtgacatgatcctagctcactgaagcctcgaactcctcggctcaagtcatcctgcgacctcagcacttgaggcacatgccatcctgcccagctaaatttttttagagatgggg

SEQ ID NO: 272823 - DNA, 598 bp, Homo sapiens
aggcctgccctgcctgacctactcttgtgaggccaaggccatctcctccactctctgggggcctcttctgactcctccaaactcttccatgtctggactcctggcttctgcccaaggccatctattggagtttgggtttccagttgaggatctgcctttttcctggatgaccaaacctagaatgtgaccggcctcatgctccctcctcacaagggtgtggctttatccgagggcctcagcaaggcaaccaacaccagacatgaagctggaggagattttaaaaggaagtctctggtggtttgtaaagcaacaaatcctgctctcaagtggatagttccaagccctctcaatgaattcagttttatacacctggagaagcacagcctcgtcctttccatggagctacaagccacatctgggggcgctcagtgcccaggctgagggggcacgcagagccctcggggacgactcaatgcacagaggccactccttaagggcccggctccctcaaactgaggtgtccccatgcttggtcttcccacagaagccagcctggttggctgcttcaaaggaggaataaagatgaggagccatgaaa

SEQ ID NO: 272824 - DNA, 436 bp, Homo sapiens
aggcctgccctgcctgacctactcttgtgaggccaaggccatctcctccactctctgggggcctcttctgactcctccaaactcttccatgtctggactcctggcttctgcccaaggccatctattggagtttgggtttccagttgaggatctgcctttttcctggatgaccaaacctagaatgtgaccggcctcatgctccctcctcacaagggtgtggctttatccgagggcctcagcaaggcaaccaacaccagacatgaagctgagcacactcagctcatcctgggagacaaggtgggggtggaggatggtccatccttcttccgcatcaagatgggaagtcttgactcattacccgctggagacttttcctgctgggctctgcactgtcaactgtgagagagggaaataaaacgtactgtacagtccaatc

SEQ ID NO: 272825 - DNA, 558 bp, Homo sapiens
tcagagagcatggaagtgagatggagaggccagcactgatctgtatcgtgcagccctgggcggcagcctcggttgggcccttgacacactcctcccatccaggcccccagccaccctgtgagggaggcactattacgcccaaaaatgcaggcaaggaaatgggctgagggaggggaagcattcactgaagttagtttgtacgtggctgagctggccctgaagcccatgccctttccacttgccagacagatgggaagtcttgactcattacccgctggagacttttcctgctgggctctgcactgtcaactgtgagagagggaaataaaacgtactgtacagtccaatctgggatacttctgagagtgaaagtggctctactagtaattaccccaggacagcatgtataaaccagggctgttccaagcaactgggacacatgattaaaatgcagattccatggcaggtcccgctcagaggtttatttagtgggtcagaaaatgggcccaggaatttcattttaacaaatgtctccagataaatctgatgtaaatggaa

SEQ ID NO: 272826 - DNA, 370 bp, Homo sapiens
tattcttagacactgctgatcgatctgtacattggaccgatctgtacattggactgatctgtacattggaccagtctcttgagggaacgttttgggccatgcatcctgaacccaccccctgctccttggacccagtactttcacttctaggaatccgtcctgagtagatgggaagagaaataaagatttacagatggaagtgtatcatagctttatttggtgcagttgacaattagaaatgaacctagtgttcagaagcaggaaaatacttaagtagatttcataagctacatagagaaatgtttatttatttatttacgagttggggttttactcttgttgcccaggctggagtgcaatggtgtgatct

SEQ ID NO: 272827 - DNA, 210 bp, Homo sapiens
tttttttttgctatgattctcgtgataaaaaactgtttaaccctttccataaatctgcaagctgggttcctttgcacagatgacgaagttaaagatcagagaggttaagtaactcattcaaggccacacagccagtaaatgttggaggcggtatttttgagcctagatggtttcactccagattccatgtgtttagcaggaacactgttc

SEQ ID NO: 272828 - DNA, 461 bp, Homo sapiens
taggttgagagctgattcccaataacatgcctcattgatttgactctaagcagtaatcaggggcccaacagttgttggaccaaccagccttgattttccagagaaggtgatttggtatatggtagtgtctgagggtgagattgccccagatgggagtggagggaagcagaacagttttctctggtgttttactgagtttttgtcttgatcctaaatccaagggttagggtcagaaacacagactcagaggttagatttaacacccatttagtgggttaaacacatcaatggttatgtgaactttgttaaggtttaaaaagctatttagggcctgtttctccctcataggaatttttgcaatcagcctttttagtagatgcccatatagaaagtgaatttgggagggtctaaggtggtattactattaaactttttgaaaaggctgtgtgatagcaatggaa

SEQ ID NO: 272829 - DNA, 367 bp, Homo sapiens
tgctctaaaacattctgaagaatgtgcacttttgaaaattttccataatagatggtttaagaaaaacagtgtctacccccacgtgtctaagcgtctggcccattatcatgcaaagcagcatttggcttcttttatcttttgttctctttgttactcgggctaaaactacacatcaacgctcctgcaatattgctaacttctttccttatgctagaaaacttctttttgatagcataattcatttaaatatgtttagattagctgatagtatttttatttaaaatatttattttaaaattgtatatttgtgtatgtttgtatttatatatttgtatataataaattaaattataatttaaaataaaat

SEQ ID NO: 272830 - DNA, 386 bp, Homo sapiens
tgcctttggactaggcctgtggaaggaggagttattcattcccttaagttttcgggagaatctttcagggatataaaacattcttattggggttgctgctgggtcctcagatatcagtgagggagaaaagtgcaccgtttaggttccatctgaatgcttcatcagctctctgaagaacataattttaaaatccccactgaaaaaggatggaattaatagcctggaataatttagaaagatgtgtatgtaaaggaattaattcaaagaaatgtgtcttctagaatgctaaagagacagtatttaaatagactgctagaaattacaaaacatgggcatcatatgtggcttgaactttgcataaaacatgtttttcatgattagattca

SEQ ID NO: 272831 - DNA, 401 bp, Homo sapiens
tcaggaatttttgcatttctgcctctgccctgaattctaaacaatctttcaaatcctttatcttatccttgggcagcccctcctcttccacattgctggtcactgggtatcttcactgtgacagaattaaagaaaaatgtgaaatttattgttatccatggtgaagatttctacaaaagacagtcttcctcccaaggtttgaggtgggaggccaagataagcctcctcccaaatgtgggggaagagctccaaattctactctagcaagggtttgctctgtaatgaggccccagcttgaagtgagatgatacagagaaaacatttgttggaatttcactcagtgctgttacatggttcttggtgtgttgtaaataaattatttttatatttcaagccaaatc

SEQ ID NO: 272832 - DNA, 552 bp, Homo sapiens
tgttttttactataaggaataaactttcatgtttgatacactaaaaagaggtcaccactcccacctaatctgtacttttgattatctttctttgtggctgccagtagaaatttattctcatttgatctctgcaaccaccctccttatgatgaagaaaaagtttacctaggtttaacagcccgtggttgctcataccatattatctaaagccaagtgagtctgacttcagaatccatgttgtgtatcaaggcgctaacattctgtacttgtggcttcatagtgttggaaaggttaaaaccagtgtgttgtaattaataactctctgttaataaggctcattctccaaagctggccagactcagatccacccctgttctatactgtctcagaagcatttctaaagatgagctcacaaccatgaaaagtgtttgatttggggaatgtgtgtttccgaaatcatctaagtcaagaataagtataggacttggtacataacagatgttccaaagtttcgaagagaataagctgcctccttaatctttagttttttaa

SEQ ID NO: 272833 - DNA, 595 bp, Homo sapiens
tagttccagaacatttcatctttccaaaaggagaccccatccccatcagcagccactgcccattcccctgccccgagcccctgacatccagtcaactgctttctgcctctgtatttccctcgtgcttcattcctttttatggctctgtaatactccattgcgtgggtagctacgttttgtttctatctcttggtggacatctgggctgtggctgccttatagagattgtgagcaatgctgctctgaacatttgtgtacaagtttttgttccgtgtccctgttgacaaacctttcttgaggttaaattgacaacatggaaaaaaccttaacccacttatcctgagggagggtgggaatagtgatttcatctgcgttggttttagtagtagcaaaaacccagcccccactgaatgtcaacacaaggaaactggtcacgtaaatataaacagcagacgtcccagacgagctgggtgtggttccaggacatgggtcctgcctggtttctgccagaatcattgttcatggtgacctccatttcctggtcaccaagtaaggctgttcatcataaagtggaaaaaaagctggaaaaaaaata

SEQ ID NO: 272834 - DNA, 601 bp, Homo sapiens
gaggcctgaggagagagatgggggtgtggccagtccgtggatcagtcagaacacacacaacatttgtgggttaagtctgctatcttatataggtgtggtttgtagctcaccctcaaaattatgaagtaacatcaaagatcattgatcacagatgaccataacagatataataatgatgagaaagtttgaaatattgtgagaattaccaaaatgtggtacaaggacacaatgtgagcacatgcttttgggaaaatggtaccaatagacttgctgaatgtagagttgccacaaaccttcaatttgtaaaaaatgcaatatctagctgggtgcagtggctcatgcctataattccagcgctttgggaggccaaatcaggaggatgactggagcctaggagattgaggttacaattagctatgatcataccacctgtattacagcctagacaacagagcaaaacactgttccttaaaaaaaaaaaaaagctaatatctgcaaagcacaataaagcaaagcacaataaaatgagatatgcctgtatacacagagaattaaaataactgattgtatgcaagtttaaaaatacttagaaaaaaaaaaa

SEQ ID NO: 272835 - DNA, 366 bp, Homo sapiens
ttttcccccatcacccacgctggagtgtagtgatataatcatagctcattgcagcctccagctcccaggctcaagcaatcctccctcctcagcctctcgagtagctgggactacaggggtgcatcaccatgcccagctcatttaaaaaaatttttttgtagagatgaggtcttgctatgttgcccaggctggccttgaacccctggcctcaagcaatcctcccgcttcagcctcccaaagtgctgggattatacgtgtgagccaccatgtctggcctctcctccccacccccacaggcccactatctttttgttgttatagttgcttttcaaattgtggtaaaatacacaaaacataaaatttgcc

SEQ ID NO: 272836 - DNA, 14536 bp, Homo sapiens
ggagttttccaccatgactattgccctgctgggttttgccatattcttgctccattgtgcgacctgtgagaagcctctagaagggattctctcctcctctgcttggcacttcacacactcccattacaatgccaccatctatgaaaattcttctcccaagacctatgtggagagcttcgagaaaatgggcatctacctcgcggagccacagtgggcagtgaggtaccggatcatctctggggatgtggccaatgtatttaaaactgaggagtatgtggtgggcaacttctgcttcctaagaataaggacaaagagcagcaacacagctcttctgaacagagaggtgcgagacagctacaccctcatcatccaagccacagagaagaccttggagttggaagctttgacccgtgtggtggtccacatcctggaccagaatgacctgaagcctctcttctctccaccttcgtacagagtcaccatctctgaggacatgcccctgaagagccccatctgcaaggtgactgccacagatgctgatctaggccagaatgctgagttctattatgcctttaacacaaggtcagagatgtttgccatccatcccaccagcggtgtggtcactgtggctgggaagcttaacgtcacctggcgaggaaagcatgagctccaggtgctagctgtggaccgcatgcggaaaatctctgagggcaatgggtttggcagcctggctgcacttgtggttcatgtggagcctgccctcaggaagcccccagccattgcttcggtggtggtgactccaccagacagcaatgatggtaccacctatgccactgtactggtcgatgcaaatagctcaggagctgaagtggagtcagtggaagttgttggtggtgaccctggaaagcacttcaaagccatcaagtcttatgcccggagcaatgagttcagtttggtgtctgtcaaagacatcaactggatggagtaccttcatgggttcaacctcagcctccaggccaggagtgggagcggcccttatttttattcccagatcaggggctttcacctaccaccttccaaactgtcttccctcaaattcgagaaggctgtttacagagtgcagcttagtgagttttcccctcctggcagccgcgtggtgatggtgagagtcaccccagccttccccaacctgcagtatgttctaaagccatcttcagagaatgtaggatttaaacttaatgctcgaactgggttgatcaccaccacaaagctcatggacttccacgacagagcccactatcagctacacatcagaacctcaccgggccaggcctccaccgtggtggtcattgacattgtggactgcaacaaccatgcccccctcttcaacaggtcttcctatgatggtaccttggatgagaacatccctccaggcaccagtgttttggctgtgactgccactgaccgggatcatggggaaaatggatatgtcacctattccattgctggaccaaaagctttgccattttctattgacccctacctggggatcatctccacctccaaacccatggactatgaactcatgaaaagaatttataccttccgggtaagagcatcagactggggatccccttttcgccgggagaaggaagtgtccatttttcttcagctcaggaacttgaatgacaaccagcctatgtttgaagaagtcaactgtacagggtctatccgccaagactggccagtagggaaatcgataatgactatgtcagccatagatgtggatgagcttcagaacctaaaatacgagattgtatcaggcaatgaactagagtattttgatctaaatcatttctccggagtgatatccctcaaacgcccttttatcaatcttactgctggtcaacccaccagttattccctgaagattacagcctcagatggcaaaaactatgcctcacccacaactttgaatattactgtggtgaaggaccctcattttgaagttcctgtaacatgtgataaaacaggggtattgacacaattcacaaagactatcctccactttattgggcttcagaaccaggagtccagtgatgaggaattcacttctttaagcacatatcagattaatcattacaccccacagtttgaggaccacttcccccaatccattgatgtccttgagagtgtccctatcaacacccccttggcccgcctagcagccactgaccctgatgctggttttaatggcaaactggtctatgtgattgcagatggcaatgaggagggctgctttgacatagagctggagacagggctgctcactgtagctgctcccttggactatgaagccaccaatttctacatcctcaatgtaacagtatatgacctgggcacaccccagaagtcctcctggaagctgctgacagtgaatgtgaaagactggaatgacaacgcacccagatttcctcccggtgggtaccagttaaccatctcggaggacacagaagttggaaccacaattgcagagctgacaaccaaagatgctgactcggaagacaatggcagggttcgctacaccctgctaagtcccacagagaagttctccctccaccctctcactggggaactggttgttacaggacacctggaccgcgaatcagagcctcggtacatactcaaggtggaggccagggatcagcccagcaaaggccaccagctcttctctgtcactgacctgataatcacattggaggatgtcaacgacaactctccccagtgcatcacagaacacaacaggctgaaggttccagaggacctgccccccgggactgtcttgacatttctggatgcctctgatcctgacctgggccccgcaggtgaagtgcgatatgttctgatggatggcgcccatgggaccttccgggtggacctgatgacaggggcgctcattctggagagagagctggactttgagaggcgagctgggtacaatctgagcctgtgggccagtgatggtgggaggcccctagcccgcaggactctctgccatgtggaggtgatcgtcctggatgtgaatgagaatctccaccctccccactttgcctccttcgtgcaccagggccaggtgcaggagaacagcccctcgggaactcaggtgattgtagtggctgcccaggacgatgacagtggcttggatggggagctccagtacttcctgcgtgctggcactggactcgcagccttcagcatcaaccaagatacaggaatgattcagactctggcacccctggaccgagaatttgcatcttactactggttgacggtattagcagtggacaggggttctgtgcccctctcttctgtaactgaagtctacatcgaggttacggatgccaatgacaacccaccccagatgtcccaagctgtgttctacccctccatccaggaggatgctcccgtgggcacctctgtgcttcaactggatgcctgggacccagactccagctccaaagggaagctgaccttcaacatcaccagtgggaactacatgggattctttatgattcaccctgttacaggtctcctatctacagcccagcagctggacagagagaacaaggatgaacacatcctggaggtgactgtgctggacaatggggaaccctcactgaagtccacctccagggtggtggtaggcatcttggacgtcaatgacaatccacctatattctcccacaagctcttcaatgtccgccttccagagaggctgagccctgtgtcccctgggcctgtgtacaggctggtggcttcagacctggatgagggtcttaatggcagagtcacctacagtatcgaggacagcgatgaggaggccttcagtatcgacctggtcacaggtgtggtttcatccagcagcacttttacagctggagagtacaacatcctaacgatcaaggcaacagacagtgggcagccaccactctcagccagtgtccggctacacattgagtggatcccttggccccggccgtcctccatccctctggcctttgatgagacctactacagctttacggtcatggagacggaccctgtgaaccacatggtgggggtcatcagcgtagagggcagacccggactcttctggttcaacatctcaggtggggataaggacatggactttgacattgagaagaccacaggcagcatcgtcattgccaggcctcttgataccaggagaaggtcgaactataacttgactgttgaggtgacagatgggtcccgcaccattgccacacaggtccacatcttcatgattgccaacattaaccaccatcggccccagtttctggaaactcgttatgaagtcagagttccccaggacaccgtgccaggggtagagctcctgcgagtccaggccatagatcaagacaagggcaaaagcctcatctataccatacatggcagccaagacccaggaagtgccagcctcttccagctggacccaagcagtggtgtcctggtaacggtgggaaaattggacctcggctcggggccctcccagcacacactgacagtcatggtccgagaccaggaaatacctatcaagaggaacttcgtgtgggtgaccattcatgtggaggatggaaacctccacccaccccgcttcactcagctccattatgaggcaagtgttcctgacaccatagcccccggcacagagctgctgcaggtccgagccatggatgctgaccggggagtcaatgctgaggtccactactccctcctgaaagggaacagcgaaggtttcttcaacatcaatgccctgctaggcatcattactctagctcaaaagcttgatcaggcaaatcatgccccacatactctgacagtgaaggcagaagatcaaggctccccacaatggcatgacctggctacagtgatcattcatgtctatccctcagataggagtgcccccatcttttcaaaatctgagtactttgtagagatccctgaatcaatccctgttggttccccaatcctccttgtctctgctatgagcccctctgaagttacctatgagttaagagagggaaataaggatggagtcttctctatgaactcatattctggccttatttccacccagaagaaattggaccatgagaaaatctcgtcttaccagctgaaaatccgaggcagcaatatggcaggtgcatttactgatgtcatggtggtggttgacataattgatgaaaatgacaatgctcctatgttcttaaagtcaacttttgtgggccaaattagtgaagcagctccactgtatagcatgatcatggataaaaacaacaacccctttgtgattcatgcctctgacagtgacaaagaagctaattccttgttggtctataaaattttggagccggaggccttgaagtttttcaaaattgatcccagcatgggaaccctaaccattgtatcagagatggattatgagagcatgccctctttccaattctgtgtctatgtccatgaccaaggaagccctgtattatttgcacccagacctgcccaagtcatcattcatgtcagagatgtgaatgattcccctcccagattctcagaacagatatatgaggtagcaatagtcgggcctatccatccaggcatggagcttctcatggtgcgggccagcgatgaagactcagaagtcaattatagcatcaaaactggcaatgctgatgaagctgttaccatccatcctgtcactggtagcatatctgtgctgaatcctgctttcctgggactctctcggaagctcaccatcagggcttctgatggcttgtatcaagacactgcgctggtaaaaatttctttgacccaagtgcttgacaaaagcttgcagtttgatcaggatgtctactgggcagctgtgaaggagaacttgcaggacagaaaggcactggtgattcttggtgcccagggcaatcatttgaatgacaccctttcctactttctcttgaatggcacagatatgtttcatatggtccagtcagcaggtgtgttgcagacaagaggtgtggcgtttgaccgggagcagcaggacactcatgagttggcagtggaagtgagggacaatcggacacctcagcgggtggctcagggtttggtcagagtctctattgaggatgtcaatgacaatccccccaaatttaagcatctgccctattacacaatcatccaagatggcacagagccaggggatgtcctctttcaggtatctgccactgatgaggacttggggacaaatggggctgttacatatgaatttgcagaagattacacatatttccgaattgacccctatcttggggacatatcactcaagaaaccctttgattatcaagctttaaataaatatcacctcaaagtcattgctcgggatggaggaacgccatccctccagagtgaggaagaggtacttgtcactgtgagaaataaatccaacccactgtttcagagtccttattacaaagtcagagtacctgaaaatatcaccctctataccccaattctccacacccaggcccggagtccagagggactccggctcatctacaacattgtggaggaagaacccttgatgctgttcaccactgacttcaagactggtgtcctaacagtaacagggcctttggactatgagtccaagaccaaacatgtgttcacagtcagagccacggatacagctctggggtcattttctgaagccacagtggaagtcctagtggaggatgtcaatgataaccctcccactttttcccaattggtctataccacttccatctcagaaggcttgcctgctcagacccctgtgatccaactgttggcttctgaccaggactcagggcggaaccgtgacgtctcttatcagattgtggaggatggctcagatgtttccaagttcttccagatcaatgggagcacaggggagatgtccacagttcaagaactggattatgaagcccaacaacactttcatgtgaaagtcagggccatggataaaggagatcccccactcactggtgaaacccttgtggttgtcaatgtgtctgatatcaatgacaaccccccagagttcagacaacctcaatatgaagccaatgtcagtgaactggcaacctgtggacacctggttcttaaagtccaggctattgaccctgacagcagagacacctcccgcctggagtacctgattctttctggcaatcaggacaggcacttcttcattaacagctcatcgggaataatttctatgttcaacctttgcaaaaagcacctggactcttcttacaatttgagggtaggtgcttctgatggagtcttccgagcaactgtgcctgtgtacatcaacactacaaatgccaacaagtacagcccagagttccagcagcacctttatgaggcagaattagcagagaatgcaatggttggaaccaaggtgattgatttgctagccatagacaaagatagtggtccctatggcactatagattatactatcatcaataaactagcaagtgagaagttctccataaaccccaatggccagattgccactctgcagaaactggatcgggaaaattcaacagagagagtcattgctattaaggtcatggctcgggatggaggaggaagagtagccttctgcacggtgaagatcatcctcacagatgaaaatgacaaccccccacagttcaaagcatctgagtacacagtatccattcaatccaatgtcagtaaagactctccggttatccaggtgttggcctatgatgcagatgaaggtcagaacgcagatgtcacctactcagtgaacccagaggacctagttaaagatgtcattgaaattaacccagtcactggtgtggtcaaggtgaaagacagcctggtgggattggaaaatcagacccttgacttcttcatcaaagcccaagatggaggccctcctcactggaactctctggtgccagtacgacttcaggtggttcctaaaaaagtatccttaccgaaattttctgaacctttgtatactttctctgcacctgaagaccttccagaggggtctgaaattgggattgttaaagcagtggcagctcaagatccagtcatctacagtctagtgcggggcactacacctgagagcaacaaggatggtgtcttctccctagacccagacacaggggtcataaaggtgaggaagcccatggaccacgaatccaccaaattgtaccagattgatgtgatggcacattgccttcagaacactgatgtggtgtccttggtctctgtcaacatccaagtgggagacgtcaatgacaataggcctgtatttgaggctgatccatataaggctgtcctcactgagaatatgccagtggggacctcagtcattcaagtgactgccattgacaaggacactgggagagatggccaggtgagctacaggctgtctgcagaccctggtagcaatgtccatgagctctttgccattgacagtgagagtggttggatcaccacactccaggaacttgactgtgagacctgccagacttatcattttcatgtggtggcctatgaccacggacagaccatccagctatcctctcaggccctggttcaggtctccattacagatgagaatgacaatgctccccgatttgcttctgaagagtacagaggatctgtggttgagaacagtgagcctggcgaactggtggcgactctaaagaccctggatgctgacatttctgagcagaacaggcaggtcacctgctacatcacagagggagaccccctgggccagtttggcatcagccaagttggagatgagtggaggatttcctcaaggaagaccctggaccgcgagcatacagccaagtacttgctcagagtcacagcatctgatggcaagttccaggcttcggtcactgtggagatctttgtcctggacgtcaatgataacagcccacagtgttcacagcttctctatactggcaaggttcatgaagatgtatttccaggacacttcattttgaaggtttctgccacagacttggacactgataccaatgctcagatcacatattctctgcatggccctggggcgcatgaattcaagctggatcctcatacaggggagctgaccacactcactgccctagaccgagaaaggaaggatgtgttcaaccttgttgccaaggcgacggatggaggtggccgatcgtgccaggcagacatcaccctccatgtggaggatgtgaatgacaatgccccgcggttcttccccagccactgtgctgtggctgtcttcgacaacaccacagtgaagacccctgtggctgtagtatttgcccgggatcccgaccaaggcgccaatgcccaggtggtttactctctgccggattcagccgaaggccacttttccatcgacgccaccacgggggtgatccgcctggaaaagccgctgcaggtcaggccccaggcaccactggagctcacggtccgtgcctctgacctgggcaccccaataccgctgtccacgctgggcaccgtcacagtctcggtggtgggcctagaagactacctgcccgtgttcctgaacaccgagcacagcgtgcaggtgcccgaggacgccccacctggcacggaggtgctgcagctggccaccctcactcgcccgggcgcagagaagaccggctaccgcgtggtcagcgggaacgagcaaggcaggttccgcctggatgctcgcacagggatcctgtatgtcaacgcaagcctggactttgagacaagccccaagtacttcctgtccattgagtgcagccggaagagctcctcttccctcagtgacgtgaccacagtcatggtcaacatcactgatgtcaatgaacaccggccccaattcccccaagatccatatagcacaagggtcttagagaatgcccttgtgggtgacgtcatcctcacggtatcagcgactgatgaagatggacccctaaatagtgacattacctatagcctcataggagggaaccagcttgggcacttcaccattcaccccaaaaagggggagctacaggtggccaaggccctggaccgggaacaggcctctagttattccctgaagctccgagccacagacagtgggcagcctccactgcatgaggacacagacatcgctatccaagtggctgatgtcaatgataacccaccgagattcttccagctcaactacagcaccactgtccaggagaactcccccattggcagcaaagtcctgcagctgatcctgagtgacccagattctccagagaatggccccccctactcgtttcgaatcaccaaggggaacaacggctctgccttccgagtgaccccggatggatggctggtgactgctgagggcctaagcaggagggctcaggaatggtatcagcttcagatccaggcgtcagacagtggcatccctcccctctcgtctttgacgtctgtccgtgtccatgtcacagagcagagccactatgcaccttctgctctcccactggagatcttcatcactgttggagaggatgagttccagggtggcatggtgggtaagatccatgccacagaccgagacccccaggacacgctgacctatagcctggcagaagaggagaccctgggcaggcacttctcagtgggtgcgcctgatggcaagattatcgccgcccagggcctgcctcgtggccactactcgttcaacgtcacggtcagcgatgggaccttcaccacgactgctggggtccatgtgtacgtgtggcatgtggggcaggaggctctgcagcaggccatgtggatgggcttctaccagctcacccccgaggagctggtgagtgaccactggcggaacctgcagaggttcctcagccataagctggacatcaaacgggctaacattcacttggccagcctccagcctgcagaggccgtggctggtgtggatgtgctcctggtctttgaggggcattctggaaccttctacgagtttcaggagctagcatccatcatcactcactcagccaaggagatggagcattcagtgggggttcagatgcggtcagctatgcccatggtgccctgccaggggccaacctgccagggtcaaatctgccataacacagtgcatctggaccccaaggttgggcccacgtacagcaccgccaggctcagcatcctaaccccgcggcaccacctgcagaggagctgctcctgcaatggtactgctacaaggttcagtggtcagagctatgtgcggtacagggccccagcggctcggaactggcacatccatttctatctgaaaacactccagccacaggccattcttctattcaccaatgaaacagcgtccgtctccctgaagctggccagtggagtgccccagctggaataccactgtctgggtggtttctatggaaacctttcctcccagcgccatgtgaatgaccacgagtggcactccatcctggtggaggagatggacgcttccattcgcctgatggttgacagcatgggcaacacctcccttgtggtcccagagaactgccgtggtctgaggcccgaaaggcacctcttgctgggcggcctcattctgttgcattcttcctcgaatgtctcccagggctttgaaggctgcctggatgctgtcgtggtcaacgaagaggctctagatctgctggcccctggcaagacggtggcaggcttgctggagacacaagccctcacccagtgctgcctccacagtgactactgcagccagaacacatgcctcaatggtgggaagtgctcatggacccatggggcaggctatgtctgcaaatgtcccccacagttctctgggaagcactgtgaacaaggaagggagaactgtacttttgcaccctgcctggaaggtggaacttgcatcctctcccccaaaggagcttcctgtaactgccctcatccttacacaggagacaggtgtgaaatggaggcgaggggttgttcagaaggacactgcctagtcactcccgagatccaaaggggggactgggggcagcaggagttactgatcatcacagtggccgtggcgttcattatcataagcactgtcgggcttctcttctactgccgccgttgcaagtctcacaagcctgtggccatggaggacccagacctcctggccaggagtgttggtgttgacacccaagccatgcctgccatcgagctcaacccattgagtgccagctcctgcaacaacctcaaccaaccggaacccagcaaggcctctgttccaaatgaactcgtcacatttggacccaattctaagcaacggccagtggtctgcagtgtgccccccagactcccgccagctgcggtcccttcccactctgacaatgagcctgtcattaagagaacctggtccagcgaggagatggtgtaccctggcggagccatggtctggccccctacttactccaggaacgaacgctgggaatacccccactccgaagtgactcagggccctctgccgccctcggctcaccgccactcaaccccagtcgtgatgccagagcctaatggcctctatgggggcttccccttccccctggagatggaaaacaagcgggcacctctcccaccccgttacagcaaccagaacctggaagatctgatgccctctcggccccctagtccccgggagcgcctggttgccccctgtctcaatgagtacacggccatcagctactaccactcgcagttccggcagggagggggagggccctgcctggcagacgggggctacaagggggtgggtatgcgcctcagccgagctgggccctcttatgctgtctgtgaggtggagggggcacctcttgcaggccagggccagccccgggtgccccccaactatgagggctctgacatggtggagagtgattatggcagctgtgaggaggtcatgttctagcttcccattcccagagcaaggcaggcgggaggccaaggactggacttggcttatttcttcctgtctcgtagggggtgagttgagtgtggctgggagagtgggagggaagccctcagcccaggctgttgtcccttgaaatgtgctcttccaatcccccacctagtccctgagggtggagggaagctgaggatagagctccagaaacagcactagggtcccaggagaggggcatttctagagcagtgaccctggaaaaccaggaacaattgactcctggggtgggcgacagacaggagggctccctgatctgccggctctcagtccccggggcaaagcctgattgactgtgctggctcaacttcaccaagatgcattctcatacctgcccacagctccattttggaggcaggcaggttggtgcctgacagacaaccactacgcgggccgtacagaggagctctagagggctgcgtggcatcctcctaggggctgagaggtgagcagcaggggagcgggcacagtcccctctgcccctgcctcagtcgagcactcactgtgtctttgtcaagtgtctgctccacgtcaggcactgtgctttgcaccggggagaaaatggtgatggagggcaacaaggactccgaggagcaccaccaggcctcgggccccagaggtcccgctcctcagcctacacgcagaggaacgggcccacctcagagtcacaccactggctgccagtcagggcctgccaggagtctacacagctctgaaccttctttgttaaagaattcagacctcatggaactctgggttcttcatcccaagtttcccaggcacttttggccaaaggaaggaaggaactaattcttcattttaaaaattcttaggcactttttgaccttgctgtctggatgagtttcctcaatgggatttttcttccctagacacaaggaagtctgaactcctatttagggccggttggaagcagggagctggaccgcagtgtccaggctggacacctgccattgcctcctctccactgcagacgcctgcccatcaagtattacctgcagcgactcaaccctatgcatggagggtcaatgtgggcacatgtctacacatgtgggtgcccatggatagtacgtgtgtacacatgtgtagagtgtatgtagccaggagtggtggggaccagaagcctctgtggcctttggtgacctcaccactccctcccacccagtccctccctctggtccactgccttttcatatgtgttgtttctggagacagaagtcaaaaggaagagcagtggagccttgcccacagggctgctgcttcatgcgagagggagatgtgtgggcgagagccaatttgtgtgagtggtttgtggctgtgtgtgtgactgtgagtgtgagtgacagatacatagtttcattggtcatttttttttttaacaataaagtatctttttttactgtt

SEQ ID NO: 272837 - DNA, 476 bp, Homo sapiens
tcagttaacagtggcatttattatttttatactaaccatgaggttcttgagcacaggttatacgttttgttcaccaccgtgcctgcagcaactggcagggtgcctgtttacagcaagccttcaagtatgcatcagatgaatgaatgactggatgagaggcctgcttggtcagaatcacaggacgctctggttcctgtcctggctgcttgggtcttcctgtctcttggccccaaacctcagttttggtgttggcctcctttcagatcaaggcaacagacagtgggcagccaccactctcagccagtgtccggctacacattgagtggatcccttggccccggccgtcctccatccctctggcctttgatgagacctactacagctttacggtcatggagacggaccctgtgaaccacatggtgggggtcatcagcgtagagggcagacccggactcttctggttcaacatctcaggt

SEQ ID NO: 272838 - DNA, 582 bp, Homo sapiens
ggcaactccagggtcactgtcctttataaggtggctcaacaatccagctacttcagtctgctagcacctccatttcactgcactgcttcagggctgccagtgcaggcaattgagcagggagcaggcccgcgggcttctaactgccttcctctggaagtgacacacatcacttctgctcacatttcattggccaaagaaagtcatgtggtcaaccttaattcaggtgagcaagctagtatcatcagaggataacaatgtatgtctataaattgttggtgagtggtcagacatggtgactcacacctgtaattccatcactttgggaggccaaggccagaggattgtttgaggctaggagtttgagaccagcctgggcaatatagcaagaccccatctctacataaaattgaaaaattagctgtgcatggtggttcacatctgtagtcataactactaggttggctaaggcaggcgatcacttgagcctgggaagtcaaagctgcagtgaaccatgattgcacggttgcaccactgcactccagcctgggcaacagactcaaaacgaaacaaaagcagaaaaaa

SEQ ID NO: 272839 - DNA, 244 bp, Homo sapiens
ctgacattggctctcttggcttcctgggacagccctcaccagcatcatgggctctcaagagcctgggatggtggctgccatccccccaggacaggagcccaccaagtcctttctggttgaggacccttgggccatcaaggatcccaactctgctcatgatggcatctgggggagcgcgggagccatggaggggaagggagccccgagcggactcactctatgatgtccctgtcggtgcggccgc

SEQ ID NO: 272840 - DNA, 508 bp, Homo sapiens
aatagaagaacatctggcctcggggacacgtttacctctaggcaaagagcaggagcgcagtattgagtattgttgtaaacaataccatttggaaacctggttccgctcctgtgagtccagcaaacgcctcaaagacgcccttttaggatttctttaaattaatctgagacaacgtgggaatactctctatatagtatctagcctactggatatgtggtttttgttgttgttgttgtttgttttatttttatttttggcacggcactgaagtctgtgtaaataaaaggcccagataaactcggcgatgggcctttctgtcaaaaccaggctggctttacatggcaaaaccagggccttacgtgtttggacacctgactttccatgtcgcccgtaaaatcgctggtagggaaacattttaatttagtaggcaccttatttttaccgagatgcttaaggctgtcacgagctactactcttgatggtagtaggaaataaacacgagcgatga

SEQ ID NO: 272841 - DNA, 415 bp, Homo sapiens
gtggttggtttatttcattcagtataatgcccttaagtttcatccatgttgtcacatattgctgaatttccttctttttaaagctaaacagtattgcattatatgtacacaacacattttctttatccatttcatctgtcagtgaacattaaaaacaataaagtaattcacaattaaataataattaaacaataaatataaatgttgataaataaaaaattaaacattacaaatccttattcataaaagtctgagaatgggcatttctcactaaccaaacatctaccatcctctcaattcctttccttctctgcctcttctctcttacctcttttactccattccaaagtatttacactcctcacattgtccgtgaataaaatccagtattaatttgggttgctttggatcttcc

SEQ ID NO: 272842 - DNA, 474 bp, Homo sapiens
gtggtatagtacttaagaataccatagacagaggactttgaaatgtaaatggcctcttagctactatcgttcttgggtgcaggttacattttattttaatttctatttaaattaggatttgctctcacctgtgctgtctttctgaagttgatttttaatttttttaaggcattctcttgtccctgcctcattacatggtattttaatgggtgaatgtttgagttagtctgtctcaacactgaattgctatctcatctggtgggtaatggaggtttaatttaaatccgtgtacagcctttctttaacttaatatgacttttggagttcttctgtgtgtatcccattttctttaaatctttaaattattacttggcaccctagaacttgtatgacctgtaaatgtgtataaaatatattgatatgattctgtagaataattcagacagataataaaaagtggaatttgttgcattg

SEQ ID NO: 272843 - DNA, 384 bp, Homo sapiens
cagtgggactgagccagccctggaccatgggctgatgcggggcaagcggctgacagagctgttgacgcaccactgtccatcaggatgcagactaaaagagctaattagcatgctgtaacaccccctcatccccagaggtggaggtggagtgggagaggggctgagaattcctgccaaccaatctccgggtctttctagtgatatctggaggccccacccagagtcacttcattaacataaactcaggtgtggtgggaaggagttccttatgaagaaagaagacgctcccacactcaggaaatcgcaagggttttagacacttggtgaccggaaccagggaccaagaccaaatatactttttgtcgtagtatagcattcaacagc

SEQ ID NO: 272844 - DNA, 751 bp, Homo sapiens
tttcttcttcttgtttctagtcatttcactggggaaagggaaatacagacaccttttaaagtaagatcaatgcatctggctttgagcacccagtgagagggcagcctgcagaggaggaacacggggttcgaaattaattagacattcctgggtttgaatctcagctctggtcctacaggtgtgtgaccttgagcaagttaagtcatagtctctcggcctcaaagtgctcagaattttaaaaccaaagataaaacccctttcacaggattactgtgaggattaaaagagaaagagtttaaggtacctaacacaataaaggctgctgctttccttcctgcgctccaactggtttaaaagcttcagtgcatctctaatgacaatgggtgaagtttattttttcagtatggaagaccctcaatgcctcctgttcattctatttcattcctcccatgaatatggatgtgccaggcactgctaggagctagaaagaagtgaggaaaggtccctgctgagagtatctcacagtcgggggaggacaaggtcacatttttaatctcccttgaggttttgacctttgttttttctaaatctccaagctaagtcattgcattctgcagatgaattgacacactttgatgcccattaaggtaacgaggttttatcatcaactctgacatctctgcaaggcactgggaggggttatgaggctcaaggccctcatccttcaagaggacgtcggggtaaccaaggg

SEQ ID NO: 272845 - DNA, 276 bp, Homo sapiens
ttttcacgttttatttgtttatttttttattatactttaagttttagggtacacgtgcacaacgtgcaggtttgttgcatgtgtatagataggttctattttcaaaggaattgttaggttatttccacatgctaagaaaagatggttctcttctacctttgccttttgtctgagacatatgcagcattttcatgataaaatcctagtgggtttactactcctttggtaagcttagacttgtgtgtttctttcctgtgtagtattagttactcatca

SEQ ID NO: 272846 - DNA, 290 bp, Homo sapiens
cttcttcatcattgcgttcatatgcaacacctgaatgactttataatggagatatattctgacatttatcaataggcttttttcttttttgcctttcccagtaacgatcaatgtcctagtcaagccaagacatctatctgcctgaggaggagatgggagataaagacaggaaaaggccgtgttacaggtggtgttcggtttctgatatgcacctcagtgctatgcatccatggaatagccttgaatgtggctagaatggaagtcttaatttttattccacagttcctaaa

SEQ ID NO: 272847 - DNA, 627 bp, Homo sapiens
ggcagccggatcccagctggaactccgccacatcccaggaatgtgaataccagtggaatccggataggacggtgtgacccaggcacagtggctcccaggggacgccaatgctgcgggctgaggcccacgctggaggaacaccggccagtgggcagctttgggtgaacttcagagtgggtggaagcgcagctgccccgcctgcccccacggctgctgcgcgatcaggaaacacagcacactcctaagtgagtcgtcaccatggtgacttttggattcccactgccagttcctgtggagtcagagagatcttagctcagaagtgctgacagcaggggctggctggccactggccacatgggaagaggagaaaggcagcaggagccaccgtgaggcaaatgagctacaagacgccgctccgtctgatttcccgccacagctcccaacacaggtgaaatggctcagaacagctcagcatgtcctactgaggggcaggaaggatgctgagaaaatcccaggcagcggtctcagctgggatgtaatttgagggcgaaaaagttgtgttgcttgcggtttcttccttgctccttgcaggttatatttgaaatgaatgtcagagccatgcggccg

SEQ ID NO: 272848 - DNA, 223 bp, Homo sapiens
cttaaagactccaggcacacctctgcacttagcagttccctgtgtctggaatgctttttccccagatattcttctagcttactgtttccattacttcagctctttacttaaaatcccctttctaagaagaagaaaaagggtaaaaagaaacccattaaggaataaccacttcctgagggagaaccatgtaccagcacaattcctagcccagagaaaatgaaga

SEQ ID NO: 272849 - DNA, 804 bp, Homo sapiens
ccagtggggcctggaacagtgccaggagtggccttgaaccccaccttgatccctctccagcaggatctggagtcacttccatgggcctggcatacaccactccagatttgccctctggcctggggagcagataaccccccgccccacataaccagctgcgctcctacacctagcaggccggctcacatcaccctttaacgcacactatattcacacacacacttgtgcacagtcttgaatgtgtgcccacacatctgcctgcacacactcatgtgcccacatgtgaatcacttggaagtgtacacaaaaccaaacccacagcacagatgggcagacaggtgagcctcgtgcagcatgtgacactcccacatgcacaagacatgtgtgcagaggcatatcacacacgcagaagcactcccgagaactgccttctcccttccagcctaggggcccctgttcccccacaaccgggcccagccctggagccccctccagcactcctctcccacccccacgctccccaagagcagcagatgtaggtctcccggctcccaaacctctgagatgctgctctgtctgaaatcatcatataaataatcattttttaatacaagggggtgggggtgtcaggcaagttccatgaaattgtgaattagccgctgctccaaataaatgcctgcttcggcccgagagcagccgcgctgcgcccgctgcgcccccaataatcgtgtgttgggtatctctccattgttccctgggccattagtcaaagggcaaattagaaacaatttcttgacgacaaaa

SEQ ID NO: 272850 - DNA, 433 bp, Homo sapiens
tttttctcaccacacccatggtgggcgtctcttgtgctgaatgtgaatccatttacattctctgcttctttgatctcattactgctaaagaaaatcatctaacagtgtcagcataatttttcagtctcattccgaaactcaaatctgcatggcagtactctcactcattcttaggcagctctctgtttgtccctatagcagctgttataggcttttaagctccctggtatcctggtcttcccactcctcctcggtctcagcaaatgatctacaggcaatgctgcacaaactctttgcacctccttcccttcacctctattcttgcccttgtctcagtgcagaggccctgcctctttccaaggttcacttctccagttggttatctgagccctgtcttcctgtaccaggggactttgctcaagtctcctatcct

SEQ ID NO: 272851 - DNA, 407 bp, Homo sapiens
gatgataggggagagtcagtcacctctgccaaagcccagagagaggagaaggagatgcagatggagcatacattaaaggtggggtcagagagcgggaaaagtgtggtgaggatgagtgaaggcatcagcacaagggaggatgctttcaaaatcaccaaatccaagcatcacagatgttctgttgttacacggattacagaaaccatgttggagctttaaacgacagaaaatgttggcatgttggtagagtctttaatataaaaatgtttgtgatatatggtagttaagacacagttatgctttggcttaatatgttacaaaattaatgggctgtagctatatattctctgattgtttggctctgttgatcaaagtagcagttatagaataaaatctatgacctgatt

SEQ ID NO: 272852 - DNA, 322 bp, Homo sapiens
cgatgtgggctccattctcaggctttccctttctggtagcacaagagctgctagagttccaggctttgtcttgccatcagctcctaggggaatagcttgcatatttcaataatgtctactggcttggggtcgctttgaccctgattaatctgacttgggtgccatgctcatctctgcacccatccttctgttctgggtcacatgcctacctctggaaaaagtgagggcagctccacctgaaccacggagattgagaattgggaaggagtgtatcacctcacgtcaggtgctgtgtcagacagaggagcactgcttggtgagg

SEQ ID NO: 272853 - DNA, 214 bp, Homo sapiens
accacggacaccaacaatttccagagataaaaataagagataacacattccgagaagtcaagtgacgaaaaaccactccaaatgactgaacggccccagatcgtattccaatgggagtctgagaacaaggaatcagaagggctcctggctgaggctgtactgtcctcacatttgggcccaggaggagactatggagggccagggagtgggtggg

SEQ ID NO: 272854 - DNA, 524 bp, Homo sapiens
agactccctaaaaataatatcaggtcgtgcacagtggctcacgcctataatctcagcactttgggaggctgaggcgggaggattgattaagcccgggaatctaaggttatagcaagctctgattgtgccactgcactccagcctggatgacgaagtgagaccctatctctaaaataaaattatatatataaaatatatatacatataaatatatattatatatacatatataaatatatattatatataatgtagtgggtgttgatttacatacatatgtaaatcttaccagctcacatttatgtgccagctctgtgccaatagatttcaacagatgtataccagggagagagaattttacttgtgcaggtaactatgtctcattccactcaatggctactctagacagtgcaagtcagtaaaagacagaaatctgttatctcaattggtgtttgatttcttgatgccttgtttgatattagtttcctactgcattgaatatgattctagtatttaaagatacg

SEQ ID NO: 272855 - DNA, 322 bp, Homo sapiens
aaaaagaaaccactgccaatgaacatggatatcattgaagggtgctaagcagatctgatttgtaaattggaagaattactctgtcagtaggttacaagttgagttgaatagatggaaaattgtaacagcataatttagacattaggattatagctttcctccagggcatagtggctcacatctgtaataccagccctttgggaggccaaggcaggcggtcacttgaccccagcagttcgaggctgcagtgagttatgatcatgccatagcactacagcctgggtggcagagcaagaccctgtctctgtaaaacaaaaacaaa

SEQ ID NO: 272856 - DNA, 281 bp, Homo sapiens
ctcacatgtagtgaacatttggtgtttgaatacgtgcacaggaatttccatcccaaggtgggggatgattacccttgctaaatactgaagagataatggaaggagcactaaaattgcatttttatcatagtttgtgcaccatgtttattcagtatacctgttataaaattgaaatagcttttatttattacaaagcccaaatatcagtctcatagtttcagttatccagttccttcagtaagtcacactattaaaagtctgtttttatctgtaaaaaaatg

SEQ ID NO: 272857 - DNA, 302 bp, Homo sapiens
ccgcctccagccttgaccgatagacacttgtgtgcacgctctcgccttctcaccaaatcccagttcctcatgccatttcatctttgtgaagccctacctctaccccaacacctaatatcatccttggcactagcaaataatgaataaatgtttgcagaattaacagttttgtgtgtgtgcgtgtgtgtgacggagtcttgctctgtcgcccagactggaatgcagtggtgcgatctaggttgtagtgagccgagatcgcgccactgcactccaggctaggcaccccagcaaaactccatctc

SEQ ID NO: 272858 - DNA, 667 bp, Homo sapiens
taagccacgttcttcctccgacccctggcctgaactgcgtctagccttggctgttcccaagcagttgatgtacatattgttgagcgagagaacctctctgagtcctgctttcttgggaatcaggttctaagttgctctcctgtgccttccatttatctggaccaactagcattttatcaaacagaggttatatggagattctggcgtgtgaatgggcccccttccccctttccataatgtcttattattgctttggcaattgcagtaggtctttgaagagggagctgactgaaaactgtgcccaaatctcaatgtctcttggaagttaagttacacatttttattttaagtaaaagcaaaagaaaacaaacaaaacccccagctccccgcaaaactcattgctgataatggagttcaatgagaaaggaagaaaatgttagctattgaggctgacaagctttaatgagctgcctgatggctcttctctactgggctacgttactgtagaagagtttgcaatttgggagactttgagacctttgatctttcatgaaacgcagactcctttcatggagaagtttgttctttggtatttgccaaccgaaagaaaaatatcctggtaggtagattttttattcccccatagcttttttgaggaactattact

SEQ ID NO: 272859 - DNA, 418 bp, Homo sapiens
aaagatttctacatgaagaaccacaaaactgctgaaagaaatcatatacaatacaagcaaatgaaaaaatattccatgctcatcgattagaagaatcaatacagttattataaaataatcatactttccaaagcaatctataaacttaatgctatcgctgtcaaaataccaatgccatttttcacagaattagaaaaaatctattttaaaatttatttggaaccaaagaagagcccaaatagttaaagaaatcctaaataacaacaacaacaaaaaagaaagctggaggaatcacattggctgacttccaagtttattctaaagctattaaaataagctctaaagctactaaagaaagctggaggcatcacattggctgacttctaagtttattctaaagctactaagataagcttct

SEQ ID NO: 272860 - DNA, 127 bp, Homo sapiens
ggggaagatagattatctgattatttttattctgagatataaacagaattgtgatgggatcgtaggacaagtaccagctctagctgactggcgtaataagagagggctttataaaggtggtaaacac

SEQ ID NO: 272861 - DNA, 891 bp, Homo sapiens
gatgcatgaatcctgagtaggcattagaatgcataagacggaaggaatgatccccagaaattcaacaactgccaccaatttcattcttaaaaatggtatttatacaatatctattttaccctggtaattcctacaatggatttttttttcatatctgaatggattgacttgataacatgttaccatgtcaggaaaacatcagtgtatttaatcagcagcaaatttgctggaagggttttcagagtggaactggttgatatttgtgcattgatgctcttcaggttagcaaagcagtttttcttgaagctagtagaaaacaggtgcatgtttgaaggtgtggagggtgtagacgggtcagcacgtaggcataagagagcctcatttgttttatttttattttattttactttatttatttacttggagacagggtctcactctgttgcccaggctggagtgcagtggcacgatcttggctcactgcaacctctgcctcctgggctcaagtgatcctcccacctcagccttccaagtagccggaactacagatgcatgctaccgcgcttcagctaatttaaaaattttaatagagatgggttctccctatattgcccaggctggtcttgaactcctgggctcaaatgatccttctgcctgggcctctcaaagtactgggattacaggcatgagccactgtgcctggctctcatttgttttacattttcacaatgaatgagagatcccttaatttgtaattttggagccctggtgactatttgtttaatgcttttttctgtgttctaagttaggttaaacaagccattatttttgaaaatccatcttattgctataatagtcatagtaaatcttgctgtaaaattatgataatag

SEQ ID NO: 272862 - DNA, 454 bp, Homo sapiens
gatgcatgaatcctgagtaggcattagaatgcataagacggaaggaatgatccccagaaattcaacaactgccaccaatttcattcttaaaaatggtatttatacaatatctattttaccctggtaattcctacaatggatttttttttcatatctgaatggattgacttgataacatgttaccatgtcaggaaaacatcagtgtatttaatcagcagcaaatttgctggaagggttttcagagtggaactggttgatatttgtgcattgatgctcttcaggttagcaaagcagtttttcttgaagctagtagaaaacaggtgcatgtttgaaggtgtggagggtgtagacgggtcagcacgtaggcataagagagcctcatttgttttatttttattttattttactttatttatttacttggagcctgggtgacagaggcagaccttgtcta

SEQ ID NO: 272863 - DNA, 737 bp, Homo sapiens
tctgctctgatcttagttatttcttgccttctgctagcttttgaatgtgtttgctcttgcttctctagttcttttaattgtgatgttagggtgtcaattttaaatctttcctgctttctcttgtgggcatttagtgctataaatttccctctacacactgctttgaatgtgtccccgagattctggtatgttgtgtctttgttctcgttggtttcaaagaacatctttatttctgccttcatttcgtgatgtacccagtagttattcaggagcaggttgttccgtttccatgtagttcagtgattttgaacaattctttcacttaaaaaaaaatgaagacacaacaaatatgacataatgagaccaatcatgaattacggttggtgataggtggagttttgctaagttagtctctgtagttttcagttttctttttatctctcaaaatgctcaattgaaagagtaataggacatggaagcatttatttaataaataatttcaactaaatctcttaggagcttgcagtgtatgtattcatcatattgacttttggctttgcatgatatgggcacgcctctacctcattgttttttccagtgtcttaccgtagctaatgcattgccaaagaacctttccaatgtatcagctttcattcacccattcattcattccagaaattattgagtttctgtatatgcagatatcatgaataaagagatttttttcaaaaccaaga

SEQ ID NO: 272864 - DNA, 239 bp, Homo sapiens
tgttgtctgaactgcaccttgaagtctgggtcggttcattacagaaaaatcagcacaaaatgtagagaaggatggcggtggggacggggcaaaggctgagaagcagtcttatgggatagaaagtatcagattagtaaaaggaaattcagaaaaaggacaatgctagtctaggcacccttggtaatttttttaaataggttatattttgcaccagaaacgccaacctggtcgttcagtga

SEQ ID NO: 272865 - DNA, 469 bp, Homo sapiens
attgtattaatcagaaatgaggatgccattctatagagtggctgcacttttgtagcctggtgtgaatgcctttcactgctccccattcctgttagtacttttcttcctatatctctttataatcctataactccaagagaataattgaatagcaagggggggaggtggccgtgacaaacacgtctgtggaaatacagtctaaacggacaaagataggtctgaaataagagttctccagtgacagcatatgttaaaatttttagtttattattatcaattcattattatttattccttcttcttaaagatgcaagggagtgaggacaatagagagtgtgtttcagtaaccacaaaaggactgcaaaaaggttgctagatgaaggactgtggatatcaccaatttaccatttcatctatagatataagatagaaatttgactagtacccgagcagacagattgatggccaa

SEQ ID NO: 272866 - DNA, 433 bp, Homo sapiens
ctcgccatgatgatgtagtggaaaaatggtcaacaaagctatttcctactgtgtgctaaatgcccatcatgggaagtcccaggaacaagaagatcatgggtgaggcagctgctcagaaacaaatgtctttcaacaattacccccaggcatgggaagaggagactaggacacggacacacatcgagaaagatcatgggaagacacagagagaaggcagccgtctgtaagccaaggagagaggcctcacaagaaaccaaccctgctgacaccttaatctcaggcttctggactcacgaattgtgaaaaaaaaaaattaatttctgttgtttaaaccacacagtctgtggaattttattatggcaaccctaaaaactaatacatgtgctttacaatttacaaagctttttctcataaactcgtttaaatgtcaaaa

SEQ ID NO: 272867 - DNA, 541 bp, Homo sapiens
aaattagtgtaagtagagagtttatttgggtcaagtttgaggattgcaacataggagcatagaatcaaattgccctgaacatatgctctaattagcagcaggtataagtgggtttttaaaagaaaaaagaagagcaagttctgaaggtgtttaccaagaatttatattaaaataacataagctattcattggctatacattgtcctttgtatcacaaattccaggaacaagaagatcatgggtgaggcagctgctcagaaacaaatgtctttcaacaattacccccaggcatgggtaggtataagtctttctggtctgagctgtttttcttttctcaagttacatcttcaggttccacttctaattctagttttcttgctatttctaccatatctgcaattacttcctccactgaagtcttaagctccttgtcaaccatgagggttggaatcaacttcttccaaactcctgctaatgttgatattttgacctcctcccatgaatcacagatgttcttagtaacatctagaatggtgaatcc

SEQ ID NO: 272868 - DNA, 420 bp, Homo sapiens
ctattctctcttcttcctggggttcacctcaagccccactgctattcaaccgccaactttctcttcagcttcaaaatagactcccgcatgtaccttgattaaacacaggcccactgcaaccccagtgccccagggacgaggagggaaactgtttttaaccataaggaaaacaaagcaagtactgtggtcaatgtcagtgaccctctgcttagggcaaatattggagtgtgtgactgcaaaactgggacatccacccccgactacagggggtgcccctattctgcttcggccagttgatggtatgtgagaatgcaaactcttgtgatttttgtaagagaacccagaaatgtggagtttggggtggaatctgatctttccatgtttgctcaattgtttaaaaatacagcaggaccagtttca

SEQ ID NO: 272869 - DNA, 676 bp, Homo sapiens
tcacccaggctggagtgcagtggggcaatctcagctcactgcagcctcctgagtagttgggaccacagatgcaaaccaccacacccaactgatttttcaattttttgtagagacgggggtctcgctatgttacccaggctggtctcaaactcctgggctcaagcaatcctcccaccttggcctcccagcatgctgggattacaggcatgactaaccatttaaccataaaaaatatttttttagtcacttaaaaagagactttgtcatgttgagggtcagatgctaagttatcagcaggctcagtcatgtccctcttgatttttagctgtggaagagaaatggccccagttcatcacccttctctagcccagcctcatcccgctcccagacaccggagaggccagcaaagaaaataaggtattcggcattctcctgcagttttcatttgctacgtggacagaagggggtgaggaaaggtgggaaacgaacctggctcttaggctttgtgctgctgtgacttggagaatcaaagaaactaagtccctgagagggacaatgcagcacccacctgaacaactatcatccctacagtcttggatactgactccagtggcctctggctgtcgcctcccactccagcatgagggatcgggtgcaagcacagaggccatgcaga

SEQ ID NO: 272870 - DNA, 423 bp, Homo sapiens
aggcctcaattctcagagttcagatgaccacttgaataagagatcccgaagctcttccatgagctccttgacaggcgcttacacaagtggcatccctagctccagccgcaatgccattaccagttcctacagctccactcgaggcatctcacagctgtggaagagaaatggccccagttcatcacccttctctagcccagcctcatcccgctcccagacaccggagaggccagcaaagaaaataagagaagaagagatgtgtcatcattccagttcttcaactccattggcagcagacaaggagtcccagggagaaaagggtaggttgctgagccaggaggaggggctgctgttggtggtggaggtatttgtggaggatgtagagattaatacctattgaaaaaaggtcttgagcattgctat

SEQ ID NO: 272871 - DNA, 569 bp, Homo sapiens
atcacttgaacctgggaggtggaggttgcagtgagctgagattgtaccacggcactccaacctaggtgacagagcaagactccatctcaaataaaacaaaacaaaaaaacccccaaacaacaacaatgaaaatatttggaattgataagaaagtagttaggtggagaaaacaggataggaattgtagaccttaaggacttttaagaaagtctatttgcaaatacaaactaccaaaaagcaagtatttttccttccaattccttggaacaatatcaccctatatctccatacgtttatcaaataacagtatgtttcagtgtttgtgtaaggataaagcaggaacgggcatctttcttcacataaatgtttgtattttaaaaacaaatattcatcattttacttatttatcttgttgccaataaatatttttctttaacatttaaaaaaaagatggctgaatgttattttatcactagtattgtaccatgatttacttaacaactacctctactgttgcttccaatatttcacttcttcattaaaaaaaataacactgtggtgacaatcca

SEQ ID NO: 272872 - DNA, 779 bp, Homo sapiens
cccttgtacattgttggtggaaatatagattggtgcagtcattatggacaatagtacggaggttcctaaagaaattaaaattagaattacctaagacccagcaatccctcctctggatgtacccaaaggaaataaaatcatcacctcataaagatatctgcactgctatattcattgcagcattatttacagtagccaagatatggaaaccacctaggtatgtgttggtgcatgaatggataaaagaaactgtggtatatgtatatacaatggaatattattcagccttaaaaaaggagaagaccctgtcatttgccacaacatgcatggacctggaggatattaagctgtgggaaataagtccaacacacatccacacacaaaattgcataatctcacttatatgtggaatctaaaaagaaaaagttcaaatataaagttagaataaaacagtggttaccggccggatgtggtagctcacgcctgtaatcctagccctttgggaagccgaggtgggtgaatcacctgaggtcaggagttcaagaccagcctgaccaacatggtgaaatcctgtttctactaaaagtacaaaaattagccgggcatagtggcaggtgcctgtaatcccagctactcaggcagttgagaaaggagaatcacttgaactcaggaggcataggttgcagtgagccgagatggcgccacttcactccagcctgggcaaaagagcaaaactctgtctcaaaataaaaaaacaaaaaacacagtccacacactgg

SEQ ID NO: 272873 - DNA, 440 bp, Homo sapiens
gaagccaggaattttctgcatattcttaaataggatgtttcagtcaaagccttgataatataaccaatctttctgattgtagcctgcttataaagagaacatatgtacatgaaaataagaatatttatgaatagtttccaaactttagaaggatcagatagggaggaaaaacaaacgcttccacccacctttgttcacaaaagttgttgggattacaggcgtgaaccaccgtgcccagccaagatctacactattatgtcaccccagaaagtgaactctcactcttcccagccagtctctttcttatcataggttagcttgcttattctggaatttcgcgtatacagatgcgtgccatgccataggtactcttttgtgtctgctttattctgctcaacaccatgtttctgaaatcattaccattgttgtatggttctcta

SEQ ID NO: 272874 - DNA, 866 bp, Homo sapiens
tggtgtgactgcattctctcctgccaggtgtgtaggcggagcttcccttcctgtctgagaaggaaaggctgggggggcggggggggcatctgcagtctgctgaggggcagcacatcgggcctgtgcacccttatcctctcctttgccgatgggaccttatttcccccaacttacaatggttcaaaagggcctgaatctgaggcaaacagagctggccatggtcagggccaggtctgtgtggtgagacagaaaggaaacagttgtcagcaggcaaaaggggtgggggcagttggagatgaagctcctcaaggagaagctgtcagctcccactctacacctccccataagcctttgatttaaagaaagcctccatctgttagcctccggtgtgtgggatagttttgcagccgaagaggggtgggcattgctcaggatcttggcatggctgagaaccaggtccaggaaggagtgggaggggcaaggccagctcctctgcccccagcttgctgtgggacctcaggccttgggctagacttccttggactgactgctaaggcaggagagacagagtcagagaccctccctatccacaccccacctctcctagccagggagcaatgggttcacactgcctggatcagctatgaggtcaggtggctgggaggcctgaaccaggaagagctctgggccatgggaggcgggtgagcatttagaatgaatgctgaccctactgagcacacaaagctgtgaagaaggagctggtccttcagagcacgctgggagtatatgcactggtgtggggaggtaggaggagggggatgcaaccccagagaaggtggcaacttctggagaagcagacacagcag

SEQ ID NO: 272875 - DNA, 439 bp, Homo sapiens
gcagtgagctgagattgtgccattgcacactacagcctgggcaatagtgtgagactctgtcaaaaaaaaaaaaaaaaaaaagaggtagctaacttatcatagtttaatatttttctgtttagccagttttatgtacatattttaaaaataaattgctatcatactggtttttaacctattttctcaatatattgtgaaagttttactcatgtcattagtctgagtaagtgttttaaatagctacacaacatattttaacagttccataagttggacgtggctgctcccaggtttttattatcagaggcaaaacttcaccgaacatctttatacatgtatctttccagtagctcagaatagaatcttaaggcaagatgaaattgctgagttaaaaggaatggatatttttatggcaaacattagcacattgctttctagc

SEQ ID NO: 272876 - DNA, 622 bp, Homo sapiens
acctgtaatcccagctactcgggaggctgaggtacgagaaatgccagaacccaggaggcagaggttgcagtaagccatcgtcgtgccactggacttcagcctgggcgacagtgagactgtctcaaaaaaaaaaaaaagtatttcctgttcctacacattggcccattgagaggatcccaggtctatgcatggggacaccgtctttttggctcatgttgagccacatgtcctgcagtatttggaagtgttctgggacagactttgttcacataaagatcgcgtgcccttcactgcagtgatgaagctggagactgtctttctctgtgacaaggacctcagccctggatctgtcctctcctagtgcccacctcattcatggagctcaccccgtggttttggaattgtttccttccctgtgccttagcttccctgaacactacttctacactagctccttgagagtgggagccctggacttattgctttttcaacagagtagatatgtgtgtttcatttatatcagtatttaaattgctagcaacaagaccacaaaaactacattctcatagaagcctgtttgggtttgatgtggttacatgtgattaatgtatttgaaatagtt

SEQ ID NO: 272877 - DNA, 588 bp, Homo sapiens
ataggacagggaggtgatggggtgggaagggctttagcttctactcttagtgaatctgggagccactgagggttttgaggaaaggggtggcataattggacttaggttttcacagggcttctctggctgctgtgttgagagcagatggaaggggctgaccagcacagacacccactgcaagaatcctgctagtgtggaccacagtaggagtggtggaggcagcaggaagtgtaaggcttgttgagattccaaaggaagggccaatgggatttgctcctgggttggatgtggagtgtgagaggaaaagaggggtcaaagatgactccaggcctctgaggagagcaactgacaggatggagttgtatttcctgaggtcagaaaaattgtgggaaaagctagatgggggaggaaggttgggattttcgtttgggatatattaagtttgaggtgtctattaaatatcaatttggtgacatcgagtagacacgttggccatcagaatggagtttagatgagagtttgaggctcaaaagtcatcagcgtatctccagcctgggtgacagagtgaaattccagctccatctcaaa

SEQ ID NO: 272878 - DNA, 475 bp, Homo sapiens
gaaactgaactcagctgatgaaagccacctggtcctggaggtgaagcatcttccaaatgacagcctgcagtcaatgactgatgaatatgacttcattgcctcatgacaggacctactctggggtatagatcatgcttctaagctcctcctggggtcctgctgaggctcaatgccagctgaaaccatacccttgctcacatactttcccttctctttccttcttcccttgcttccttagagattcctcctgcaatggcttcctcaaaaaagcattttcataagcaacctcatgtcagcctctgcttccacagaagccaatctgagttaagcagctgtttaacttagcatgtccaacataaaattcttgttttcttctcatcccctgcccctgaacgttctcctttgcctgtctttcttatctcattgaaagtaacaacacaagtatcaagtgaaaataaaagaatcttctctgatt

SEQ ID NO: 272879 - DNA, 594 bp, Homo sapiens
tatacttctgtagtataaattttagctggcaacatggctgcctggccaaagactacatttcccagtctcccttgcagtagccatggtcatgtgacgaggtaaagccagcagaagtgatgagggtcacatcctgatcttgccctcaaaaaattggtagtatcatcgaccccttgtgcccagtccctttccccctttccactgctggaaggagaggagaagaaccagggtatctccttagacacagaaatggaaagcacgtattaaggatgtggagctaccccagcagccctgacctgctgacctccagactgtgacatggaaacagatcaacttctctcttggcattaagtctgacactggggacatcaaaacggataacacatggccctggatctcaaggaacctgccgcctgatggaaaataaaagagagagtcacacttaaatgaatgatttcagcataatgaatgtgacaagtgataagataagggaatgcatccagtatcactgcttttccaaggcttctcgaggggtaaaaaattacccagtgggtatttgaaggagaaagtaaataaaagaaaatctaccaagaaaaa

SEQ ID NO: 272880 - DNA, 561 bp, Homo sapiens
aaggctctgtctacttggcttttttctttcacctgttctgcggaataacagcctgattcgttcctctttttgggtccttcacttccatacctgggattcggggcgtggcccagaaagaccctgcagtcttgcagtgtggggctgccagcatttcatggcctccaagctcagctgggctgaatgaacgctgccatccagcgcttggctcattttctgtcccattttcctgagtgcttttgccagacttacacttttctgaaagctactccaccctaccccagacacaccctctctcctcggatgacctgcctcctaatttcctgagaaaactggacatggccacctttccccagtgtctgaggcccaggttgacccgtggtcatggtcgctgtcaccacccacctgcctgtatgacagagtgagaccctgtctcaaaaaaaaataaaaagaatgcctcatgttaggctgggtgtagtggcttatgcctgcaatcccagcactttgggaggctgaggcaggaggatagtttgagcccaggagttcaaggtcaacctgggcaag

SEQ ID NO: 272881 - DNA, 380 bp, Homo sapiens
gggaaaacattctgtcttcccccgattcagaggtgaaagctccttgccattcacacactctagttcaatggtatcgagtgcgggcactgctaatcctccggaggacgctgttcaatcaagtctaaatcagccttccagtagtttccatccattgggtctcacctttccccagtgtctgaggcccaggttgacccgtggtcatggtcgctgtcaccacccacctgcctgtatgacagagtgagaccctgtctcaaaaaaaaataaaaagaatgcctcatgttaggctgggtgtagtggcttatgcctgcaatcccagcactttgggaggctgaggcaggaggatagtttgagcccaggagttcaaggtcaacctgggcaag

SEQ ID NO: 272882 - DNA, 449 bp, Homo sapiens
agaacatttgaaaagcacttcattttaaaaagtgattttcaagccattgtaacacctctaagatcttgtcagtgttattttaaagacagaagactacaaaaagcttagcaaaggaatatactgctgtgaatgaagtaaagctcaatgcaagaggctgccagatatcttgaaaccaagaaaatgatcaaagtaaagcaaaaactaagactcagctaccagtataccctgcttggtgcagtagttactgtttattcattctctccacagatctatattgagagcctattgtgtgcagacaccatctaggtgcttggaatatgttggcaaacaagacaggcacaaatccttactctcatcaaacttacattcctcttctcctgaaaaatcaaacttaaccaaacccattttactaatagtaattttaaaagaagcccctcccccgcccctta

SEQ ID NO: 272883 - DNA, 513 bp, Homo sapiens
ctccctacgtctgtgtgggttttctctgggtattgcggtttcctctcgtatcccaaaggtgtgcatattaggttcattggtgcgtctacatggctgcagtctgagtgagtgtggggtgtgagagatgccccgcgatggtgtcctatcctgggctggtgcccatcttgtgtcctgagctgctgggatgggctctgaccacccaagacccttaactgcaataaatgggtaaataattatttgctgttcttaatgaatctttcttaagctcatatttattctatgtatagtgcacatttatttccatgtttaatactagaagtgttttggtcttgagaagtttggtaggccaggtacaatggctgatgcctgaaatcccagcactttttgaggctaaggcaggaggatcacttgagcctgggaggtcaaagctacagtgagtatgccatgattccagcaccgcattccagcctgggtaacagagtgagacagaagaagaaagaagaaagaagaaga

SEQ ID NO: 272884 - DNA, 436 bp, Homo sapiens
attgcagagataccccaagaattaaccaagtatgtgtgtgggtgtataggtttcttttggaggaggggaatgtaaaagagggcagagtaggagacaagttttcaggacaaaacatctggtccagtaggtaatagggtaaggagaacagaaaagaaagggtggttcaagatcctcactttaggccagacgcggtggctcaaacctgtaatcccagcactttgggaggccgaggcaggcagatcatctgaggtcaggagttccagaccagcctggccaacatggcaaaaccctgtctctattaaaaatacaaaaattagccaggcatagtggcatgctcctataatcccagctattcgggaggctgaggcaagagaatcacttgaacctcagagacggaggttgcagtgagccgagatcaccccactgcactccagcc

SEQ ID NO: 272885 - DNA, 405 bp, Homo sapiens
cagtccgaatcattctatctcactggtcaagctcagccttctttttccttattctcattttttttctttcacatgtgacaaaacaaatgcatttgaacgcccctcccaccctgtcccccacccaaatccctttagtagagaacacagtttgaaatgaaaaggaggcatagattataaaggggaagatatgtgtaagcaaaaaatgcagaacttagaaactgggcacgaatgtaaggaatacaagatctcaaacctactttgactggattttctactttattccatgtgttttggacgcatctagaactcttggcagtgttatctgatatatgctattcattccatgatacaagaaccacaagaaggtcatgcaaagtttattaaagtataaagcagaagcagcaa

SEQ ID NO: 272886 - DNA, 471 bp, Homo sapiens
gagtgacttgttctgattcccagttctccttcttcttaactccgataataaaatattaaccagtaaataataaaatagttaccagtagaagctggtgcagaaatctttggatttttgtaaaccactttatctgatttacaaaaatcagcctgtctgtgaagagggtctttggtagatacagtttctttgatcacgcatgaagtacagtggggaaaaggtggacggagtggtttggagaagcagatgacgttggtctgtctgtgcctgagcactgtgtggaaagcgattggtctttgccatatagagatatttcatcctgctcctcaggagttggttagggaacagataagttaaaagagtttggctttcattttgttagttctcacggcttctcattattttcatggtgtgtggttactgtaagctacataggtgttctcctttgcttctgattttgtgctaaaaaacaaa

SEQ ID NO: 272887 - DNA, 237 bp, Homo sapiens
tccagcaacaccctagccaatgcagtatttgatgccttaaacttcacatgcctttatatcgttacacattttacttcctatcttttataactgattcagtgtgttgtacatgtgtggatggatattcaattaatatgtgacacattgattatcagctcaaatgtggcagatggagatggatccttcttgacctctcattgattctttttagtcaattgaaattgcattatccctgaa

SEQ ID NO: 272888 - DNA, 308 bp, Homo sapiens
gccaactctcctgaaaaagtggtaggtgtatatgatctccgcataaagtgaaaaatatggtttctgctgaccagaggttagactgtggcaaagactgcttttgctcaaaatctattatcccttccgaaatgtatagagctgtctggagttcatgttgccttttcctggagaacaagtaaatcaagtaaatgggaggggaaagagtaaggacagaactgggactcatttctctcttactaaggggatgtcccatggaaagaacacctcttaccagcctcctaataaacgttctgatggtacttactgat

SEQ ID NO: 272889 - DNA, 699 bp, Homo sapiens
atattttcgacaaataggattatcattctcatactattatcgttctcatactgcatcctcctttttttgcttcatgatttttcttagaaatttttgataaccagcatatacagatttttacattctcttagcaacagcatagttacctagcccctgttgacagatgtttaaattgtgtttattatttttctgtcacaaataatgctgcagtgatttgtatatatatctttatattcttgaaatggacctagtaagtcagaggctttgtgaattttcagttttggtagattttaccatattgccctcctaaaaggttataccagtttatactcctgattacagtgtgacactgcttgattttccatatctccaatattgattattatcagaattcttaatttgttctactcctattactttaaaaatgactttttttttttgtatttctttacttttgagtgaacttatacatcactttgtaagtttataggtcctttaattttttttctggtaattgtctatatctgccccagtccacctttaaaaaaaaaaaaaaaaagaatcttttcctcttagattcatgggtaatttagttaagaaaattagctctttgtcatatgtatagcaaaatatgaagaaaatatgtttggttacttgcaaaacctagggaagggaaaacactgtggtagaaatgaaaga

SEQ ID NO: 272890 - DNA, 505 bp, Homo sapiens
aatttttttaaggctgtcagtaaactacttttttcatcataattatcaatatataccatttgaagagctactttttatggtagcacgtgcttctgatctaaaagatttgacacaagccttattttcagagaacttaaaatctgaatggatagtggttttattacttaaatctttaagggtgtgtctcatgtcttcttcatctttaagtctcttgggcatagtaggtgttcaataaatacttgtcagatgaatttaatgaaattaaataatacccttttgacttacttttccttgggaaaggaaaataactctggcaatactagttttatgttctgattcactagcctttctctctgaactgaccatctcacttatatttgaagataaatgtagggtgagaatggaagagcacagcctaagttcctgaaaagtacaagtaggcaaaatagtttctagtgtctaattaaaggactacaggggaaagttttgcttaaatcaaatgaca

SEQ ID NO: 272891 - DNA, 631 bp, Homo sapiens
cactgttggtgggagtatcaattagtacaaacactttgaaaaataagagggaattctataatatctaacatttgcatatatccatttatctctctagatctagatcttagccctctccaccctgcactgtgttcttggaaggggatcatgaatggtttccttgcattctgccttctgatttggttcagccaatgagagaccatggcaagacatttgtgagaagggtagagagtcaggtcaaggttcttagtgagatcaactctttctctgccagtttgttaactgaattctactgaaagctagagctctgttgagtaatcttttaaagctgcagctacccttttgagattaagtaatagctccctgtttgtgccttgttagggctagggatgtttaaggatccttgcccttgctagtcctagcatgttttgttgtcccataatagttctttttttaaactttcctcaattacacaatttgatcttgttcctaccagtacctttgctggtacaacctaaaactcaacagtttcactcttaggcatttacccaagagaaaccaaagtaggtacattttccagaagacatgttaagaatgtttgcagtacgctttggatgctttggtaatagca

SEQ ID NO: 272892 - DNA, 289 bp, Homo sapiens
cagcatgcagagtttttaatggggtctcagtgtgcagccacacagagcattgctgaccagggacgctcgcccaggtctcagagtgcagaatttctattgaggtctcagtgtgcagccagccacacacacagcattgctgggcagggatgctcacctgggcctcagcatgcagagtttttaatggggtctcagtgtgcagccacacagagcattgctgactagggatgctcacccgggcctcagtgtgcagtttctatcgaggtctcagcgtgcagtcagccacacacac

SEQ ID NO: 272893 - DNA, 291 bp, Homo sapiens
ggggtaggagtgaagggagggttctgaaaaaaaaagacagcgccagggcaaattatcttccagcttttcaaaggcagcagctccatgcttgccgactctgttctccgtcaatgcatctgacagagaattcacaggcaaggtcagacatcaccccagtgaggaaagaggaggagccacacccaagcaggggcctgggctgggctctttcacagctggctgagtgatctccctacttcaggcctcagtttcctcagtgtgtaaaataaagccattgagcccgttgctgtttaa

SEQ ID NO: 272894 - DNA, 432 bp, Homo sapiens
tcttaagttttagggtggtgtcaaagaaaaatatccacagttatctgcatggactagtaaaatattctgccattttccaactatgtaccatgagaggctagattttcttcatatacttcatatatatgattttcttcatatatttcaacctaaataacatattgccatagattgaatgcagaagcagatatgagaatccaggtgtcttttattaaaccatccatttaaaagatttgaaaaaatttaaaacatcttttgttttgttttagaaaagattatttttataacaaatcatttatgttaacagttaatggtttattgttattttaagtgaattagtaaatatcttaaaatttctctgtttaaatttttaacatgacaaatatcaaaatatataactacataaactaaaagtcttttgggtcctcaatg

SEQ ID NO: 272895 - DNA, 544 bp, Homo sapiens
cacctccaaattcactcttcaacatatgctttgtgattatgggcttcctgtaagcatttttcctttaaagtgagcacattgttaagctttctcattaaagggtactgtgggagcaccgtaggaacaagagggtctcctgcaggtgctgatggctgaaatgtgggtagggtggtgtggctgggatgacatccagtggagctctgccacaaccacaggcccagagtgcatggatccacagacaccttgaagtctcagtctggactgatgataacctttccatgaccctaaatagagaaaccagtgctctaaagaccttctgctggcacagctgccctgattccttctgcaggtaccagagtggtccctgaggcccagaggatcccttctggatgctgatccctctgccagaccaacatgtctggcctggggcctggaaaatccccacctcctctgcttgccctggttactgatggcctgttccccacttgcactctggaaggctacattgtactgacccagttgtgcagatcagctttagtatgga

SEQ ID NO: 272896 - DNA, 188 bp, Homo sapiens
tggactggcctcaagctccctctgttcccatgtactcaaggccagaccaattactatttgtagaaggtcacaccccaggtcttctgatcccaaaccctttctcccaggcacctgttcatcagcccctagagtcacccagattgtctgggttctgtccttggtgacagcgattaaacttgtaacactga

SEQ ID NO: 272897 - DNA, 313 bp, Homo sapiens
ggcagcccctgccatggtcccagttctcaccagatggccctgacttctatgatctagtaaagacacctcctgcccgcatctctgcagccctgtgggcattagtggcttcctgcaatctctgaatggctttagtatcttggttgagactcttagtacttctgtcacctgtgtagccagttttctgtattacattccttagcttggaataactggagtggtttctgtttgcctgatacaataagatacttggattgcgatgatgtatcttctttaggtgtttttaaaatgtctttatttcagtgtatagttagta

SEQ ID NO: 272898 - DNA, 501 bp, Homo sapiens
gatgaatttccagataattatgctgagtggataatgtcaattcgaaaatgttatatactgtatgattgcattttgatggcaatcttgaaagaacagaagtatagaaatggtgactagattagtacttgccaggcgagtggggaggaggtggctctggcaatagaagggtggcttgaggggtccctttgatggaactgttttgtatcttgattgtggtggtgattacatgaatctgtgcatgtgatatattgcatataactaaatgtgcacgtacacacgcacacacacaaataagtgcatgtaaagggaaatctgatacagtggatcatatctaataagatgggtcatatctgaatacagtggattatcaaccagggctttcttggttatgatgaaaccaaggagaaccataggagaaaagtgaatgaagaatatatggaatctctcatattatttcttccaactgtatgcaaatctaccattatttctcaataaaaagtt

SEQ ID NO: 272899 - DNA, 163 bp, Homo sapiens
tttttttttttcctccccaaccatgtagggattgggtatccctgatttgctcttggtattagccatgaacaatgttcctggctttacaagggctgcagctggcaagtggcctttcaaatttgtctttaaaaaagaagtactgcggctgggcgtggtggctctc

SEQ ID NO: 272900 - DNA, 407 bp, Homo sapiens
gggagggggcgggcgggccggcgggcggggggagccgccgccgccgccgccgctcgatttccgtaattttgagaagatttttttttagtaattttttattctgccccagctgatgtttgagccagcatgtcgcggaggaagcaagcgaagcctcaacatttccaatccgaccccgaagtggcctcgctcccccggcgagatgccttcgtagatgaccacacaccatttgtacaacagaagttggtgttccccatgctgggcaaacaatgggaagccatcctgtctttgaataggatgttagcttggagttagagatttttctgtttaatttacaaatggatcttagtgagaagacatctgagcaaccaatggaaacaaacatgaaataaagggatttttataataaa

SEQ ID NO: 272901 - DNA, 5239 bp, Homo sapiens
gggagggggcgggcgggccggcgggcggggggagccgccgccgccgccgccgctcgatttccgtaattttgagaagatttttttttagtaattttttattctgccccagctgatgtttgagccagcatgtcgcggaggaagcaagcgaagcctcaacatttccaatccgaccccgaagtggcctcgctcccccggcgagatggagacacagaaaagggtcaaccgagtcgccctactaagagcaaggatgcccacgtctgtggccggtgctgtgccgagttctttgaattatcagatcttctgctccacaagaagaactgtactaaaaatcaattagttttaatcgtaaatgaaaatccaggctccccacccgaaaccttctcccccagcccccctcctgataatcctgatgaacaaatgaatgacacagttaacaaaacagatcaagtggactgcagcgacctttcagaacacaacggacttgacagggaagagtccatggaggtggaggccccggttgctaacaaaagcggcagcggcacttccagcggcagccacagcagtaccgccccaagcagcagcagcagcagcagcagcagcagcggcggcggcggcagctcctccacaggtacctcagcgatcacaacctctctacctcaactcggggacctgacaacactgggcaacttctccgtaatcaacagcaacgtcatcatcgagaacctccagagcaccaaggtggcggtggcccagttctcccaggaagcgaggtgcggcggggcctctgggggcaagctggccgtcccagccctcatggaacaactcctagctctgcagcagcagcagatccaccagctgcaattgatcgaacagattcgtcaccaaatattgctgttggcttctcagaatgcagacttgccaacatcttctagtccttctcaaggtactttacgaacatctgccaaccccttgtccacgctaagttcccatttatctcagcagctggcagcagcagctggattggcacagagcctcgccagccaatctgccagcattagtggtgtgaaacagctacccccaatccagctacctcagagcagttctggcaacaccatcattccatccaacagcggctcttctcccaatatgaacatattggcagcggcagttaccaccccgtcctctgaaaaagtggcttcaagtgctggggcctcccatgtcagcaacccagcggtctcatcatcgtcctcaccagcttttgcaataagcagtttattaagtcctgcgtctaatccacttctacctcagcaagcctccgctaactcggttttccccagccctttgcccaacatcggaacaactgcagaggatttaaactccttgtctgccttggcccagcaaagaaaaagcaagccaccaaatgtcactgcctttgaagcgaaaagtacttccgatgaggcattcttcaaacacaagtgcaggttctgcgcgaaggtctttgggagtgacagtgccttgcagatccacttgcgttcccataccggagagaggccattcaagtgcaacatctgcgggaacaggttctccaccaaggggaatctgaaagtccactttcagcgccacaaagagaaataccctcatatccagatgaacccctatcctgtgcctgagcatttggacaatatccccacgagtactggcatcccatatggcatgtccatccctccagagaagccagtcaccagctggctagacaccaaaccagtcctgcctactctgaccacttcagtcggcctgccgttgcccccaagcctcccaagcctcatacccttcatcaagacggaagagccagcccccatccccatcagccattctgccaccagccccccaggctcagtcaaaagtgactccgggggccctgagtcagccacaagaaatctaggtgggctcccagaggaagccgaagggtccactctgccaccctctggtggcaaaagcgaagagagtggcatggtcaccaactcagtcccgacggcgagcagtagcgtcctgagctccccagcggcagactgcggccccgcgggcagtgccaccaccttcaccaaccctttgttgccgctcatgtccgagcagttcaaggccaagtttccttttgggggactcctggactcagctcaggcatcagagacgtccaagcttcagcaactggtagaaaacattgacaagaaggccactgaccccaatgagtgcatcatctgtcaccgggttctcagctgccagagcgccttgaaaatgcactacaggacacacactggggagaggccctttaagtgtaagatctgtggccgggctttcaccacgaaagggaatcttaaaacccactacagtgtccatcgtgctatgcccccgctcagagtccagcattcctgccccatctgccagaagaagttcacgaacgctgtggtcctgcagcagcacatccgaatgcatatgggaggccagatccccaacaccccagtccccgacagctactctgagtccatggagtctgacacaggttcctttgatgagaaaaattttgatgacctagacaacttctctgatgaaaacatggaagactgtcctgagggcagcatccctgatacacctaagtctgcagacgcctcccaagacagcttatcctcttcgcctttgccccttgagatgtcgagcatcgctgctttggaaaatcagatgaagatgatcaatgctggcctggcagagcagctacaggccagcctgaagtcagtggagaatgggtccatcgagggggatgtcctgaccaatgattcatcctcagtgggtggtgacatggaaagccaaagtgctggcagcccagccatctcagagtctacctcttccatgcaggctctgtccccgtccaacagcacgcaggagttccacaagtcacccagcattgaggagaaaccacagagagcggtcccaagcgagtttgccaatggtttgtctcccaccccagtgaatggtggggctttggatttgacatctagtcacgcagagaaaatcatcaaagaagattctttggggatcctcttcccttttagagaccggggtaaatttaaaaacactgcttgtgacatttgtggcaaaacatttgcttgtcagagtgccttggacattcactatagaagtcataccaaagagagaccatttatttgcacagtttgcaatcgtggcttttccacaaagggtaatttgaagcagcacatgttgacacatcagatgcgagatctgccatcccagctctttgagcccagttccaaccttggccccaatcagaactcagcggtgattcccgccaactcgttgtcatctctcatcaagacagaggtcaacggcttcgtgcatgtttctcctcaggacagtaaggacacccccaccagtcacgtcccgtctgggcctctgtcttcctctgccacatccccagttctgctccctgctctgcccaggagaactcccaagcagcactactgcaacacatgtggcaaaaccttctcctcatcgagtgccctgcagattcacgagagaactcacactggagagaaaccctttgcttgcactatttgtggaagagctttcacgactaaaggcaatcttaaggtacacatgggcactcacatgtggaatagcacccctgcacgacggggtcggcggctctctgtggatggccccatgacatttctaggaggcaatcccgtcaagttcccagaaatgttccagaaggatttggcggcaagatcaggaagtggggatccttccagcttctggaatcagtatgcagcagcgctctccaacgggctggcgatgaaggccaacgagatctccgtcattcagaacggtggcatccctccaattcctggaagcctcggcagtgggaacagctcacctattagtgggctgacgggaaacctggagaggctccagaactcagagcccaatgctcccctggccggcctggagaaaatggcaagcagtgagaacggaaccaacttccgcttcacccgcttcgtggaggacagcaaggagatcgtcacgagttaaagcagctcgggctggagacatagcattcattcctgttcagaatgcgacctatggtggcctcctactccttgccccccaccccgccccgccccttccttctgttccccagatctatgaactacaacattatgaagacattcttttgtaccttgttcaactttagagttctaagaaagcttatttattagcgatataaccttgctttgcaaacagaatgcaagcgttaactttggtcttctgtattttggactaaatactaattgactagagtgctgtaaacttgctgtaacatttatggcaattgcaagttgccctgctaggcagttgtaatctggcattaacttattttctatatccagtttaatatgaatctggtgttgatgcaatgcctcagtgatgcattagatctctaataaagtctgtatatacatgtacactttgatcctgctggaaaattttatcagcaaacacattgtctaatctttcaaaacagatttaaggaaaggactgaaagtacagactgaacagtgtggttctttgaaaggtttggttttttaatttttattctaaaattcaacctttttttttgtcgatttaaccatttccattttgaactgctatttgtattgtgctttttacttgagtcgtcttcaatgttaataagtttctgtacagtaataagcacgcagaattctttagagaaaaagaaaacaagcgttgttttggtagttgaaactgagacgtaacattttgccttgtaggtatattcacgatagaaaatgtgtgctggaatttcacaatgctgctaagtatagcatcttgaacaaccttcagtggagaaaatgtagatgctcttgtatatacaataagaaatatcactttcattcaaatgtacatatgttccttacaagagcaaatgcttcttcttgatcaagagagcaggtatagtgtttgtttattttgtcttaggtatggaagaaaaaaattggactgttacatgcactttcttggaaagttgaaaggaaagggggggtccaatttctttaacatttaatacttactaacaacagagatactgtaattttactcaagtaatcaaatacattttttttgcaacagataaaacaaaatactgtgt

SEQ ID NO: 272902 - DNA, 1781 bp, Homo sapiens
gggagggggcgggcgggccggcgggcggggggagccgccgccgccgccgccgctcgatttccgtaattttgagaagatttttttttagtaattttttattctgccccagctgatgtttgagccagcatgtcgcggaggaagcaagcgaagcctcaacatttccaatccgaccccgaagtggcctcgctcccccggcgagatggtacacatgggcactcacatgtggaatagcacccctgcacgacggggtcggcggctctctgtggatggccccatgacatttctaggaggcaatcccgtcaagttcccagaaatgttccagaaggatttggcggcaagatcaggaagtggggatccttccagcttctggaatcagtatgcagcagcgctctccaacgggctggcgatgaaggccaacgagatctccgtcattcagaacggtggcatccctccaattcctggaagcctcggcagtgggaacagctcacctattagtgggctgacgggaaacctggagaggctccagaactcagagcccaatgctcccctggccggcctggagaaaatggcaagcagtgagaacggaaccaacttccgcttcacccgcttcgtggaggacagcaaggagatcgtcacgagttaaagcagctcgggctggagacatagcattcattcctgttcagaatgcgacctatggtggcctcctactccttgccccccaccccgccccgccccttccttctgttccccagatctatgaactacaacattatgaagacattcttttgtaccttgttcaactttagagttctaagaaagcttatttattagcgatataaccttgctttgcaaacagaatgcaagcgttaactttggtcttctgtattttggactaaatactaattgactagagtgctgtaaacttgctgtaacatttatggcaattgcaagttgccctgctaggcagttgtaatctggcattaacttattttctatatccagtttaatatgaatctggtgttgatgcaatgcctcagtgatgcattagatctctaataaagtctgtatatacatgtacactttgatcctgctggaaaattttatcagcaaacacattgtctaatctttcaaaacagatttaaggaaaggactgaaagtacagactgaacagtgtggttctttgaaaggtttggttttttaatttttattctaaaattcaacctttttttttgtcgatttaaccatttccattttgaactgctatttgtattgtgctttttacttgagtcgtcttcaatgttaataagtttctgtacagtaataagcacgcagaattctttagagaaaaagaaaacaagcgttgttttggtagttgaaactgagacgtaacattttgccttgtaggtatattcacgatagaaaatgtgtgctggaatttcacaatgctgctaagtatagcatcttgaacaaccttcagtggagaaaatgtagatgctcttgtatatacaataagaaatatcactttcattcaaatgtacatatgttccttacaagagcaaatgcttcttcttgatcaagagagcaggtatagtgtttgtttattttgtcttaggtatggaagaaaaaaattggactgttacatgcactttcttggaaagttgaaaggaaagggggggtccaatttctttaacatttaatacttactaacaacagagatactgtaattttactcaagtaatcaaatacattttttttgcaacagataaaacaaaatactgtgt

SEQ ID NO: 272903 - DNA, 396 bp, Homo sapiens
tgtgtggaagctcagactgcacagatccgttgtacagattagggctgatcattcagtcagccctaacctgtacaacactccccaccccttgcgttttggccctgctctgccaatagatgccagaaacccaacttgagctcactctgctgaacagtgatgagagatgggctggtggtcagggctgacgggactaaggttccttctcaccccatgccactcccctgtgtggcattgcccattctccattctctctgcagggacgctgtgctgctcagcccaccccaggcagggcagggaggacagacactagagaggctcccgggagctccctggtaagaagtggagtgggatggatgcagtccaacgtctctctcttttgttgttgtcaggttattg

SEQ ID NO: 272904 - DNA, 545 bp, Homo sapiens
cactgaagggtgtattatgtatgccaggcttaaaaggaaaggggagtgagacaatgattaaaatcacactaagcaacagtcctaaataaaatgcaataagtatttatcttctttctccttaaacatttatttttatatacgtacacatacacacatttacatatatatgttcaaatattaagttaaaataagctcatcttctgtaaatataacttacctcctgagatgggattggaggacatggttctgagatgagaatgaaaacaaaatataccacacacaccccttgatattccttagtgagagataacacggtcatattcccatattccatctttcactccaaaaatattttaacaatttttttcttcttatcacagaaatcccattgcttcagaacccagttctagatagctgtttgattaaacacatttaataagcaaatttaggccaaagtataaataattgataatagcttaatattgtaactttcccaagagataatttttgtttaaaagacgatgcttaggaaaacatttttaaac

SEQ ID NO: 272905 - DNA, 605 bp, Homo sapiens
tataaatttacttatgtcaattataatgagaataaaataagtaaaaaaaaatacaggcttatgtagaattctttaattaaaagaacaaatggaatgtcctaattaaatgaaatgtaatacacaattttggaaatacatctaaaaattgttttgtgtgcactactatattttataaaaatcattcttattagtcatgaccagctcacataatacctcataaactataaaagaaaaaaattataagagacaagaaaattataagtctagcatgagaaccaggcaaagaaaaacagaaaatgttcatggggagattctgaatcataagtcagaagattttacagtaatgaatttaataaaaagcagagtatagatttgctttcagcatttttgaggttttcagttttctagtaaatttgtcaccttattaagatatttgttttgttccaatattgctctattcttctgaaaacaggtataaactcatactcacccaaacacacttactctataattttcttgcacctaaggtctatttttagagtaatatatgtgcatagctaactctatgtaaatcagaactaaaattctgtatgtttgcaggcaga

SEQ ID NO: 272906 - DNA, 277 bp, Homo sapiens
tggatggatggatggatggatggatggatggatggatggatagagagataggagctatagacaaaaacttgtctctttgtagagtatcaggaaggattcacactaaactatccccaatatctttgggatagaaggcgaagagccttggaagcataactcaccctcatttattttagtaccctcaactctcagcacctgagttccaccaaacttcaaattgcaaatcttagattgaatggtatgttactgttttcaggagaacactcgaaatcatgaa

SEQ ID NO: 272907 - DNA, 424 bp, Homo sapiens
ttccacccaagtcttctctttctcaagttattttttaatagaattaatgaatgcaaattgtgtgttcttttgaggaggattaaaaaatggtgcctcaagatcaaggccagttattcatgggcccaaaataatctgtccccactacttcatttatctcatttttaggtccttctttcctgtattacagctggggtctttatgaaaattaagaaatttaaacagttttgtattgtgcttatttttatttgaccagtttgttacttaattattcaataacattcattttatatatatgtttatatatatacataataatatgtaaatatatttttatatattttatatataaatatatttatttatatacatgtatattattattgttattattttttagacaaagtctcactctgctgcccaggct

SEQ ID NO: 272908 - DNA, 406 bp, Homo sapiens
tgtcaagttaaagggcgtgactcagatacacaccggctacaagagagcaaagctgtagacctcacattttttattatagagcaatttcttccaaatcagttaaggtttcaatgtttgccttcacaaaaaaatgaaacgcggttttgcaaattaatgttcgttatccgtatcttgggggaattgtttaataccgtgcagttaatgaaacaattcagcgatacttcttccaaaatcattgctaccttatcttcatctaatctaataatcaaaacatatcttctagtaacaagacttctgattttaattatcttaactccttgttgccagattgtcctgatacgaaacccacatgcagaaagcatctgacttcaccaaaccagggtttcctctcgccccaaaggaataa

SEQ ID NO: 272909 - DNA, 358 bp, Homo sapiens
atccttgtgtcaagcgcttaattcaattattttgttattttgacttctaaaaaatcagttaattctataagttttcctctatgtactacattgagcaaactccacagatttctgtagggggcatactaattgtaattcaatttcgttttccatgtgtaggtccagatttatttgaatgtccaaatacttagaattgtaggctcttgttttgttattaaagtctggttttattacattgtgtttagagaaaataatatggaggattttaattttagataaagcattaatatcttttttatcctcaaacatgatcaatttttgacagtgttccaaaaatatactatgaaatatatattat

SEQ ID NO: 272910 - DNA, 433 bp, Homo sapiens
accatctgtttaacaaaatgatgttcattacattagaagtgtatgtattcatctggtttagttttgtaatttagaagagctattgatctgattcaaagataaccattacccatctttccaaggcccatctaagtagtacaggtgttttgtcttttaaaattgacagtcctctttgcattaagtctgtagggggggaatacaatataaatattcttctgtgtaaacgtaagaatgtgctgtaatctccagttcctttggatacctcagaattctatttattgtatacacttatactgtttattcaatgttttgggtcttactctttttgacgtattctcatcagtcttcactctagtttgcaagctctgaagttattgattacgtctaatgtgcaatttggcttctattaaatgctattttatgataaaaaaaa

SEQ ID NO: 272911 - DNA, 803 bp, Homo sapiens
gggatttcaccatgttggtcaggctggtcttgagctcctgacctcaggtgatccacccacctcagtctcccaaagtgctgggattaaaggtgtgagccactgcacccggccggccttgtacttttgaggcggtgttgactcttgcaatccatagctttgagagctccccatccgaatctcaggcacacttgactttttcactctcgtaggagtgatctccttagtccatcgatcaaactgctgagagcaggccatggcctgcctgctgtcatggcccgtgaagcagaattggagatgagaggggaggacctgggctggagagtgggcaggaggagatcctgcaaacagggaactgagagaggggagggaggaggagggtttgagagtggggaggggagctgggggtgctccctgaagaccaggaggagaggaaggaggggagctgcaggctatgaacggggctgcaggttatgaatggggcactccggcgttctgagaactgagcactccgacattctgagaactgggcacaggggcaccaggccctaagtgagttctgctccggggtggccgggcccgagagcactgacgtccaacgggagtgtcgctgcccaccgcctcccacaagaggacacttcgatttgccagagaagggcagagtgggagatgactttttctcagcatcttgcctcattttcctcttcccagaggtttgtttttaaggaagtttaagcttgctgcactggaaaagcaaaaaacaatattttgtaaaataaatatttgttttgtgcagaaaaaaaaaa

SEQ ID NO: 272912 - DNA, 671 bp, Homo sapiens
ggttgaattaggcacagcaaattcaaatgctatttattgaaggctggaggtgtccaggctcttgcagcttgtggaatggtcccctcttccccaccctgctccccactctcccagtcctcaccccccactggcaaatgaacttgcgtttccttccatgcaagtccattgaaatcaggatattagttatatttgaagcgacatattctaaagttactcggaaagaaaaaggtatcagttttccatcaaggcacttcccatctcacacgtggtcctggcgatgtgcccctgacaccgaaaccagcagaccctgcctgtggctatgaacggggctgcaggttatgaatggggcactccggcgttctgagaactgagcactccgacattctgagaactgggcacaggggcaccaggccctaagtgagttctgctccggggtggccgggcccgagagcactgacgtccaacgggagtgtcgctgcccaccgcctcccacaagaggacacttcgatttgccagagaagggcagagtgggagatgactttttctcagcatcttgcctcattttcctcttcccagaggtttgtttttaaggaagtttaagcttgctgcactggaaaagcaaaaaacaatattttgtaaaataaatatttgttttgtgcagaaaaaaaaaa

SEQ ID NO: 272913 - DNA, 414 bp, Homo sapiens
agtctgtcatatgccacagtggtgttttcatcctccctgtgagtctgtcagggaaacactactgagcaaagccagcccagagagtgagaaaccatgtgattcctatcctttttttccccatgcaaatggactaaataggtgatcaccttcaactatggccttgtgttaggatgagttgtgaatgcagcaagagaaaaagaagggagaccagtttaactggtttcaaggtttgcagccctgaagtgaacaaggatggaggattggattaggatgttaacaatggaggtgacatgcccccagatgaaaccagaggccgccaacattgaaaaggtgatggaagcaaaaaaacacttctaaaaacagtaaagacgttggtaactaagaagttttaattataaccttctgctcaaaaaa

SEQ ID NO: 272914 - DNA, 265 bp, Homo sapiens
gtacgtacttgcagttataagatgaataattttcagagacctaatgcacagcatggtgactggagttaatgtattgtgtacttgaaatttgctaagagagtatatattaagaattctcaccacagaaaggtgaggcagcacgtaagttaattagcttgattgtggaaatcattttgttcctggaccaaactgagagttgggctgctatttctcatggcccaataatgagacacagatgtactggggaggaagagagtttttattt

SEQ ID NO: 272915 - DNA, 761 bp, Homo sapiens
atgacagaatctcagtatcagggtagcatttaaagcaaaaagcattaaactggatcaaaaatgtcattttacatcaacacagggtacactccaggtaaagacttaacagttatgaacgaatgtgctaaacatcaaaatgtattaagtaaaagctgaaagaaatgaagaataattggtagaaaagcaatgataggaatccttaatgtacttcaaaaggcacgaagtaagaaggtacagtcatgtaccacataatgatgtttgagtcaacacctgacctggtatacgacaatggtcctataaaattataatggagctaaaaagcttctatcacctagtgatgttgaagccgttgcaatgcaatgtatcactcacatgtttgtggtaatgctggtgtaagcaaacttactgtactgtcagttgtataaaagcatagcacagttatgttcagcacataatactttataatgataaacgaatatgttactagtttacgtgtttacagtactattattttagcatgtgcttctgcttattaaaaaatgttaactataaaataatctttaggcagatcctacaggaggtattccagataaaggcattattgtcataggagatggcagctccatggatgttattgccccttaagaccttccagtgggacaagatgtataggtggaagacagtgatattgatgatcctgaccttgtagaggccaaggctaaagtatgtatttattagtttttaacaagagtttaaaaaaa

SEQ ID NO: 272916 - DNA, 469 bp, Homo sapiens
agtcaaataaataattcattagtaaccaggataatagaaaacctcaaaaaaattaaaatacataaaacccaattttttaaaaacagatttttcaattctcactacaactatgttctctccaaagcgtaagctagtaaggaaagacactgccaactggaaacctaggtcggcccccatggagaatgatgggtcatgtcttttaaacaaaagcaaacagaaaacattcatgtgttcaactttatggactgtcaaacctaatgcaagcttgaatttaattcaagaaaattattattttagcaaaagtccacattaaatagggactgctgtgtaaagagactacttatttttttttttttaactaagagttatattcctatcacctataatgagttttgtggaatccacaactctataatcaacttgtaaacacgtaacttacatattggtttatcattcccagattattaaa

SEQ ID NO: 272917 - DNA, 731 bp, Homo sapiens
atagccattgtgtattactgggttctagtgagtgctgctttacacaattcatgttttacaagtaccatttcatttaatctccataagaggcctaaaagtaggaagtattggtttcacaatgttacaggtgggattaagtaatttaccagaaatcacgaagtaaatcatagagccttgacttgaactcaggaagttaacacaattctgggaatatagcaggctgccaagaaagggagctccgaaggacaatgaccaaatatggaaatattcagacaaagatcaattaaactttgtggagacatagagttatcagagtcctaaaagttcaattagaccaacctccaacatagaacacagacttcctctgcaacctctccaacagatggccatcccagctgccacctaaacaagtccaatgacaaaagagagtgctctacttgttaaagcagctcattgcattgctgaacgtctttgctggaaaaagtcttctttatatgaagctaaaatctgtttctccataagtatgagcaatttgttccaagcaatcaaaagaaaatgaattttttgtctcatgcatgtgataactcttcagaacaaataacccagatccttccatttttgctcacttgacatggtctccaagcccatcccttatctggctaacccctctggagtagaaacagtctagtttctcggtttttttattaaaatgtattcccagaaaaaaaaaa

SEQ ID NO: 272918 - DNA, 868 bp, Homo sapiens
cgggggatattattgcccagactacagacagtcctgacttgttggcattgtataaagcatgctccagataaacactactatgtacattgcttccaaaagttcatagtactgcaaatgttataacccttatgctgtgtttaaacccttattcctgagcctttccgcttcatgagcccacttggccagactttccaaaaaccgtatttaggggccttatagtaatattaatcaacacagatcttaggacctcttttcaagatcaaataaaaaatgaattggttaacctcacattgtagtttattttgactagcacagatgtaatcttaaataatttttaaaaatccagaaaataagccaggtgtgctggctcatacctgtaatcccagcactttgggatgctgaggtgggaggatcacttgaggccaggagttcaagaccagcttgagcccagcatggtgggaccctatgtcttcaaaaagttaaaaaaaaaaaaactagacaggtgtggtggcgcatgcctgtagtcccatctacttgagaggctaaggaagagaatcactggagcccaggactttgaggctgcagtgagctacacaagacaataagtgctaacaggtatgtggagaaattggaacccttgtgcaatgatgataggaatgtggaatggggcagctgctgtggaaagcaatataatgattcttcaaaaaagtaaacatggaattaccacatgatccagcagtttcaattcgggctgtatatccaaaagaaaggagggtctcaaggagatatttgtacagccacattcatagcagcactattcacagtaaccaaaagtggaagcaacctaagccttcatcaacacaagtga

SEQ ID NO: 272919 - DNA, 283 bp, Homo sapiens
ggatgacacagacagacataagttcttaaatgtcttaaatgttatgtgagaattaaacagaattcaaagacttgtggggagcacttaggaagttactgggaatgtcataaagggttaatttgtattttattttattttttgagacagtctcattctgtcacctaggctggagtgcagtggtgcaatcaggctcactgcagccttgaccacctgggctcaagtaatctcacttaatttttatttggtttaagaaagtcttggttgagggtggtggcttatgcct

SEQ ID NO: 272920 - DNA, 338 bp, Homo sapiens
ggagcacacatgcccaggtgtggaaggaaggtgggaggaagagtcatccttttggccccagtgggggacagagaaaggggtgagctgttcctctcaagatcctgcctcacttggtagggggagggggtccaggaagatcacagcagagcaccccctgtcatccgaataaagggctggaagggacccaaggaaacctgccagtctcccgaggccaggcctgcggggggcggggcggggagtccctgccgcactcccatccaccccccatgttgtgcctctccctgcagacggtaaatattggtgttgtgacttcattaataaaggcttctgtgagcctg

SEQ ID NO: 272921 - DNA, 732 bp, Homo sapiens
aactcacccaggcggccagacccgggcgcgggctccggggcacgcgctagacgacctgtcgcgccccctcctccctgcgggcgggcgccgaggcagcggatctagggcgcaacagaagcttctctccgctcccctatgcagaccattgtcagtgctccggtcgccggcgctttccgcacggtgtggcgactggcagcagctctcccgttgcgagtagtcacagcgctgtcccgcagccaggggcaaaagctgcttttgcatcagagccgagggctgcaccaggtgtaacttccaccccttgacctattttagagtgtgaggatgaaaggaagaggaaaaaatagacggagggcgcgcgggggtgcgggcggcagggtgcgcgcgtggccgtgggggagcgcgcgcgcgggccggggctcgtgtcggggcttccaaagagaagttgcagcgaggcgccccccggcgtccggcgcctgggcccggtcgggggtgcttcgctagcccttcttcccgccgcggccgcaggccagcttggcccgccctactccggcgccccgcgcgggaagcgcatctaccggggatcgggggctttgggctggcccccgcgacagccgttgggagaccgccagaggcccccgcccccgtcaccgtccccgcctccccgggccgccttcacctttcgggaggcggcgctcgggctcagctgtccggtaacccaggcctgcggcgcct

SEQ ID NO: 272922 - DNA, 346 bp, Homo sapiens
accaaatgcaagagacagcattttccaccagctctagctggaaaatccttagaggaggactgtagttatcagctcaaccaggacaacttgatcggagaagagtggttatccagaaagggatgctgagcagataatcaacgttctctgaagtgggtataatgactatctacatgcatatgggaaagggaggcacagagaaatgaagtaacttttccaagatcacacggttggttggtgggagaggtaaaccaaaaacccaggcctcctcactcagacctctgctcttgcctgaataaccatgttatttcgccacttcaaaataaaagtgagacctaccagttttcat

SEQ ID NO: 272923 - DNA, 376 bp, Homo sapiens
gagatgattgagcttagtgaggaagacatgttgaaaactgagacaggctgaaaggtatgtctcccaggctaaagggcagggcacaatcatagttcattgtaacctcaaacttctgggctcaagtgatcctcctgtctcagtctcccaggtagctgagattacatggcccatgtcacggtgcccatctctgcaaaaaatggaaagattggctgggcatggtggtgcatgtctgtagccccagctactcaggaggctgagttgggaagatcacctgagcccagggaggtcgaggctgcggtgggccatgattgtgccactgcactccagagttccagcttgggtgacagggcaagacactgtctcaaaaagaaaaaag

SEQ ID NO: 272924 - DNA, 312 bp, Homo sapiens
ggatattggtagcagcattgcctttctaaattatttccttcaaatagccatgacatgaatgataaatgatgataacattcagagaaactgttgtttcctaaatgtcacacctttgtattcaaatcaggaaacagacaatggagaggtgaagtgacttgtctaaggtcacactgttgtttagaattagaagcagtacttgattctgggtctctttccatctagccattcccagattcagctgctggtacaaagccttcggtggtgtcatggtagcacatctgccttccttgccgcttaagtataaccttaaaa

SEQ ID NO: 272925 - DNA, 291 bp, Homo sapiens
cctgcctctcgaaggcctgcacgggcccggcctcggcctcacagcggactctccacgcccagctagctctcgcctcactgcggcctccccagtccacagctcctgcctttcggccacttcggcaggtccagctcctgcctgccagtggcctctttaggcccagctcattcctcacaacggcctttccaggccccgtttttcccttctggcagcctcttggcctctaatttgtttatcttttgtgtataaatcccaaaatatggaattttggaatatttccaccattatata

SEQ ID NO: 272926 - DNA, 505 bp, Homo sapiens
aagctagaagtctgagatcaaggtgccagcaggcttgatttcccctgaggcctctctccttggctcgcagatggcaaccttctctctgtgttctcacacggtgttttcttggtccatgtgcatccctcgagtctgtgtgtgtgtccaaatttcccctttctataaggacaccagtcagactggactagggcccccgctaagggtctcattttaacttaatcacctacttcaagccccaatcccccagtacattctgaggtactggggggctaaggcttcaacatatgagcttggtgggtgggggacgcaatccagcccataacactgtatacccagggtgacttgggcagaggagggattcagggtggagctaaaatcagcctcagccactccttgatgctctgctatctaaattaaatcatttcattcatcaaatagtagttgggagcccattatattcaagacactcaaggagcttacagtctagaagaggagacagacttgt

SEQ ID NO: 272927 - DNA, 213 bp, Homo sapiens
ctcaggtgttctctcgggctctccaactgcctctgctttctgtgaaggtttaggctcagtcatttatgctggcaggaggccctcttcttcatgttgatggtgtggcctgtggagaggtggagccggtgtcttgctcctagagggagtcctgactccagcagagaacatgttccgggatgtgctccacagttggcaccagcacccacaagctcc

SEQ ID NO: 272928 - DNA, 492 bp, Homo sapiens
gaatccaggaggcggaggttgcaggttgcagtgagccaagatcgcaccactgcactccagactaggcaccagaacaagactccatctcaaaagaaaagaaagacagaaagggagaaagagacaaagagacaaagaaaggaaagaaggaaggaaggaaggaaggaaggaagggaggaaggaaaatgatggctctgaaaagagcctttggttgatgttacacctctctgcagtgttagcagctctttggtattacagtcttagtgttactgctcttgcagttttgatgaccaatttcctcaccatctctcgctgtctcactgatcattgcctcttgctgtctctctcactgcttgctgtctcttgccatctctcactatctcaccaaccattatctctcaccattgcctcatcaatcactgaccaccatcctctcttcactcctggctgactcatcaccgatgcagggcagattcttggctttgctcaggaaag

SEQ ID NO: 272929 - DNA, 512 bp, Homo sapiens
  misc_feature (38)..(38): n is a, c, g, or t
  misc_feature (57)..(57): n is a, c, g, or t
  misc_feature (67)..(68): n is a, c, g, or t
  misc_feature (79)..(80): n is a, c, g, or t
  misc_feature (92)..(93): n is a, c, g, or t
  misc_feature (112)..(112): n is a, c, g, or t
gcacgaggggcggcacgttggttttccattctgatgtnttctgtacctctgatttgntgaactattnncctagactcannttctgggaatanngttcggcccaacttttttnctgttgttttacagtttcaccatctctggaattctgctgcataaattctagtcattttgacctccctgaattccaatctcttctcacctcaggagaaaataaagagaacgtataatccccttcttgagctgtgtaaaactaccacctggcagaaagccaggaaaattataggtttcatcttgtttgcttcctgcttctcaagtgtcacaagactatgttgcctattgttgaatatcttagaagcgttgtttcatattttgttcagttttgtggttatttacagtgggagggtaattctcataacctttttatgatatttttgttttctattaccatactttttattcatacatgttttattcttcccttcttttccagcaataaaattttctttgttcca

SEQ ID NO: 272930 - DNA, 510 bp, Homo sapiens
aacaaaggaaaaatttttaaatttttaaatctaataaaaaaaaacctttagagggacttgataaaacatttccataaaataagaacaggttgttatgagaaaggaaaatagcccaagaagtatttcttggaaattaaaaatgcagtcaccaacattaaaccttccatagaaggagccgaagaataagtcaaggaagtatcccacaacttagattaaaagtcaaagaaatggaaaaggcgagagagaaactgagaaacacagatgactagcaataccaatatctaactaatatcaacccagaaagagagaacaaagaaacttaagagcaggaaattaccaaaggaataacagaagaaaactccccagagctgagctaagatatagaccttcaaaaagaatgacccactgagacagaagcaggggggaatgaaaaaagacccacagttgtatagttgcgtatcctcttgatatttcagaacatttaggataaagagaagattctcaaagctt

SEQ ID NO: 272931 - DNA, 451 bp, Homo sapiens
cagaattgcaaaagaagcaaggttttcgggggtggttccttcaagacgctaatagggtttgatggaggtgaaaacgggggcctctgaaggaaacaaagaggcagtgaatttgctttcttccatggggtgggggagaaatgtgaaggaagaatgaagcaagcttgtccaacctgccttatttcgttgtggttttgttttgttttaggcttttagcagcctgaagccatggtttttagtttctgtctctagaggtaaatggaaaagagggatgaggaaggggctttactggctcaactagaaacagaaactatgaatccatgactgtattctctcccttggacacccctgagaggccggagttcattctctttggattagttcttcaaggccttttcccggatagaaaaacatttccgaaatattatgcccaatggaagcctctataaagaat

SEQ ID NO: 272932 - DNA, 540 bp, Homo sapiens
tatagtcagtaggtgttgagtgttactgatttttggtccccgagctgggtacattcaggaacacacatatgcccaggtttatgggccgttattcacaaggctctcttaggttttctaatgtgaacattgtgtagtcttggcaagactcaataaaaactctctaaaagaaaatggctagaaacaaacatggtataaattgcaatatcagaagccctgtgctgaaataaagcaagagttcatgtagcctgtgttcagcttctgaccacagcatccagagagagcctgcagtgggaatcatgcttctactgagttttcaaattatgatcatggaacacacattctcctggatgccaaagtgactcatgtttcatggatcagcctaaaggtcagttcctctactaaactactttgaatccatagtcctacagtttaaaaatctggaaggcaattccgaggtcacccagagtgataaggtcattgcaatatttaaatcatgagttgaaagcactttgcacaatgtaacatgctataaaaaaacaa

SEQ ID NO: 272933 - DNA, 344 bp, Homo sapiens
agagggaagaaaagtaacgattcttaaattttctttttatgatatatatgatcctatgtacatatatgttggtgtgtgtatatatatatgtgtatgcgtatatataatgtatgtatatatacatttatttatacacactccccctctgtccctgctttgtggatttagctgcatggatagtaatgtctatctaaggggctatagtctagaatctagaatatatactatttgcttttttttctttcatatcattgaatctacagagtttggtaacctgcatctttttccacttagtgttagttacattctgaatattttcccatgctattaaaaaacttgtggaa

SEQ ID NO: 272934 - DNA, 487 bp, Homo sapiens
gaagcagtctggacaccttactgcaggtgtcctaacctggggtccacagcctaagggaccgtgaactgaggggatccgtgaacttgaatgggaaaatattacatatttactttttgtaatctctcaacgaaatttagcatttccctcaattatgaatattattagcaaatcccagcagcacctgtggttttgttaccaatacagcaaaccaaatatttttctatctcattacagttgttgcacgtatcttgaaataaggtttacgttcatcactacttcaaaatatccatagttgccaggcacagtggctcacgcctgtaatcctagcacttttggagtctgaggtgagtggatcactagaggccaggagttcaagaccagccttgccaacatggcaaaaccccgtctctactaaaaatacaagaactcgctgggagtggtggcatgcagctgtagtcccagctacttgaaaggctaagagacaaga

SEQ ID NO: 272935 - DNA, 410 bp, Homo sapiens
ctgcttccatttaatctaattgttctttagttctgctgtaccactgaggacttccctttactgcactccaaagttagagccactcttttctagtatctatgtcttcgatatggtttggctgtgtccccactcaaatctcatcttgaattgtagctctctcaattcccatgtgttgtgggagagaccttgtgggaggtaattgaatcatgaggggtgagtctttcctgtgctattctcgagatagtgaataagtctcatgagatccgatggttttgtaaaggggagtttccccgcacaagctctcttctcttgtctgccaccgtgtaagatgtgcctttcacttctgccatgatcgtgaggtctcctgccacttggaactatgagtccattaaacctctttcttttgtaaa

SEQ ID NO: 272936 - DNA, 123 bp, Homo sapiens
taggattttccttactttcttgctagtttggctgtgcattcaaaaaaactctctattctttctgaattgtatgttgggatagtacaaaagagcttattttgagactatttagtctgccatctt

SEQ ID NO: 272937 - DNA, 514 bp, Homo sapiens
gggccctcaaaggatggggaaagacagagtgaaagggatgcgggagagaaagtcacagtcactttgttgtatggcccagagtgactcttcttgtttcccaagtctcggctcaaaaagtagcgatctccattcacctttacctccttctccattctcatgccctattttattgtaactttgtttcccaatttttaggtcatttgtgtcacttgcaattctcacaggagtggtgatgtcaaagaaacccaaagaagagatagtggattacgggcgtgagccaccgcgcctggccttctgttcttctttggattgcttttcctacagtttttgttttccttaagttggggtctcattctgtcgcccgctggactttgataacagtaggaatgtacatctcagacaaaatgcagatgcctaaagtacatctgaaagatgatgtgaataattcctgtagtctatgcaaataaagaaataattgcccttattaaagatttcctataaggtgagtacttta

SEQ ID NO: 272938 - DNA, 845 bp, Homo sapiens
cagtcattaagtgacaagcttttcctggtttttccttttttttttttcgagattgcaccactgcactccaagcctgggcaacaagagtgaaactctgtttgaaaaaaaaaaaaaaagtcatgttgttttaactattcattgccatttgttggttgggcctcttcaaccattgtgatccaatcctagttcaatcccttgttgaattcaagtattgaggtcttaggatgaatgaacaaggctttgggctggcacataaaggtgggacacccacaggtcctgctctttgggagtttgggtaagtgtattttattcccgagatgcacttgtaaaaatatacatggtaggccataggtggtctcacagtttgtctgtagtagtacagttactgtttgattcaggggagtgagaggtgagtctgtttcagagcaggtgcctgggggacaacctggagaggaaggttgagcctgcagggctttggatgtgtgaaggtaatgattcccagtagtgttttgtattatttcaaagtacttctataccattgctacctcccaccaggtctcatctgcttctgtcagtaggttggccatgtccccatttcacagatgaggaaacttggctttgagagtgtggcttggtgcaactgagatttgggtctaaatgcaatcatgattgcatttagacctgattttaggcatagtcatttagtcattgcacctgctgcgatggcttccttgtcattgtgaaatgacgttatggctccgataacagtccaagttccttgtattctaaatcgccaggatctttgtttaggggatatatacgtactttaccatcgaggctcacgt

SEQ ID NO: 272939 - DNA, 237 bp, Homo sapiens
gggcagccttgctcccgagacagtgaacatggagccaagcccaccctggtgggggctgtcgttccagccttgagaccgccctggcatcacattttccataatcacttatcagggcagccactgagcatccaggccaactcaggtaccccttttgcttgagccagtggcctcaagctactactctgtgtggggaagaaaaagtagtgtctctgttcttctgagttcctacgaggggtg

SEQ ID NO: 272940 - DNA, 437 bp, Homo sapiens
aggctccagaaaaatgtttcaaagggaaggatgaaggcttatagaatacctgattgcttgaatgcgttgaaaaaaatatttattcctagaagtctgggaatgaatattcattaatattggatgaagaaaatagacttttattggccgggtgcagtggttcatgcctgtaatcccagcacttttggaggccgaggcgggcggatcacgaggtcaggagatcaagaccatcctggctaacacagtgaaaccccgtctctactaagaatacaaaaaaaaaaaaaaaattagccaggcgtggtggcgggagcctgtagtctcagctacttgggaagctgaagcaggagaatggcgtgaacccgggaggcggagcttgcagtgagcagagatcgtgccactgcactccagcctgggtggcagagccagactccgtctcaaaa

SEQ ID NO: 272941 - DNA, 319 bp, Homo sapiens
cagagggctgctcaagtggcctaacatggcagctggttttccccaaagcaatccatgagaaagttcgtgggggggggctgtaatgccttttatgacctagtctcagaagtcacatgtcattatttctgccatgttctatttgttagaagcaattcactaagtacagcccacttataaggcaagggaaatagggctctgcattttataagaatattgaatttttgacatgtttttaaactattacacatatgcatataaaagtagcatgtaagttaataagtgtggcaaagagataacttcaagggaaacaaaatctaaa

SEQ ID NO: 272942 - DNA, 1313 bp, Homo sapiens
gctaaaggtcgtaagcaaggacaatgaacctggaatttggaggaattcatactccagtgaagaatttccagacccctcatgaaaatagcagattgcctactcaccagagaatactcaagctgaaactaagcagcccctggagggtaagcaaatgattagaagggtagatttcaggcaagcaaaagggtgagagcccagaatctccatgtgaatgaccctaaaattacaggtaatataggaagtggcttccttgtacctctagaaattgaactctcagaacctgactgacagtctgctcttaagaacattacctcaatctggagagaaatgtgtgtttcctctcctatatggatttcagacagaagcagaaggaggcttagaggttcttcgtcacaagttgccaaaatgaaacagaactgtgaaaagaaaatggagatgcttcttcaggaggtgcccgtgatgtgatttacttgatgattatggcctgcagggtattgagatgggattatgtaacttaaataaactggatatgagtagagatctgaaagatttttcaaaaacattcagctttactttttttttctcctaaggaacaagttgttcactcatagagctgaaaaggataaatgaagtgttcagtacacagaagcaaaatatgagtagttcatatatcttttgtaaatgttctatgtatcactgtaaactagacatcttccacatgcccctatgtttttccattttgaaatcaatttctagttcaaacttgtcaatagacaatgaatatttgcaaagttatagtttcactgaattaggatgtaacctgtagctcacaatgaaaatgccattagcttgagtttaaaatttatgttgctatttttttcttttgtcaatattttccttctgtgggacttattgcacaagggtcggatatcacaactgagggaaactgcagaacaatggttcttccaatcattcagacccatttaagccatagtctttgttggctttgccaaatgactgaatgcttgggtctattagcactgtcaaatagtgttgagtacatacttgtggcataagcaagttaatatttatagggagcacttttgcatgtcttttaagtcacatactaattttggaaagtctctatgctttatattttgccctgaaaacagatattctagtttaaaaatgttaatttagtgattagaaaccgctgtatatattattacatatattgtctaacaattgaagataattatgtttattaattgcaaataacaggacacataaataataaacaaagatcggccaat

SEQ ID NO: 272943 - DNA, 831 bp, Homo sapiens
taactcattttatatagactttggcagtgttctgtgatctgttaaaatactaatatacctccagttgacatatttctgctttttttttcctggagaaaagtggaagttgagaatagtataaaggaaaatgctggagtaggaaaggacatgtactgggggggcagaaggcctgggtgaccttggccaggtcatttcctcactctggatggcttcattttacccatttagaaaacggattggggtcaatgggattgcactagtgattgctaagttctcttacagctaggattccgttattctattgtcctgatctgaaatctcccagccaaagctttaggaagccacctattctccctgttctcctatgaagtttgttactgtgaacttgaggagcagttgatctgagtggactcgccagtctagctaacatggagggctagcttcctctcagggatgcagagtgtgctttgttgtgctttcttcctggagaaaagcatgtccagtagtatatacatcagctaggtgggattctttgggacagtggcatgtgctgtgtttgaaagtcctttgacagagttgaatctgacaaagctatcccagtttgtaaccatgttaagtggtggctttcattagccttaagccacttttagatataggagacttcctatattggtacatcaacatttttcgagtacctcctgtctgcaagacaccatcacagtataaacttaaaagtacttatgactcactaatccagccacatgaaagtgatcattcatctgaataaataaataaacagttttcattattttctccatgaaaaggtctgaa

SEQ ID NO: 272944 - DNA, 553 bp, Homo sapiens
  misc_feature (536)..(536): n is a, c, g, or t
  misc_feature (541)..(541): n is a, c, g, or t
taactcattttatatagactttggcagtgttctgtgatctgttaaaatactaatatacctccagttgacatatttctgctttttttttcctggagaaaagtggaagttgagaatagtataaaggaaaatgctggagtaggaaaggacatgtactgggggggcagaaggcctgggtgaccttggccaggtcatttcctcactctggatggcttcattttacccatttagaaaacggattggggtcaatgggattgcactagtgattgctaagttctcttacagctaggattccgttattctattgtcctgatctgaaatctcccagccaaagctttaggaagccacctattctccctgttctcctatgaagtttgttactgtgaacttgaggagcagttgatctgagtggactcgccagtctagctaacatggagggctagcttcctctcagggatgcagagtgtgctttgttgtgctttcttcctggagaaaagcatgtccagtagtatatacatcagctaggtggggttggtcgnggggntcctctaaagtc

SEQ ID NO: 272945 - DNA, 456 bp, Homo sapiens
cagtcacagataaaaccagctgggaagttaacaggaaacaacttttctcccaaggtcaggctgctgctgttgagtcagaacaacgtctttcatagctgcacttttactgagaaaacttgttttttaaaatcatagactgtcagaaaatatgctctttaaaatcatatcaataagaatgggataccctactctttcctggctgatctaaatccatttgacacaaataagcagcctagaagaaaatacaggaaaaaatctaggtgaccttgggtttggcaatgagactttagataaaacacttaaatcacaattcataaaagaaaaaaacaatttaaacttctgccatgcaaaagacactgttaataaagaaacaaatcacatactgggagaaaatattcgcaaaacatttttacaagacttacacccaaaatatacgaagaactcttgaaactcaac

SEQ ID NO: 272946 - DNA, 271 bp, Homo sapiens
ccagccagctcacactcttttgcacagctcctgggactcccgttgacacacagggaacagccacccacaatggactgcactgttctgtttgcacccttaaatttatcgtgcttacagaatgacacttctgcaaactagtcaagtagggggaagtggtttgtggatatgcacccttgttcattctctttgaaaaggtaaccagctctgaattctttctcctttgaggaggagtttcacttgtcgcccaggctggagtgtagtggtgcaatct

SEQ ID NO: 272947 - DNA, 485 bp, Homo sapiens
ccttctctcttccagcctgcatcggtggcttcatggggacttccctgtgatcagctgacagagaaagagaagacttaggcctggtttacagagtgttctgtatgatatgcaggtaccaccctaaagtggatagctgcagcactacatctcacctctgggctaccttgaaggacagtggtgaagggaaatcctcctggtggacacaactttgagcagtccccctgttgactttgcttagaaggaaaaatagccagatattcaattatatgccaattcataggccgtggccagtggtttggctggatggtcagggagttcaatataactggaaaattggtgacaaagaaatttggagatgaagtatgtggatagacactgaatgggcaaaaagggtgaagatatttgtgccccatgtgaatgctcaccaaagggttagcaaaaaaggattttaataaagtggacaagataacctgttctgtggatac

SEQ ID NO: 272948 - DNA, 746 bp, Homo sapiens
aatgagggagctcttgagctcccttgatgagcaccacacagggccctctgggaagcagtaagaacccatcccagggctcaataagaacctaacccagcctgggatggcccttccctttctgccaaggtccttcccatgccaaacctcaggcccttatcttggtatctgtcaccacccaccacccccccgacacacacacagtcatgcaagttgtaagacagtgacagaagatttgaagaagaccaccagagcaggggatagcagaacatgcagacttagggggaagccaggcgttcataccaaagaattagacctgttgggtacccaggctgggggtcaggtgaggagggagctgggatccagcaagcctagtgaaacccaggggacagtggactcggtcacatccaggatggtgatcaacagctgcatcatcccgcttccttctcaagcgacaattccagagccttggccacacggtgcttgtatctttcgtattcagaccccctgggttccagccccttactgccttcactttcctctcaccccttgactcatctttcctgctacttgtcacttgagatacctaagatgatgtgtgttatggagaggttagagcaccagcttcagaaccaccctgtgactttggcctagtcacctgacatttctagactttggtgtcttcattcataaaggcagtgtggactgcttgctgatgttatcgtgaacctgaattccttcttagagtt

SEQ ID NO: 272949 - DNA, 724 bp, Homo sapiens
tacttttccattgtatgtatataccgcattttgtatccattcatctggtgacagacgtttgggtcatcttcacctcctgacgtttgtgaataaagctgctatgattactggagtacaaatactcatttgagtttttgttttcagttctttgggatctatacctagaagtggaattgccacatcatatactaattctgtgtttaaactttgagaaaccaccaaattgttttccaccgcagctacactattttacattcttaccagcagtccactgagtttccaatatcttgtagcccacacttaccttctggcctttatattttggtttttgtttgtttgtttgctttttatttttgaacagttgctctttcttatatctcatttggggttgggaaaatgaattaattgatctcaacaaaccttttaagtatcaggaccaggcacggtggcatatgcgtgtaattgtagcactttgggaggccagggcaggaggatcacttaagcccaggaatttgagatcagcctgggcaacacaaggagaccctatctctacaaaaagtttaaaaattagctgagtgtggtggtgcgtgcctgtagtcccagctactcaggaggctgagataagaggattgcttgagcccagtctgaggttgcagtgagctatgattgtgccactgcaatccagcctgagtgacagagcgagaccttgtctcttaaaaaaaaa

SEQ ID NO: 272950 - DNA, 203 bp, Homo sapiens
actttgtgatggggaaaagttacttccacaatctgaaagctggtattttggagaatatttaaaatatttaaggcccatgcatttttcagctaatctgtagttttccacaaattggtagggatcttagagactgttaccacctcccctgggcagaaatgtcttgacgtatatacagctactgtgtacccacaaaaaagaaaaaa

SEQ ID NO: 272951 - DNA, 593 bp, Homo sapiens
tttttaattgcaaaacttgttgcaataacaagttagtcaaagcacaactatcaatagaattttgagtctgttgagtcaatgagtcagcacttaatccattggagataataggtcatagagaatgttccagtaattcttgctatattcataaacattgattagtgctgcagagtaagcaactctgcctaagcacattagcacttagctgaccacaatttatgatttatgccagatgaataattcactgaaatggaatcctttatttggagttatttttcatgctttccaattgctaaacacatggcagaagtgagaaaaattgtaagctcttctgaggataggaaagttagttcaaacttcattctcctcccctaagtctagtacaagtttgtcattctgtaagtatttgttggtaacaaatgctcttttttcttatgtaatcatggcaatttccttataactaaaaataattggctttatgggaaattatggccaaaattttaatgaaattattcatactgctgggtcaacatttataattttgattgaataaatatgttattagaactaataaagtgttaaaaagttaaaat

SEQ ID NO: 272952 - DNA, 500 bp, Homo sapiens
aacaccacttctcatattccagctcactttgtctggtcacaaaactccaaaagtcctttgaaaatctaactcactgcacctacagtccattagtctcatatcctttccctggcctggacccccacaccctgtgtcctcacttcactacttaactaaattccacggtcaatcgtcataatcactcccatgcagataccttcactaagtttttccccattccttttcttacctatctgtgcctaaaccaaaaccctcattaaatctaaactctttgctctgccctaagccacaaaatgtgaccaaaggaaaaaacacagtcctgccatcatctttcatttccagttcaggaaaatccacctcaaaaggtctgttattcttcctctctcttcacacctccttggctcatggccctttttcctgatccattgagaaaaagatccaatcaaaagagaaactgtaccagctcccacgatatctacccacttacctgcaccttgaaa

SEQ ID NO: 272953 - DNA, 366 bp, Homo sapiens
aaaggattagtggtacgagatacactatttggtgttctgagggcatgataagtaatggtgttaaatcaatatgtaaacactgacatattctataataacattaagaacccactgaagtctgggcgtgatggctcacccctgtaatcccagcactttgggaggccaaggcgggtggatcacctgaggtcaggagttccagaccagcctgaccaacatggtaaaaccctatctctactaaaaatacaaaatttagctgggcgtggtggcacacacctgtaatcctagctactcaagaggttgaggcaggagaatgacttgaacccaggaggcagaggttgcagtgagccgagatcacaccgctgcatt

SEQ ID NO: 272954 - DNA, 427 bp, Homo sapiens
ttcctaatgttcctaatgttctagaaactcaaataacagggctggcacacacagtttccgggaacctatcccattgtgggcccctactcagccagatacagtcaaatatttaggagaagggccagggaatctactttcagcaaatgttccaggtgacacatttagtacctaatttgggaaatgttaatctagtccaatcccattagtaagaaaggaggggtccttagtccaaaggaagtgaccttccaagataacatagaccagcagtgtcagggttgggacttgaaccaagccaggtctccaggcccccactagggtcttgttcaatgggtaaccatgttagttctaggagaattttatcattggaaatgcacatttgtcacaaacagcttatagatgagttggataaattagggctcattagggc

SEQ ID NO: 272955 - DNA, 656 bp, Homo sapiens
agcaggtgaggccctgagacctgcccaggcagcccacaaggtggtaaagaaggggctagagtgagaactcagggctcacagctccactggcctcttcccagcactctgacttccctgagaaagaagtttgccatgaaagaagagagtagggctgggggagcgccctcctgtgagtcaggcagaggctgcaatgggctcagcggggagaaggcctgcctgcagtgaccagtgggccctcagctgccaaacccacaactgtcagatgcttctcaaaagcaaaactggaacattaaaggtagaaatcatgctcggccagatttactctcacatgtgcacacacaacttacacatacacatgtgcgcacacacacaacatacatatacaccatacacacaacttacacatatacacgtgcatacacaacatacatacacactcatacacaaacttacacatacacacgtgcgcacacatacatatacacatacacaccttacacatacacatgtgcacacacatacactcatacacaacttacacatgtgcacacacgcacaacatacatatacacccatacacacaacttacacatacacatgtgcacacatacacaacatacatatgcactcatacacaacttacacatgcacatgca

SEQ ID NO: 272956 - DNA, 333 bp, Homo sapiens
gaacaagatgtttctttgtagctctttttaaagtgaaccctttgagtaatgactgcattagaacttcccagaaaaaggaggttaaatcactatagacagacggataagcgtaaatgacagagaagcagaaaatatatctattgatcatttgacaatagtcttgaccagtatttgtaacacaatacactgaaggcatcgtgttttttgaaagtgtatacactttggattcagacacacttggttttaaataacagtttggctactcgtgtgtgtgtgaccttgggtcagttacttaaactttctgagttcattttcctcatctgttcaatggtt

SEQ ID NO: 272957 - DNA, 963 bp, Homo sapiens
tgctcaagcctgcaccctcgtccaagtcctagccccactgaacgctatgcctggtcagcagtgcgtgtcaggggtgcctggcagagtgtgcattttccgtacacccaacctgtctctgcctctccccaggccctcacagcaaccaggccaggcgagaagcttgggagatagatactcagaggaggcactgtggggccatctgaagatcctgcgtcccctgtcacagcctttatgtcactcagggtccatgactgtgctagaagcatgtccctgaggcccatggtggtgggaggagggtgtgggattcggatctgggcacctggctgtgctgcacaccagttgtgtaatcatgatcatctgctctaaacacgtatctttaacattcgagaggaatgaccgcctggtggggttgccatggagagtacgtgagaaattaaacctcacaggtgcttagcaaaagttaattcgctcttctctgaaggcttaaagtgctaatcccctggcgaggggggaggtccagtgaaaatacacaacccctggccacaggttccattgttgtccggactcctctgaccagtggacagccctggacctgggttctcagacctgagtcagaaccacgtggaggacaccatagagcttaggctgctgcccctcaccgctgcccccctctcacaggatctggggtggggcctgggaatttgcattttaacatgtttccaagtgaccctgaagctgctggccctgggaccacacttagagaacccctggttcaggctatggggcctgggccaggctcgccgtctagcagaggatcagaccccaggttggagcataaccgtcatgatggctccattcatcaggcacctgctgtgtccccgcacgcccagatccctgccacagcgcagcctccctagagaagtgacatccaatgctcgaggggaaataaatcaaaggtagttt

SEQ ID NO: 272958 - DNA, 373 bp, Homo sapiens
acaatccttacaatcggcccaacaaagcataaggaagcagggtatttatccaccaactcatgatgtgatggctgttcttggggatttaactctccacttcaggcctggccctccgtcatgttagccacgcaggctcttatgggccacagaaagacctcaagagttcagaagccagctgcatgcaagggaatggtacaaaaacttcagatgacatcctgcataggccaaaggaatctgccaacaacatctgtcaaagctatctacaatacagtacgttgtatcatgttttcccaagcatgagacaagtaccaccagtggttcaggagatgattttaggtggttctgggtcatggaattaaataacattgaatta

SEQ ID NO: 272959 - DNA, 195 bp, Homo sapiens
tccataggtcccctgggcataaagccctagacagtctccctgtactgctggaataatccctttgggaccacccccattcaggacaagtagcactttgatcacttactaaatctgaggtgaatctgggctacaggcacaatctagagccaaaaaggcagtgacatagcgtcaaagattcgccaagcaaatataccc

SEQ ID NO: 272960 - DNA, 438 bp, Homo sapiens
aacgcccctcccagtctcacagctaggaggcttcatcactgctaggccagttggagcgttccctagagctcagaacaaattgtttcctctgctgtccctaaatataggacacctacaagcactctgaagcaagggcagacattcccacctggtacctgtcaaagtcctaggatgcctgggatcttccatctttcagtctagcacgtgggaccaaatacaagagatgctgccctcacaacagccttggaaaagatgagcgccagggctgtcagtacccatcggttcagtaagcgaggcattgtccacgctgcctattcactcgagagatgaatagtttcctgttttcgatggctggggagccagtatgagctcataaaccaaacagcaattttcagagacatctgttcctgatcttcagaataaactcagtgtccagtt

SEQ ID NO: 272961 - DNA, 816 bp, Homo sapiens
aacgcccctcccagtctcacagctaggaggcttcatcactgctaggccagttggagcgttccctagagctcagaacaaattgtttcctctgctgtccctaaatataggacacctacaagcactctgaagcaagggcagacattcccacctggtacctgtcaaagtcctaggatgcctgggatcttccatctttcagtctagcacgtgggaccaaatacaagagatgctgccctcacaacagccttggaaaagatgagcgccagggctgtcagtacccatcggttcagtaagcgaggcattgtccacgctgcctattcactcgagagatgaatagtttcctgttttcgatggctggggagccagtatgagctcataaaccaaacagcaattttcagagacatctgttcctgatcttcagaataaactcagtgtccagttaaaaaaaaaaaaaaggggggggtagtcccctcgggggcccaagctttagcggttccccaggtttttttgtaaaaggggggccccctattagggagagcgcggttatattaagcggtagggcacggggcccggtcgtttaacacacgttcggggatgtggggaaacactggctcgcctggggattctttttgagaagggaccctaacttttttgggggtggagcttactttggggacaaacttaccttacagagagagattaagcggtctaagggtagaatatttaaaatttcaaggtgttttatgggtgtatccaacgctgattttcgtggccgtgaagaagttggctgacggagtatgttttttgaaatttttttcg

SEQ ID NO: 272962 - DNA, 597 bp, Homo sapiens
taggactttataaactgacatttattgttatcattttggaacatatcaaaatccgttcctcaaaattaaaaaaaatctaagcatatataattcaccagatctgaaaagaatgtgttaagggttactaaaagtgactgagagcaggaagaaatgatgcaagaagtgaagagcagagccatggagaagtgggggtaggggggcagctatttcagaatgtaccagcatttcctgaaggtgagagatatgcccaggagagcagatactagattctttgtttacgacactggatgtgggaacaggtttaagcagagatgctggcagaagctgtcacagaatgaatttggtagaggaaagcaggggacagggacctcatccagaattgtaccttcaacaaggtggctatagttaatgacgatatagtctcaaaaactgcagagagagtggataagtgttgtcaccacaacaatgataactatgtgaggtaataaatttgttagctagatgtaagcattccagaatgtctgtatacctcaaaacattaatgttgtacatgatcttacactgtcaatttttgaaacacattaaaacttaaattta

SEQ ID NO: 272963 - DNA, 782 bp, Homo sapiens
gtgggttgaccgtggcttgtgggttgaccgtggcttgtgggttgaccgtggcttgggggggtgaaaagagttgctgaaaatctcccgatgggcaaattgagggttcccccaaggagggacagtggtttggatggttccatgggcctgagtcacctgtgacagggccaccccccaacccccagggtatttttagctgcaggctgcactcccgtctgggcctgggtctgagtcacactctgtccgtgagaagcgtcttcccttccggctccaaagccacctccccaagtcgctccctgcctgtgaggcaggagggtggcccccagccaggcagccctatggagccagtgttccccccacccttgaggggtcagcctgtctaagaggaagacttcccttgggcagaggggtgtgggtcggatgatgcccatgttgctcactctggcttcccgggagttattttctgtcctgggaaaatagaaatggatggaaaatgtctgggcttgggccgagcctcagccacacccccacactcgctcactctctggcctctgccattcattcccccccgccccaccccaactcacccgcttcctccatccttatcctttccaggcaccaggctgtctgggggacaggcatgcacacgtgtgcacccgctcacacacgtggccgggctctgggacctcggggccacttctcccaggcacccatcgtcacccacggagatgggaggcatggagcatgtctcctggccctcccctctctccaggatctccctgtat

SEQ ID NO: 272964 - DNA, 564 bp, Homo sapiens
aaaatgataacatgtttttaacacatgcatatcaattaactgagtaattctgtttctagagtttttccctaggcaatacataaaaaggtacactcaagaaattgatcacagtatcatttataatagaaaacattgtaaacaccatgaaaatctaatattaggaattggttagatcattatttcccaaagtatttcgaaaagatcaaaagttctaggattgttaatgtgtaattcacaaaaggatgttatggtcaaatagctttaggaaatagttgtttaaacctattattctgtttctttactctagcacatctgaacagatcatacatgatctcagtagaggtaactaaattagggtatatccataaagtagaagattaagcattcataaaaagtgatacagatgtgtgtgatgtgtgtgtgtgtgtgtgtgtgtatgaatatagaaatgtgttcttgatatagtaagtaaacaagtatgtattatatgaagtcatttatatgaaaaatgttttttaaaaatttagtgaagtatacaataaatgttaatagtggtcatcttgg

SEQ ID NO: 272965 - DNA, 441 bp, Homo sapiens
ttgcagtgagccgagatcatgccattgctctccagcctgggcaacagagtgagactccatctcaaaaaaatttaaaaaaaagtttatcatcaggctcttcattttttggctgttgatttttttccttattttgagagtaggcctcaaagagcaggaaggctattcttgattaggcgtacttcagggcacagtgacgcatccactgcctcttttaaatctcatctgagtccttatttttatttttttaaagatagggttgcactttgtcacccaggctggagtgcagtggtgcaatagcccattgtaacctcgaactcctgggcttaaacagtcctcccacctcagcctcccagttactcaggaggctgaggcaggagaatggcatgaatctgagaggcggagcttgcagtgagccgagatattgccattgcactccagcct

SEQ ID NO: 272966 - DNA, 456 bp, Homo sapiens
ttgcagtgagccgagatcatgccattgctctccagcctgggcaacagagtgagactccatctcaaaaaaatttaaaaaaaagtttatcatcaggctcttcattttttggctgttgatttttttccttattttgagagtaggcctcaaagagcaggaaggctattcttgattaggcgtacttcagggcacagtgacgcatccactgcctcttttaaatctcatctgagtccttatttttatttttttaaagatagggttgcactttgtcacccaggctggagtgcagtggtgcaatagcccattgtaacctcgaactcctgggcttaaacagtcctcccacctcagcctcccaggtaactaggactacaggtgtataccatcatgcttgggtaatttttattttattttattatttttttttgagacggagtctcactcttgcccaggctggagtgc

SEQ ID NO: 272967 - DNA, 510 bp, Homo sapiens
aaaagggctgatgggacctcagtcatgtggcagagaatctgaaagccagaagcttggcaggtctgtctcggggtggggtgacggagagacatttccctagaattcagctgctgggagcagaaagacagagcaggggcaagtgctgggtttctgaggcccgcagtcctgagcatggcctcaggcagtctgttctatgacagaacctgaagaaaggcccaggcatttgcatctatgtgtgcagttctacttgtcctaaaggcacttctcacactgggagcctgcctgtctgtacctgtctagaaatcagcctggctgggacgcacaccaataggagggcatcctcacctttcccacccatgagtcgggactgttgcctgctgtgcagcaaaggcaccaggaacacggagtcagacacttagggtctaccccaggctccacttcccactgcctatttgactctgggcaagtcttttacagcttttcaaacttctctctttcttaaaacaaaaa

SEQ ID NO: 272968 - DNA, 302 bp, Homo sapiens
cttctcctcttctgggactccacctacacatatagacctttccaacagatctcctctgcctcatacactccgtcctgtactttctctcagttttgatctgttactctgcctcattatttcccagggaccttcttccagctcactcatctgctcttccttcatactcaatgttttgtgatgcccatctattgagttattagattcagctctagaatttccatttgattactttgtttatagaatcaatttttctggtgaaattttccacttaccctttattttcttgaacatatcaaccacag

SEQ ID NO: 272969 - DNA, 1085 bp, Homo sapiens
tgctgctcctgctccatgggaaatggtgaattacactgcccatcaatagagccaatagcaaacacaagcaccagtgagcctgtgattccttcgtttgagaaaaacaatcattgtgtgagtcgctgtaactcccagagctgcatattagcccaggaagaagaacagtatctacagagtggagaccagcaactgacccgacatgtgttgctgtgtttacttctcatcattggcctgttcgctaatctttccagttgtttatggtggctattcaaccaagagcctggaagactttatgttgagttacagtttttctgtgccgtgtttaactttggtcagggatttatttcctttggaatctttggattagataaacatttaatcatcctgcctttcaaaagaagacttgaattcctatggaacaataaagacacagcagaaaacagggattctcctgtttcagaggaaataaaaatgacctgtcaacaatttatccattatcaccgtgacctctgtatccgaaacattgtcaaagaaagaaggtgtggtgcaaagacttctgctggaactttctgtggctgtgacctggtgagctggctaattgaagtcggccttgcctccgaccgtggtgaagctgtgatatacggagacaggctggtacaagggggagtcatccaacatattaccaacgagtatgaattccgggatgagtacttgttttacagatttcttcaaaagagtcctgaacagagtcctcctgctattaatgcaaacactctccaacaggaaagatataaagaaattgagcattcatccccaccctcacattcccctaagacctaaattatgcaggggagaaccctacatggaatcatattctagccgcgtattcattagtttttagctgggtgaccttgggcaagttaacagaggcaacctctctgagcctcagttgtctcttctgtaaaatgtgaaaagatgtgctcccaccacatgcgcagggtctgtgattttacatgtatgtaaaacacataggaagctgacttaggaaaaagagaaaaccaaattaaagttccgttgatgccgta

SEQ ID NO: 272970 - DNA, 445 bp, Homo sapiens
gttgggggttgggatttcgacgttttgaagcatgaaatgatctgtaaaccatttcaaggattttgaattttatactaagaacaatgggaagacactgcaagtttttaggtaacggagtgacaaacagaactctccttattttgtgttgatctgacttttgtttagatcaagaataaccttgatctcagccacatactgcatacatgatgtgtctttccagagtatcccatctggaggtacatgggtatctgtctctcgtaggtgatgttaattttgattacccactcaaggttttgccctgttttgttgccgtattttctctgttttgcaattagtaactaatctgtgggaaggttaagaccttgtaaatatttgcttctcatcaaatatttctctttgatttggggtccattgattagttactaatgtcgacgcggccgcaatt

SEQ ID NO: 272971 - DNA, 648 bp, Homo sapiens
aagttccacttcgtggacctggcgggctcagagagggtgctcaagacgggcagcaccggcgagcggctcaaggagagcatccagatcaacagcagcctcctggcgctgggcaacgtcatcagcgccctgggggaccctcagcgccggggcagccacataccctaccgcgactccaagatcacccggtgagctgccccctggctcctatgtggcctgggggccggggaggcggggagtgtccagcacaccagtgggggtggaagcccaggtcccctgaggtctccagcccacgggaaccgcgccaggagccggtcccaggtctggcccgctggccctgggcctggagcgtcggggcccctgagagcctccccctcgcgccctcaggatcctcaaagactcgctgggcgggaacgccaagacggtgatgatcgcctgcgtcagcccttcctcctccgacttcgacgagaccctcaacaccctcaactacgccagccgcgcccagaacatccgcaaccgcgccacggtcaactggcggcccgaggccgagcggccacccgaagagacggcgagcggcgcgcggggtccgccacggcaccgctccgagacccgcatcatccaccgcggccggcgcgccccaggcccagccac

SEQ ID NO: 272972 - DNA, 373 bp, Homo sapiens
ttccttccaaagccagaagataaagggggaaaataccccagcaaacctgtggtcatcacgtccattcttcacgtttttaactcccttcacatctgcctgctattatttgtatttctgagtcttcaggtggtttctttttgtattcactctggggtgttaagtagaaatcggtgagagagatgctgaaatgtgcttatctcatcttggccagtaatagaagtctgccttgtatatgttattgtatgtatgtgtatatattaagttgtatatacacatattaaatatacatacatatattacattttatacacatacatttgtttcctcatgcaatttgtttcagcagaagtaaaaattaataaaggtacaagta

SEQ ID NO: 272973 - DNA, 518 bp, Homo sapiens
gattgagctaacggccatctgttatgatgggacaatgctgattcaagaagtgtcatttgccactttatctgatgtcaggaggcaacacatgaaatctgaggacctttaataactcacaacaccttgtgtgtaagatccccggggaaaggcaaccccaaattagaaacatgtttcactggaagggcactcacttactgatacctcagggactccactttgagggatgcctttatcattcatacctttccatggcatgaatggaaaactgctgcaatgctgcttctgtcctaatgcatttcatgagtcagcatatgacaaagggaagggacacccaggtcagccccatcattgtatctgaaaccaacacttcgaatataattggaatgattacatacgattctagatgttgagtgattagcacagcaagtggtgcccagttggttgctattattactgttgttgttgacattatgattatgcttattttgtgttatttattaaatgaatatacttaaaaa

SEQ ID NO: 272974 - DNA, 983 bp, Homo sapiens
tgatttaatcatctgatatggcaataactctgaagaattctggctaggatgtatcagcaaactgcaatgcagcacagaatttcaatgaaaatgcattattctgaaaatctttctctactggaaaatttccagaccaatatctcttcaaaagaggaaaggctgttaaataatgggccccaatgccattatgatacaatccattaattcatattcaagattccccatgatccaggaaagccactgatgctacagctattttcttcacatttcatataagaagaaggagtaaaattgggaattccagcgaaatgacatctgcttacatctgttggccatctctagctgccaaggagactgaaaaatatagggtttttttggccaagtatgttgtttatcagcacaaaattatggtgctgcaagtaaaattgaatggaaacataaatattggcacagtaactagtaatctatgaaacaaagcataacatcaaattaatcctctttctgcaactgtggtgttctcttcccatttcctggtgaagccttggtagcaccatccactcaatgagcaacagaaatctgacagtaatttttgatatgtatttttctctctcacctcatatccaatcatgaaaatattctcagaattctctctctttttataatgtcagccagatcatgtgctgatagcataagaaggtttgaggaaggcatgtctcacacatgagtctgaaaacctaatcatcacacttgtgaaccacaaaaagatctctcaggatgcttaactaccttcaacttgggtcctttaactgcatgacactctagctccagctacatgtttttttccttgcactttcaatccaaaacattaaaacctatcagatatattcatgatcagtttctcattagtttcttgatcctttgcaatttgttttctattgcttttctccagtctgcacacccctttaaaaggtattcaaggacat

SEQ ID NO: 272975 - DNA, 447 bp, Homo sapiens
catactgtcagtagagaaatgtgtgctataatcattattacttatgacatttctacttaactaagaaggcatttccaggaaatatcttttaaatcagtaactttaagaagctgacgctcaaaggggatttagaatctggattatttttctgattcaaattatcttttcttttggcctttgaagaagcaaatagatatttatttctcttgttccctcctctgcaaatgcttaattgattttattcctgtcagctgactgcaatagaaatcgctgtttccacttcttcctgttaacaccttttctgcaggggtggagggctagggggaagctgggacaggtgaatgtcttcttgcgttcggctgtgttgtgcatggagaagatttggagaattttcattcttccaaaattatccacaacactttgaaatgaggtgacctcctgttcggc

SEQ ID NO: 272976 - DNA, 380 bp, Homo sapiens
gaccccatgtgccaggcccggtgcccacagacatgaggggagccactggtctggcctggcttggaggttagagaagggtagttaggaagggtagttagcatggtggctcatgcctgtgatcccagcactttggaaggccaaggtgggcagatcgcttgaggtcaggagttcgagacctcatggccaacacggtgaaacagcgtctctagtaaaaatacaaaaattagccgagtgtggtggggcatgcctgtaatcccagccactcaggaggctgaggcgggaaaatcacttgaacctgggaagtggaggttgcagtgagctgagatcacaccactgcgcgcgagcctgggtggcagatggcagagcgagaccctgcttca

SEQ ID NO: 272977 - DNA, 283 bp, Homo sapiens
ggttggggggacagattgtgtatagttgggagagagattgtttatggttggggacagattgtgtagtgttgttggcaggcattgtgtagggttggggccatagatggtatagagttggggaacagattgtgtagcattatagggagagatgtgtaggattgggagagatttgtgtagggttggagagatggattttgtaggcttgtgggggacagattttgtagatttagagagatagattgtgcagggttgagggggacagattctgtagatttggagggat

SEQ ID NO: 272978 - DNA, 828 bp, Homo sapiens
acgttggagtttgcagcaacctccaagtaggaggctgtgcgcgcgtgtgtgtggagtggctgcgcggccggggaggatgtgcgctgcagggcggccgccgcagtgagcaacgcggcaaccggagcccggcgggcagccggggaggccgggactgagaggggcgagccgctggtgctccccggcggcagagggccgcgtcggccacgggcccgggagagacgcgctccagccggccccaggatgtaggcgatcggcggcagcgctcctgcaggcggccggctcatcatgaagaagcactcggcccgggtggccccgctcagcgcctgcaacagtccggtcctgacccttaccaaagtggaaggggaggagcgcccccgggactccccgggcccggcggaggcccaggcaccggccggggtggaggccggcgggagagcgagtcgccgctgctggacgtgctcccgggcgcaactcaagaagatcttctggggcgtggcggtcgtgctgtgcgtgtgctcctcgtgggcgggctccacgcagctcgccaagctgaccttcaggaagttcgacgcgcccttcaccctcacgtggtttgccaccaactggaactttttattcttcccgttgtactacgtggggcacgtctgcaagtccacagagaagcagtctgtgaagcagcgatacagggaatgctgtcgattttttggagacaatggcttgactttgaaggtgttttttaccaaggcagcaccctttggtgttctttggacactcacaaactacctgtacttacatgcaataaagaaaataacactacggatgtctccg

SEQ ID NO: 272979 - DNA, 455 bp, Homo sapiens
gccctaaaataatcagaactctccctccattccacttttgtgccagtgtgtttaaaagcagcagtctattaaagcaaaaccatatgtcatttagggaggattcaactttttactttcatttctttgttttaaggcaaatagattatttctctgccagagtcacagaaaccaaaatccagctataatcattactcctattgtgatgtggactgaccaagacaaggctcttttctcttactgcaggtgggagtataaattggcgccacctttctggagggcattcgtacattcattcaacaattatttgctaagtacctactatgtaatagacctagtactaggagctaaaacaaatatgtattaagggctttgaaaatgttcttatcctatgaccaagtaattctgcgtctaggagggtatcctaagaaaataatcagagatcagtaaaaaaaaaa

SEQ ID NO: 272980 - DNA, 364 bp, Homo sapiens
ggccttgtgacctaggtggaataaatttccgagtgctgtagctgaagctatcagtcattatgcagtcaaagattagaggggtaggcccggtgcggtggctcacgcctgtaatcccagcactttgggaggccgaggcgggcggatcatgaggtcaggagattgagaccatcctggctaactcggtgaaaccctgtctctactaaaaatacaaaaaattaaccaggcgcagtggcatgtgcctgtagtcccagttactcaggaggctaaggcaggagaatcgcttgaatccaggaggcggaggttgcagtgacccgagatcacgtcactgcactccagcctggacgacagagtgagactccgtctc

SEQ ID NO: 272981 - DNA, 513 bp, Homo sapiens
acccaccctctggaattggcctgctagagtgcctgagaaggatgttcatagggaaatgtttcagcagaggaactctactacaaaaaccacaagagggagggtgccaggggaagcggcctggtgctattgaaactgcaacacagaagccagccactggagagagctgcacaagctgcaggaacaccctacccagtaagccggccagaaggagggagcaaaaccttttctctctgcaacatctttccagtttcctctactggaaaagcttcattgccagctgacaaaaggaaaaatacttaaatggatcagatccattttcacagagcagtcaataatggtgaatttggagatgataagcaacaaattgatgaactggcacaacttccctgctactttcttgattgtaatgcctagatagggaataggaaagttattgaaatgtatgtgttcccatgaaatgtgtttatttgttgttcaagatcaatactaataaatggggactaatgttctgaa

SEQ ID NO: 272982 - DNA, 379 bp, Homo sapiens
agcacgtgggtcgggtgagtagcctaaagcatatttgcccgtagtgtttgtggaatgcttcctggaatggcatgctctttttttctgaataagaaaaaggaagaataagaataagatgaaagcaagatttcaaagccatctgtcctgtttttttcataggatttttttattctaagtttaatttttcctgattatagagcttaaactatgtaacatcttcatgcaaggtagtataacacagaggaaggagcactagatttgggaatcagaaaatatgggttccagtttcaacgctatcacttaattttcataagttgtttttgagtatcagttgttttgttttgttttgttttgttgagatggagtctcgctctgtcac

SEQ ID NO: 272983 - DNA, 452 bp, Homo sapiens
cagagacagcttctttatagtgtttattaggattttaggtttttcactacaagcctcattgggtttgaaatgtacccttgcagattctagaaaaatagtgtttccaaagcgctaagtcaaaataaaggttaaactctgtgagatgaaaccacacattgcaaaagatttttacagatagcttgttctagtttttatcatggcatatgtggtttttcactataggcctcaatgagctccaaaatgtcccttcttttattctacaaaaagaatgtttccaacctgcccaatcaaaacaaggtttaactctgtgagatgattctacacattgcaaaacattttctcacataccttgtttctagtttttatcctgggatatttggtttttagtataggcctctatgggctccaaaatatcccttcatagatattacaaaaagagtattttcaacctt

SEQ ID NO: 272984 - DNA, 522 bp, Homo sapiens
tcttacacaaatctgcagcttttggacagtcaaaagagagacccacctggcacacaggaagccacacacgggcagcaggaccactccaggccgtcgaggcccatggtcgggacgctgctcaccatatgtggagatgttgctttcctccagaagctctgtcacattaacgtcaaactggtcttagatgtcattgagggctttggcatcattctcctcagacacaaaagtgatggccaggtctttagtgccaaagcaacctgcacaggccactgggtggaggtaggtgtccgagtcttcaggcatgccatagttaagacgatgttgaatcactcaattcctacaatggttaggaaatgactgaaagtgaacacggggactctgagcaaacctgctgagatacaggcttggggctgcctcagtaaattcctccagtgaagtggatgggattatggtgtggatgatgacaaaagagtagaagagaagttgtcgacagatttgcacagaggccattgaagattttat

SEQ ID NO: 272985 - DNA, 427 bp, Homo sapiens
cccgcccattttgggcccagggttgccgctggggcctgtacccaaatgcagccccccatggccatggccccaggagtgcggcagagcagggaggagtcctggaaagaggagacgcaggggcaggaaggaatgggcctcaaactccaggagggggtccttctcatgggtcctgctttctggcctctcctcgcttacccctgggctgatccccctgggaagaactgagccaaggtttctcactctcaaatccgagggattcaattaccgggcccttagggaggtgtcagccccctgaaacgatgcaaggtgcccggcctaatttttatatttttagtagacatggtgacttgcgcctgtagtcccagctactcaggagactgaggcaagtgaatcacttgaatccaagaggcggaggttgcagtgagcc

SEQ ID NO: 272986 - DNA, 305 bp, Homo sapiens
aaaaaaaaaaaaaaccatattgtgtttttatgtcacccaatgttgtataaacatattgaattcctggcttactcaatggtaaagtaacttagcctttgtgactatttacaatttaattgtgtagtgatttatttaaagcttatctttccttttgatgtaagttccatagaattgtagaatatgttgtatttttaaatctttgtatagctaattcttgatacattgatatacagaagccccaatacatatctattgaacaaatgaataaattaataaatttagttttatgattttaaaaaaatgtt

SEQ ID NO: 272987 - DNA, 440 bp, Homo sapiens
cttctcttctgaagttgctgttgttcactgtgggtttgcaggacattttggccacaggatttaaataagaaaaagtgttggaaaggtttgtgagaactgtgaccagcagctataaactctgaatttccctccctataggaatagtaaactggaaaggccttcctgtcaaaaatatcttacccatccccactcttttatgtgttctggcgggccatggtacgggtcagttccaagagttagtagttatatctttttcaatctttctttcctgaccgaacggtgaaatgtttttcgtattggtcgctttgcttgtcagcaaagccctgaatatcagtagagtctggtttgagtctttttctgcaatggttggggtaagtatgcttcgttagtaccctcaaatgcttccgaggtcttgataacagttggaaagccaaaaaata

SEQ ID NO: 272988 - DNA, 406 bp, Homo sapiens
cttctcttctgaagttgctgttgttcactgtgggtttgcaggacattttggccacaggatttaaataagaaaaagtgttggaaaggtttgtgagaactgtgaccagcagctataaactctgaatttccctccctataggaatagtaaactggaaaggccttcctgtcaaaaatatcttacccatcaagaatcattgatatgatcaggcaaacaatgctaggcttcagtggggaaagctaatagtaatatcttaatgttacttaatttcctgatacatacttgaaatgaatagacgattgggagttttgcttgtcaggaaagcaaagaataagcaggaggaaacaggactgagtgatatgatgaaatgggcggggacgtatgcaacgtgagtaccctcaaatacttc

SEQ ID NO: 272989 - DNA, 205 bp, Homo sapiens
ctctggtgcacttgaaattcaccgtctgcttccccagtctggaagactgatatcttcattcccactggtcactctcagcttgggctaaagcacatttgctggattcctggggccagaggcaaaggcaaccacaggaggaagaagttggttgaatgttacagccagagagcacgttagaggcattttgaaccaacctccctttgct

SEQ ID NO: 272990 - DNA, 717 bp, Homo sapiens
caatcattatgcattctatgcatgtaacaaaattttacatgtatcctataaatgtgtaaaaatataatgtatcagaatcatgaaaacaggccaggcatggtggctcatgcctgtaatcccagcactttggggggccgaggtgggcagatcacttgaggtcaggagttcaagaccagcctggccaacatggtgaaatttcgtctctactaaaactacaaaaattagctgggtgtggtggcggggtggcctgaagtcccagctactccagaggctgaggcaggagaatcacttgaacccacgaggcagaggtttaagtgagccgagatcaggccactgcattccagcctgggcaacattgcaagactctgtctcaaaacaaacaaaaacatgaaaacaaattttaaaatacaattaaaaattcacttcacaggaaggccacgtgcagtggctcacacctgtaatcccagcactttgggaggccgaggcaggcagatcacttgaggccagcagttcaagaccaacctgaccaacatagtgaaaccccatctctactaaaaatatgaaaattagccagcgtggtggtgcatacctgtaattccagctactcaggaggctgaggcgggaagattacctgagcccaggtagctgaggctgcagtgagccatgatctcgctacactccagcctggggaatagagcaagaccctttctcaaaaaa

SEQ ID NO: 272991 - DNA, 812 bp, Homo sapiens
ctgtgttggagaagtacatcaaaaaggaaaatcaaatttcatcctcaataagtaatcacaatacactgtgatgagagttagggtgaaggaggttcaggttaccatgggcttatattaggagggcaaattctgtcttcaagtctttttgcttcaacagtagcgtttagatcttgtgggctgggcatggtggctctagcctgaaatcccagcactttgggagggtgaagtgggcagactgcttgagcccaggagttgcagattagcctggcaacatggcgaaaccccgtctctacaaaaaatacaaaagtcagccaggcatagtggtgcctgcctgtagtttcggctacttgggaggctgaggtaggaggatcgcttgaccccaggagttcaaggctgcagtgagctaccatcgagccacttcacttcagcctgggccgcagaataagaccctgtctgaaaaaaaaaatcttgtgatataataacagcttgtgcactcttcgatagctcagctggtagagcagagggctgtagactgcatagataataataacagtttgcgtttttgagtcaaagatgataccccagaatcattatcgaaaataatggttgttccattcacctgtgcctatgactgtgagccacattgtgaccaatctgtgagcaacatgggtgggaatgcagtttggggccatggaactcacttaacaggaagttccaatagcagtggatttaccatgttgcagctgtaggatcttgcgccagagttttaccacgtcatcgacgctcggttcatcgacgatccagtacacagc

SEQ ID NO: 272992 - DNA, 372 bp, Homo sapiens
tgaaaaactgtaatttatttagctttagagtactctcgtgatatgagattgccaaattaatactttgggtgcatttcttttctcaaaggacttgcaaatttacaaagaagtgttgaagaaaagccacacattggcaggtaatgtttgcaaaagacagatctgatgaagaacaatatttttagaatatacaaagaatacttaaaactcaacagtaagaaaataacctgatttaaagcaggccaatgacctgaacatctgttcaccaaagaagatacacagatgcaagtatgcatatgaaaagatgcttgacatcatgtcattagggaactgcaaattaaaacaagtagataccactgcatacctagtagaatg

SEQ ID NO: 272993 - DNA, 466 bp, Homo sapiens
aacattacaaactaggtattttactttataaaagaaatttatttactacagttctgggagctgggaagtccaaggttgagggaccacatccggtgagggcctcctttctgcatcataacatggcagaggatatcacatggtaaaaaagcaagagcatgccatctcaggtctcccttcctcttcttatatagccaagattcccatcatggggcctcaccctgatgagtttatctaatcctaattttttccctaagacctcacctcttgatactatcacgatggcaattaaattccaacatgaattttggagggcaaactcaaacaacagtccataaggcagtttggataaaggaatctaggaattgagctttttggagttcaaggcttacttataataggtgacggcatgaggaaagatagttcacccaagaaagtatgcagaatcagaatctgaagtaaaaaaaaa

SEQ ID NO: 272994 - DNA, 744 bp, Homo sapiens
  misc_feature (18)..(18): n is a, c, g, or t
  misc_feature (55)..(55): n is a, c, g, or t
  misc_feature (119)..(119): n is a, c, g, or t
ttttaaatttgggggaanttgggccccaacccattttgggccccggggggggganttggtccttttggaacccttggaaatcccttttaggttttaccttgcccctttggtgtaaaggnttaattttgaaggaaccagcttccaaaagaaaccagcatatggcactataaactatttcatttgagcaccattctttaccatggatatattaattatgtattatagtggagtgatcatacagttcccccaaatgtgatgtttcagtgtatttatttaaaacataaagtagaccaggtgcagtagctcacgcctgtaatcccagcactttgggaagccaaggcaggaggattacctgaggccaggagtttaagaccagccttggcaacatagcgagacccccatctctacaaagaaattttaaaagattatccaggcatggtggtgcatgcctatggttccagctactcgggaggctgaagcggtagaatcacttgagcacaggaggtcaaggctgcaggtgagccatgatcgtgtcactgcactccagcctaggcaacagagcaagaccctgtctcttaaaacaaaaaacctcacacatacctaaaataagtatatatctgtaaccaaaggaacttaattttagagccaaatttttctatcttgttggattttttacagtgtttaagatagacacttaagtgttgccgtagtatcaatatttctgtcattgaattttttctcacc

SEQ ID NO: 272995 - DNA, 653 bp, Homo sapiens
atactttagttttactgaccttgtgtaaagataatatgaagaaccagcttccaaaagaaaccagcatatggcactataaactatttcatttgagcaccattctttaccatggatatattaattatgtattatagtggagtgatcatacagttcccccaaatgtgatgtttcagtgtatttatttaaaacataaagtagaccaggtgcagtagctcacgcctgtaatcccagcactttgggaagccaaggcaggaggattacctgaggccaggagtttaagaccagccttggcaacatagcgagacccccatctctacaaagaaattttaaaagattatccaggcatggtggtgcatgcctatggttccagctactcgggaggctgaagcggtagaatcacttgagcacaggaggtcaaggctgcaggtgagccatgatcgtgtcactgcactccagcctaggcaacagagcaagaccctgtctcttaaaacaaaaaacctcacacatacctaaaataagtatatatctgtaaccaaaggaacttaattttagagccaaatttttctatcttgttggattttttacagtgtttaagatagacacttaagtgttgccgtagtatcaatatttctgtcattgaattttttctcacc

SEQ ID NO: 272996 - DNA, 611 bp, Homo sapiens
tgcagagagtgggagagagaagacttaaaatccccaggaaaaagaggaaagaggcagagaaaacttagacatagcataaacaaaatcacctccagaaagtaaaagtttcactgctaagtgacacattcacagcacagttaaagggaaggggattgaaaataagcagaaccagaagtagcagcttcaaaggagcattgcttcttggggagaatcacataaactaagaaacagtagtgctccttagagacttgatagtgatgagaaagaaggagctaagagggaaaaatagaggatcttgcagaaattagagagaaataagacataatggcccactatcccattactacccatttctgcactgcactgacaggagaggatattcctgaattaagaacctgtccaaaaaattttaaaataaattttaaaaagcaacctaattccaaaaagagctactattagaagaacacatacacacacaaatgcgaatcattacagtttaactgatgagaattcttaaccaaaaccaaccaaagagcagaagaaaactgtaacccaacattccaaactgaagtagttatcttcaaacaatgggacgtatttagaaaaaaaaa

SEQ ID NO: 272997 - DNA, 329 bp, Homo sapiens
tattttttttatatggtagactgcttttctttttcttcatattttgtgtatctattacagttttttactttggagttatcatgagacttacacgaaagatcatagttataagtctattttaagctcgaacaatttaactttttctgcatacaaaagtatacactttaacttctcctacatcttatgctattggtgtcacaatttacaacttttatatattgtgtttccatgaacaaattattataattacttttcttttaattttacactagagttaaaagtgacttatgcatcactgttatagaattagagtattctgaatttaacta

SEQ ID NO: 272998 - DNA, 246 bp, Homo sapiens
atgctcagatgggagaatatatgacagtaccttatcttttaagtgtcatacaactttattaaatgaagtgcggagaataattgttgaaattgataattttatttgctgtatctcttcacttttaaggcaagatggtatcattttttaactatctctcatggttttagtttaaatttgcagttactgcttaccagaacatgtgctcttgagtctggggattgggtgatatgaaagggtttatataga

SEQ ID NO: 272999 - DNA, 292 bp, Homo sapiens
cccccattttcaacagcaccacatgagctctggagccgcacaagccaaaagcctgctagtaacaccctccattcccttccttaccactcccccagcccaatccgtgtcagtcctggtggcgctccctcctaaatgtggcccagatccatcaccagctcctttcttcaactcaaaggcaagccaccatcctcccgggcctaagcaccacatcagcttcctaggggtctcccatctccagcctccatcaccaccactgccaagtgatttcctttacagctggggcggacctctt

SEQ ID NO: 273000 - DNA, 806 bp, Homo sapiens
aaggcatttcacttagcagtcaggaatgaaaaaacgatactgaatttgaacattaggaaagcttggtaaatttcaagagtataatttctgcaaagttggaacacagtgaataaaaaagtgctaagaaattgaggacaattgaaaagtttagcaaatgataagacaaagcagaagatagtagatagtgaggacagcagaatcaataggagggtttcttgggaaggccatctttgttttaaagtttatggggagagaaccagtgtgcgaatggaagtagctagggggagaaactgaaaatgctaggaagactgggtgtggtggctcatgcttgtagtctcagctgctcagaagcctgacgtaggagaattgcttgacccagtagttcgtgaccagcctggaatatagccagaccctgtttccataaaaaaaaaaaaagctaggaaggtaaaaaataaatgtgaagcaacaggattccccctttgagtagctcatgcttactgtgcagtttcagtaccccatactgttctaggtatcttaacatgtcataactcattcacttctcaaagctctgtggggttggtacaactattatctctattttataaataaggaaactgaggcagtaaaacaccaatttgcctgaagtcccgtaatcagttcatggtacaactgaaattgaggcccagctggctttttgagtctgccctctgaatcaccaaattgtactgccactcttcctgttgtaaatgttgtttataaatgtatttaattttattacacaagtaaacttgaacctgaaaaatttg

SEQ ID NO: 273001 - DNA, 621 bp, Homo sapiens
actctagacgatccctaatgtgagtatagaaaaattttgcagaggatgaggcaatatattcttatagaaaaaagatttttttgggttcaaaatatagttattcccttaaaaagatgctttgtgctgggtgtggtggctcatgcttgtagtctcagctgctcagaagcctgacgtaggagaattgcttgacccagtagttcgtgaccagcctggaatatagccagaccctgtttccataaaaaaaaaaaaagctaggaaggtaaaaaataaatgtgaagcaacaggattccccctttgagtagctcatgcttactgtgcagtttcagtaccccatactgttctaggtatcttaacatgtcataactcattcacttctcaaagctctgtggggttggtacaactattatctctattttataaataaggaaactgaggcagtaaaacaccaatttgcctgaagtcccgtaatcagttcatggtacaactgaaattgaggcccagctggctttttgagtctgccctctgaatcaccaaattgtactgccactcttcctgttgtaaatgttgtttataaatgtatttaattttattacacaagtaaacttgaacctgaaaaatttg

SEQ ID NO: 273002 - DNA, 268 bp, Homo sapiens
agattttatatttttgttgcatgatggtaaacagctgtaaccaccagcttggcctttttggcagctggctttatttagcattttaagctttaagtttgcctctggtgcctggaattgttcaattaaaattttaaatttattcttatcatcctctaacacaaagcttacttatacaataccaaatctagcctgagacacttgttcttgaatcgattcttttttaaataataagttcagtatgaaataaatctctgctgaaatgaaagaa

SEQ ID NO: 273003 - DNA, 287 bp, Homo sapiens
tggaccccatcccaccccacatgccactaaagcagtgaggcttacagtagctatctaatccacgttctctaaaactcaagcctcaaactcttaagaatttcgctgctgggccagatcttactttatctagctctgtagtctgtagttcatgatagcatcaaaactcacacagtgtaaggggagtacttttcaaactccctgtggttaaataccagtcttaaatttctaatccatcacagattagcacttttgtaaaatacaaataaaaacacacagaaaaacgaaaa

SEQ ID NO: 273004 - DNA, 335 bp, Homo sapiens
cgtaaaacaccaggtgcctaacccggcacagagcaggagggctaagcgtgacatccagcacgtgctgcccctgcagtgagatgtggccatcggagccagcattggccaatggactctgcatgggagtgacgcatgctgcctccaggcttgtctctaaaacctcccacgtgtcctccgcctgctcttcccacctccaaggagcacggcaattgtggaagacccagattagtgatggcagaaccatagatgggaggaacctgggtccctgacttaaagtatcatggatttggatgttcccttagtgagaaataaacttccattgtgtttaagccttt

SEQ ID NO: 273005 - DNA, 365 bp, Homo sapiens
tttagttttctgcttgggttcattcttgtgtcctctggctcaatgcacacaatatttgaaacaggacactgcaagtaaatgttctttacctttctcttttcctaattataaatgaaaattcccctcaggtagacttaactaaggggaaaattcatattctgcatttagctccagggtgatctggaagcttctctctgagactctgtatctgaatctgggttgcacttgacaactagacctgagcttttcttaaggacaccccgagcaacgccagctgaccagtggtgctctgtatgtatgatctaataagatcactatagcctctctgtgacagtacctacattatacaaccatgtatattttag

SEQ ID NO: 273006 - DNA, 572 bp, Homo sapiens
ggtgcaggaacctgaaagatgacacctgaaaactcaaattacatttcaggaacttgtgctggcgagagatagggataacacagataaaagtgtaatttgtagatattctaaaatcccttatcttagccaatagtttcagccgtggcttaaaacaatatatctatctgtactttagcaaaatgggtggatttgcatttcacatgctcctcctttggttgaaaacaactgattacataggaaagggaagatgatactataaactaggtcttcgttctcctacaatgtgacattggacaaggcatttcgtctctctggtttctaacctgcaagtaaaaggatgatttaatattggtttagataatttttaaagttcctttagaacctgaagggtctttatttctacaacaaaaaaatcacccatgaggtagaattggctatacattctcaaatgtaaaaaattaagcaaaatgctgatctagtaggttcacataacttttaagtaaagcatcttgaaggtgtccctctatcaactgaagaacaaatgtctgagtttaatatatgactgcatcaaa

SEQ ID NO: 273007 - DNA, 463 bp, Homo sapiens
ttatatacatcttataaaaattgtttgatttataccaaagtatttcatttttgtgggggttaatgtaaatggttttgtatttttagtttcaaattgtgcttattcattgctggtatatagaaaagagactgagttttataaatattaaccttgtattattgtgcaccttgctataatcacttattgattacaagtaaagtttttttttgtcaattctttaattgtcatttgtgaacaaagccaattttatttcttcctccttaatctgtataccttttaatttttttcttgtcttagttgcattagctaggaattccagagtaatatcaacaagaagtggtgagagaagatacccttgctttgtttctaatcttatcagaaaggcttctagtttctttctttctttttttttttgggacggagtctcaccctgagcgacagagcaagaatctgtctaaaaaaa

SEQ ID NO: 273008 - DNA, 435 bp, Homo sapiens
ctgactataagaccctgaccgctcttttcttacagctctcactttagaaaacttgcaattgtaaattcttcctctgcccctttgagatgtaaatcttctacaaccaaggagtatctttctcaaggacatggaaggcatccctttgaaatataaacatcaagaaaaacagcagccctatcttccagtctccgtgagaagatagaagcctaacttcaataagaaccaattagcaaacagagatggcctaagcacacaaaccaacttccgggctaatgtcctctaggacttttccagtagctcacctcagcaagcacaaacactccaaccttttgttttggagtagttgagttcaatttttgtcctctgttgtaacagtcttgacccctttgcaatggtcttaaataaagcctttcttgcctttttaatgtgtccagt

SEQ ID NO: 273009 - DNA, 291 bp, Homo sapiens
gtcttgaagtaggagagaaagcaagcagtctcctgccacatggagagattgtcattggataggaacacccttaagtcatccactgtccaagaaacacatgcaagtatgtggtttgttatgatggcaggagcttgtggaaactctcttttgagtgtttctattttctctggaagcaaggtcatcagctaggagttagggtttaggagaaagtattagaagttagaagagagaataaaaagtatgaaatatttttcagggggagtgggagaatgaatgatgtgaagaaataag

SEQ ID NO: 273010 - DNA, 554 bp, Homo sapiens
ctgtacttgtgtaaaacgcctggcagatcttagagggttcttaacttggaacaaacccttgggatgatgagcctgtattgacacaatcattattactaaaattccattgtttacattagggttcattcttggtagtgtatattccatgggttttgacaaataacaacatatatgcaccgttatagtagcatactatatgggtatataatggggtatataatctccaccccaaggggagacattactctgatttttccacctcatgtttttccctggtaattgctgtgacagaatgttgtttttggagttgagtaggcaagtggtgtgcatgatatgaaaaaccaaaaaaaaaaaaaaagaaaagaaaaaaaagccaccaaaccccacaaactttctgacccaaagcactcatcagttttagcctgtctatgcagtgatcgaggacttttcctataagtgagaagatcctacctcagttttcagctgggttttagatctgccggcaagcgtgttccaatctaagaaccgggctaggcggcagggtgtttacatct

SEQ ID NO: 273011 - DNA, 856 bp, Homo sapiens
tttcttgcttctcagaccagaaatagaagctttctcctggagatttttccttctatacccagtgtgcagttttcaacttcaggctgcctttgagtccaggtcaagcaatattagagttaaaaactaaaggaaaagcaaagaaaaatgaaaacatagaaacaccccaatttaatactaaatcaaattacagcttttttcctaatctataagctacggtttatttttaattaataaactttatttttagagcagatttaggttcacagcaaaactgagcagagaattcccatatatctcctgttaccgcacttgcacaacctccctcacaatcaacatcccaaaccacagtggcacatttattataattgatgagcctgtattgacacaatcattattactaaaattccattgtttacattagggttcattcttggtagtgtatattccatgggttttgacaaataacaacatatatgcaccgttatagtagcatactatatgggtatataatggggtatataatctccaccccaaggggagacattactctgatttttccacctcatgtttttccctggtaattgctgtgacagaatgttgtttttggagttgagtaggcaagtggtgtgcatgatatgaaaaaccaaaaaaaaaaaaaaagaaaagaaaaaaaagccaccaaaccccacaaactttctgacccaaagcactcatcagttttagcctgtctatgcagtgatcgaggacttttcctataagtgagaagatcctacctcagttttcagctgggttttagatctgccggcaagcgtgttccaatctaagaaccgggctaggcggcagggtgtttacatct

SEQ ID NO: 273012 - DNA, 446 bp, Homo sapiens
atggtatttcactgtagctttagtttgtgtttgcctaatgaccaatgatgttgaacaactatccatgcacttgtttgccatctgtattagcatcctattgctgctataccaaactaccatgaagctattggcttgaaacactttccattagcctctttgacagtacacaaggggagacttgaatactgaacaggagagaatgatgagagaaatttctctagaaagagaaagagctctgcagggatgcatttctttctggaggccctaggagtcactctgtgtattagtccattctcgcattgctgtaaagaaatacctcagattgggctgggcatggtggctcatgcctgcaatcccagcactttgggaggctgaggcaggcagatcacctgaggtcaggagttcgagagcagcctggccaacatggtgaaaacctgtgtctacta

SEQ ID NO: 273013 - DNA, 285 bp, Homo sapiens
gctcgacggggcggttgcgggcgcccctagctaatttttgtatacttagtaaagacagggtttctccatgttggccaggctggtttcgaactgacctcaggtgatccgcctgccttggcctcccaaagtgctgacattacagacgtaagccaccacgcccggcctgcaaaaatatatctcatatttgaacaaaaaaagtagttgacattgggacaagtgcttttcccctaaagaaatgatcagaagtacaaaagtgatgtacattcatctcttctaagctcgtcg

SEQ ID NO: 273014 - DNA, 301 bp, Homo sapiens
ggtgagggctctgccaagacccagtatgcatgagtagatggtgagggctctgccaggacccagtatgcatgagtagatggtgagggctctgccaagatccagtatgcatgggtagacagtgagggctctgctaagacccagtatgcatgggtagatggtgagggctctgccaagatccagtatgcatgggtagacggtgagggctctgccaagatccagtatgcatgggtagacggtgagggctctgctaagacccagtatgcatgggtagacggtgagggctctgccgagatccagtatg

SEQ ID NO: 273015 - DNA, 388 bp, Homo sapiens
cacacccagacacatgcttacacatgcacttacctgcacattcccacacacggacatgcaggcacacccctccacacacacataaacgcacatgtatgcacagcttctcacagatacacaaagcaatgcaggtactcatgtatgtatacatgagtacacatgcatgcacacaggcacacacatgtgcacaaacatatatatgcacacacccgtgtcatgtgtctgtttataaacatgtccccttccctttccttccccctcggccacccgcctccctctcaaccttgtaaattccccttcccaaccccgaggggcttgcagggacaaggcgaccgactgcgctgagctgcttatttatccaaaataaacgacggaaaagtctgaaaaa

SEQ ID NO: 273016 - DNA, 209 bp, Homo sapiens
tttacatatagataattgattctcaaagctttgtggcacttttttttttcctcacatcattgaaatgtccttgcttaaaagcctgtcaaagactgaccagttaaacctgcagatacagggactctatttacaaacccgcgtatttaggcttcttttcatttacctgttgaagtatcatacacttgaattatttgggccactttctttcc

SEQ ID NO: 273017 - DNA, 295 bp, Homo sapiens
aaattgtcaggttgaagaggttaacgatataacatggcaagaatacatttattgtctttttcttccacctggcttcatagtagtgttggtgtaccgtgtgagatccttagattagaaggggttggccagtagggactatgaaatgattgttgttaaattctaggggtttaatttaggatataggtacaaatgttagttctggaatcaaagggaagaaagagaagatttggatgacgcatcacctttacttgaggttctttaggttggcatcaggctaactttggtaaaaccacat

SEQ ID NO: 273018 - DNA, 306 bp, Homo sapiens
atacgctgtgaggagcaaaaggaattgctgcaggcacatcctgggcatggcccctcttcctctttggcaccatgcagtccatgccatgtggataaagagcctccaagagagcattttgcaaggctgacagagcattgcttgtcttgacaatgaagcccagaatataacaaaacagatgcagaacgggttctccatcctcgcggctgatgagccattcttagtagtcaacagggcttctgtgcttacaatgaaagaaaaatgccaagcccctgactgcctcactcttcagtctccgacccctacccc

SEQ ID NO: 273019 - DNA, 370 bp, Homo sapiens
ttgagacaaagtctcactctgttgccaggctggagtgcagtgcacaatctcggctcactgcaagctccacctcccgggttcacgccattctcctgcctcagcctcctgagtagctgggactacaggcgcctgccaccacgcccggctaatttttttgtatttttagtagagacggggtttcaactgtgttagccaggatgatttcgatctcctgacctcgtgatccgcccgccttggcctcccaaagtgctgggattacaggcgtgagccactgcgcccggcaccgtgtgctccaattgttaaagtacaacaataacattatatttgaaaaaaaaggaagatagtgtatatggtactaccacaattagag

SEQ ID NO: 273020 - DNA, 317 bp, Homo sapiens
ggatgtattgtacagcaaggtgactacagttagtgatgatatagtatactcttgaaaacgtaaagagagtagatattatgtgctctcaccacaaaaaaaagatacctgtgaggtaatacatttgttaattagcaagattcaaccatccaataatatgtctgtacttcaaaatatcatgtacataataaaaatgtacaatgttatctgtcaatttaaaaatgtaatagtaaaaagaaaacaatagagaaaatgatgaaattggaagcaaaaaacaatagaggaaatcaatgaaacaaagcactgattccttagaaaga

SEQ ID NO: 273021 - DNA, 470 bp, Homo sapiens
ctggagccagagttcagggcaatgaaaaacagccttgtcaagaactcttaaggcttcatgaccctgcatattcaagtcaataggttgtcagatacagtgtttggtacctactaacctattgacttgaatataccaggttaatataagattttctttggcccaaagtgagttgacttcaaagccagtagccatagactagaaagccagagaaaaatgaggctgtaagaacaaaggaatctggggaaccctctcttaccctagaaatggagcgggcatgtgttagaaatatttgtgtttactaattaaatacatatcatttatttttacatcttttttgcttaactcaggggaaaatgtgcattatttaaaagaaccacacagaatgaaaacacgaaaaagaaaccgtttgtattcaaatcttggcaaatatccaactagcaataacttgaagatttaatattattacatgc

SEQ ID NO: 273022 - DNA, 431 bp, Homo sapiens
gagaggaggaaaaggagccaagagtgatactgaaaggcaaagcaacagatatctcctgttgaaaatgccctctgtgttactgtataggatctgctttcctgtaccatgattactcttcctggtcttaatagtcaggggccggccgggcgtggtggctcacgcctgtaatcccagcactttgggaggctgaggcaggtagatcacttgaggtcaggggtctgagaccagcctggccaacatggtgaaaccccatctgtactaaaaatacaaaaatgagccgggtgtggtggcgtgtgcctgtaattccagctactcaggaggctgaggcaggagaatcacttgaacccaggacgcggaggtagcagtgagctgagaccgtgccactgcactccagtctgggcaacaagagtgaaactccatctcaaaaaaaa

SEQ ID NO: 273023 - DNA, 589 bp, Homo sapiens
  misc_feature (40)..(40): n is a, c, g, or t
tagatagagtctctgttacccaggctggagtgcagtggcngatctcggctcactgcaacttccacctcctgggtctaagcgattcacccgcctcagcctcccgagtagcctggaccacaggcgcccaccaccatgcccggccaactttttttgtatttttagtagagacagggtttcacatgttggccaggctggtccgcactgatataacctaccctgctggattcatggatgtcatcagcattgacaagatgggagagaatttctgtctgatctgtgacaccaagggtcactttgctgtacatcgtattacacctgaggaggccaagtacaagttgtgaaaagtgagaaaaaatatttgtgcgcacaaaaggaatccctcatctggtgactcatgatgctcgtaccatctgctaccctgatcccctcatcaaggtgaatgacaccattcagattgatttggagactggcaagattactgacttcatcaggttcgacactggtaacctgtgtatggtgactggaggtgccaacctgggaagaattggtgtgatcaccaacagagagaggcaccctggatctcttgacg

SEQ ID NO: 273024 - DNA, 302 bp, Homo sapiens
aaaaagagtcaaaacaaacatggcaaccaaataaataagcaacaagcaaacaaacatggcaagactttaacctgggactctcagaatttattaaataagaaagcatcactcttcacatggatccccttttctcctctccatacaccatctgcctccgcctttcctgccttggcacctgtatttgcttttatgtatatcttagtgtgattctatttatatataaatatatgttcatatttaaatcatttcagaaattgaagtgatatagatcctccaaaactattgagggggtgtccaatgtt

SEQ ID NO: 273025 - DNA, 375 bp, Homo sapiens
tggcgtgactcagccgggtgctgcgacccagctccaactgcctttacgtaggtgctgcagggtgtttgatgatgcaagaaggaggccttgaggccgggcgcagtggctcacgcctgtaatccctgcattttgggaggccgatgcgggacgatcacgagatcaggagatcgagaccatcctggccaacatgctgaaaccccgtctctactaaaaatacaaaaaaattagccgggcatggtggcaggcgcctgtaatcccagctactcgggaggctgaggcaggagaatcgcttgaacccgggaggtggaggttgcagtgagcggagatcgtgccactgcactccaacctggagacagagcaaaactccgtctcaaa

SEQ ID NO: 273026 - DNA, 419 bp, Homo sapiens
acttgatcctgtgagtcagagattgcagtgagccgagatcacgtcactgcactccagcctgggtgacagagcaagactctgtctcaaacaaaacaaaacaaaacaaaacaaacagaaacaaacaaacaacaactttccagtaagctaaggcatctatccagtgtgccaggcctcctgtgttcgaggccctgagctgcccaaggctgggacccagggagcttcagatcttgccctgacaactccaccaccataggactagtgagctggaaggcacagatatgcctttctgaaaattaagttttggtaggaatgcaggaagtattttgccacagagaaaactctttaagataaatgaagggtaaaaataaatagcccttgtttagatgtggacataggaaatacagttccagcagaatctc

SEQ ID NO: 273027 - DNA, 300 bp, Homo sapiens
ttttaaactttaccgtggaaactttcaaacatgagcaaaataagaggataatacagttcagcccccaggcaaccataaacatatgcctaatcttgtttcatcaattactacagacctgctgaattattataaagcaaaactatatcattttatctgtaaatactttagtatatatttccaagagataatgattctttaaaaaaacataaccacaaccccaccattatcacacctacaaaatgaacaataattcattaacatgaaatgtctagtcagtgtttgaaacatcccggttgtctc

SEQ ID NO: 273028 - DNA, 284 bp, Homo sapiens
ccaggctggagtgtagtgatgggatcttggctcattgcaacctctacctcccaggctcaagcaatctcctgattttaaaccctggcaacttatccaaagaattttaaagcactaaggagaccaaacaaaacatatttgtgggtcatatccagtcacagacctctaaatttgcaatctctctcatccagatacatcccataaacatgagatcaggcaccaagacattcatgatggtttaaggaaataaacaaagatctaagtttcccatatggactttcaaaatt

SEQ ID NO: 273029 - DNA, 379 bp, Homo sapiens
atatctgtgtctctcttaaagcaaaatctactttaattaagccccaaacattctgatgaaagatgataatcctcttgtactgtgaacttgtgatcttacaaagaagtctggagtagcagagaggtcaaagaaataaacactaccctcatgcccaactctctccatgccttccaagtttgttaatacagacacatccaatccaatcacatatgtactgaaatccttttttaaatgatgcagattcagatggagattattacaccgttagcaattcaaagtggctaacactgatttcaatgtgggtaaccacattccttgaaatcaaagatttgatatgaaactgacaataaagaattcatatggaactcaatttttcttg

SEQ ID NO: 273030 - DNA, 503 bp, Homo sapiens
aaatgaactatcaagctatgaaacgacatggaggaacttaactgcatattacgaagtaaaagaagtcaatctgaaaaggcttcttactgcattgttccaactacgcaacattctggaaaaagcaaaattatgaatatggtaaaaagatcagtggttgtcaaaggattggcaagagaagaaaagaatacattggcagagcagagggtttttagggaagtgaaaataccttacatgttactgtaatgataaacacatgtcattatacctttgtgtaaagccatgcaatgtacaacaacaagagtgaaccctaatgtaaactatggactttgagtgattaaatgtcaatgtaggatcatccatcaaagcaactgtaccactgtggtgagcaatattcatcatgagggaggctgtgcatgtgtggaggcaggggtatatagaaaatctctgtatctttctctcaattttgctgtgaacataaaactgctctcaacaagtagtctttc

SEQ ID NO: 273031 - DNA, 1649 bp, Homo sapiens
  misc_feature (381)..(381): n is a, c, g, or t
  misc_feature (396)..(396): n is a, c, g, or t
  misc_feature (550)..(550): n is a, c, g, or t
gtgcctgtatcacctgcccttctgctgacactcctgcctgctgttcctgactacagccatcatgcctcggggtcagaagagtacgctccatgcacgtgagaaacgccagcagacccggggtcagacccaggatcaccagggtgctcagatcactgcaactaacaagaaaaaagtatccttttcatcccctcttattttgggggctactatccagaaaaagtctgctggtaggtcacgtagtgctctcaagaagcctcagagagcactatccaccactacatctgtagatgtttcttacaaaaagtcatacaagggagccaacagcaaaattgagaaaaagcaaagcttctctcagggtctatcctccactgtgcagtctcncacagaccctctaancatgaagacaaatatgttggtgcagttcctgatggaaatgtacaagatgaaaaagcccattatgaaagcagatatgctaaaaattgtccaaaaaagccataagaattgcttccctgagatccttaaaaaagcttctttcaacatggaggtggtntttggtgttgatttaaagaaagttgattctaccaaggactcctatgtccttgtcagcaaaatggatctccccaacaatgggacagtgactcgtgggaggggatttcccaagacaggtctcctgctgaatctcctgggcgtgatcttcatgaagggcaactgtgccactgaggagaagatctgggaattcctgaataagatgagaatatatgatgggaagaaacacttcatatttggggagcccagaaagctcatcacccaagatttggtgaagcttaaatacctggagtaccgacaagtgcccaacagtaatcctgcacgctatgaattcctgtggggtccaagagcccatgctgaaaccagcaagatgaaggtcctggagttttgggccaaggtcaataaaactgtccccagtgcgttccagttctggtatgaagaggctttgagagatgaggaagaaagagtccaagctgcagctatgctcaatgatggcagtagtgccatgggcagaaagtgttccaaggccaaggctagcagctcttcccacgcctagtgaagttgaagcaaattttgcattttgtggttaaagagggcagtcactgttccaaggagtgaaggactgggtgttactggagggaacacactgtataataccttttgtttctgttctaaatggataatttgaagttttatctgtattttggggcatatttttcaaatgttccttttatttaacattgtaatctaagtttaggattgatactggtcacatttgttgtttaagagtaaaaattttgctgttttgtaaaacagattgagaaaaattcgatcttatttagtgatctgttgcaagataacttggaattagaataagcatttccttgaaaatgtttaaaaaaaaaaagtcagcagtaaaatgtatggcattaagaaatagagaaagagtgtaagatggtcaatatttggtttcctaaatgcttttactctgtgttttaagaaaatgaaagataaataaccatatatgtctggcttacttaagaatgtagaattaaatcataataaattagacctcatgctgacacactcattctccaagtgtt

SEQ ID NO: 273032 - DNA, 360 bp, Homo sapiens
aaaattggcagagacatggggcctatttctaaatgtgcaatgagttctcatgaagacaagatatttggatttgtccttcatgggtaaaacaggaataatttgcctaaaggaaagaaaatgttatctgaaaaccaagacttttcagatagggagcactatctaaatgagtagtatgtgtcagtcaggacctcatggaggtgtaaagcagtctgaatatagaacaaatccaactattaagttcccgtccaaccttgagattctatgattccaagagtcagagtaatgctcacagtataaaattgtcacttatgcatcatttataagcagcactatgtacccttaagcataaaaaataaatat

SEQ ID NO: 273033 - DNA, 257 bp, Homo sapiens
attcccttgcagacaccatttaaatcctggagcttgggaagcagggatgaagtcttctgcccattcattaatagatggcccaggctatgacattattgagagcagacatttagaagggcgaaagagaaggaaagggccgggcacggtggctcacgcctgtaatcccagcactttgggaggctgaggtgggtggatcacctgaggtcaggagtttaagactagcctggctaacatggtgaaaccccgtctgtactaaa

SEQ ID NO: 273034 - DNA, 326 bp, Homo sapiens
taggaggcaacagggaagcttccatctgctgtcctctcgtgcctcaggcatgggcctaacatggctcctgtctgtaatcccagtgccttgggaggctggagtgggaggatcacttgaggccaggagttcgagaccagcctaggcgacacagtaagactctgtctctgcaaaagatttaaaaattagctgggcttggtggcacgcacctgtagtctcagctgctcaggaggctgaggcacgaggattgtttgagcccaggagtttaagattgcagtgattgcaacactgcactccagcctgagcaagagtgaggccccatctcttta

SEQ ID NO: 273035 - DNA, 2118 bp, Homo sapiens
gggagcttggccgcgcagtgccggaacccggctgcagcggtgggaaggcgggggcgtgccggcccagcggggagaggcatctgcaggggctgctgagagtaaatacttggcgcctccagctgctggccaaggagacagatggagctcaagttgggagatacgccctgagagccgatgatagacacaagtccagatctcggattttgatactgtatgttccctgggttcctgagagaggacattgaggagtaggagtcggcgattaaggagatcggtacaattgggaagcctcctgtcagagcttccagcaatttcctcatcagaggtggacaagccctatgggctaagacagagggtcctcagaaaggagtgcggacgccgtcatgctgcagcagctcctgatcaccctgcccaccgaggccagcacctgggtgaagttgcgtcatccaaaggcggccacggagcgggtggccctgtgggaggatgtgactaagatgtttaaagcagaagctctgctgtctcaggatgctgatgagacccagggcgaaagtttagagagtagagtgacccttggatccctgacagcagaatcccaggaactgttaaccttcaaggacgtatctgtggacttcactcaggaggagtgggggcagctggcccctgctcaccggaatctgtaccgggaggtgatgctggagaactatgggaacctggtctcagtgggatgtcagctttccaaacctggcgtgatttcccagttggagaaaggagaagaaccatggctgatggagagagatatttcaggagttccaagttcagacttgaagagcaaaacaaaaaccaaagagtcagccttacagaatgatatttcgtgggaagaactacattgtggcctaatgatggaaagatttacaaaaggaagcagcatgtattccaccttgggaagaatctccaaatgtaataagctagaaagccaacaagagaaccaaagaatgggtaaggggcaaatccccctgatgtgcaagaaaacattcactcaggagagaggccaagagtctaatagatttgagaaaagaattaatgtgaagtcagaagttatgccaggaccaataggtcttccaagaaaaagagatcgtaaatatgacacacctggaaagagaagcagatacaacatagatttagttaatcattcaaggagttatacaaaaatgaaaacctttgagtgtaatatttgtgaaaaaatcttcaaacagcttattcaccttactgaacacatgagaattcataccggggagaaacctttcagatgtaaggaatgtggaaaagcctttagccaaagttcatctcttattccgcatcagagaattcatactggtgagaaaccctatgaatgtaaggagtgtgggaaaaccttcagacatccttcatcgcttactcaacatgttagaattcataccggggaaaagccctatgaatgtagggtatgtgagaaagccttcagccagagcattggactgatccagcatttgagaactcatgttagagagaaaccttttacatgcaaagactgtggaaaagcgtttttccagattagacaccttaggcaacatgagattattcatactggtgtgaaaccctatatttgtaatgtatgtagtaaaaccttcagccatagtacatacctaactcaacaccagagaactcatactggagaaagaccatataaatgtaaggaatgtgggaaagcctttagccagagaatacatctttctatccatcagagagtccatactggagtaaaaccttatgaatgcagtcattgtgggaaagcctttaggcatgattcatcctttgctaaacatcagagaattcatactggagaaaaaccttatgattgtaatgagtgtggaaaagccttcagctgtagttcatcccttattagacactgcaaaacacatttaagaaataccttcagcaatgttgtgtgaaatatactaaacatcaaagaatctatgttggagcacaagattctaaatcagtggttccctgatccctcaaaaatccatttgtttttggatttccaaaaacgaacattaaaaaaaaatggtttggcacaat

SEQ ID NO: 273036 - DNA, 2032 bp, Homo sapiens
gggagcttggccgcgcagtgccggaacccggctgcagcggtgggaaggcgggggcgtgccggcccagcggggagaggcatctgcaggggctgctgagagtaaatacttggcgcctccagctgctggccaaggagacagatggagctcaagttgggagatacgccctgagagccgatgatagacacaagtccagatctcggattttgatactgtatgttccctgggttcctgagagaggacattgaggagtaggagtcggcgattaaggagatcggtacaattgggaagcctcctgtcagagcttccagcaatttcctcatcagaggtggacaagccctatgggctaagacagagggtcctcagaaaggagtgcggacgccgtcatgctgcagcagctcctgatcaccctgcccaccgaggccagcacctgggtgaagttgcgtcatccaaaggcggccacggagcgggtggccctgtgggaggatgtgactaagatgtttaaagcagaaggaactgttaaccttcaaggacgtatctgtggacttcactcaggaggagtgggggcagctggcccctgctcaccggaatctgtaccgggaggtgatgctggagaactatgggaacctggtctcagtgggatgtcagctttccaaacctggcgtgatttcccagttggagaaaggagaagaaccatggctgatggagagagatatttcaggagttccaagttcagacttgaagagcaaaacaaaaaccaaagagtcagccttacagaatgatatttcgtgggaagaactacattgtggcctaatgatggaaagatttacaaaaggaagcagcatgtattccaccttgggaagaatctccaaatgtaataagctagaaagccaacaagagaaccaaagaatgggtaaggggcaaatccccctgatgtgcaagaaaacattcactcaggagagaggccaagagtctaatagatttgagaaaagaattaatgtgaagtcagaagttatgccaggaccaataggtcttccaagaaaaagagatcgtaaatatgacacacctggaaagagaagcagatacaacatagatttagttaatcattcaaggagttatacaaaaatgaaaacctttgagtgtaatatttgtgaaaaaatcttcaaacagcttattcaccttactgaacacatgagaattcataccggggagaaacctttcagatgtaaggaatgtggaaaagcctttagccaaagttcatctcttattccgcatcagagaattcatactggtgagaaaccctatgaatgtaaggagtgtgggaaaaccttcagacatccttcatcgcttactcaacatgttagaattcataccggggaaaagccctatgaatgtagggtatgtgagaaagccttcagccagagcattggactgatccagcatttgagaactcatgttagagagaaaccttttacatgcaaagactgtggaaaagcgtttttccagattagacaccttaggcaacatgagattattcatactggtgtgaaaccctatatttgtaatgtatgtagtaaaaccttcagccatagtacatacctaactcaacaccagagaactcatactggagaaagaccatataaatgtaaggaatgtgggaaagcctttagccagagaatacatctttctatccatcagagagtccatactggagtaaaaccttatgaatgcagtcattgtgggaaagcctttaggcatgattcatcctttgctaaacatcagagaattcatactggagaaaaaccttatgattgtaatgagtgtggaaaagccttcagctgtagttcatcccttattagacactgcaaaacacatttaagaaataccttcagcaatgttgtgtgaaatatactaaacatcaaagaatctatgttggagcacaagattctaaatcagtggttccctgatccctcaaaaatccatttgtttttggatttccaaaaacgaacattaaaaaaaaatggtttggcacaat

SEQ ID NO: 273037 - DNA, 1194 bp, Homo sapiens
  misc_feature (21)..(21): n is a, c, g, or t
agttcgacggagattctcggngaatctccaaatgtaataagctagaaagccaacaagagaaccaaagaatgggtaaggggcaaatccccctgatgtgcaagaaaacattcactcaggagagaggccaagagtctaatagatttgagaaaagaattaatgtgaagtcagaagttatgccaggaccaataggtcttccaagaaaaagagatcgtaaatatgacacacctggaaagagaagcagatacaacatagatttagttaatcattcaaggagttatacaaaaatgaaaacctttgagtgtaatatttgtgaaaaaatcttcaaacagcttattcaccttactgaacacatgagaattcataccggggagaaacctttcagatgtaaggaatgtggaaaagcctttagccaaagttcatctcttattccgcatcagagaattcatactggtgagaaaccctatgaatgtaaggagtgtgggaaaaccttcagacatccttcatcgcttactcaacatgttagaattcataccggggaaaagccctatgaatgtagggtatgtgagaaagccttcagccagagcattggactgatccagcatttgagaactcatgttagagagaaaccttttacatgcaaagactgtggaaaagcgtttttccagattagacaccttaggcaacatgagattattcatactggtgtgaaaccctatatttgtaatgtatgtagtaaaaccttcagccatagtacatacctaactcaacaccagagaactcatactggagaaagaccatataaatgtaaggaatgtgggaaagcctttagccagagaatacatctttctatccatcagagagtccatactggagtaaaaccttatgaatgcagtcattgtgggaaagcctttaggcatgattcatcctttgctaaacatcagagaattcatactggagaaaaaccttatgattgtaatgagtgtggaaaagccttcagctgtagttcatcccttattagacactgcaaaacacatttaagaaataccttcagcaatgttgtgtgaaatatactaaacatcaaagaatctatgttggagcacaagattctaaatcagtggttccctgatccctcaaaaatccatttgtttttggatttccaaaaacgaacattaaaaaaaaatggtttggcacaat

SEQ ID NO: 273038 - DNA, 946 bp, Homo sapiens
tttctcccggtcttttcccctcaaaaatctctattgtgatgccagagagacctttctgaaacctctccttttttctgtgtttaaaaccccccagtgccgcccatgaaatacacagcaaagtccaaactccttatcttgcttggatcctcctttccaccctttttaactgttcagccatatttctccatgtacttctgagattggaacccagggcaacaaagctaatgtgggttctccaagattaacacaactgaaaggaggcccctttatgccatctattctaggtcccttggaatataattaaaaacaggaatttcaacattgaaatgtaatgatgttcaggtaagggcagtaaggtacattgacttgagtcaatctcccaccatgtctggggactgggacagctgagccaggggtcctacctaagggtcaggcctgtgtcttcacttctcctttcaaccctttacttcttccagagttgaacggcttactttccttcgctcactaggccatttcatggcttgtgtttgcctgaaatacaactctttccctccctggtctacacctgctcaccctgaaagaaatacctctgagcccactttctttcttggaagcattttatgactcttatttctgttatcaacacagcttttatttatgtctccatgtatcctttgaagaaacacaacttttcaggttctatgttttatttgcattcttagtgtctggcacattgtctgacacagtgtaaaagctgagtagaattttgcctgatagcagatgtgcctgaagtgagggtgtccaaaatttcattaaatgacgactgctttaatatgaattcttggctaaggcaggagaatcgcttgaacccaggaggcagaggttgcagtgagccgagatcacaccactgcactccagcctggtgagagagggagactgcattctc

SEQ ID NO: 273039 - DNA, 577 bp, Homo sapiens
gaggctttctctttctctcttttcccaaggtgaggctggcaagctatcagtctctccagagcaaagagaaatggcaggagaattgactgcgtgaaccccacagggccgttagtggaaaaataaatgtctaaattgaaagggtcacacttgtgtagatggtgactgtcttgcttgcagcagctgaggacaccgactgtgtttagcgagtgtcctgcttttcatgtacacatctggcttaataagaagtcacgatgcagacgtggccttggctcagaccctctgtgctggacacaaatgactttgattcaaactcaagtccttggagtgtcacaaaggactaacaacgctggctgggacaaaacctacagcttctctaaatgctgaggggcccctatggagaaatggcccagtgtgtttctcatgggtgtctcctccacttccccacagaatgcaatgaactcctgattccccaggtcacctacaggatatatgtccaatggatggggatctcctgccttccagagaatttgaggggaagaaatgaccttttcctgagacaggaccatctcaatttaaa

SEQ ID NO: 273040 - DNA, 486 bp, Homo sapiens
ttttgaatgctttctaactgccaggcactgtttaagtgctttacatgtattcataggaggtaggagtttacctaccctatgaggtaagtaaactaccattatcctcattttgcatatgatgagattaagaacaggtaggactaatagagggtctgtgggcactgtccattccaagatggtagtgccttgggtcaaaaagtttgatttttagttaagataggtttggctgcaatggggcagtagttgttaggtatgcagaccctgggtctggacaggatttgtatcccacattaccactcaccagttttgtaccctaggacgagttacttccctggtcttttagtttccacagctaaaaatatgaaggaaataatgatactttacttcatagaattgttacgaggattaaataagttaatacatgtaaagtacttagaacaatgtcttgcccataattgcaatgttagaaaaacaataaaataaaaa

SEQ ID NO: 273041 - DNA, 293 bp, Homo sapiens
  misc_feature (137)..(137): n is a, c, g, or t
ccctcctagcacagcccccagccctgcagatgtcagaaagaaagaccctgctctgaaagacagacagacagacagagagaaacagatggagaaacatagtcagaggcagagagacaggaaatgagaaagagaaaatncaagctcatgcccagcctcaccatccccctttcatggatgcagaaatcatggactgaacccttaactctgcaccggccagcctcaacacaccaggtcctcaccaaggactccaggactagatgctggtgtcctgtccacttcatagataaggagct

SEQ ID NO: 273042 - DNA, 298 bp, Homo sapiens
aatcattgagataataaactataacttaagtaaaaatgtacactgtcctgtttattaagtttgtgtaaatgtgttatgtgttgttatgtagctttagaataccttcactgacttttcagcaattacctttaacagaatagtttttatttatttttacatttattatacatttagaaagaagatgagagcaatagttttttattagtataaggcaaacttaactgattaaaccttcttaggaaaagcaatagttctgaaagatatgcaagaaaaaaaatgacaaaagtgaaagaactct

SEQ ID NO: 273043 - DNA, 589 bp, Homo sapiens
gtcctcctcacttatagtagagacttacatagaaaatgaagttgatcagaccacatttctcatatgttcttatctccaaacctgcaaatgaacttgaatctatacctatattttcactagttacaagagaatagtaactatttcctgtattttcacttctccaatatcttaactcctacattctgaattctagcccctccttcttcttcaggaacctgaaattctattggttttccttctttcttctgtgttttcaaactctgtctatgtaccttttgccaactttagagtatgtcactcacattgtaacttgactttattgtaacgatgcctcctagagagacatgcaggccagaatcatcaaatgacaagaatctgtctctctgtcattattacgtctttctatcaacagctttcaaggaagaaagagaaaaagagagagaaagagagaaagaaggaaagatggaaggaaggaaagaaagaaagaggaaagaaagagagagaaagaaagaaaagaaagaaaaaaaagaaaaaaggaaagaaagaaagaaagagagaaagaaagaaagaaagaaagaaagaaagaaaa

SEQ ID NO: 273044 - DNA, 1296 bp, Homo sapiens
ttttttttcaaattctcttttattgctttatgtccctgactcatgcaggccaaagggtgaggaggagtaatagccaacaagagcgtcctgcagaaagaaacaggctgcgtgggtccggaggagcttgaaaggaagaacccgaccaaagggcaggagacccggctctccaggtcgcggaggcgtgggtgcccagccaggcggagtgcggggcggggcctctcgggccgcaaggtggggcctcctgggccgggaggtgggaggtgagctccgccagcccagcccactgcagacaggttacccaggacctcaaggtgtgctgcgtcaccccgcccgcgctgcgctgattggttcctccagggagcccccgccccctcagctgtaaccgggccggcttcagtgtcgccgccatctttgttgatgtgtcagctccgcaggggtttggggaaacggccgctgagtgaggcgtcggctgtgtttctcaccgcggtcttttcctcccactcttggctggttggaccccgctatggaaaagttggcccctgagccagagctccagcagccttgttagggcgtggcctgaggcttggataagtgggatgtaaaacgaagatcaggagcagatttgaagaattacaaagtgaattggtgccagtcagcatgtcagagacagaccacatagcctctacttcctctgataaaaatgttgggaaaacacctgaattaaaggaagactcatgcaacttgttttctggcaatgaaagcagcaaattagaaaatgagtccaaactattgtcattaaacactgataaaactttatgtcaacctaatgagcataataatcgaattgaagcccaggaaaattatattccagatcatggtggaggtgaggattcttgtgccaaaacagacacaggctcagaaaattctgaacaaatagctaattttcctagtggaaattttgctaaacatatttcaaaaacaaatgaaacagaacagaaagtaacacaaatattggtggaattaaggtcatctacatttccagaatcagctaatgaaaagacttattcagaaagcccctatgatacagactgcaccaagaaatttatttcaaaaataaagagcgtttcagcatcagaggatttgttggaagaaatagaatctgagctcttatctacggagtttgcagaacatcgagtaccaaatggaatgaataagggagaacatgcattagttctgtttgaaaagtgtgtgcaagataaatatttgcagcaggaacatatcataaaaaagttaagt

SEQ ID NO: 273045 - DNA, 1421 bp, Homo sapiens
ttttttttcaaattctcttttattgctttatgtccctgactcatgcaggccaaagggtgaggaggagtaatagccaacaagagcgtcctgcagaaagaaacaggctgcgtgggtccggaggagcttgaaaggaagaacccgaccaaagggcaggagacccggctctccaggtcgcggaggcgtgggtgcccagccaggcggagtgcggggcggggcctctcgggccgcaaggtggggcctcctgggccgggaggtgggaggtgagctccgccagcccagcccactgcagacaggttacccaggacctcaaggtgtgctgcgtcaccccgcccgcgctgcgctgattggttcctccagggagcccccgccccctcagctgtaaccgggccggcttcagtgtcgccgccatctttgttgatgtgtcagctccgcaggggtttggggaaacggccgctgagtgaggcgtcggctgtgtttctcaccgcggtcttttcctcccactcttggctggttggaccccgctatggaaaagttggcccctgagccagagctccagcagccttgttagggcgtggcctgaggcttggataagtgggaggaaaaagtcctggatttcgagtcagaacatctggattagaatcctacttctttcacttgataatcttgttacctgtggaaatcagaagagagaatatagtaaaaatacgcagtacagtcccagatgtaaaacgaagatcaggagcagatttgaagaattacaaagtgaattggtgccagtcagcatgtcagagacagaccacatagcctctacttcctctgataaaaatgttgggaaaacacctgaattaaaggaagactcatgcaacttgttttctggcaatgaaagcagcaaattagaaaatgagtccaaactattgtcattaaacactgataaaactttatgtcaacctaatgagcataataatcgaattgaagcccaggaaaattatattccagatcatggtggaggtgaggattcttgtgccaaaacagacacaggctcagaaaattctgaacaaatagctaattttcctagtggaaattttgctaaacatatttcaaaaacaaatgaaacagaacagaaagtaacacaaatattggtggaattaaggtcatctacatttccagaatcagctaatgaaaagacttattcagaaagcccctatgatacagactgcaccaagaaatttatttcaaaaataaagagcgtttcagcatcagaggatttgttggaagaaatagaatctgagctcttatctacggagtttgcagaacatcgagtaccaaatggaatgaataagggagaacatgcattagttctgtttgaaaagtgtgtgcaagataaatatttgcagcaggaacatatcataaaaaagttaagt

SEQ ID NO: 273046 - DNA, 231 bp, Homo sapiens
cccccactcaagggaacaccgtgcccagctaccctgagacagccccactcccaggaaatgcaggtgccaaccagccccagtgaggcatggcacctgagccagacacccccaaatagtcccttcccacctcctcaagcatctgcactctgggtgaacccagaaaaactggggtacctggggagacatagaagggccaggccaggaactccccaataagcaggaacagagacc

SEQ ID NO: 273047 - DNA, 364 bp, Homo sapiens
ccccagggccagcgcggttttgctggcgcgggagctgggcggggctgcattcctgccccagggtgcggcgaaagctggccctgccgggtacacgtgacggatgccccttctcctgggcccgaggccagcgcgcgcggcactgactgccttgcagcgcgtggccctctgcagatcctcagactctgccgctcaagtcccctcccagcccaccgtttggctccggctttgagggagaggagggggcagtctgctggagtcagaccttgggcttcaaagccagaatgtcgtgggttcaaatattgggtcatttgtgcgactttgggccggttacctaaacaagaccgtattttaaagtttgtatgca

SEQ ID NO: 273048 - DNA, 276 bp, Homo sapiens
ggtggcgagtgcagtggcaggggccgcagggatgcagacaaagccacgtccccattggtcctgctgctgtgagaatggggaggaaagtgactgcacaccctctggaaccttctgacggccaggggactttgaatagtttgccccacacggcaggagggtgggggccgcgctacggagcgttggcttgtggactgaaacaaagcgccccaggaaagaacaagctccgggataccagctccgggctccttgctggctgcaacttgaacgtggtctgag

SEQ ID NO: 273049 - DNA, 298 bp, Homo sapiens
ggagaaactttggggccaggcaggcagccccctggtaagagctgcttcttggaacacaaagagccgttgcgtcctccagccggccttgaggaaggtgtgacttctctgctcccagcaacgtcttgggcacccttctctgccctgcacagcagctctgcctgcagggtgcctggacactctgggtgtctactgtgtccccatatggtgcttgcaagtcttcctcccagactgccccctgcttctgtgtcccctccctggtgcacagcgccacatccagccctcctcccacccagcccac

SEQ ID NO: 273050 - DNA, 231 bp, Homo sapiens
aaaaaaataaaaacaagtgcttcattaagaaaaaaacatctttttcaacacatacaattctttgttaatgaacttaatcattgaatgccaactggttgggaaatggtatacctgacaacatagaaagccatcagacagctaacatggtatttgcaacttctcgtgagggtgggagcaccataaacacatatatgaagagataataaaagtccaaggcaacaatataagatg

SEQ ID NO: 273051 - DNA, 421 bp, Homo sapiens
ttaggaaaacaggaaatccagcattccctcctccttccccaaaatacaaagtgattaaaacaaaggcatacataaagttctgtacaatacgaatttaaaattgttcgttagatttggcagttaagaggttgttggccaaggaagccaaaagattggatacccctgctctagaggaactgtcaagtgggaagtgagagaaactaaatttaaagagtagaaagaatgggagtgatgtactataggagtttggagggaataggttaagcgaatggttgaaaggattggccctgagaaggagggtttcttaccctcttgagtgaaaaatagtggaaaggtttgtattaggtacctgtcctttaaaacagagctgctgcatttacccttggtgtttcaaattaagctaagcttagaaaaaataaaa

SEQ ID NO: 273052 - DNA, 617 bp, Homo sapiens
tacctaattcagtgtggtactaaatgaacactattaatgcttgatctttgttcagtgacctgggaaatattaattggtagcctacatattagcagatgtttttgaaccactctacttagagatgtgagccgagtttggaaactgtagtgatagtgagcagatagttcaacagattaacactggtaaacccacttactcggaaatttcaagtttaggttagtgagaaaattttctgtccttttaaactaaacccaaaaatcagtgtgactccttcccaagaatttatagcacttaatgttcaattcatcagaatttttcaggtattagtccataatctccttcacactaatccagctttcaggagtcattaaaaaaacaaatggaaaagttttattctaataattgattatttgtttttatattcttttataccgtggtgatgactacctatacattatttcaaggttatttatttcaatggcatggaaatgcttgttttaaaacactatttctttagtgatcccaatagaacatttgtgtctatcagcaaatggcttatcaaagatttataactgtctcacaagggtgcgtcaaaataaattcctttcttaaataaa

SEQ ID NO: 273053 - DNA, 711 bp, Homo sapiens
caagaccagtctaaccaacatggcaaaagcccattgctactaaaaatacaaaaattagccaggcatggtggtgcaggcctgtaatcccagctacttgggaggctggggcaggagaattccttgaacctgggagagggaggttgcagtgagccgagattgcaccactgcattccagcctgggtgacagagtgagactccatctcaaaaaataaataaaaataaaaattaaaagaaagctctcaaatcagtcacctaactatacactttaaaggatctagaaaagaagagctaaacccaagctagcagaatacgggaaacaaagattacagtgaaaataaataaagaataggaaaagaagagaataggtagaattaaaacttttttacaggtcagcaaaatcgacaagtttttagctagatttactaagaaaaaaaaaagaaaactcaaatagccaaaatcagaatgaaaatgaggacattactgtaactttacagtaattaaagtgattataagagaatactataaacataggtacagcagcaaattgaataaccaaatgaaatggcaaatctctagaaacacaaaacaactcggaggctgaggcaggagaatcacttgaacccgggaggcggaggttgcagtgaaccgagattgcaccattgcactccagcctgggggatgagagcaagacttcgtctcaaaaaaaaaaaa

SEQ ID NO: 273054 - DNA, 798 bp, Homo sapiens
gctcaggctggagtgcagttgctcgatcttggctcactgcaacctctgcctcccaagttcaagcagtcctcctgcctcggccccccagtaggtgggattacaggcatgcaccaccatgccttgctaagtttttgtatttttagtagagatggggttttgccttgttggccaggtcagtctcaaactcctgaactgaggtgatccatcctcctcggcctcccagagtgctgagattgcaggcatgagccaccgcgcccagcccttatcttggatttccagaactccatctcaaaaaataaataaaaataaaaattaaaagaaagctctcaaatcagtcacctaactatacactttaaaggatctagaaaagaagagctaaacccaagctagcagaatacgggaaacaaagattacagtgaaaataaataaagaataggaaaagaagagaataggtagaattaaaacttttttacaggtcagcaaaatcgacaagtttttagctagatttactaagaaaaaaaaaagaaaactcaaatagccaaaatcagaatgaaaatgaggacattactgtaactttacagtaattaaagtgattataagagaatactataaacataggtacagcagcaaattgaataaccaaatgaaatggcaaatctctagaaacacaaaacaactcggaggctgaggcaggagaatcacttgaacccgggaggcggaggttgcagtgaaccgagattgcaccattgcactccagcctgggggatgagagcaagacttcgtctcaaaaaaaaaaaa

SEQ ID NO: 273055 - DNA, 118 bp, Homo sapiens
ggggatcctgctctgcatggagcctgcccacttcctgggaatcagacaggtcctcttccccactccgaccacttcccgcatctgtaaccatggcccgcccaactcccttccagttgcc

SEQ ID NO: 273056 - DNA, 451 bp, Homo sapiens
tattttgcacaggctataggtttttgtttgatgagtgtttccaaagaactatttttctctgttagatagcatatcaagtataaggtaaacatattttcagagaaaacttcattttaacactaaaaattagactcttgtgatacagaattaagtataaattttacttggcaaaaactcgttttatttttacctgcaataatacagagcttaatattagaatgatatcaggtcataataataatacaccagaatcttttgagatggaattttgctcttgttgctgaggctggagtgcaatggtatgatcttggctcactacaacctccacctctgaggttcaagcgattctcctgcctcagcctcccagctacttgagaggctaagggaggagaatcacttgaacccaggaggcggaggttgcaatgagccgagatgatgccattgcgcccta

SEQ ID NO: 273057 - DNA, 277 bp, Homo sapiens
ggggtgatgaaaatctaaaataaattttgatgatgttctgcacaactctgtgaatgtactacaaaccactgagctgtatacatatatacagcttgttctgtcaaacagggtcttgttctgtcaccaggctggagtgcagtggcacaatcccagctcactgtagcctcaacctcccaggctcaatcgatcctccacctcagcctccgaagtagctgggactaaaagtgcatgccaccacacccagttaattttttgtagagaaggggtttcaccatgt

SEQ ID NO: 273058 - DNA, 365 bp, Homo sapiens
gaagtctgcaagaagagactgaatggggaacacagagtaggagagcagacatagtgagcaaggctgctgcaagcttaggtgagagccatatgtcaggcagctttgcatggcaggttaaagagtttcagttcagctgggcgcggtggctcacgcctgtaatcccagcactttgggaggccgaggcgggcggatcacgaggtcaggagattggagattgcaaccatcctggctaacacggtgaaaccccgtgtctactaaaaaatacaaaaaattagccaggcgaggtggtgggtgtctgtagtccctgctactcgggaggctgaggcaggagaatggcgtgaactcgggaggcggagcttgcggtg

SEQ ID NO: 273059 - DNA, 453 bp, Homo sapiens
ttgatttttctttgattccatacaacagattgcttgcctgggttagtgcttattttaagttcttggtgcttcttgtctgacttctgtatttgcaattaaaaacaacatgaccctccccacctgcagccagatatcgttagaaattcaacttcgaaatatattcctatcactcctgttttcactttaatagaaggctgttgcagtactgcatgatgggctcttataaaacttctactatctgctaattcttatctttgtgacaggattgtttgacactgagcaaggaaacacaataaggaagtaatttggatgctaggctggcagaagcctgcagctgtcaaccacagcctgccccagtgtgttcaacacggtggcattgttctccctgacttcataatgagcaaatgtttcacatttgaacttaaggaataaatttttactaataaaagatca

SEQ ID NO: 273060 - DNA, 477 bp, Homo sapiens
cagacaatcattctgtgaacaatcaaaaggtgagtgtatatttttaaaggtaagtaaaaatatggcaggaaaaagtctgctcttgatttttttgtttactaaaaaattttcaatgagtcttacaaacttagatgattattagttaaagtctatagaaatagttatacgtcatggacattataataattttaaattttctttaacggaagaactttcccctaaagttaaattttgttttagttgcaagacaataaagctatcaagattcaatggataaattttgtagaatcaaagaagagtgaaagatcttaagagaacatctagttcatgcactgttctacagatatgttctgcaggacacattcacagcattccaagaagatgaaaacctattcttgaattttcttgtttcatttagtattgtattctagaatttaagaaatgtttagcaataaaagttttcttatggctaacctt

SEQ ID NO: 273061 - DNA, 513 bp, Homo sapiens
atgtagtctacaaattttgaatcagcatatcattttgacatttatagtactaacagcaaagttgtttttttttctggtactgattttagcaactgaaagaaaaaatattatttcttagagaacttcctaaagccaggtgatgctattttcagatagccaaagaaccatgttttaaatcttttagtttatcctagacactttccccaatgaaataatattgtagcattggaaaaaaatattattggcaatgaaagctgctcttaagtatgtgaattcaaatcataccatatttttatttattttgggtggaaagagcaatctaatgatcttcagtaatcttttttcaataagttataagcataaatgagaaaagttatggttaaaaactgaggtttcaagaattaaagttggaaactcatctaaatgttaaatcatgtctaagttgcaaatttgtaagtatctcagagctcatagaagttgacagttgattaaagtactggctttttaaaaaca

SEQ ID NO: 273062 - DNA, 287 bp, Homo sapiens
ttctgctagacaccagggatataagatgaaaagacaattttagtcactgctcttaagctggtgacactcttaggggaagacagacattctcacaagtaattaaatacttagttaaaaaaaaaatagtggcatatgtgggtatagtgagagcccagggtgagcagtggctttcagaaatgttttaaacaaagacgtcatccccagaatgcattatcccccaagttggcattcatggttttgtttatttggcgtgaaaattcatcttaaatgggcgtgatcctttcaaa

SEQ ID NO: 273063 - DNA, 412 bp, Homo sapiens
  misc_feature (124)..(124): n is a, c, g, or t
ttagtatccccgctgcaataagagaaatggggtctctctctgttgtccaggctggtctcaaactcctgagctcaagtgacctgcccacctcggcctcccaaagtgctggaattacaggcgtcangccaccacaccccagccaccttctgcactttctaattcccctcgtttccctaattttgacctgaaattcttccccagttggtccatacattcccagtagtatgcgtaggagtgaacagcttccttacctgcgatgctttctgcctggttttgctgagaatagggaaggaggtggggcttagggagcctccacctcagggttcctcccagtcagaggctgaaaccctggtgggcagctggcttttgttaactcagaatacacctgactgggaatagtgacttatttgaa

SEQ ID NO: 273064 - DNA, 551 bp, Homo sapiens
tgtggggagatgccagagggaaggtatatcggtcaggggtagcgtcaggctgcggataggggctatgatctttgctccagcagggcgaagccctacagtgtaaagtaccattcacatggctcccacttggcagttcactcagagaggctcctctgaccccattgcctgggagtctgaggtagaagccagatgaggagctgaggttaggggcctgcctggctctaccacactttgctaggaagccgctgggtctgggaaagttgcaagctgaaagttgccagagacagtggggggcaggaaggcagcagcattgtaacaggagctgggatgagctaactcccaagccctaaagaccagaaccagggtaaggggatttgggctgaaatagcaaactccttcatcttctggaagggagacccacttagatactctctaggcagaagaggtgaattcagcctgatagttcagtatcattgatcattctagaagtcactactgcacaatgttggcatatagtaggtattcaataaatatttgattgaatgagctta

SEQ ID NO: 273065 - DNA, 379 bp, Homo sapiens
tttgagatggaatctactcctgttacagacgctgcgacattattggaatgacaacaaaagactgagaatattacacaagcttagttgataaagcagcagcagggtctgtgagaggattgattccagttttgaaagaagttctgctggaggcaaaatgctatcaagcagcagtgtatgctacagataaatctttcattaaaggaagggtcaatcaatgtggcaaactttattgttgtcccactttaagaaatcatcggtggggcctggtggctcatgcctggaatcccagtatttgtgggggccaaggtgggccaatcacttgaggccaggagttcaagaccagcctggccaacatggtaaaacctcgtctctaccaaaa

SEQ ID NO: 273066 - DNA, 464 bp, Homo sapiens
ctgggcctcaagcagcacaactaacgctcatgggacactcaccgtgtgccaagcccttgcatgcacttcacctcgttgaatccgtacagccgtattttggggatcttcaagtgaccttgaaatggctgtggctgctcctttagaggactccatcctgaccctcttctagccatgcctctccctgtggggaaggagtctacagggccaaggagacgtgactctgtgaagcccatggctcccttctaaaacattctctggatattctctgcagtcttgaactcctgggctcaagtgatcttcccgcctcagcctctggagtagctaggactacaggtgtgtaccaccacagccagcccttccttcggtttgcactttcctcttccaacttatgctcatttcccccgacccaggcctctccctttaagatcaaatataataattcctggaattccccaaaacaaaaa

SEQ ID NO: 273067 - DNA, 305 bp, Homo sapiens
ttaataataaaaaaactggatgacgtagctcatgcctgtaatcctgacaactcctgaggtcaagccaggcagatcacttgaggccaggatttctagaccagcctgggcaacacagcaagacccttcatctctaaaaaaaaagtttaaaaattagccaggtgtagtggcctgtgcctgtagtcccagctacttgggacctgaggtgggaggatcactggagcccagaaattcaaggctgcagtgaactatgcctatgccattgtacttcaacctgggtgacagagcaaaactccaacactcagtaa

SEQ ID NO: 273068 - DNA, 237 bp, Homo sapiens
gaaccttgtccaatcaggcttttactcctccaccgctaatactaccaataacctctaaattgccaaatgcaatggtcaaatctcagtcctcagctgttcgaccagcaacatctgacacagaccacttcctcctcctggaaacactttcttcacttgacctccagaacaccacaaactctagcacatcaccaatcacatcttttcaatcttatttgccattccttttcttctccagga

SEQ ID NO: 273069 - DNA, 623 bp, Homo sapiens
  misc_feature (587)..(587): n is a, c, g, or t
  misc_feature (623)..(623): n is a, c, g, or t
cataagccaccacacacggccaaattcaccattttaaaatacgctatgcaatatttttagtatcatcatgaagttgtgtgaccatcgccaccatctaagtccgttcattttcgtcactctgaaaagaagcctgttacctcattagcagtctctccattccccagcaccccccactccagcccctggtaattgctaatggttgtctctctgggtttttgatagcttatttataacattcagccttcacctaccatatgactaggtatttacctatgagaaatgaaagctcaaattcacataaaaacctaaagaggaatatgtatagtggctttattcataattgccccaaactggaaacaattcagatgtcagactgcccagtgaataaacaaactggaacatccatactgtggaatattagttagcagtgaaaaaggatgaatgatggataccacaccaccacggggaaacctcacgagcattgtgctaagggaaggaagcagactggaaaggccgcttccaacctagttctgttcatatgtggggttttttttttcgagaccccatctctacaaaaagatttagangtgggagggtggtttgagcccagaagtttgagaccn

SEQ ID NO: 273070 - DNA, 509 bp, Homo sapiens
gggtcgggaattcccgggtggacaactactactaaattcgcgcccgcgtcgacttaagaggagaattctgttttaatttgttgcccctccatttgttctcattccaaattaaaaagaggtatgtatttgataagacttaccaaataaaaatacaaaaaatcaccatgcctattttggtaataacttttaaaaaggcacgtggaaaaaaattattctgggccgggcgtggtggctcatgcctgtaatcccagcactttgggagcccgaggtgggtggatcacctgaggtcaggagtgagaccagcctgaccaacatggagaaacctcgtctctagtaaaaaaaaaaaacaaaagaattagctgggcatggtggtgcatgcctgtaatcccagctactcgggaggctgaggcaggagaatcgcttggacctgaaaggcagaggttacagtgagctgagattgtgccgttgcactccagcctgggcaacaagagtgaaactgtctcaaaaaa

SEQ ID NO: 273071 - DNA, 601 bp, Homo sapiens
gttgcagtgagctgataactgcaccactgcactccagcctgggtgatagagtgagactcagtctcaaaaaacaaaacaaaaaaaattattattgactgtagtcaccctgttgtgctatcaaatacttgatgttattcaccaggtattcaagtctttctatttgtcgtaccctcatagtgcatttaaatggaacgacaaggcttttttttacccatctgattaaaacatgtttgataggcctgtgcatttttaaaatttctgctcaatttaaggtaattttgaaagttaagaggagaattctgttttaatttgttgcccctccatttgttctcattccaaattaaaaagaggtatgtatttgataagacttaccaaataaaaatacaaaaaatcaccatgcctattttggtaataacttttaaaaaggcacgtggaaaaaaattattctgggccgggcgtggtggctcatgcctgtaatcccagcactttgggagcccgaggtgggtggatcacctgaggtcaggagtgagaccagcctgaccaacatggagaaacctcgtctctagtgaagtcgtattactttcactggccgtcggtttac

SEQ ID NO: 273072 - DNA, 864 bp, Homo sapiens
  misc_feature (146)..(146): n is a, c, g, or t
acatctatcccagtattcgccaagcttggaattacccttccctaaaggaccaaaatgtgaagcccaccccggtgcggcccttctagacaagtgttcccccggcggcaagaaatccggcagaggttcacattaacttaataccgccnccattccattcaagctgggttataaagttaagctccaatctcaaaaaacaaaacaaaaaaaattattattgactgtagtcaccctgttgtgctatcaaatacttgatgttattcaccaggtattcaagtctttctatttgtcgtaccctcatagtgcatttaaatggaacgacaaggcttttttttacccatctgattaaaacatgtttgataggcctgtgcatttttaaaatttctgctcaatttaaggtaattttgaaagttaagaggagaattctgttttaatttgttgcccctccatttgttctcattccaaattaaaaagaggtatgtatttgataagacttaccaaataaaaatacaaaaaatcaccatgcctattttggtaataacttttaaaaaggcacgtggaaaaaaattattctgggccgggcgtggtggctcatgcctgtaatcccagcactttgggagcccgaggtgggtggatcacctgaggtcaggagtgagaccagcctgaccaacatggagaaacctcgtctctagtaaaaaaaaaaaacaaaagaattagctgggcatggtggtgcatgcctgtaatcccagctactcgggaggctgaggcaggagaatcgcttggacctgaaaggcagaggttacagtgagctgagattgtgccgttgcactccagcctgggcaacaagagtgaaactgtctcaaaaaa

SEQ ID NO: 273073 - DNA, 1039 bp, Homo sapiens
caaccgtaatgcctgaattcaatattatttctcttaggatttggcagctcaattttaaggcaaaaattggggaaagggctggtccgtagtcagtacacacacacaatttataattaaattagctattttctacaggtctggttcgtggggcaccaaaatgattacaatagtaacatcaaagattactgataacagatcatatcagatataacaagggtgggctcagtgtggtggtttacatctgtaatccaagcactctgggaagccaaggtgaggatctctttagcccaggaggtgaggctgccattacccatgatcatgccactgcactccagcctgggtgatagagtgagactcagtctcaaaaaacaaaacaaaaaaaattattattgactgtagtcaccctgttgtgctatcaaatacttgatgttattcaccaggtattcaagtctttctatttgtcgtaccctcatagtgcatttaaatggaacgacaaggcttttttttacccatctgattaaaacatgtttgataggcctgtgcatttttaaaatttctgctcaatttaaggtaattttgaaagttaagaggagaattctgttttaatttgttgcccctccatttgttctcattccaaattaaaaagaggtatgtatttgataagacttaccaaataaaaatacaaaaaatcaccatgcctattttggtaataacttttaaaaaggcacgtggaaaaaaattattctgggccgggcgtggtggctcatgcctgtaatcccagcactttgggagcccgaggtgggtggatcacctgaggtcaggagtgagaccagcctgaccaacatggagaaacctcgtctctagtaaaaaaaaaaaacaaaagaattagctgggcatggtggtgcatgcctgtaatcccagctactcgggaggctgaggcaggagaatcgcttggacctgaaaggcagaggttacagtgagctgagattgtgccgttgcactccagcctgggcaacaagagtgaaactgtctcaaaaaa

SEQ ID NO: 273074 - DNA, 306 bp, Homo sapiens
gacttcctgggctcaaaccatcctcccacctcagtctctggagtagctgggactacaggcatgtgccaccacaccaggttaatttttaaatctttctcgtaaagatggggtcttggtaatgttgcctaagctggtctcaaacccctatgctcaaatgattctcctgccttggtccccaaaatgctgggattataggcatgagccacttcctctgccttgactgtttttgatggaatattctcaagtagattacatgctgtggcatcttaaacagagcactgtgaaccaaatgtacccttgggtgct

SEQ ID NO: 273075 - DNA, 363 bp, Homo sapiens
actgccccacaaatctgtgggagtcatcatttacttctagaaaagagaagtaaaatggactattattctgatgcagatatttcatgaatcccatgatcacccgtgccatgtcgtctgccctttggtatttttccatgctgtaggctattcctacatcacaagaagagtccaaggttaatcatgataccggagccccatctggacccagcatacaggctgctggcaggcctcctatacagtgcttgatgtaacgccagctcctctcattcttcctgcacctccagttatcatttaccagccctgaataagagataaccaacagggcattcttaaagttgggagtttcaccatagaaaacaaaaa

SEQ ID NO: 273076 - DNA, 296 bp, Homo sapiens
aatgttttatgcatctcccccaactaccactccccgctgccgccgccaccaccacaccaaaagtctggtttcttttatagccttctcactagacgaaagaaaataaaaaatctggttctcagataaaaccaaatgaaatattattttcccagcatcactaagggactaggtaattgcttttgagtttgaagcacatgagctgaccccaagaaggttgaagattgaaacctttccccctctcctctaagaccagctcaaaggaaacagggagcttgggcccaggagtttgagaccag

SEQ ID NO: 273077 - DNA, 565 bp, Homo sapiens
tgcactacgtgaacatgcttcatacagagggtcagcacctcactgtgtgaacatgtgtcatacagagagtcagcactgcaccgtgtgaacatgcttcatacagagggtcgggtcagcaccgcactgtgtgaacatgcttcatgcagagagtctgtcctgcaccaggtgaacacgcttcatacagagagtcagcaccgcaccgtgtgaacacgcttcatacagagggtcagcaccgcactgtgtgaacacacttcacacagagggtctgtaccacattccgtcaacatgtgtcagcaccataccatgtgaacacgcttggtacagtgatatacatgcatgtggcagagctgtgaaattatgacctgctgcagacagactttgtacactgtgctatcagccaactgggcaaatgtggacaagagtccctgcatgtctctattcaccaggtgtctgtcaaatgaaatgggctgaactggataatggcaggtctgacccatgattactgcctgtaagagctgagttatcccagagtgtaggcgtgggatattaaaatatatatatatgc

SEQ ID NO: 273078 - DNA, 444 bp, Homo sapiens
aattcatacaaatgttagagatttgttagtttttacattatacttctattaactgtagaattactattagtatagagacctcaagtgtttcttatttctgaagtcttcttagtagtgaaatgatgaggggtatagtaatgtccatttgtaataaaaatgattaatgaaaaatagaattttttattttttaacttttaggattcatcatatgctgaacatctttttaaagttctgactgtattgtgcaatgtcttttaattcatgtgtgttcttccttatctaaaaatcatttacatttacaaataagaatatttttacctgcaccaatcaagatacaattagtagctataaatgtaacattctatatgtaacagaataagaaaacaagagaaaaaaattgtaacttagcataattgaaacatgtgcctagccatctggagcact

SEQ ID NO: 273079 - DNA, 1634 bp, Homo sapiens
tccaatttgaaacatctcaggctttagtcagtggcaaaattgaagttaattgtttgctctctcttcttgttaatgtattttgtactcaggagagggtctggggacatagaaatgtttcaaaagatgtcaggtgtggtcaaacttgcttttcaacctcattgagagacaatatagcaaaaggctgagagcacaaactggagccagactgcttgggggtgtggggatctggctgtgctctgtgatcgctgtgtgaccttgggcaggtcacttaacctttctggtactgcgtttcttcatctgcaaaatgggagtaatatcatagggatgctgtgaggatctaaatgagttaatactgatgaactaactgcttagaacaaggtttgccccgtactaaatactgtgcacggtggtaataagtaataataattgatttctcctacttttcttcctctagtctatatcactacccttcagacacactggactcttttctctccttcatacaagtcaagcctttttctgtctccaagtctctgctcttgctgttttctttacctgtgttctctctcacatatcactttatgctcttcagatcctttgtcgcaatgtcacccttatgttttatggtatggtcctgctgtgtttttgtcttccctgactgcatgctcactcgtgctctctctcaatcgtgcgctctctctctctctccctccctccctctgtctcccgtcccacgccggcacaagccgcacgacaaggcaacacgaccccccgcgcagcagaaagcaagaccaccaccggaagacagaacgcaggagcacccagagaacgcgagcgcagcacaaaaaaagcaaaagaccgagcacgacagaacgagccagccaccacaagaacgagagacaaaaacacacgacacacaagcagacgaaaaagacacacacacagcccagaggaaaccacacaaccacaccgaccgaccacagaaaacgcggggggacaggcagcaggagagagcgagcgcgggcacagcccaacgccagcgcgggacggcagcaaccgacaagcacgagcacgcagggcaaagcaacgctcacacgcacccgcacggacgcagcaccagctcaccacgcgcgagcagcccaacacacagaacaccagaaggccacacgcacgcccacaaccgacacgcagaaaacgcagcccagcgcgcgcgcccaggcgcagcgcaagggccccaacgagcacgcgcaacacgcacgacaaggcgacggcgccaccgccgaccccgcaaggacagcagcgaaggccgagcacccgcgccgcaggccgggggcgggcaacacgccagcggacaccgaccggacgcaagaggagatgagaacaaaaacagaaggaagccaagagaaaaaacaacacaagcagcgaacaaaaagcacaaagacaaaaaacagaaacgaccaacgcggaaaaccgaccgcagaagagagacaggacccgagaagggaacaacaacagtaagagaacaaacacagacacaaaaagaaagccgagaaagaggggaagggagaagacaaaagaaagaagcaaaggcaacacaagagaacaacaaaaatagtcacagagataagggacgc

SEQ ID NO: 273080 - DNA, 379 bp, Homo sapiens
cctagaggcagccagtgttccacgttttgtgtatccttccagatatctgttaacacatcacacacacttttaagtttttcttttttaaaagacaaaagaggctgggtgtagtggctcacgcctgtaatcccagcactttgggaggccgaggcaggtggattacttgaggttaggagttcaagactagcctggctaacatggtgaaaccctgtctctactaaaaatacaaaaattagccgggcatggtagtaggtgcctgtaatcccagcaactcaggaggctgaggcaggagaatctcttgaacccaggagttggaggttgcagtgagctgagattgcgccactgcactccggcctggatgacagagtgagactctatc

SEQ ID NO: 273081 - DNA, 288 bp, Homo sapiens
aaagaaacgagggaggcatgtgaaattctgtactcttcgataaccccaagggaaactggccacgatgtagacgtcactctagtgatgaagttgttgagaaatgaagatgagaattccttgggccagtttctgtgcccatggatttgatgtctatctgaattttggagttagtaaacacatcagtgttacatagtttgaagggctcttgttgaaagccttgtgatacctgtagtagctgatgtgttattactaattctacacatctcctggatatatacagctcctgga

SEQ ID NO: 273082 - DNA, 2052 bp, Homo sapiens
taactgctaccaagtcagggaggagtcagacatcatcagcctcagccaggagccggacgaacatccaggcgacatatttttcaagcagactcccacgaaagacattctaactgagctgtacaaactcacaacagagagggagagactgctaaccaatctcctgagctcagaccacatcctggggatcacgatggggaaccaggaggggaagctgcaagagctgtccgtgagcctggcccccgaggatgactgtttccagagtgctggtgactggcagggagagctccccgtgggccctctcaataagaggagcacccacgggaacaaaaagcctcggaggtctagtggaaggagagagagctttggggcccttccacagaagaggaccaaaagaaaagggcgtggaggccgagaatcagctcctctgatgggcaaggacaagatctgttccagccactcccttcctctttctagaacaaggcctaacctttgggtactagaggagaaaggaaatctgctcccgaatggggcacttgcctgctccctgcagaggagagagagctgccccccagatattcccaagacgccagacacagaccttggctttgggagctttgagacggctttcaaggacactgggcttggaagagaagtgctgccccctgactgcagctccacagaggcaggaggggatggcattcggaggcgcgagcggctggagcatcagcaaacaggtttgtctgaaagtcaccaggaccctgagaagcatccagaggcagaaaaggatgagatggagaagccggctaagcggacttgcaagcagaaacctgtctccaaagtggtggccaaagttcaggacctgtcctcccaggtacaaagagtagttaaaacgcattctaagggtaaggagacgattgccattcgcccagcagcccacgctgagtttgtacccaaagccgacttgctcaccctcccgggagctgaggctggggctcatggctccaggcggcagggcaaggagcggcaaggggataggtcatcgcagtcgccagccggggaaacagcctccatttctagtgtgtcggccagtgccgagggggccgtgaacaaggtccccctgaaggtgatagagagtgagaagttagatgaagcccctgaggggaaaagactgggcttccctgtccacacgagtgtccctcacactcgcccagaaacgagaaacaagaggagagccgggttgccccttggtggccacaagtccttgtttctggatctgccccacaaagtaggtcctgactcctcacaacccagaggtgataagaagaagccatccccaccagcaccggcagctcttggcaaggtgtttaataattcagcctcgcagtccagcacacacaaacagacgtcacctgttccctcgcctctgtctccaaggctccccagccctcagcagcatcacaggatcctccggctccctgcattgcctggtgagagggaagctgctcttaatgactctccttgtagaaagagccgtgtcttctctgggtgcgtctctgctgacaccttggagccaccatcctctgcaaaggtcacggagaccaaaggagccagcccggccttcctcagagcaggccaacctcggttggtgcctggggaaactttggaaaagagcttggggccagggaagaccacagctgagccccagcaccagtcacctccaggtatctcctctgagggctttccctgggacggcttcaatgagcagacacctaaagaccttcccaacagagatggaggcgcgtgggttctgggctacagagcgggaccagcctgtccatttttgcttcatgaggaaagggagaagtcaaacaggagcgaattgtacttggatctccatcctgaccacagcctgactgagcaggatgacaggactcctggcagacttcaagctgtctggccacccccaaagacaaaagacacagaagaaaaagtgggactgaagtacactgaagcagaataccaagctgctattttacacttgaagagggagca

SEQ ID NO: 273083 - DNA, 347 bp, Homo sapiens
attaaggggttggcccagtaggccatagaaggcaacttaaaaggcttctcattaggttaggatgggaaaggatttacaaaagaatttaataaatttaaatcaaatatatgaaaatctatgaattaaaaattatactcagaaaaactcatgtatcataattagaaattgctaggatatcagcttcttgctctgaaaattgataacaaagtaaaagaaaaataaagcacttacctgcctttcccgtacaaattatatttctgagttgtcaaaagagttgagagaaaattcttttttataaaagaattgtagctaatgcacaagtaatatacacattttcaacaaacatt

SEQ ID NO: 273084 - DNA, 1887 bp, Homo sapiens
tcagttttcacttatgcatattattgaacagttgatttcttatgaatagactgaagaaaaaaccatcactattatagataagtaaattttcagtctttttcatcttggatggcaagcaaaatcaaatatatggaggcaagaactattgggcaaagcattttctacctctgtgcacaattgaaatgacattattcaaggtgactgcatctgaacacatcctcaatcatgcattatccaagaagtaaaatggtcttaggcgggcaggggcaggaataatgggaagttataagagtgctggacacagagaaggtaaccacatggtggatattggggatattatatttactttgaatgagctacaggaacagtatgaggatgtttcaattacagaaggatcacctttgaatgaaattacttcagacagaaagttatcaagtgtagcaggatgctatctaaaatataagaagaaaaatagtttgtcttccaaactccctgaaccttcaatatccaaaaagttaaataaaaaaagcaaccaatattatagcaaaattatggagaatgatgaccttgaatctaaaagaccaaaaaatacttggcaaataagaaaatttctgggtggggttggcagcagtaatgtaggagtccaagaaccatattcaaagaatggcataaactttaaaaaacattcagagaagggtgaaattcatgactcaaagtctaaaccacaaagcttgaagagtagtacaagcctcagtaagtctctggataaaagtgatatttctagtatcccaaaacttcagaagccagctgtaagaaagcattccagtctccaaaaacaggtttcgtctacggaaaaaactgcaattagtactctggaaaacttctgtgaagctatcagtaaacttcaagaaaattacattgcagcagaagaacttcagtctattttgccttcaacaggaattaatttattagatgaagaattccagaagattgtgacagacactagtagaaatgagaatggaatggtggagttagatgactttgtaaatgctctcgccaaggagcgaagttttcctgaatgcaatgcgttgcctggtgtcattaaagccattgataaaattaaagataaaaatgtggattatgaggatctaaatacttgtcttcaaaattttggtatttacctttctaagccagaatttaagaagatcacagaactgactgaagctggtgaaacaaaaaaagtgaattttaaagaattcattgatactatgatgagcaacacggaatgcttctctgaaaaattagtattgcctgatgctattgaaaccctcgacgatctcagaaaggagacgatgagtgtttctgacctgtggaatactctgtctagtttgaatagtaatttaaaaaaggatgaatttctagctgcattggaactagtgacagttgatggtgagtgttacaaatactaaaattaaaaagtataccaagatattactttattttctgtcaactcttgtcattgtatcttgtacttggcgagacggagtgttcgaatatgattgaaatgccaacatatgcatttaggaaatattgtataaagaaagttcagattgtttggctattcaatataaaaatattattatgtaatttattattgctctaaattgatcaaatatgcattgagtaccttcaagttgtgtggtatgttactggaaaatggcatatcccaatgaacacagagggcatgattaggaaatgttaagagatctattcaaattttataataacagtacttggaatattcatactgttttgttgaaataggcttttatttaatttggtagaaaaacacacctgctgatagctaccacctctatttagcaagtt

SEQ ID NO: 273085 - DNA, 1585 bp, Homo sapiens
tcagttttcacttatgcatattattgaacagttgatttcttatgaatagactgaagaaaaaaccatcactattatagataagtaaattttcagtctttttcatcttggatggcaagcaaaatcaaatatatggaggcaagaactattgggcaaagcattttctacctctgtgcacaattgaaatgacattattcaaggtgactgcatctgaacacatcctcaatcatgcattatccaagaagtaaaatggtcttaggcgggcaggggcaggaataatgggaagttataagagtgctggacacagagaaggtaaccacatggtggatattggggatattatatttactttgaatgagctacaggaacagtatgaggatgtttcaattacagaaggatcacctttgaatgaaattacttcagacagaaagttatcaagtgtagcaggatgctatctaaaatataagaagaaaaatagtttgtcttccaaactccctgaaccttcaatatccaaaaagttaaataaaaaaagcaaccaatattatagcaaaattatggagaatgatgaccttgaatctaaaagaccaaaaaatacttggcaaataagaaaatttctgggtggggttggcagcagtaatgtaggagtccaagaaccatattcaaagaatggcataaactttaaaaaacattcagagaagggtgaaattcatgactcaaagtctaaaccacaaagcttgaagagtagtacaagcctcagtaagtctctggataaaagtgatatttctagtatcccaaaacttcagaagccagctgtaagaaagcattccagtctccaaaaacaggtttcgtctacggaaaaaactgcaattagtactctggaaaacttctgtgaagctatcagtaaacttcaagaaaattacattgcagcagaagaacttcagtctattttgccttcaacaggaattaatttattagatgaagaattccagaagattgtgacagacactagtagaaatgagaatggaatggtggagttagatgactttgtaaatgctctcgccaaggagcgaagttttcctgaatgcaatgcgttgcctggtgtcattaaagccattgataaaattaaagataaaaatgtggattatgaggatctaaatacttgtcttcaaaattttggtatttacctttctaagccagaatttaagaagatcacagaactgactgaagctggtgaaacaaaaaaagtgaattttaaagaattcattgatactatgatgagcaacacggaatgcttctctgaaaaattagtattgcctgatgctattgaaaccctcgacgatctcagaaaggagacgatgagtgtttctgacctgtggaatactctgtctagtttgaatagtaatttaaaaaaggatgaatttctagctgcattggaactagtgacagttgatgataatatggaggtggatttaaaagatttcttaatgaaaatgaaagaaagtccacatttccaaaagtccaagggtaagtgaatacttcttgttcaagagaatggctagaaaataaatatttaaaaatgaaataaaaa

SEQ ID NO: 273086 - DNA, 428 bp, Homo sapiens
ttttcatttctctagatcagatgtgagaaattttcttttcacccagtggctatttactgcctgttttgcattagcaaaactcaatttattatattttgaaaggaaatagaaaatgtttcactcatctaatttcaaataacaaggtgaaactctactcaggaattacatgagattaaaatttatagctcagttattgtcaataagaaaaaagaaagggaagaggcatctttaaaacttgccaaaactctagatggcaaaaatcagaatcaagtaccaatgctgtttatctttaatgatcaaaaccaaagactttttcattcttaaggtggttaaatattatcagaattgattattaacagtatttacaactaagaagtttgaaaggacattctaattacttttgtattttttataaaatgctcattgta

SEQ ID NO: 273087 - DNA, 350 bp, Homo sapiens
gcagtatttattgagcgttatttataaaagggaaaaactggtggcacctgaatattcctcaagaaaggaatgggggaatcaattatggtgtgtccagagtgtgcagttatcacagaggaatgaagtcttcatgtacagacttgggtgaccctcaaaggcacattacagagaaatatgtattgcatgatcttatttttactaaaaatcaccccctcaagatccaggcatacgtgttttatgtaagaagaatgtacggagggaaatatttcatatcatacacagcatatagatgtcatctgaattgttatagcaagcattcgatacttttataaatcaaataactgaaatgg

SEQ ID NO: 273088 - DNA, 413 bp, Homo sapiens
ttctgatgcccttggatcacatctggatttatgttatgagatgattcaggatggggctgctcaccacaaagaccaaccatgggatcaggggctggggcttggagcccacgtcaactctggggaggggaggttggctggagattgagttctaacacatgaccaacgatttgatcaatcttgcctgcataaataaaccccaataaaaatgctgggtgtggaagttcagtggcacttcccggttggtgaacacatgggtgtgccgggagggtgacgtgccctgctttcatagggaggaggcacagaagctctgcattcaggaccctcctgggcccacttctatcttatggctggtcctgatctgcatcctttataaaactgtcattgttaagtactacactttaccgagttttatg

SEQ ID NO: 273089 - DNA, 328 bp, Homo sapiens
atcctttaatatacctaattttgtttataatgaattgaatagtagtgatcattcacttgaaaaataatttgagtgcccattttgaataacccataatgtctaatgcagtatttgcatagagatgaataaaatactgttcctgtcctcccatagtttataatctcatagaaagacagtgatatgaagtaactgtattacccagacaatcagtgatttcttatgaacattagtgggtgcaataaataggagaggtttcttttcatctttaattttcaatgactgagaaacttcagctattcttttgcttacatgacaccaataaacacct

SEQ ID NO: 273090 - DNA, 355 bp, Homo sapiens
gtcccaggggcaccgcaggattgcagaaccctagaaagcttgggcttctctgacctgagagcagcactttgacctcaccctcaacactccacctctctgtcacccaagaggagtagcttctcccagcaggctccgctcctcccatcgtttcgtgctcaacggcaaggcctttgctgacactatgcaatcagatcaaattcagaagaggatgagtggatgcagctactacactccttggtttcaaattttgtgctaattgaaactgcctcattgctctcattgattttctttgtaacagataaatgctattaaattgaattgcaaaatatataataaaataccaccattacttgca

SEQ ID NO: 273091 - DNA, 437 bp, Homo sapiens
gttatctgttatattctcaggttctgtcctcacttggggagggaatcgtacaatggggacctggatcttagtttccatcttaaaattctgctttgccacaaagtacaaagtaaagatgagagaaaaatgttgcaaaggctgattgaggagtgacctttgccttgatttatgacagacgtttgggtatggagagatggagactactattaagcagatccctctaaaagatctgaatgggaacacttgatcctatgtcctttagctggctcatggcaggattttacaaatagaattgttcaatctctctgttcagattactctccactctaccatgctgcttgctccttttggtctccctttcgtttggcctgtaatgtggatgtgttctttgtttaatgagatgagcattataataaagtcctagggcatttgaagat

SEQ ID NO: 273092 - DNA, 597 bp, Homo sapiens
ggattttattgccattgaaagtggctctcagcgggagggagagagctggaaaatggggatggagtgggaacgtattcttcccctgaagtactgccatcaagcagtcccgctaaagtcaagctgctgctctccgactcagactgcagtctccgacgtgcagctgcttctcctcttctctgctctgtgccagtggagcctgggatttttatgggtacaggatacggggtggggtaggccaggggtggttttggaaaaggcaatatttgagcaggaccctgccctttttctgtgtacaatttctgtgcctcctgtccctctcagtctctacagaatgtctcagaaatctccatagtagaggatcatcattactctgcccctggcttctgttttattctgctatagtttaagcatctttatgaattttatttgacccagtttttgaattgtctgtcttacacttctgtaacctctctttcaatatcattttcttccagttccatttacaaaacagtccactattcttttaggattaataattttatctgcctgacctcatcttcatgttttctgattcttctggtgtataaaaaaaaaaaa

SEQ ID NO: 273093 - DNA, 651 bp, Homo sapiens
ggattttattgccattgaaagtggctctcagcgggagggagagagctggaaaatggggatggagtgggaacgtattcttcccctgaagtactgccatcaagcagtcccgctaaagtcaagctgctgctctccgactcagactgcagtctccgacgtgcagctgcttctcctcttctctgctctgtgccagtggagcctgggatttttatgggtacaggatacggggtggggtaggccaggggtggttttggaaaaggcaatatttgagcaggaaaacaggaatgtaaagttctcactttgggcttgagagtgggtcttggccagggaccctgccctttttctgtgtacaatttctgtgcctcctgtccctctcagtctctacagaatgtctcagaaatctccatagtagaggatcatcattactctgcccctggcttctgttttattctgctatagtttaagcatctttatgaattttatttgacccagtttttgaattgtctgtcttacacttctgtaacctctctttcaatatcattttcttccagttccatttacaaaacagtccactattcttttaggattaataattttatctgcctgacctcatcttcatgttttctgattcttctggtgtataaaaaaaaaaaa

SEQ ID NO: 273094 - DNA, 244 bp, Homo sapiens
cttatttccttcccatctctgggcctcttgccctttctctgaagtgaatgatgtgaaaaatgaccttacatttccgatcatattctgttgtgtgattttaaatattgatttatttgaacatttttgagtgccaattatataccaggcatggtactagttgttaaggaaatactccttgtccttaatctcatggatcttgtaaaaaccacacagcaatcaaacctcgataaatatataaataaaa

SEQ ID NO: 273095 - DNA, 448 bp, Homo sapiens
gaatgccatctatctaattctgtcagtgtaatgcccatagagcaaggtcccacataagcttttctgttttaatttagccggtaaatcataagtagaaatttttctgatacggtaattgtctacaattcaaacctaactttccccaaataaaatttagtttgttccgatgtgatctcacagcttgccacaccaaaaacaaatagtaggggttaggaggcattaaataaacagtttccttaactcctgattgtccaaaatagctgaatttttccaattctatttataatatcctatgctaattagaagtattgagataacgttttataatcaagcctccagtgactggggatcacagctgccattattcacaagaattttcacaggtgaatgattatatttctccaagttgcaaactccagtaattcatggacctttttttaaaaaaaaa

SEQ ID NO: 273096 - DNA, 476 bp, Homo sapiens
attcctattgagaacatttcatgtagttataaaaacatcttaaatctgaaacaaggcatagaactgtacatatataatatatacatattaataaaaatgtttttcatacctaatgagaacgtcttatacaaaaaccaaaatgctcagtgaaaaataaggttgagtcacaatgcagaatagtttttataaatgttaataaagagggtaattgtactggttgctgcaacagatctgttgatcgatttccagattttagaaactattaacttttcaaatttttgctaggattagtcctctttttaatttttttaaaatcaactatatactctagataactacaactttaaatgttggaaaacctttttagagttttctctgtagaacagcaagccttttggagtggaagatgtccagcttaaatttgttaaaaccatctttggtgatgaagatttcaaataaatcaaggcactttgatt

SEQ ID NO: 273097 - DNA, 325 bp, Homo sapiens
gtatgtatcctccaccccttccatccatccctcctttcatcccatgtaaaatgctggcctgcagtgactgactgactgagactgataccgggtttaaaagccagctccagccgggcgcggtggctcatgcctgtaatcccagcactttgggaggctgaggtgggcggatcacaaggtcaagagattgagaccaccttggccaacatagtgaaaccctgtctctactaaaaatacaaaaattagctgggcgtggtggtgcatgcctgtagttccacctactcgggaggctgaggcaggagaattgcttgaacctgggaagcagagg

SEQ ID NO: 273098 - DNA, 298 bp, Homo sapiens
ccagaaaagaatgtgagaagacacccaaagttaatagccatccctttcctaatgttccctatgtgcggctccctgatgagaaactggaggaagagattcccatcatcttgcgtcttctattctcaacatcggagaactcctgttcttgaaattcaacctgatatcattattgctctgtggattaaactggctcttgtttgctaggctcagagtccaaatacaagatataacattgtttttatggaaaaatgtgcccaaataccaaataattgatctacaaagaaagttttgaaatgta

SEQ ID NO: 273099 - DNA, 440 bp, Homo sapiens
ctaaccttttctttaaattttctgggataaatatttaaagaaatagtatgtgtgaagaaaatcttgtaaatctatccaaaatctatccaaaagcagaggataggcctggctactaggtgttactttgataaagtgtctctgtaaatcatggtcaatatgtgagagatctttaaaaaagatgttaactaataaaatcactgggactacctctttctttcatttcaatggaattgtaaggactctgtcaggcaggattgatttcagcaaaaggtagaatggggtacaaaatatcccttgtttcactgaagtatatacagaaatagtaagactcgttggattcagtcagttttatagttaaagcagttttgtgggctgaacactgacacagtaactttcacaaagtaggcaaagttaccaggcaggtattgttctcttaatta

SEQ ID NO: 273100 - DNA, 307 bp, Homo sapiens
tccaagccgggagagcagcaggcctgcccgggctgagctccagctgccgacctgggggaagggcgactctaaagcccccttttccaccttccaggccggctcaaatgtcgtcttctccactaagcctcctcccgctttcctttcctttcttagagctcccataatacgttcgaatctccaccgtttgttaagtctttcttgccctttcttcctacctctatcccaaaaatgtgagcagggacttgatcattttcagtctcgcatcgcctggcgttcaagaggcgcccaataaatgattactggaaaa

SEQ ID NO: 273101 - DNA, 154 bp, Homo sapiens
gggatcttggaatgggggaaggctggggctggggcggtgggtaacttatttcctcagaaatggcacacgcagacaggtccacaattcctgggctcacattcttgtttgcgaaatcaaatctagggcaccgccagcctgaatgaagatttggaag

SEQ ID NO: 273102 - DNA, 350 bp, Homo sapiens
ctcagaaaaagggatgtagaaaaaggttgctgaatggagtaatttcagtgttttgcacaggaatggctctttttctttttctggtccgtatgacttttgctttaagactattgctcaagctattttgtaagtttggggttctcccacacaagtacattgactaagcattggttaaaaggctaggcacctgagtaccacttacatgttttactttccaagttccaacctaactacttataaacttgaaagtagttatgaattgtgggttacctatagtcaaatagtagggtttttttttttttcagtcaattggaaatgaaagggcaggtattggcaaggcttcgggacta

SEQ ID NO: 273103 - DNA, 245 bp, Homo sapiens
cttagtgaggcgggtctatagtcaggggcaattgttcctcgtcagcctggctggagaccttccacccattgggattttgtaaaacatctactttaaaatgtggccgtgagaaaagcccccattcctccccaccatctgttcgcctctccccgattttctaggattaaagtataggcctgcaatcccctacctccaattctaaagcccacaaagctctgaaaacaggaagatgttccccccaagtt

SEQ ID NO: 273104 - DNA, 456 bp, Homo sapiens
cttcataaaagtgagacgtgtgactggggaggactcctatcatgggtactgaggccatagaaaaaaagcagaacaaactctagagctaaaaacatgaacttgaaaggacgtgcagaaaggaaacacaaaagttaaaatcaagcacactcctccttaaagtccttgctatatggcagttatcaaggtctaaattttggctgtttccactcacacgcataatcttttgtgagacaactgactgtcaatagatcccaccaacttatatagaactctgttttcttatagagccaaccctgactcagttcatagaactatctaacttcaaaggaagcctatatcagttactggtattaatcaagataaccattcattcataaacatcatatggcatttgacaaaaaacaagtaacccgaaacataaggaccaaaattctttgatacacacaaaaaagagaa

SEQ ID NO: 273105 - DNA, 528 bp, Homo sapiens
gcgagactgaataccagaacacagagtatgcacaactgcaggacatcaagacacgcctggaggtggagatcgagacctaccaccacctgctcggtggagagggaggttctgaggccagagaagctgaatctaaaggatgattctctgtggactccaaaggaataaccaacacagctcaatcgaggggaagagtcgctttttaaaattcacataaaagcagaggaaccaggctggtgacggataatgaccaactaatttcatctcaacactgtttctgatgtaaaattcaagagtaagatgcaggcagctgagtcctgtccccaggatgtaaatgatgacacctaacaaaggcgtgctgaagcactgcaacaaacctgcggccacagagctgcagctactcctgtaatcctttctcagattcttttgtcttattggttcggttttgtctttaaattgcaaaatgtgttttccttcttaatcattctgtgtcgataaactttttgcctgttgcaaatcaacaacatcaat

SEQ ID NO: 273106 - DNA, 398 bp, Homo sapiens
agtgcatccttgcagacacagatctccacggatgctgaagcagttagctcggccaagagtgagataatggagctgaaacaagtcctccagtccctccagcatgaactgcagtctgtcttggccatgcaaagctccccagaaggaaccctggctgacacagaagctggctacgtggctcagctgtcagaaattaagatgtaaatgatgacacctaacaaaggcgtgctgaagcactgcaacaaacctgcggccacagagctgcagctactcctgtaatcctttctcagattcttttgtcttattggttcggttttgtctttaaattgcaaaatgtgttttccttcttaatcattctgtgtcgataaactttttgcctgttgcaaatcaacaacatcaat

SEQ ID NO: 273107 - DNA, 457 bp, Homo sapiens
ttttttttttttaaagacagagtctcactctgtcacccacactggaatgcagtggcgtgatctcagctcactgcaacctctgcctcccgagttcaagcaattctctggactcagcctcctgggtagctgagattacaggtgcccaccatcatgcccggctaaagacatcaacttctgaaagactaaaagttggtgtctcttgggattcaacatgaaatttaggatggaattttctatttctacaaaaaaaaagaaatgctgttgggattttgatgggaattgtgttgaacctgtagatcactttgggtagtactgacatcttaaccatattaagtcttccactccatgaatataggaagccttaccatttattggtgtctaatttctttccacaacattttgtagttttcagtatacaaatctttcacctccttggttaggtttatgcctgagtatt

SEQ ID NO: 273108 - DNA, 221 bp, Homo sapiens
aactaacctttagagttgctaaataacgtgcccaaggtcacccagctggtaacggtcagggtcaggatccaaacctgagtgtgcctgattgcaaagcccacacgccgaggaatggtgccttcctccctttatgaatgtatggctttattaagagctaaccagcacacagcagctgcgcaaatgacaaatttgtgcgctaacatccaacagactgtagcctc

SEQ ID NO: 273109 - DNA, 490 bp, Homo sapiens
ggtcctaccagaggttgccatggatctacctctggaaactcatgaagcacatgacttagtgtggctctgacaactgttctcctgaggggaatgataccctgcaagagaaggtgaagtcagaagcctactttcataggtgcttgttctctgatgtctgagatgcagcgttctctgatgtctgagatcccattttattatatggccaaccagactgtgagctcaaactttgggatgctaaagggaatgaatgtggcagtttaaaaaaaaatacctttatattttagacctccatatttggctgcttagatcccagttgtttccttcctgagtttcaaatgtaagaatgctatagtcacaacacactcagacacaaaatcactgggtttcgatttttcttctggaattgggacatacatgagtgaataaaatatccctgggaaaaactctaaatatccaacaaactagtaaatcaagatataacaacacatta

SEQ ID NO: 273110 - DNA, 561 bp, Homo sapiens
gacaagggtgtttgctttccatggaccaaattgacatcacagagggccatcagaccagaaccatcttcagaggaccctgctcaagaggatgccggcagggacgaggagaccccagggaattgcctctctcccactgtgtgatgtcattgtgggatggtcaatacacatgcctatcctctctccagatgcagatgctaagaggactccattctgatgactgtctatatcaaggcctcctaccctcagggaattgggtgagctgttcctgttgatgaagctatggggctctcctatgggagataccagtatttgcatatgggacttggtgcctagattggagctggctttggggctaagctccagatatggttgccagaatatgaccttgaggaaatggagtattatatacaaatgtgaatgaaaaccaaaaggcagaagaatacacacagtatgctacgtttcacacaaaattaaacaccattccataatttgacaatatatttaccttattgaatatgtagacaagttacagtgaaaagtaaaggaattacaattacaaaa

SEQ ID NO: 273111 - DNA, 445 bp, Homo sapiens
gtttgcagagaggagagaatgaaacaggactgtagagagaagcagagacaagaaatggatcttcccatctcgtcatgagcttccacttccaggtcctcatctctctgatcctgtttcccatcgtctctttacccttgatgaagataaaattcctggctagacaccttgcttaaagaaattaaataaagggacaaaatcaaagagttggagtaagaagtgcacatttggttttgcagctaagctccagatatggttgccagaatatgaccttgaggaaatggagtattatatacaaatgtgaatgaaaaccaaaaggcagaagaatacacacagtatgctacgtttcacacaaaattaaacaccattccataatttgacaatatatttaccttattgaatatgtagacaagttacagtgaaaagtaaaggaattacaattacaaaa

SEQ ID NO: 273112 - DNA, 312 bp, Homo sapiens
tgtgagtttcagctctagatcaactgcaagaacaaaccagcaatctggagaggaaccacagatcctcggaaggaagtgaactgctcctgcgggattcgggagacaccccaaatactactgaaattattaactggcagcaaaccagccttcagcatacacatgatgacaatgcctgggaggattctgttggagaaacaagaaggaaggaaacttggatcttgagtgacttcatagagcaaactggtctggcataatggaacatctctatggactgctgcatgaatgttcgataacactttattttgtttgagc

SEQ ID NO: 273113 - DNA, 324 bp, Homo sapiens
gactttaatttttttttaaatgttgttactaggggaaggttctcttcttggaattaaacatacttgcagaagcactagatactatcctcattaggatttcaaagcatgaatgggtcccagagtcatgtgctgtttctgtgtctgttgctatagattacaaattttaagttaaagtttccattttacctagatcactgtgacaccaaagaactacaaattacaattgtggtttgtatagcaatttttctctgtagttcgataaaaatgaaacttcgtcaaataccaactggtattttaaggagtcagtagccgttgagaagtatt

SEQ ID NO: 273114 - DNA, 445 bp, Homo sapiens
agtttactagttctcgtaaccgaaaaaataatagcattgtcaaaatttaatatgcatctttagtttctggaactaactcatgttaaactattaagaagttagtttcttagcatctgctgttgttggactatgtccatccaaaatttaggtggtgaaacttcatggccagtgtgatggtattaagaggtggggcctacaggaatgggatttaaggcccttatgaaagaggctttatgcagccactagctctcttgcccttcagccttcaccatgtgaggacatagcattcttcccctctggaggatgcagcaacaaggtgccatcttggaagtggagagcagccctcactagacaattgaacccgctggtgctttgaatcttggactacccagcctctagaactgtgagaaaataaatttgtttttttataaattatccagtcctt

SEQ ID NO: 273115 - DNA, 484 bp, Homo sapiens
actcatgggcaatcttgttttatctattaccactcccccctgccccccgctccctgacagctccctcagaaataccatttccacctaccagattgacaaagatttaaaaaattgacagactttgttaaagaaaaagttaaaaaaacaggaagtctcatacattgctagaaggaatgtaaattaattacaatccctatagagagcaatttgttcttacccatcaaaactctaaacacttctatccagaaattctgcttcaatgattttattatgcagctgtacttgcacgtgtgcaaacagcacatccacagttattaattataatagccaattattggaaatacctaaaatgtgaaaactttgcagctctgaacaaaaataaggaaactatattgatatggagtgttctccaaggtgtattggggtgaaatgcaaggtgcagaacagtgcagcaatgtaagttcccatttgtataaaaaaagaa

SEQ ID NO: 273116 - DNA, 451 bp, Homo sapiens
tgaatactgtttagtgtaacactttattaagttacataggatgccaacatctctagggtaagcgtggaaaaaagagaatggtgtgtacaactgttaaattagtagaagaaaaaccatggaactatatttaaaaaaaaaaacaaaagcaaaatccaaatgaaggcaataaagaaaaaataaggctcaggaaaagcaggacaaatagcaaaaaataatatggtcaaaatgaatataaatgcattagtgcaatcaataattagtgtaatctgctaaacaacatacatcaactgaatattttacttaaaagacaatgactgattgaattaaaaaatagacaacatatgtccacacagacttgcatgtgaatgttcatagcaactttatccacaatagttgaaaaaactggaaatgacccaaatatccatcaacttgtgaatagctaaaaaacaaa

SEQ ID NO: 273117 - DNA, 270 bp, Homo sapiens
gggggcaagcagggtcctcaggagggacaagacaagaggagatgagacagcagggaaatcactccagagttgctgatctcttttgattaaagagaaaagattttgcagaggaaggaagatgtcaggagctgttgcagggcaggagagagccccaggcaaggagtttattaggacacagaacggccagggatagggaatctacatggggagggagccttggggagggagccttggagagggaacgactgtctcaggaagcagacaggtgtg

SEQ ID NO: 273118 - DNA, 375 bp, Homo sapiens
atatcaactacaaaattatattaaagttacataattaataaattattaaaggggagaacggttaactggccggcacagcacacagtggctgttccacatgtcagccctggacccactgtcttgggagaagatgatccaaggaccccagggacgctggggcggagacgggtagaggcgacaaagcctcctggggcgaggcatcacagctctctcagcctggcctccttgagtaccttgaagagagccagatttagaagaaatatgacttcagctctcaagatgggaaaacatctagccaagaggcagggattctggaaaattgctaataaattgttacttcctgctattaaaaggatcgataagataaggccagaa

SEQ ID NO: 273119 - DNA, 995 bp, Homo sapiens
aaatagccggccgaatgctctttttccagttctggctaagctgttagctgcagccgggcggcgacgcctgccaggtacctggctccgtgagcaccgcccaaactggtcaggccagtccgtcctgtggctgtttctgccaggactcgcccgagtgtgtgtgtgcgcgtgtatgtcagagacccaccctgctcccctgcaaccgaggtaggtggaaggcagttgcaggcaccagcctggcagtcaggccagatgggtggggctgaattaatctaacctggaatttcaacttggcctgcacaacaggtgagggaaaaaagcagcagagagaacgggcagtttggcaacttggaaatattcctgagccctgccccttaccccctgcctggaacgtagcccagggtgactcttcaaagtgtctgcgccgggttttagggcttagtcgccccacggccccctcgaggctgtccgaggccctcctgaacgctgtcctcctcagttaccctccgcgacgcgcccgttccccctcctctgggaggcagggcgggggtatcggattagtctttgttttcgacgcgaaagaatcgagcgcggcgcgggggaggctggtgatggcagggccgtggggtccacctggacagggcattcggccgtgacccctgcgagggtgcccttagcctctgcccccgagcaaccccttcttgccggccaggctgactcggtacgcaaacgcgcgatgtcccccattgtcctgcctcggaatgagccagcggcagctgggacaggggggtcagtcgggcccggcgctcaggcctcccgggggcgccggggctgtcccggacagatctggcccgcagggagtggcaggaagtggggacaccgagcgaggctcggccgagggcctaggctggaaggtccgcgtgccccaccccgcctcgccggccccggctgcagccccgccggagggcgagggtggccaacccgaagggggcggccgc

SEQ ID NO: 273120 - DNA, 747 bp, Homo sapiens
aaatagccggccgaatgctctttttccagttctggctaagctgttagctgcagccgggcggcgacgcctgccaggtacctggctccgtgagcaccgcccaaactggtcaggccagtccgtcctgtggctgtttctgccaggactcgcccgagtgtgtgtgtgcgcgtgtatgtcagagacccaccctgctcccctgcaaccgaggtaggtggaaggcagttgcaggcaccagcctggcagtcaggccagatgggtggggctgaattaatctaacctggaatttcaacttggcctgcacaacaggtgagggaaaaaagcagcagagagaacgggcagtttggcaacttggaaatattcctgagccctgccccttaccccctgcctggaacgtagcccagggtgactcttcaaagtgtctgcgccgggttttagggcttagtcgccccacggccccctcgaggctgtccgaggccctcctgaacgctgtcctcctcagttaccctccgcgacgcgcccgttccccctcctctgggaggcagggcgggggtatcggattagtctttgttttcgacgcgaaagaatcgagcgcggcgcgggggaggctggtgatggcagggaagtggggacaccgagcgaggctcggccgagggcctaggctggaaggtccgcgtgccccaccccgcctcgccggccccggctgcagccccgccggagggcgagggtggccaacccgaagggggcggccgc

SEQ ID NO: 273121 - DNA, 864 bp, Homo sapiens
tccattagatattcctctcctggcatttaggttcatcttttaattttgagatttctcactagggatcacaactgtgactttaacttaaaacaatctattcagagttaatgttctacctactaaatgtcaagaacccaacttgtgtgccacacatacatgtactacacatgccaccactgcatgcatagtatttaaaaactgccaagaatttggacagatcttatatgcgaatttttttggactcactttctttgtagctgcctctcttccaggatttacccactaagtttcttgctgttctgttagcccagaactctgtatccttacatttcatgcaaataaggttgtggtattcttcaccaagtagcaggaggattacagagcaccctcagacaaaaacccaccaactcatgaatttcacaagatagttatgttttaagaataggctctcctccagtttgtctgcttttgatcactctccagtacctttaaagaaaaattaatgtattttgtccagatattatcattgttatctataggaaggtaactctacagtattgcaccattactagaagccagaatgccacgttacttttactacataaactccattctgaaaatgacttaactaggtaatttatgctactattaggtgtatttttcctttttattttagtagcagctttattcagatataatgcccacgccataaaatttatcctaaaaggataagttccgtggtttctagtacagagttgtataaccatcaccactacctaattttagaacattctcatcaccacaaaaagaaatcacataccctttagcatttgttccccatgctccttcccacaacccctggca

SEQ ID NO: 273122 - DNA, 378 bp, Homo sapiens
aaaatacagtactccctgtctgcttcatctcaacaaatgactttctggcctagagccaggtggtggttagaataacctggaagtcatagagtagaccctgtaattttgactcaccttcagtgtacgctgtgttatatctgtcagttctcattagtatagtggtgagtacccccacctgtcactgtatcatgcctgactgtgagattatgcttttgtgtctgctttaatatcacatgaaccctttattttgttttccagagtgaaaacttgatcctttgtatgaaaaatgcttttatttatttatttatttatttatttatttatttatttagagacagagtctccctctgttgcccaagctggagtgtagtggcacgg

SEQ ID NO: 273123 - DNA, 315 bp, Homo sapiens
acgcattgccaaaaagggagacttacgcatcattcactaaagctttccaaaaactaaatcagatccaagaacagataaactcctgcagaatgacaatggtggagaaattgacctcccagcattgcagacttacatcagttgttctgatgttcttagttatatcagattccttccagaatcttctaaatatatcagacggtcagacacaaccccaggccctaataaaaaaccctgatgctggcctacagatgtgcaatttaataaactttctccatgattctggtacacatccaacatagaagaaccacttagtac

SEQ ID NO: 273124 - DNA, 220 bp, Homo sapiens
gtttgcagaaatacaccaaacgtgtgaccacccttcgtgaccggactacagcaataactaagccagtggggtaggaaggagaatcggatcaaaagttcacattttgatcaacgtcacatatgcttgagataaaacgctgctaacgtcaacactggactcaccccagtcatattaacattgacacgactcaccccagtcatattaacattgacaccaaaca

SEQ ID NO: 273125 - DNA, 296 bp, Homo sapiens
ggagaaagttttgtctatagcagaaaggctttatgtgtaatgcttgtcaggtttacgaacctgtaaccagcaccatgcctggcatgtagagagtgagtaggaagtctttataaacctataataatagaaggcatctcattgtcccatcaaaaacgtaggaaacccaaaagaatatgaagttgttatgttgttatttccttcttaagcttttaatttgaaaggtagcaaaggttctgctgtttgacatttctaccccctgcaattctgtcaggagaaataggtcacatcatggtggg

SEQ ID NO: 273126 - DNA, 294 bp, Homo sapiens
cccaccagcatattcaaaaggcacaggtcccctggcaggtgcaaaagaaaatgtgccatggagatgaaactgggggagggagttacgagtcaattactacttatgttgaactaaaagaagcccaaggcatcagcttcggctcagtcttctccatacaccccaagctgctttccattctcactcagcccctgactattcctcccattcccctgcccagtacaataaaaacagcatgcagttagcttcctccaccccggaggctgaccaggaccagaatcagcacttggatagtac

SEQ ID NO: 273127 - DNA, 481 bp, Homo sapiens
atgaacaactttgtaaatctttggtggtatctgtgtgatgatttcctgaagatagggctctaggagcagaattattgggttccagaattattaaggttgataacattgccaaattgctttgcagagcaattctgaatttatgtttctgtcagcactgtatgacaatgcctgcttggccctggctgtcactgtgttttcacattaaaaataatgataagtaattctgcatgcctcatggcatacctactctgttgacacactgacatggaacctttaaaagcagtggagctgggactaagggtggactgactatttgctttttctttttaacagccacctctttcctcagagggaagttagtaccagctgtcagtgtgccagcctgagtttacatagaaggtgtctaaatgtttacaaatgaagtatttgtcaattaaaatgtattttaatgaattatactgaaaatcttttgtaaaatgaa

SEQ ID NO: 273128 - DNA, 455 bp, Homo sapiens
tgagagagagagtcttgagaaattggcatattcactaatttagtgacttttttgtaatatcgtgtatagtcaatattagaagtgaggaggaagattttaactacttaaagcactggaaaataacaaagttatctttaatggaaaggtgatgttaatataaatcaaatttctgcctcattttctccatttgaaatcttaattgaatcctctgattgcggaagatattgaaggacataacccatatgggaatccacccgtagtagttgggtactttggaaacctttaggtacctgtagagcataaacaaattttcttagcatagtaattttctttaatcatatacattttatttagcaactacttgctgtgtgataatccctgctaaataaaatattggttttttttgtttttcattggaagtggagaactgtctaatgtagcataggttagtacta

SEQ ID NO: 273129 - DNA, 429 bp, Homo sapiens
gagtgcagtggcatgatcttggctccctgcaaccctgcctcccaggctcccatcctccctgcaacccatcgtcccacctgtgaagggaaaataaatcttgggcccccaaactcaagccaaagggaaaagtcaagctgggaactgggtcatgcaaacctgcctccccttttggtccctaaataagatgctgcaagatgaaaaactgcacacctcccctatattttgtccacaaggaaattcctagtgagctccgcaatctttactgtaaggtgtttctgttaagatttcaccacagcaatgcaaatcgatagctcatctttacaggtgcagtcaacccctgcccgccagacacaaatgcaaacctgattgttcccctgccccctttgtctaagtcatcttgtgtaaaaataatgcagattcaatgagcca

SEQ ID NO: 273130 - DNA, 503 bp, Homo sapiens
aaatgtgaaataaatctatgctatctttcatagtgttaccacacaaacatctaaaaggactacttttggttttgcaatgacagggtcgaaaaaagccccagatgggctggatttttttttttttctgatattttcttcctcaaagtccagttgctctccaagttcctacccctcccctgcccttgcctcagacctttaagaccaaagactgcaaaaccacagtgctgtacctgccacctccaaggactggcgtcgaggcccaacccaggaatgttggcttatttacctcctgggggaagcagtttaggcctcatcagagctggggagcacatcccttcagagcccatgggtttcccattccctcctgtcagccctggccatgaaatcctggggatctggagggagggaggatagttagagagtgagaggggcgagggctagccttttcctaatacccctgggtttgagtttaatttgcaataaaatggaatcccagcacatca

SEQ ID NO: 273131 - DNA, 1175 bp, Homo sapiens
agctacatttttttaaaaaggacacagtaagaactttccccgtgttttcacctgagttcttttgtaacagtggtgacaaaagttcttttcaacctggtatagaaaattcatctaatgccatttgagtctacatttgctctgttctatgatttgcttcttatagaagtatcttgtagccaaagtcacgaagtagatgagaattaccccgaaatttcagacctttgacatcagtgtggttgtgctgattgccaggttcataattgtgatttcattttcctaagaaaaatctaatgatacatcttcctattaatgattgatcagtcttccataaagtcaccaagatatttttttaaccgtgaaaatgtaaaatgtacagaaaataatgacactcatgtgcctaccacccagacttaccaaagcctttatcattagctgatagagtcacacgttcacattccctgtaatcatagttgtcctttccttccttaggtttagacaattgatttaatggacttaataatcatttaaataatttacataaagattgagtctttattttttagttaatggcttagtttgaactatgaaaagtcaaataattttggtcttttaagtttccagacttgatagtagtccataattttaaatgttttgaaatactttgtcttaatttttataagagttgagaacagctcactgatttgagcattcccttcttcccttgcctattttgtgaaatacttacagatggtcacgtgatgtgctagcagaaagtcaaaagaaggagcaaaaaccaccaattggtttaatcctttttctatatttactaaatatttattgagtacctactgtatctgaagtattgcaccatttttgttaatcaagaattaggccaggtgaggtagttcatgcttgaaatcccaacactttgggagaccgaggcaggaggaccgcttcagctcagcagtttgagaccagcctgggcaacatagtgagaccttgtctctacaaaaaatcaaaaaattaggcgtggtggcacacacctgtagttctagctactcagaggctgatatgggaggatcacttgcgcctgggaggtcaaggctgcagtgagctctcagtgcacctctacactccaccttgagtgacagagtgagaccctgtctcaaaaaaaa

SEQ ID NO: 273132 - DNA, 688 bp, Homo sapiens
ttgaggcatcagctcaacctctgggggctggagactgaggtcagtaggccatgtctgtatcaaaaggccccctgaagactctgggcatccaggcccaggaagctcacagttgccgtgctccatgcaccttgtcacaaatcattgctgggaggtgtgatatggtttggctgcgtccccacccaaatctcatcttgaattcccatgtactgtgggagggacccagtgggaggtaattgaatcatgggggcaaatcttttccatgctgttctcatgatagtgaataagtctcacgagatctgatgcttttataagggggagtttccctgcacaatctctctcttcacctgctgtcatccatgtaagatgtgacttgcttctccttgtcttctgccatgattgtgaggcctccccagccacatggaactgtgagtccattaagcctttttcctgtataagttacccagtctcaggtctttattagcagcatgaaaacagactaatacaaggtgttaccatggtgagtccacagggcaagaacaattagaaggtcggtacttggaaccttctggatgctacctcacacatctcttccctcggctgatgttttggggtttgtttgttttttttttttttgagacagggtttcactctgtcactgaggctggagtgacagagcgagactccatct

SEQ ID NO: 273133 - DNA, 697 bp, Homo sapiens
gcaaagggattcagatacctaggctttgtctttgtattaagcatgtctttattctgatgtttgacatcttggggctttgctgaccctagagaaactgcccctcccatggctagagatggtaagggactcacttgtgagcatgccttttgtataccaaccaaccaatccagagtctattttccaacttttttttttacagggcccttccagggttctcacgctccaggccactattccccagcccttacaccccactgacaagcccactgaaattattcacagtagccaattctaggcctgcttcctaccctgcctcgaccattccttccctcagaaacacagcaaatgctcctgcctacattttcccctccctgactctgccttctgaccaccctgaggcctccactcctggccctgcctggtatgacccgccctctctacttgggaactgtgagtaacaattattctttcgatagcaatcagatcctgatctcctggcctcaccatatgtgaatataaataagatctacatttgaaagccggctacatgctccctaggcttcaaacttgcaaactctaggcccagcgcaggagctcatgcctgtaatcccggcagtttgggaggcccaggtggggggagaacttgagcctaggagtttgagaccagcctcggcaacccaaggagaccccatctcta

SEQ ID NO: 273134 - DNA, 267 bp, Homo sapiens
ctcacctccccttgctacaagtcagtagttcagttgagatgatttaacccagattacacactctaaaggaaatttactttactgtcttagtttccaaatgttttacggtcagtttaattcatatggcccatatgtcttctgtcccacacagaggcagctgcatacttagtgccttttctcccttcccaaagaacattagaataaacagagcgttgcagaaagtgatgcctgtgtgtatgtgtgtgtgtgtaagagtgcacacatgca

SEQ ID NO: 273135 - DNA, 383 bp, Homo sapiens
tactccgtccgcggcctctcagctctagggccctctgcacactggcccccccagtgtcacgggcatccagacgggatccagtgcatcctcttttagaagaaaggcctgtctccagatccccgagtccctctagcatctcccagaaggtgtcagacgcagcagtgtccagggagcggcagcaggtccttatcatggtccaagggtccctcccagcctccaagtctcaccccatacatgaaaaaaggtggccccggtttcccgccacctcctccacagcaccatctctttgaaggtttcctcctgtttttgttttttttgttgttgctgttgagacagcgtctcactctgctgcccaggctgctggagtgcagtggtgtgatcca

SEQ ID NO: 273136 - DNA, 470 bp, Homo sapiens
tgtatatcagatgtataattcctatctctccctccaaatgcaattgtttccagcaagacttcctctagtctctagagtcggcaaagctaatacagtccttcaaggcctcatagcaccctataaattctagtgccatgtgatttaccatcttctactgaaataatatgcttatattctccccaacctaaattgcaaaagaggtagggtgttgtatttatcttaaaacaagtgcctgatgacagagagggctcaataaagatttattgttagaaaaattattagacatgtgaaaacagccaccctagtcgattgtcaatcattttaaggagaaaaagctggtccaagatataattcttggttgaagccacattgttcaactttgtagaagaattgcattgttatctgaaggtgactgtgttttggagccttgatgtaaatatccaaaataaaaactgcatgtttataaagta

SEQ ID NO: 273137 - DNA, 461 bp, Homo sapiens
agcaaatgttcctcccttgatgacagacctcttcatttcctcatggagaaaggtcatagggaatctacagacaaagtcagggtttctcttagaataagcttttgattaattctagctttgaattcacgttttgaccagctaaaacccttggagggatttctgttgctgactcttggaaaaaagtttgtcaaggtggcacctcttactttcatctaccaaactgaagggaatgaggctgaaagaatatgctgaaaaatctacttgagcccaggctgcatttttttttcctatcaactttatacatttcatgccttgtttcttaaaagaaaaaaatactgtaggtgaactttacaatgaatgctctgaacaagtcctttaaatgactctataatgagaaaactcttttgtatgaatttgtgaagttcacagtcaatgctgatcaataaattctgcacaagtta

SEQ ID NO: 273138 - DNA, 284 bp, Homo sapiens
cggaggaacaggatgatgagatttttctttaggggaagatgacggcagcaataagagtgttggaaaagtcaccctgaacaacttttgtaggtaacttaagggcagaaaaaaggaactctttatttttcaagtggcatcatggctatcacagctcatcagtgcctggaacaacacctttaataatgtcaataggaacgcttcgaactgctgcagaaattctgcttcctgaatgtttgaacttaccctcccatttaatctttaaaccatcccttcaagagagggag

SEQ ID NO: 273139 - DNA, 169 bp, Homo sapiens
gacggagagaagatgcccccattctagagagctgcagaggagcctgtgtcctcccaggacagtaggatggtgaaaggatggtccagagaagagagatggatatgagggcttaggatatgaggaaggtgggagatggaaccattaggacttgacactggggataaggcat

SEQ ID NO: 273140 - DNA, 845 bp, Homo sapiens
gcctatagtcccagctactcgggaggctaaggcaggagaatcacttgaacccaggaggctggggttgcagtgagccgagactgcaccactgcactccagcctggccaatagagggagactccgtctcaaaaaaaaaaaaaaaaagaaaagaaaacatagttacccagcaattccacttctaggcatatacccaaagaactcaaagcagggactcaaacagatacttggacatgaatcttcatagcaacactattcataatagacaaaaagcagaagcaactcaagagtccatcgatagatgaatggataaacaaaatgtggtatatccataaaatagaatatcattcagccataaaaggaattaagttctgatacatactacagcatagatgaaccttgaaaacattgtactaagtgaaagaggccaggcagctaaacttccaaagactaatatacaattccactgaataggcaaattcatagacagaggatagaataaaggctaatgaggggtgggggagaagagaatgggcagttattgctaatggatacaaagtttctgttggggatgatgaaaaaattgtggaactggacagtggtgatggttgtaaaacacggtgaatgtacttaatgccactgaattgtacacttaagaataaacttgtaaattttatattatatatactttgccacaataaaaatttttttaaaaatgtctaagtgtgacaaccgaacttctgtgttaggataggaagaatacttatgaagtattcttgcccctgaaatgaaccaaaatctaatcaagtctctagaataaacaaccagttcacaggaaatccacagat

SEQ ID NO: 273141 - DNA, 927 bp, Homo sapiens
gtcaatattttggtatgtgtccttctagtcttcccctctatagtgaatgataaatttaaaacgaatcatcacttctatccctatttctgtactaagatatcaaaatgtcgacaaaaggtttcagatagctcttcttggaaacatattttttgaacgtaaaaaataaaaacaaaaaaacagaagaggaattccacctccaaatgttttatatgccatctctattactgatatcaaggaccacctgaatctggtgaaatcctttcgacctcaatgtccacgtatagttagtactgtttccacactatatgtggcaatggtaacatactgaaaagcatgagaacttgagcaacagacaactgtatattaaatgaccacccatgatttcttttaaaggctgaaaaatctagttttgtcatcaaccatgggcctaaataaagtttgacccagaattcataacgaataaaagaaaaaaagaaagcactccaaataggtacaaaatggctctaactaaaatatctactaacaggataattccccagattttctttggtagaaatatttgcttaaaagtgtatttctaaagtacttctgtagctttctataaactagtgtcaatattgaagtgtggatataggccgatttttctttgtacaccttcactaacctataataaatccttagaagctatcaaaaagagattactcttttaaaggtcccatctggagtaaaattccatgactacaatagtcattctcgctacgctttcttataatttctaaagtaaatctagtagttactcaaataacatttttcctctttgagttttttttttttttttttttttttggacagggtggcgctttgttgccccaggcgggtgtgcgggggtgtgagtgatggccccccgcattggagggggttcccgac

SEQ ID NO: 273142 - DNA, 445 bp, Homo sapiens
gacagggtggcgctttgttgccccaggcgggtgtgcgggggtgtgagtgatggctcactgtagcctccaatcctgggctcaagcaatccttctgactcagcctctcgagtagctgagactacaggcatacaccaccacatccagctgatttttttatttcttatagagatgggggtctcactatgctgcctaggctggtcttgaacttgtgggatcaagggatcctccccctttggcttcccaaagtgttgcaactacagtcacgagacagtcactgtgcctagctgaaatatttttttaaagggagtaggggtaaggaccctgaccatcaagactttgctgaaatcctacccctaatgcataaaacaaaaatattatagaaaaatatctaggcctttgcgccactgcactccagcctgggcgacagagcaagactccatctcaa

SEQ ID NO: 273143 - DNA, 313 bp, Homo sapiens
ataatataaaacctatgatcttagtcaacatacacacctcccagaagacagatcccctctctttgctattaaattgtgttctgggcatgcaaagctaaagggtagcctctgtgacactatggtttgagttttcccatgacttaacccaagtgacacctacatcatcattgctactgtcaatattgtcagtaggcttttagcctatttggaatttataaaagtaaaaaatgtactaagctttgtagagtaccagggtcaaaaatatatttttaaatgattgttttaataaaagcgctatgaaaaattcaactca

SEQ ID NO: 273144 - DNA, 367 bp, Homo sapiens
ctgtatatggaacactaagataattaaatgaacctcataccaagaaaattccatgtcacatctgtccttttaaaaacctccatgaggctgggcacagtggctcacccctgtaatcccagcacttcaggaggccgaggagggcagatcacgaggtcaggagaccgagaccatcctggctaacacggtgaaaccccgtttctactaaaaatacaacaaattagtcgggcatagtggcaggcccctgtagtcccagttactcgggaagttgaggcaggagaatggcatgaacccgggaggtggagctttcagtgagctgagatcgcgtcactgcgctccaacctgggcgacaaagtgagactccgactca

SEQ ID NO: 273145 - DNA, 217 bp, Homo sapiens
ggctgttctaagcttgtttctgtgagtcacctggggcaggaggcagctgacaaggatcttgaatgtctgctcttgttctctctggtggttttgggttgaatagtttctgctctaactatgacctccagtgcaggtgctctggaagttaaatccagaaaagttaaagcccaaaagccccagacctcacttggaaagtaagaaaaacacatgggcatta

SEQ ID NO: 273146 - DNA, 288 bp, Homo sapiens
cccaaaatgactgtcagagaccagaacataccatccaaaaatgactgtcagagaccagaacatagcaccccaaaatgactgtcagagaccagaacacaccatcctaataaatgtatgcctttttggcataaggattattttgagaaactgaagatataggagaagctctgaaaacaagttgattctcttctataagagagatctatgtttataaaggagtcctccatttgtaagggtggctcctctctgcacctggaagaggacggctctcgtcactggaaaccccat

SEQ ID NO: 273147 - DNA, 463 bp, Homo sapiens
ataatctaccccagaggtcagccaaactactgcctgtgggccagatgtgatgtactgcctgtttttgtaaataaagttttactggaacacagctacacccatttgtttacatgtggtctctggctgctttcatgatacaatggcagaggagagtagctgcaacagaaacgatacggcccacacagcaaaaatacttactgtctgaccctataagaaagtttgccaacccttgatctacaccttctaattactttttggtcatacattttctttatgctgtgtttatctctaatcagaaatttaaaaaatttattttctcttagtactttgtatatttaagtgatattaacatatttgttataaagatgtctgataaaattcctcacacccatttaagataaaaatgtgatctgtatatattttctcagagatttcgcaaaattttaagtgcactatacaattg

SEQ ID NO: 273148 - DNA, 367 bp, Homo sapiens
ttaaagtttgtggaatttagacataggcttccttgggatctataaattgatattcatattggataatgttcttcattgagaaagagacaccatagacccacgtccaatgaagtttcggggttgattttcaaaaaatggtaataaatatgcaaaaatctatctatcctctttcaccccaaacttcctggaggcttgtgggttctgggtcctcagaagggtgtcagttttattgtctacaataaggttaaaactgggcacagtggctcaggcctacaattccagcactttgggaggctgaagtgggaggattgtttgagaccaggagttcaagactagcctgggcaacctagcaagactctgtctttac

SEQ ID NO: 273149 - DNA, 287 bp, Homo sapiens
cccaaatgttatcactcagagaagtccccctccgcaaacttccccacttaagtgtgctctgtgcccaggccctgggctaagcacgagatgtggaaaactgaccaagacaaaaaacagtcccaggccaacctgacctcacagtgtcaggcattaagcaagtaaccaagctgcccgcatcagcaataccttctggcccctgatttttctgtctctgcgatttaccttgccctgatctagcagacttaaagggatcagtttttggggctggcacggcctgagaggtcaaa

SEQ ID NO: 273150 - DNA, 456 bp, Homo sapiens
cagagggatttagagcaggcgttaagcttgaagctctgaagtctgctgtgagaatgaaatgagatagcaaagctgtgcctgaagtcatgtctaccctttggactttctcttcaatttaagtcattttgagtagtgtttctgcctcttggaatctaaaggatccacatgaatgtaatgaagttatgtgccaggtgctatgaggcgatgagaaggaagaagagtatgtaccactgtcttcctggaggaagtgacacaggacctgagtcttgaaagcccagtaggacttagccagctcaagggattctgagcagagtgagccacataagaaattacgtaggagcatgacagtttgtgccgtgttttggagatcaatgcagttcattgttattggagtgaggttggcagtagtggaacattaggtggatgaataaatgtcactatctccgtccccaaaat

SEQ ID NO: 273151 - DNA, 534 bp, Homo sapiens
agtgtcgaggcgagcccagcgcacgtgacctgactcactgccttgactcagttgccgtcagggaactcccactaacagggtcaggctgttcaactgaagaaccggatgggaacgcggctcggcccccagcgcctgtgacccatgcccgccgggtgggcacggcggcgggcggcgtgggctctgacaccctcctgctcgccgcgctaaggaactccactggccagcgcgtcctgccgcggcgcagggccgcccaagtcaaggaaccctctcgggtctctgagatccaggccaacagtaaacagagcgtccgagacgggtggccggggcgggcaacccggccagaggtcacgcccgacgacctccgacctctccaagccgggtggggtcttggcctgctccgggggcctgagcgatgccgggtgtgcccgcgtggccagggctgggactggagcctgcccaggaggacagggaggacgcgaggccctggcgaccgaggggctgaggggggggatggggccaggccgccggccgggc

SEQ ID NO: 273152 - DNA, 332 bp, Homo sapiens
ggggaggttggaatcatctgactcccgtcttgactgagtctggcagccaacatggatgttggctgggacctcggtgaggactgctggcaagaacacctacacacggccttttcctttgactgctggccttgctcacagaatggtgaccgggttcccagtgtgaacccaggtacaggaagagacaggaaacggaaactgccagtttccttaaaatctgggcccactaactagcatggcatcatttccaccatcttctattagtcaagcatcacgaagcccatattcaagaggagacaacctagacccagcctctcaataaacagtgtcaaagg

SEQ ID NO: 273153 - DNA, 585 bp, Homo sapiens
agcttggctaaggtgaaaagggacttgctggagaggtacagcagaatgggatgggattagaaaacaacaatctattaggaaagatgaaaggaaggaattccccagtgttcacgctgagaagtcttcatattggaccagtgtgagggggtcttttatactgaggttttaaaaacctgacttcattttgtcctgaatgtagaagtgaagaaggacactagtttcaggcacctgggatggtggaaaagtttattcaactgaggctttccatgcattgggttgaatagctgagggaagctgaagactcttatctgaaaatatgatctgaaaatatttattgtataggaagacagaatgcctgatttctgaagttttcttgatggcccaactaaagaagaaaggcaccaaatcctcactttaacaggtaaatggagatcctgagggctggatacccaagagccaccattttacggattcctcagatttaaaaatgtctcagatagatatttccaaattctatttctattagcctctgtggataaagagttcctgaaactctggttttactttttttggaaaaaaaaaaaa

SEQ ID NO: 273154 - DNA, 377 bp, Homo sapiens
aactacattggtcctagcaaaacttttaaatagaaaagaaattgtataaaaaaatcagtaatcctttaatctagttccagatcttaagtgtactttcttcatgaccttagataaatcatttaatagcatggttttggggcatctgaggttaatctgcaaaggttaacatcactgttaacttctatctctatgcccttgcatacagcaaagtggcttgtaactcctgtaagattcagttcctcatatacaaaatggggataaaaataaatgcccacctaatagtgtcactgtgaacataaaatcagatagtacatgtgaagcacttaaaggggtatatactaattgctcaataaatgtcagtcttgaataatcttggg

SEQ ID NO: 273155 - DNA, 1354 bp, Homo sapiens
ttgtttacaaaaacaggcggcaggctggggttggtggggcttgtgtttaattaacgcagcacacaaagtcttatgacgtcgttttactcttttctctcaggaaacaattctggtgaaatgtgatcgtcctggccaccctctgattgataagacatatcattttgaaagatatactggccttcccagctgacatggacctcaggtcagcttcagcgtgagaagcaggccaggcctgggtctggagccgtcctggccttcccagatgacatggacctcaggtcagcttcagcgtgagaagcaggccaggcctgggtctggagccgtcctggccttcccagatgacatggacctcagggtttatggtccagcagagtctcagagcgcggtctttggagatgtgtgccccctactcacttctctcttggatgggtacaatgtttgtgttatggcgtatggacagacgggcagcggaaagagctataccatgctgggacgccattcggacgacggccctgttctgccgcttgacccacagagtgacttaggaattatccctagagtggctgaggagctcttcaggctcattttggaaaatacctcaagaagcccaaaggttgaagtctccatagtggaagtttacaataatgacatttttgaccttctggccaaagacagcattgcagcagtgtcgggggtcaagcgtgaggtggtgacagccaaggatggacggacagaggttgcgctgctggcctctgaggctgtcggcagcgcctcgaaactgatggagctcgttcatggaggtctgcagctcagggcgaagcaccccaccctggtgcacgcggattcctccaggtctcacctgataattacggtgactctaaccacagcctcctgctctgacagcactgcagaccaagcctgcagtgccaccctccccagggagcaaacagaggcaggaagggcaggaaggagccgcagagcttctcaaggggccttggctccacagctggttcctgggaaccccgcagggcatgcggagcaggtgcaggctcgactacagctcgtggactcggccggcagcgagtgcgttggaggcgatgcgaagttactggtgattctctgcatttctcccagccagaggcacctggcacagacgttgcagggcctgggtttcgggatccgagctcggcaagtccagcgaggccctgcccgaaagaagccgcccagctcccaaacggaggggaagaggaggccggattgaatgcattaacaagtttttctcctaaaactgtgtttcttgtccttgctttataatgcatatgtgcttagaaataaacaggtttcacgtggactc

SEQ ID NO: 273156 - DNA, 1510 bp, Homo sapiens
ttgtttacaaaaacaggcggcaggctggggttggtggggcttgtgtttaattaacgcagcacacaaagtcttatgacgtcgttttactcttttctctcaggaaacaattctggtgaaatgtgatcgtcctggccaccctctgattgataagacatatcattttgaaagatatactggccttcccagctgacatggacctcaggtcagcttcagcgtgagaagcaggccaggcctgggtctggagccgtcctggccttcccagatgacatggacctcaggtcagcttcagcgtgagaagcaggccaggcctgggtctggagccgtcctggccttcccagatgacatggacctcagggtttatggtccagcagagtctcagagcgcggtctttggagatgtgtgccccctactcacttctctcttggatgggtacaatgtttgtgttatggcgtatggacagacgggcagcggaaagagctataccatgctgggacgccattcggacgacggccctgttctgccgcttgacccacagagtgacttaggaattatccctagagtggctgaggagctcttcaggctcattttggaaaatacctcaagaagcccaaaggttgaagtctccatagtggaagtttacaataatgacatttttgaccttctggccaaagacagcattgcagcagtgtcgggggtcaagcgtgaggtggtgacagccaaggatggacggacagaggttgcgctgctggcctctgaggctgtcggcagcgcctcgaaactgatggagctcgttcatggaggtctgcagctcagggcgaagcaccccaccctggtgcacgcggattcctccaggtctcacctgataattacggtgactctaaccacagcctcctgctctgacagcactgcagaccaagcctgcagtgccaccctccccagggagcaaacagaggcaggaagggcaggaaggagccgcagagcttctcaaggggccttggctccacagctggttcctgggaaccccgcagggcatgcggagcaggtgcaggctcgactacagctcgtggactcggccggcagcgagtgcgttggtgtgtctggagtgaccgggttggccctgagggagatggcgtgcatcagccgcagccttgcggccctggcaggcgtcctgggggctttgttggagcaccgtggccatgccccgtaccggaacagcaggctcacccacctccttcaggactgcctcggaggcgatgcgaagttactggtgattctctgcatttctcccagccagaggcacctggcacagacgttgcagggcctgggtttcgggatccgagctcggcaagtccagcgaggccctgcccgaaagaagccgcccagctcccaaacggaggggaagaggaggccggattgaatgcattaacaagtttttctcctaaaactgtgtttcttgtccttgctttataatgcatatgtgcttagaaataaacaggtttcacgtggactc

SEQ ID NO: 273157 - DNA, 835 bp, Homo sapiens
ccgtctagatgggagtgataaggaccaagtatccctgggagaagaaaacagctctggtagcagatcactcaagcccgggaggtgtaggctgcagtgagctatgatggtgccactgtacttcagcctgggcaacagagaccccatctcttaaaaacaaacaaaaaaaagctctaagatctagtgccacctcctacaggtaggcacccggcgttctaggtaccctgctagaccagcccttccctgactccaccctgctgtagaatgatggcctctttctttctcttccaccaggctctagggcttggcagaggaaggggcaaggtatctctgcatcccttggacccagccacaccccaacacagagtgaatgtttcctaatgccattccctttccacaactccactccacgagagagaagtgacttaagcctgctaaggagcggagggaaaagttcaggaaggtttcagcgtgctatcattagcgctatcattagctcttgaggactgaataggaatttactaggggtgggtgggggagaatattccaggcaaatggaagagaggtagatacaaaggcacagaggtatgtagggaacaataagggaaattgtgtatttgctgggggagggctaaagatgaggattcaaggccaggagcagtaatcccaggactttgggaggtcgaggtgggaggattgcttgagcccaggagttggaggctgtattgatctatgatggcgccactgtgcttggccaatctagtaattatttaaagtacttcctgctattctaaaaaaagtttattcccatctccatgataaatggcgggtcatttca

SEQ ID NO: 273158 - DNA, 501 bp, Homo sapiens
ccgtctagatgggagtgataaggaccaagtatccctgggagaagaaaacagctctggtagcagatcactcaagcccgggaggtgtaggctgcagtgagctatgatggtgccactgtacttcagcctgggcaacagagaccccatctcttaaaaacaaacaaaaaaaagctctaagatctagtgccacctcctacaggtaggcacccggcgttctaggtaccctgctagaccagcccttccctgactccaccctgctgtagaatgatggcctctttctttctcttccaccaggctctagggcttggcagaggaaggggcaaggtatctctgcatcccttggacccagccacaccccaacacagagtgaatgtttcctaatgccattccctttccacaactccactccacgagagagaagtgacttaagcctgctaaggagcggagggaaaagttcagggccattcacgcctccgggccatcacgcctcctagccattcgacg

SEQ ID NO: 273159 - DNA, 400 bp, Homo sapiens
ccaggagttcaaggccagcccgggcaacacagtgagacccccatcgctacaagaaatttaaaaattagctgagtgtggtggtgcgcacccgcagtcccaggtgcttgggaggccgaggtgagaggattgcttgagcctaggagttcgaggctgcagtgagctatgatggtgccactgtacttcagcctgggcaacagagaccccatctcttaaaaacaaacaaaaaaaagctctaagatctagtgccacctcctacaggtaggcacccggcgttctaggtaccctgctagaccagcccttccctgactccaccctgctgtagaatgatggcctctttctttctcttccaccaggctctagggcttggcagaggaaggggcaaggtatctctgcatccctt

SEQ ID NO: 273160 - DNA, 468 bp, Homo sapiens
aagagaactaaaggtttataagagaaccagaagttggttctctgtgataatgtagttctgacccatgccactggcctatttttggaggtcaagcggggaggagctaaatactatttttctctccttgttcaaaaaccttgtcatgaagcctccgagatgagacatcagccagggaggactagtcctccatttcccccaacacccaggcgggtatttttatttaatatctgcataagcaggcggttgcttggtgcctgcacgtgtcgcccagtggtggggaaagcagaagtgtgtggctcaacggctccaggcgccttctgggatacttggttgcctgttgttctgggtcacagcaatggcattgcggccagggccgtgctccggcagctggcttagagggacagatgggtggggctgggtgagggtgttctgctggccagcacagacactttcaaccagggtcccaag

SEQ ID NO: 273161 - DNA, 403 bp, Homo sapiens
aggtgaaagtaattctatgttttagtttattaaatagaatggagttcttaggtgaaatgaaagtgatattccaaaaagaagcccagaaaatcaaaacaatctaagtaatgagatcaataacaataaaaaaaatgtggaccctacctccattaattatttattacatctttggttttgctccagtcagtctttctaaaactcatgctcatttttgagtggtgataatacaagtatttacctggtagagatgtgagtgttaacatgaaactcacgtgacagttaacatgcataaagaacttaagtttagcacagagctcgttacatagtaagagtttaatgatgccccatgcatagggagaaactgctgaacttcacaatgatagcactgatgaaatgttatatt

SEQ ID NO: 273162 - DNA, 275 bp, Homo sapiens
agcaagcattcttttttttcaaaataaattaatccttactctggtggtttgagattatgcactgtattatacaacagcgccttatcaagcctcatcagtgaagatggaattcatgtctgtaaaatgctgcaggcaatcacagtttcatattttatcatgttgataaggatatcgcacattctctgaagcatttcaaaacacttaaatgaaaaaggagaaatgcaactaaaaggctttttatatggtttgttgtgggttattatgagttatttata

SEQ ID NO: 273163 - DNA, 449 bp, Homo sapiens
acactgagcacccttatgccaaatgcattaaacattagataaaatggatgaacacctagaaaactaaaggaaaccagaactgggtcaggcaggaaaagaggctggatgtgatgctgcatgcttgtagtcctagctactgggaaggctgaggcgggaggatctattgagatcggaagttagaggctgtagtgagccaggatcaggcctgtgaacaacgttgcatctcagcctggacaacagggcaatacagagagacttcctctcaaaaacaaaacaaaacaaaacaaaacaaaaagcatgagtagccctatcaaccaataatgaaactgaattggtatttttcatccttccaatacaggtaacaccaaagccagattattttacagagttctcccattattcaagaaacagttaattacagtcttacacatactctcccagaaaatgga

SEQ ID NO: 273164 - DNA, 685 bp, Homo sapiens
tttaggccaaaacaaggtctggttgtctttattatgctgtgattccccacctgttaatgaaatggacctgcagttagagggaaactccagctgggtgaataatcaccaacaggagctaaaacatatggtttggcttcttacatcaggggccatgctcaaagccatggggcagacggggtgcctctccctgaagaggtaatcattacatgtactcggatttggggatgagaggggagagaatacatttttaatatattaaaacaaaattggataatggtgctttggagactgatccagagatttcaaagaaggctgcttcagcttatggggtgggggagtaaaggttctgctgcctttaggagcaattctggcaagtcagagattcactaggtcaagttttttgtattcggccagttaatcctattttttttttttaggacggtaagtgttttcaagttacttattcaaaggtcaagtacttttacccatactatggtcttatatcatgctgtccaaggatggtgaactcagtatgaaagttagaggctgttcatttcctttgttctttatcttagaaatcggttaactttctaatttttgtttacatagtaatagactttgttgatcttactccactgtaacaacatttattttaaataaacttatcagagacttttcttacctc

SEQ ID NO: 273165 - DNA, 480 bp, Homo sapiens
ccttatctttgtcacctgattttcataccactttcttcaaaagacagtggctagtttatctttggtatttgtcttgcaaaaggactttgtgtgtgtgtgttttacttttaattaccaaaaatttcaaacttaaaaattgagaggatagtagtactctgaacccccatattctacctagtcattcatcaactcgtggccactgttgtttcatatgtattctatccataactcccatcctgggtgataagagtgagactgtgtctcaaaaaaaaaaaaaattatttactgtaaaatagaaataatgatatattctttgtagggttgttgtaaagataaagatgtttataaagtctctggcacaaaataggtcctcataaaacaagagctcttttttcccctggaatctattgatacagtttaattcagcaagtatttattagcatttaatctgtcctagactctgctgaggatgctgaagag

SEQ ID NO: 273166 - DNA, 295 bp, Homo sapiens
agcacactttccaggctgagcatttccttttgtgcatcctctccaagccctgaacttactccagttggcctcttcagaccaagctctccctcccagtggcctctacaggccaaaattgtcctcaggtcagcctctccagggccaactcctagctaccggtggcttctgcaggccaaaatcgacctcaagtcagcctcttcacacccagctcttgcctctgagtggcctctccaggagcaaaactttctcaagtcggcctctccaggcccagcctcctgcttcccgagggcatgta

SEQ ID NO: 273167 - DNA, 491 bp, Homo sapiens
cggaagccaaggaacacccaccacacccctccccatgctccgtgcaggatgtcctgtgttcacgccagggcaggcacaaggaaagtcagcacggccccatgttcccagcagctcagtctcacctgtgagtggcaggagtgcgaggtgtgagttggatgagggctttggaccccagcgctaaggtgggctacgtggagctcccaggatgctggggtcacaggccccagtgagcctgctgaaattgtagcagagactgtaatattttatctagactacaagacataaatttgctgtgtgttcttgcactaccaactttaataataatgtctttgcatgccatctattctctcatgggcaataacacagatacaaacggtcctgagtgctcagcgctgctgggttttggggtctgctttaggggaaacatttccaaaacctgccgtccggtgcgtttgctcttctgaaaaacgtccccagaaccagcggccgcc

SEQ ID NO: 273168 - DNA, 222 bp, Homo sapiens
aaaataaactaatcattctttgttccctagacacacactttactatttttacatttcatttggtattgaccctaagcttcaggacttgtatgtagggaatctatttgacatttctatttcaaaagctttcacacgagagaatgaatcattcacacttaattcctgaagataagattccatttgctttaactcttaatttggttgcattatattctactacta

SEQ ID NO: 273169 - DNA, 995 bp, Homo sapiens
ttaattattagatgtcagtgctagtttaacttattttaaacgtttcagatatttatttaattatactttaagtgtctcatgtaaaaaagttatttataaaataatttatagggttagagtcattgcccttttaatgcaacaaataaacagttttttaaaaacctgcatgggggccaggcgcggtggttcatacctgcaatcccagcactttgggaggtcgaggctggcggatcacgaggtcaggagatcgagaccaccctgattaatgcggtgaaatcccgtctctactaaaaatacaaaaaattagccagacgtggtggtgggcacctatagtcccagctactcgggaggctgaggcaggagaatggcatgaacccggaaggcggagcttgcagtgaaccaagatcgcgccactgcactccagcctgggcgacagagtgagactccatcgcaaaaaaaaaaaaaaaaaacctgcatggaagcctagtatatttattaataacaaataaattatactttagtgtactattaacctataccaattttaagttgtgattagggaatggggatgtttttaagctgaattgtcttgctgcggaactttccttttttaataagaccatattatgactctgaatgctcaagggtaagtctaaggcctcattgctgttaccaggagatttttctagttacagtaataaagatgttaattcacatgcatgcagacaactgaaactcaagtggagaatttgtttgtgaacaagtcatactacttctgttatttgcatgaatggaatctgcaatatctttttccatgggagaccctaaaagaaaaccctggatcagaatgatctgcagtttcagataataaaggcttttaagagacatttttagaattaaaaatatgctaattttattaaatgaaaatatttgtaactgttaactttctcactgacaaagcaagtttctcaataaaatacctattttaacttgca

SEQ ID NO: 273170 - DNA, 2566 bp, Homo sapiens
ttaattattagatgtcagtgctagtttaacttattttaaacgtttcagatatttatttaattatactttaagtgtctcatgtaaaaaagttatttataaaataatttatagggttagagtcattgcccttttaatgcaacaaataaacagttttttaaaaacctgcatgggggccaggcgcggtggttcatacctgcaatcccagcactttgggaggtcgaggctggcggatcacgaggtcaggagatcgagaccaccctgattaatgcggtgaaatcccgtctctactaaaaatacaaaaaattagccagacgtggtggtgggcacctatagtcccagctactcgggaggctgaggcaggagaatggcatgaacccggaaggcggagcttgcagtgaaccaagatcgcgccactgcactccagcctgggcgacagagtgagactccatcgcaaaaaaaaaaaaaaaaaacctgcatggaagcctagtatatttattaataacaaataaattatactttagtgtactattaacctataccaattttaagttgtgattagggaatggggatgtttttaagctgaattgtcttgctgcggaactttccttttttaataagaccatattatgactctgaatgctcaagggtaagtctaaggcctcattgctgttaccaggagatttttctagttacagtaataaagatgttaattcacatgcatgcagacaactgaaactcaagtggagaatttgtttgtgaacaagtcatactacttctgttatttgcatgaatggaatctgcaatatctttttccatgggagaccctaaaagaaaaccctggatcagaatgatctgcagtttcagataataaaggcttttaagagacatttttagaattaaaaatatgctaattttattaaatgaaaatatttgtaactgttaactttctcactgacaaagcaagtttctcaataaaatacctattttaacttgcattactgacatcttttctttgagtaatctgaataatgcagaagccatcatagaggtcttttctatacattctcaatgttttcttaaatgggtttcctgagttctgttcttcatgactctgggctctgcaaacagggtttcccaattacgcattctataaacacttttatgaatgagtcaatatgacattgagtccttttcatacatttcatcatttccaatatgtagagtgacagctagaaaaatgataaaattttgattaaaacctatctctttttcttcagcatagtcaattgttttcttaactctcaatgagtaactccatgcctagcttgtgcttagctttcaatatttttagactaagacaaagtgtatttggcattttgagaacaacaattaatggtcagtaaatttctaaagcaagaaaaatgtgaaactagtgttttatatgtttgttacgcagcagaatgcggctcttagtgtttgccccttcatatctcatcatgtaaaatattaaattactttaggccactgcacataggtagtcctgtcatgagtgatggctggagaaaagttcaggatcataaatgttatcatcattcttcaagaaaagatgagattataaatttctgcaattggtatgataaaaggttgaaataattaatgaaaaagaaaacattagctctgtagacctgttttgggcacactttacaagaagaaactaactctccaaaattctaggctatgtagttatttctaaagcaaaacttttgattcatgattaacatatataagctggtgttttcatcaaagatcaaacaaaatagccttgtctagaatactcgtattattcccctggcttattaagtaatggtaaataataccagtatctaagaggtgacaggttgacctgagacttatcaaaggataccaagttgtgcagatagattgtctagctagtttcttcaactttacatttctacaggtagagaagagggctgtgtaaattcttcccatcagtacttgaatattcatttaacaaatatgtatcgagcatctagcatgtgccagacacaatctgaacactgagcacacaacagtgggaataaatatgattcctatctgcatggagcttctattctgtgaaaaacagatgttaaacatgattgacctgtgaccaggatcacctgtgcctccaagagtattagagagaccttctggtgtgaggaaaactcccctgaggaagtcatattttagcaaaactctaaagggtgtcaagtattacttatataaaagggagcacatggaatgaatagtgcaagcagacaaatacggccatgaggaaggcacattcaaggacatgaaaaagcagcatagtagaaacctaaaaaacaacggttgaaggtgtaataagatataaatgaggcagatcagtgggatccctttggtatttaaagaggtttaggctgggcacagtggctcacgcctataatcccagcactttgggagggcaaggcaggtggatcacctgaggtcaggagttctagatcagcctggccaacctggtaaaacc

SEQ ID NO: 273171 - DNA, 1282 bp, Homo sapiens
acacggtctcgctctgtcacccaggctgaagtggcagtggtgcaatcacaactcactgcaggcctccaacctctagggcttatgtgatcctcccacctcagcctcccgagcagctgagactaccggtccattgccaccacacccgataatgttttatatgtttgttacgcagcagaatgcggctcttagtgtttgccccttcatatctcatcatgtaaaatattaaattactttaggccactgcacataggtagtcctgtcatgagtgatggctggagaaaagttcaggatcataaatgttatcatcattcttcaagaaaagatgagattataaatttctgcaattggtatgataaaaggttgaaataattaatgaaaaagaaaacattagctctgtagacctgttttgggcacactttacaagaagaaactaactctccaaaattctaggctatgtagttatttctaaagcaaaacttttgattcatgattaacatatataagctggtgttttcatcaaagatcaaacaaaatagccttgtctagaatactcgtattattcccctggcttattaagtaatggtaaataataccagtatctaagaggtgacaggttgacctgagacttatcaaaggataccaagttgtgcagatagattgtctagctagtttcttcaactttacatttctacaggtagagaagagggctgtgtaaattcttcccatcagtacttgaatattcatttaacaaatatgtatcgagcatctagcatgtgccagacacaatctgaacactgagcacacaacagtgggaataaatatgattcctatctgcatggagcttctattctgtgaaaaacagatgttaaacatgattgacctgtgaccaggatcacctgtgcctccaagagtattagagagaccttctggtgtgaggaaaactcccctgaggaagtcatattttagcaaaactctaaagggtgtcaagtattacttatataaaagggagcacatggaatgaatagtgcaagcagacaaatacggccatgaggaaggcacattcaaggacatgaaaaagcagcatagtagaaacctaaaaaacaacggttgaaggtgtaataagatataaatgaggcagatcagtgggatccctttggtatttaaagaggtttaggctgggcacagtggctcacgcctataatcccagcactttgggagggcaaggcaggtggatcacctgaggtcaggagttctagatcagcctggccaacctggtaaaacc

SEQ ID NO: 273172 - DNA, 774 bp, Homo sapiens
gcaggaagtatctgagcggtggttccggtacaaccctcgtctcacctgcatctattgcgccaaatctttcaaccagaagggaagcctggaccgccacatgcgcctacacatggggatcacaccattcgtctgccgcatgtgggcaagaagtatacccggaaagatcagctggagtatcatatccgcaagcacacaggcaacaagccctttcactgtcatgtctgtggcaaaagtttccccttccagactgaaacatccagggggagggggctgaccctcttcccctatgagccataagcagccagcatcagagccatgggctgatacttagattcacaaaatgccacatcactaggccagaagatgctcccaagatgttgccaaactggaggatcagcaacttacacaaaagcactaaaggctcctcccttcttattgcccgcctcacactttggaaaataatcaagcaaatcaactttctaattcagggatcaacagccttggtttgttaactttataagaaaaaaggttttttaacaaaacgatgatgataaatggtcatttatctatcagtcatgtttgaacactgtactttggtccatatcatcttggtggctataattgcccggatctaaaaaatgcagcaggagcctcaaccatccgaagcagccaaccgcaagagaggaggtagtcatgatggtgatgaggaggagaaatttctcctcttccttccctggcataacatgcatttttgtgtttcaagaaaaaaatgaa

SEQ ID NO: 273173 - DNA, 450 bp, Homo sapiens
aacaccacctctagcatgaccatatacacagttgccagaaggggccccttggtctgccctctcccctggcattgtggtgaatgcctgcagggagggaggcaaccaatagcatgctactacagctcctgctacccctgctgacatgtgacaataagaacagatcctgctgccaccaaaatacgaaacgttttggctgacataacccatcagagtgtactgcccaggagatcaggagcaccttcaatccccagcgcagtggattcctaacaatcaggagacagagaacaaagccagggccaaatacaagtcctacagaattacagcaggcagtccaggagctgggaactgagcattggccccataaaatcttgtagaattgaagccagtcagctgctaccttcatgttataccaaaatgaaaccctcaaagtcatcaaatagtataaaagat

SEQ ID NO: 273174 - DNA, 1084 bp, Homo sapiens
caaacaggagatgttggcggatgctgtccattgacagggtggttggagaaatgaggatggtgtgctcagagaccccaccacccctgctagaaggaaagttaagtttggatggaaggggaatagagagaagtcttaagacaggagctgtcaaactatgaccagcagtagttgggacccagctacacttgctcacagatgccttgtctgtgggggactgtgtggccagcaaaacccagaacattttgacccttgacagacattgccaactctgccttagagcactgtgctgcactgaccacaggagtgaaaaggccacacttggagcccacatagcaggtcccccatggcctggtggtatggacgagtggggaggctttctgctgcccccactctccccactcagatccttcttttttttagttacttaagaatcatcatttagcatgagtgtgttaaatgagtttatttcagcacatttcagtgcatctgtgactcaccctagacattcagtgctctacgtgtgcccaggctggatgcctgtgcaagaagaccatgttgtttgtgacatgggtggtcactagttttatgttttagtgtctgactttagctctgtcttcctttcctttttttcccgctgctattgcattattcatttttccttttcccccagtttgctgctcattctgtagatacataccttggtgagcctcactggagagctgtggcacctttcagagtggagactggtgggggcagagcttaggaatgggtcaggcacaaagaagtagtgcagacttcttaatatggttggctttttccctcagtgctcagtgtttcaaaggaaagatgcaggccaggcacggtggcttatgcctgtcatcccagcactttgggaggctgaggcaggtggatcacgaggtcaggagatcgagaccatcctggccaacatagtgaaaccccatttctactaaaaataaaaaaattagccgagtgtggtggtgtgtgcctgtagtcccagctacttgggaggctgaggcaggagaatcacttgaacgtgggaggcggaggttgtggtgagctgaga

SEQ ID NO: 273175 - DNA, 408 bp, Homo sapiens
aactgagaaaggctacgtgactaagtgacttctttgtttcaatgctgactaaagctgtgatgtcctttttaatcactttgaaagattcaaattgctttaggaagacaattcatgcatggagctcaccctcccagaactccacacttaatgcccactgaggaaggagagaaatgcatgcaaatatatatcccaatatagaaggaatattctagttcagtaacttccactcctgagcttttatcaaatttttctctatagaattatttttgttttattgtatccaaaatgtcagatatctttttcaaggaaggtcaagggactttgccattttctaagccagaagtattctcacctagtccagtactagtcaaagtttttagtaaatcacttagaatttccttttttaaa

SEQ ID NO: 273176 - DNA, 956 bp, Homo sapiens
ccggcatcccagaatactggcattacaggtgtgagccaccgcgcccagccagttttgcatgttctgagtgggaaggtaatctggagaacgggcagccaggcttccttgttgaatgcgtgagagggagcaggctggtaactaccgcctttgtcaaagaaaggagggtttccttctatattcttcagtccaaccccttccccgctttttaaaaccatccttgagtttcagagttagctcctgatctggtctgcttctctttcaggtccattcacctttgcaagccattctaaggctatcacccattttctttggggtattctttggttctatggagcaaccaaaagccacccttcccggctttgtctgtgagagaggggacacatgtaactagtgccaccgttcactttcattcttgaacgaattgccctaacagttaccccctcagcttctcctgccctttctatttcttgattcagcttggagtttcttcaaggtgctcttgggaaaaccacatttacctttggtaacttgtactgccctttccttctggtttctctgttaattcaaacttgtttctgtcttcttggaattcctccaaatatttgctccattgatgtcatgcatcccttcttgttttccaatgttattgatgcattctttaaaaaattttaaagaggccaggcgcggtggctcacgcctgtaatcccagcactttgggaggccaaggcgggcagattgggagttccagaccaacctggccagcatagtgaaaccctgtctctactaaaaatacaaaaattagccatgcgtggtggcgggtgcctgtaatcccatcagcgactcagaaagctgagggaggagaattgcttgaacctgggaggcagaggtttcagtgagccgagatggcgccattgcactccagactaggcaacagagcgagactccgtctcaaaaaa

SEQ ID NO: 273177 - DNA, 1068 bp, Homo sapiens
tccaacttatacctttattaaaatttggtgtgtgtatccatccaatctctgtttttagagattgttttattatgtgctttaagtccacataaatgatctcatactgaatgtgtcactgtaggattttttcttcaaaattgtatttttgaactttctgtatatatatatttctttaattttaaccattttatgaattctaaagtttatgtatttccccatcttaatatattatttccaattttttgattacaagcaatgtaatctaaaatgtacacttttgtatggttttcttctgtgtatgtgcaatattttgtctaggatatatacctagaagtggaattgctgttatagagtgtgtgatttttcagctttaccagatactgctaaattgctgtctgaagcaaatgtggcagttcacactgctgtctagaattttctcatatccttattagattttgaattgtcagaccctgtgatttttactcttatgatggctgtgatatgcttttttgttttaatttgtacttcccttattatttatggggataaatatatttccacgtttaataagtatttggattttttcttctatcaacaacatatataaatctttgtcaccaaatcagcttttttgaggtatgacttacatgtaataaaatgtgccaattttgagtgtaccattctctgagttttgacaaatatatgaagctatatatccatcaccacaattgagttacaaaacattttcagaaatgctccattgtggtaactgtcttttcccccattgaattaattgtctccgtacattcattgaaaattgattgatcacattaaatatgaatctgtttctggactctattattctcttgatctataattatgtcaataccacactgtcttgattactgtaactttacaataaatcttgaaagtaggtagttctccaactttgtttttcctttttaaaattgcatttctatctaaatgttagggtcagcttattaatttctcaaaaaaatcctgggattttggttgggattatgttggatttgtacatgtatttgggaa

SEQ ID NO: 273178 - DNA, 225 bp, Homo sapiens
ctgtgtgcagtggttttagggtctaatgaggagtaaaacaagatttgttgataacagagaagagttgagagtccagtgggtaacactgacatatcaaggagtagccgatgatgcctggatgctgtttcatgtttagaaagcatcaaaggccaggtgtggtggctcacgccggtaatcccaacattttgggaggctgaggtgggaggatcgcttgagcccaggagt

SEQ ID NO: 273179 - DNA, 767 bp, Homo sapiens
  misc_feature (613)..(613): n is a, c, g, or t
aacaaagagtatgtacatatatgtacatttacatgcaaacataaatagggtttctttgggaaaggaaactggtttacagtggttatctctagggaagggcgcaaggggtcagtagaggtaattttcagactgcttaattttaacatgaacagttttgtttttgttcttgtttttgtttttgtttgagacagagtctcattatgttggccaggctggtctcgaactcctgcgcttaagcgatcctcccgccttctcctcccaaattgctgggattacacgcgcgagccaccacacgtggccatgaacagtttttaaatctttataagttaaagcaaataggccaggtgggtggctcatgcctgtaaatcccagcactttgggaggtggaggtggggagatcgcttgagctcaggagtttgagcttagcctaagcaacatagccaaaccccgtctctacaaaaattaaccagggcatggtggtgcatacctgtggtcctagctaccggacaggctgagatgggaggattgcttgagcccaggaggtaaaggctctagtgagccaagttccactgcactccagcctaggtaacaaagagatatcttgtctttaaanaaagaacaaggtaaatacattatcgtacatcgatctcgaaggtggctaactttacctctctcctcttctggaaacgcgcttccaccgccccccccgcctgggcgcaacaagacagccaacctctgtctccaaacaccacacctctcccctcctg

SEQ ID NO: 273180 - DNA, 185 bp, Homo sapiens
cctccctctttggctttccaaagtgctgggattacaggcgtgagccactgcacccagctggcaatttcttataaagttcagcacacattgaccacccagcctcagctatcctgctcctgggtattcatccacgagaagtgaaaacaggtgcccgcacaaagacttagatgcgaatacatattgcc

SEQ ID NO: 273181 - DNA, 537 bp, Homo sapiens
acggggtttcaccatgttggccaggctggtcttgaactcctaacctcagatgatccgcccaccgtggccacccaaagtgctgggattataggtgtgagccaccacacccggccaaatcactgcgttttttaaaaagataaggtcaacgatcctagcccttgtctcctcctgcacataagataacgtctgacaggatcagtggctgtaatctatgacgagatggactcttgcaccgaaactttgacgatcggatttggctctaaggtaccccctgagcaggtgcagagcctccgccacccgttgataagctgaggcccgaaacattgctttggagcagtcgaactgaaactctgaaacaccctcccggattgcaatgctcaataggaatctgaataaaactaactttacttcttcgaaagcaaaattttcctttagttgactccttgaatctgggtgggcacttgtggtcacagtggaggctggatcccaaacagtgatgcagcttcctcttggttccccaggacacctgtgccgtgg

SEQ ID NO: 273182 - DNA, 489 bp, Homo sapiens
gatgacttacttaatgtctctaagtctgtatttcctcatctgtaaaatcgtcttttatagagagtattaaaatgagaaagtatatggagtgtatttattacagcgcctggtgtagactcagtagctcaaaaactggaggttgttatcaatgtgtgaatatattctgagcagtttctaagtctcttgggaaacttgaccttgaaagatgggtaccattaagaatttctgagacctgtataggtgaaatgtgaaatgggtcttcataatctttcagttttcttttctgctcctaatttcttgctgggcagtacagaaggaaaaacaaagatgtcataatatttgagggcaaacatccattgttgagtgtacttatatatcataattaaaaaaaagaacctaatggaaaaatagacaatttagaagaaaaattgtaaatgttcaataaataattaaaatagttccacctcactagtaatgaaagaaatgcaa

SEQ ID NO: 273183 - DNA, 400 bp, Homo sapiens
ggcccccatactaaacagtttcctctggtgtgatgagtcctgttcttaaaaaattcatgggggtccctattaaaaatcacctgataagaaggcgtgagaagaggagatgtctctatccaagggtacctgctacccggtctcccagagcaggttggggcagctgatggggccagatgatgggaggccttaacactaggcttggaagatgtaactgttgctgttgggaatgatttagtaaagcactgttttggagtagattatctagataagtaagacaaattgccagggagctagaaaggaaaatcaattagtgtgttccaaatgtccgcctggactcattttgtgttaaaactaataatgcttaaatatatatattcatattttttattgtcatttacaa

SEQ ID NO: 273184 - DNA, 256 bp, Homo sapiens
cccgatcagatcttagcctttaagcccaatgccacttctgccaccatgttggggtgcacctactgggcatagcacccactgtgtgccagtcaggggtggaacccatgcagggtggggatggcagtgcccgcacaggtgggtgagcggggcttctcgtgaagcaagcatgacggtgccaccttctcaggaccatgcacccacagcccacactcctttctggtttgaggctaagtccagggccatgggtggggcgcgc

SEQ ID NO: 273185 - DNA, 1007 bp, Homo sapiens
gtctgccaggaaaagttttctgtagtgacgcacgtgttgtgtgtgtatgtgtgcgtttgaggctatattactcattgctacggcagttcaaaatgacttggaaaaaaacaatgaacgctggtcattgatatgtatactgacatgtttaagggaagttactgtggtctgtaacttatgaaatacataaaaaatatgatgggtggagtgacggacacatggacagatatgaagcaagcactgtaaaatattagtggtagtttttgtatgcccatactcacggcaccattattcacagtagctaagagatggaagcaatatgtgcccatcagtgggtgaatgatcaacaaaatgtggtatattcatacagtggaatattattcagcctctaaaaggaagatacgctgacatgtgctgcaacatggatgaatcttgaggacatgatgctaagtgaagtaagccagtcactggaagacaaatactctatgcttccatttatgtgaagtatctagagcagtcaaatgcatagaaacaagtagaatggtagttgccaaggactgggggaggaggaaatgaggagttgtttaatgggtatagtgtttcagttttgcaagataaaaagtcctgtggattggttgcacagttaagttatgtgaatgctgtatgccaactcaactgtacactctaaaatggttaagatggtaaatcttatctttattttaccacagttttttttaaagcatggtaaacaccatttcccaggatgtaaatcggtactaaaaaaaaagtgctccaaagtaagatatatttgggaaacacagggataactaaggttagataggtgttctttattgcaggaattctaagagcatttaacaaattaatttacactgggaattttcagtgtggagggtctggctcatagcatttcacaaacattatacttcagagtcccaaagcctttaaataaaatgttaatggtagaaactccttaaggggtgttcactgta

SEQ ID NO: 273186 - DNA, 606 bp, Homo sapiens
gtctgccaggaaaagttttctgtagtgacgcacgtgttgtgtgtgtatgtgtgcgtttgaggctatattactcattgctacggcagttcaaaatgacttggaaaaaaacaatgaacgctggtcattgatatgtatactgacatgtttaagggaagttactgtggtctgtaacttatgaaatacataaaaaatatgatgggtggagtgacggacacatggacagatatgaagcaagcactgtaaaatattagtggtagtttttgtatgcccatactcacggcaccattattcacagtagctaagagatggaagcaatatgtgcccatcagtgggtgaatgatcaacaaaatgtggtatattcatacagtggaatattattcagcctctaaaaggaagatacgctgacatgtgctgcaacatggatgaatcttgaggacatgatgctaagtgaagtaagccagtcactggaagacaaatactctatgcttccatttatgtgaagtatctagagcagtcaaatgcatagaaacaagtagaatggtagttgccaaggactgggcccattgttggtgatgtcattttaattaagtcgacgcggccgcgaat

SEQ ID NO: 273187 - DNA, 379 bp, Homo sapiens
gctaatttacttagctagtgcatagacttaattggttttcagatgctcatgtggtaaattatcactgaaattctaaaaatctaattttatttgctagtttgccttatttgggtacctgtctttagctgttaaaatccttccttcatatttgtgcctgtttcatacttaatttttcattctctggttctctttttcaaaagaacctgtaggatctctgttcctatttccctcctatatgtgtgtaacaccgtgagtcagtatattgacaagagcaatggctttattataattctgatgttccccacttgggggtgaatgagccctcaaaaactcatagtgttgaacacctctgcatgctggggcctttggaaaaaaaaaa

SEQ ID NO: 273188 - DNA, 324 bp, Homo sapiens
gacatggatggagctggaagccattatccttagcaaactaatgcaggaacagaaaaccaaatactatatgttcttacttataaataggagcttagtgatgagaactcgtgaagaccaggaggggaacaacaacactggggtctaattgagagtggagtgtgggaggagggagaatcacagaaaaaaatcatggatactaccaggcttcatacctgggtgatgaaataatctttacaacaaactcctgagtttatttatataacagacttcaaatgtaccccaaacctaacataaaagtttttaaaaaaaattaaaaattaaaaa

SEQ ID NO: 273189 - DNA, 513 bp, Homo sapiens
gcctcacagtgacagagccttaaagtgtgcactgctctgattagtgttcatgacgctagtccatcttcctggaaaaggtgaggaaaccaagattaagaggctgcgttttctttagactttgtgctgtcaggagatgtatctagtgagaagagaagagtggctcacatctgtcaccacccacagtcaccagtcagaggcgacggaagcccttggaaaaagcccactctggctgggtgcggtggctcatgcctgtaatcccagcactttgggaggccaaggcgggtggatcacgaggtcaggagttcaagaccagcctggccaacatggtgaaaccccatctctactaaaaatacaaaaaatttagccggacttgttggcaggtgcctgtaatacccagctactcaggagactgaggcaggagaatcacttgaacccaggaggcggagtttgcagtgagctgagattgtaccactgcactccagcctgggcgacagagcaagactctgtctcgag

SEQ ID NO: 273190 - DNA, 523 bp, Homo sapiens
ctctccctaaccctgtgcaggcaaggcttagctgctcactccttcacactgttgccttctttgtcctctctgagtcagagttctgagcctgtcgcagatccagtataaaactccaccttctccacatcagttcacgttgagcccttcttctccagacctcctgcctccttccttcattcattaatggagaagctgctgcaggtcaaacctgtaggtgccgggtgctacaggggatatgagactgatagggtaactgggaaggtaaaacagccacagaaaactcaatacacagaactcagataaagagtggcaggggataggaggggagggatttccctgtgactggagtattcagggccgactttcagaggtgacttttgggaaagccttgactgatttgtagcatttggcttctagatagcatatatgaaaggcttagattctgatcaaagactgagattaaaatatactttgaaaagggagggaagaatttgtttctcaacttttgcaatctcaaaaattg

SEQ ID NO: 273191 - DNA, 1484 bp, Homo sapiens
ccttctgctgtgtgtgtgaggacacaagatgttgtctatggagtagggaaagccttcaccagacactgagtctgctggcacctcgatcgtagacttcccagcctccagaattgaaactggattagcttaaaagtagagcaacatctctcacacttcatagctcttgacagttttgacaacaaggatgggtgctgatggagacatggctttctggaagaccccttggatctggctaaatgacactcttaccatcatgaccacagttgataatcaccatgccaatggctagaacaaaccacgaaaggacaaaaaggaaggtggcaactctggttcccagaagttctccgcccattcccagagaaggcatgaatattcctccccttgttttcaatgctcaacatctttattaaagatgccctgtatctgtgacttcccagcactcacaagctgagcagtgttgtgggaagtcaggaacccggaatggagggaccggctgaagccatggcagaagaacatggattgagaagatttcatggacatttattagttcccgaaattaatacttttataatttcttacgcctgtctttactgcaacctctgaacataaattgtgaagatttcatcgacacttatcacttccctaatcaatacccttgtgatttcctatgcctgtctttactttaatctcttaatcccatcatctttgtaaactgaggaggatgtatgtcgcctcaggaccctgtgatgattgcgttaactgcacgaattgttggtagagcatgtgtgtttaaacaatagaaaatctgggcaccttgaaaaaagaacaggatagcagcaatgttcagggaacaagagagataaccttaaactctgagcactggtgagccagatggaacagagccatatttctcttctttcaaaagcaaatgggagaaatatcgctgaattctttttctcagcaaggaacatccctgagaaagagaatgcgtccctgggggtaggcctctaaaatggccgcttcggggggcagccgtcttttatggtcgaagctgtagggatgaaataagcctcagtctcccgtagcgctcccaggcttattaggaagaggaaattcccgcctaataaattttggtcataccagttgtctgctctcaaaacctgtctcctgataagatgttatcaatgacaacatgtgcccgaaacttcattagcgattttaattttgccccggtcctgtggtcctgtgatcttgcctctgcctccatttgccttgtgatattctattaccttgtggagcacgtgatctctgtgactcacaccctattcatacactccctccctttttgaaaatcactaataaaaacttgctggttttgcggcttgtggggcatcatggaacctgctgacagttgattcgtgagccaagctcccacttctcaattccatggccattaaataaagcctgcactgcttgatgctcac

SEQ ID NO: 273192 - DNA, 209 bp, Homo sapiens
gctgagatctcaacgctggtctccgaatcctttctctaatagactatttgacatcttcatttggatgcctaacaggaacttgaactaacatgtccaaatcaaaatactgctcttcccccaattgtcagatttgtttcttctacagtctttccctcttctgctaatgaccacttcagactttcagatgcttagactaaaaaaaaatggag

SEQ ID NO: 273193 - DNA, 281 bp, Homo sapiens
tcaagaagtttttaatgcattagcttctcttcttgcgctgccttctttttagcgatatctaaatagaaactacatgacaagtagttatcatagcaaaagctagctttgtaatgcacatgacaaaaacatagtataaatgtgacccgtgaagcagtgaaaactttgggtgctgtcatttactgtggtaccatcttgtctcttactgtgtactgtgacctctagtggtttctgtttcttccatggatcatactcttctgaatagtgttgacaaaaacttactg

SEQ ID NO: 273194 - DNA, 262 bp, Homo sapiens
ccagcgtgactcagctgggttcagtgcaaggctgcaaccataatgtcagccagggctcagttctcatctggaggcttgactggtgatctgcttcccttctcatctggttgttggcagcattcagttccttgcaggctgctggtctcagggccccaggttcctgctgtcctcagcttcctgccacatgggcctctccatctggccactcatgacatggcagctcacatcttcaaagccagcaagatagcctcctagcaagaca

SEQ ID NO: 273195 - DNA, 351 bp, Homo sapiens
aaattgctgtaacataggtaacaaagggctgatattctataaagagttcttgcaaatgaataagacaaagatgaatccaagtgggcaaaagatatgctgtaggcaatctgcaaaagtgatgcataaaaacaggttcaacattactagcaattagtggaataaaacttaaaacaacaatgcaaaaccatcgttctatcatattaacaaagatgacaaaaaatggtgtgacagtgcagggtgtggagaaaagttggtgtcaaagctgtgccatctttctgtgtatctttcatatcaaacaaacgccttcaacaatgagcacacctttcgacacgagttcccagactttatcct

SEQ ID NO: 273196 - DNA, 352 bp, Homo sapiens
gggtgcccgggcgcgtcctgtggcctgggactggcagggggagtcagtcctgaataagtcactttttcttcttagctagaaaaacgactttcaaaaggctttcaaaatctcgtctttggtcgatttcccctactacagcattttacgctgagttctagtttctctctcgagaacagcctccgcactgtaatctgcatcaacccaaagggtcatgatgccatttctccacttcaacgagatatacctatttattgcaccctggaggtctctttcgtggcggtgttcgattttagataacttacttgcaacttgtgtttaggaaaaaatgtacactgatactttaaaccatgct

SEQ ID NO: 273197 - DNA, 469 bp, Homo sapiens
tttgagatacctccctttacggagaggggcctatgttttttcctcttgaatgtgggcaggctctttgactactttaactgataggatgcagcacaaatgatgtctcagttccaggtcttagccttaagagactggtagcttttacttcctgactctgagaagacttttattcttggagccccaagctgccatgtaggaaatctatctactcctctaaagatatcatgtgggaaggttatagatgacatggagaaggaaggggcccagcccagccattcagccaggcagccatctctggcaatgtgcctggcaactaaatcatgctaccttagacccaccaggctagctcagctgccagctaaataccaagtcaagaccacgtggagaagaagaattgcccagccaagccctacctaatctcctaacccagaaactcatgaaatataataaaatggttgttgttttaagc

SEQ ID NO: 273198 - DNA, 344 bp, Homo sapiens
  misc_feature (9)..(9): n is a, c, g, or t
  misc_feature (16)..(16): n is a, c, g, or t
  misc_feature (55)..(55): n is a, c, g, or t
aattttttnaaaattngggttttttaaagattttttttgttaaacttttattttnatatatgtgagtacactgtcccttcttcttcagacacaccaaaagaaggcatcagatctcattatggatggttgtgagctaccatgtagttgctgggaattgaactcaggacctctggaagaacagtcagtgggtaagggcacccgactgctcttccgaaggtctgaagttcagatcccagcaaccacatggtggctcacaaccacccgtaatgagatctggtgccctcttctggtgtatctgaagacagctacagtgtacttacatataataaataaataaatcttta

SEQ ID NO: 273199 - DNA, 566 bp, Homo sapiens
gaggaattaacaccaatttttcactgtcttccaaaaaaataggagggaacatttcccaacacattttatcaagccagcattgcccaaagatatcacaagaaaacaaaactacaggccaatatcccttacacccaagcccgcacagcacccgctccacctctggagggctggagactaaggctggccatgtggggccagctgtgtctctgtggccaacccccaatcaaatctctggatctcgaggctcaggtgagcttccctggatgtcaacactccatagagacagccacacatcctcgatggggaaacactcactgggctgtccacatgaccccaacgggagaggacagccggaagctcacaccagagtgggactccatctcaaaaaccaaaaaaccaaaaaaaaaaaaaacaaaaaacaaaacaaaaacccaaaaaaccaaaccaacccaaaccaacctaaagcaaatagaaggactcctggtccttccattggtggctcctgcgccctgccccacacgcctcttccccgggctgattttaacctgtattcttccactgtaata

SEQ ID NO: 273200 - DNA, 585 bp, Homo sapiens
acttaggttcattcaaaaacctgtgcatgaatattcatagcagctgtatttgtagtagcacaggttggaagcaacccagatgtctttaaatggacgaatgtttaacaggctggtgcatccatgccatgaagcacaactcggcaataaagaggaatgagtggctggcgcttggtgagtggctgacgcttggaaccacctgaatggatctcaagggaattatactgagtaaaaaagccaatcccaaaaggtcacatattacatgattctatttatgttacattctgaaaatgacaggataaagagatggataacagattaagttgccagggatttgggacagcacaagggaggtcttatgtggagagacagttttgtttcttgatggtagtggcaggggctacacaaacccaccaggttttgaaattgcctagaacctgaataaggattgtggatggcactgatgccagcttcctggtttggatattgccctgtagtatgtcagatgttacccttggtgaaggatacatggggccctctatcctatctttgtcaattcctgtgaatctatagtcgtttcaaaataaa

SEQ ID NO: 273201 - DNA, 861 bp, Homo sapiens
gtgatcctcccaccacagcctcccaagtagctgggactacagatgcatgccaccatgcctggctaattttttgtatttttggtagagacagggattcacgatgttgctcaggctggtcttgaactcctgagctcaaacaaaacacctgccttggcctcccaaaatgctaggattacaggcatgagccatcatgtctggcctggaatacttatttttattttgttttattactgccctcattttacaattgagaaaactgagaggttaagtaacttgcctgtggttggtggttgcatagctagtgattggtcgagccatggtttgaatccaggtctgatttctggcacaggaagccttaacatcatgttagctgttcattcaagaaagaactatgtaaaatgtactagtccacacttattttatacaattatgcctggtccctaacctgttctttgccagataagcagatacctatcacctgacggccctcccttttatttctttcccttcaaatgttggagttatttgacagcaacttttcctctggagaaaaaggaggcagcaaatgtggagcttccttgatctgtctctcttgattgcttgcctgcctttcccactttacttaaatagatcaaagtcaggaatgatgatgctgaagctttagcgtatgtaagggagaagtatgtaaatgatgtcttttatgtaaccatagaaacatcaccctgttgtattcccacgaatcagggtagatccctggagccccttcaggaagtggcaattacctatgtggttttggaaattgagaaagtagaattaatgaaattgtctatccttgttcagagaataaaatgacttccagtg

SEQ ID NO: 273202 - DNA, 415 bp, Homo sapiens
aggttatttagaaattctaagtgagaggtggagaagacctgaatatcctctgtatttttgtatagtccacatatctagacattgccttccatataaaggtgcttaataaatattggttggattaacatatatgctaataaacatttcatcgttttgtggacattttcatacagtctttgggtcctagttcattgtttcctaagcacaggtaaaggaggggaattcagtgacagccccaagtagagactgatatcagagattttatttaaatgcttttccatgttttacctgatacagattgatgcattattaagttgtttctaattctatgctaattttgtacaacattactctcaaagtcaataatatgaaatgtgtgaatattaataaaattagtcactttatattaatgctt

SEQ ID NO: 273203 - DNA, 639 bp, Homo sapiens
cctggtctctgtaacttaggagggagtttgggttatcttttacttgaggctgaggctatgtcaaattggtcttgggctcatagagaggaatggatttgttgccctgaaaaggagcgataactctagtttttaaacatttgttttagttcagataattactgcccttattcattgtgtccacctgagttcagagcaagcattgctgctgttgcctggtctaagggaggaggacccaggcatgtaacggactgcatgctggccagttgtggtggtcagagcaagctggaggccagcgaggcccttcaggggtcttttcaagggtctgccttggggagcagaggaagatgaagtgaggcagtcgttatagcaagggcacacccacgtttctcattttgaacagtgaagaaagcagatggaaagccacatgtagggcatttgctgaagacaggtgtgttgggggcgtgtgtgtgtcctctgaggcattttgggtggggcgatattttgaccgaatgataccttgttcttcagtgcttcaatggttgatggggtggctttttttcgagatggagtctctctctgtcatcgcgccactgcactccagcctgggtgacagagcaagactctgtctcaaagagaaaa

SEQ ID NO: 273204 - DNA, 453 bp, Homo sapiens
tcctgaaggatatttcttgtgatcctgcttcataattatctcaaagaatagaaaatcctacaggtagaaacaggtcattaaacagtggctgtcacatttgttactggagtttcttatgccctaaaaacctgtctcagtttcctaagttgagttctttaaactttacattcctgtctatcaaaggataataatggatagtaacaaagataataataccttagtgtttattttgtatggtgttgtgagatgtcttctattattattccctttatatagatgagaaaactgagacttagataggtgaagtgacttacctaaagtcacacagcaagtcacactttaggtacaactcaggtgttccaaatctatagcctgggctttgaaatgctgtgccagagaaaggttgggggagtgagggggagacagaaacagagagagagagagagagagaga

SEQ ID NO: 273205 - DNA, 583 bp, Homo sapiens
tcacgtgccggcttcagcgcaggctgtttaagtgtagtcttgtgaagagagttttaacatatagatgctgcatctgggggctccctcctcagctaccaacacttttctgtccctctcttaggctgtgattggtgtggtgccgtcagagggtctctttggaatgtaactataccacttatgctggggtggtggggagtgaaaatatttttaagaccacaagctgagatgggggcaccctcatgttttatgtcagttaagccattgccaaacaactggagatcctaaagagctggcatctgtctttgaaagtcacccaacctattatggggacagtcctctcactaaaatcctgaggccaatggggtcccattcattcattttctcctgccccacctccatctccatgtcgtgtaagtgagaacattatcatcagttcaggagttattgaccgtcagcatacaggacttcagctttcagcaaattcttggctacctcttcctgttttcaagctgacatatatacaaagaatataaatgaatattgaggctaacttaattcagaaaaaaaataaaacgtggttagc

SEQ ID NO: 273206 - DNA, 501 bp, Homo sapiens
caggagttcaagaccagctggagcaacatagcaagacctcatctctattttaaaaaagaaagccaaaagaagaaggaacaaagggggaaaatgttttcttctcagataaaaataaggttaaagaacaaaacaaaaaccaacttgaataaataagcattcaggaaaacgtatctgaggccagatagagtggcagagtaaagacatgcatgttttatcccggtattcagaagttatatttggaaacttcttataccctgttcccacattatctgataaaaagccaaaaatagttttcgtcattcccttaccagaggaaggagaaaatatctctgatatcttttatggattgaaattaaagatctgaaggtaaatcttcctgatgttttgctatttagtataacaaacattgtagaagacgtttaaaaactatcactaggttgtgattaagtccagattactgtttgaagagaaacaatatattttaaagataaatcattcaaa

SEQ ID NO: 273207 - DNA, 154 bp, Homo sapiens
ccactatgggcttcctacccctataccaccaatcctggtgtgggaaaaacatatacctggtggtccttgcaggtgatggggttatccctgactctgcacatccccttctgggctcagggcaaatggtttcatggccttcgggtctggccctttt

SEQ ID NO: 273208 - DNA, 384 bp, Homo sapiens
gtctccggagggatcgtctctggtcccgcagcccctctcgacccctcaccctgtcgctgggctgcagttggcgattccgcgcggtgaaagcagccagtgcccagggtcttttcctgagtgcacctgggcctgccgcccggcgatgccatggggtcgtgcgctgcttttctacttgccgcgctctcactgctcggtgtactgggagggtaccctgggaggcgtgcctttattcttccgaaccgccgctcactgagacagtggctagaagtgtctcttggacctgtgagttagccttaacctgttatgcccccagagccctcagtggagcgcccgtactttgccggcatgacgtttgatttcccggtgataatccgacgagtttga

SEQ ID NO: 273209 - DNA, 344 bp, Homo sapiens
ttaaagtaaagctgtcttgttagatttgtagtaaatttccaatgaaaggtcatcactagagtccaggtgctgtgactcacatctgtaatgcctgcactttgggaggccgaggcagatggatcacttgaagccaggagttcaacaccagtctgggcaacatggcgaaaccctgtctctataaaaaacacaaaaattagtcaggcatggtggcatgcacctgtagtcccagctgcttgggaggctggggtgggagatcactttagctgaggaggcagaagttgcagcgagctatgatcacgctacccaactctagcccgggtgacagagcaaaaccttgtcttaac

SEQ ID NO: 273210 - DNA, 333 bp, Homo sapiens
cattgaatgcaaccagtattgttcaactacacagaatttcaggaatgaatggagaccttcagagctgcttgaaagcccctctaaatcgctaccatccaacaaaactttagcttctagagcttgcacctctgacatgctttgggtgcttagattgcaagtggaaaagtcttatccttacacacattggtgcacctcctcaccccaccccctaataacctttgtggaaaatttttaattcataacccatttaaaatcattttaggattttgaaaagctggttattattagataaaattcaaccatctgaaggacaaatagaagtatgaacataaa

SEQ ID NO: 273211 - DNA, 378 bp, Homo sapiens
actaaagtcaaaccaaaagagctacatttaggggggctaatagggtagtctatggcagtgcaatgtagagaaatagagactgtctggggaaataatcatgattacagtgtgggaagaaaaggaagatttaggtaaagagactgataatcagtcctagtttattttcctagttagtttagcacaagaagaggtcagctaaacccaggagtgaaataggttgcacagtgcactgcagaacagtgttttcagagcatccctttaaaaactgaagaccacaaaactaagatgctcatgttaagttagagagtaatgtcaaatgaggacatatgtaatggtggcattcctatatgaggccaaaatctgtgtccagaggtcata

SEQ ID NO: 273212 - DNA, 419 bp, Homo sapiens
acagaagaagaacccaagaatgctttaactctgatcatcctaatctcaatgtataggttatagttccattatttgagttcttttatttcagacaccaccagttagatgatgttttatgcaatgtttgcttgagtttatttcctcttcatttattttctttctgaaaataaatctgagaagtttctttagtgaaggtctattggtggtaaactctgaatttttttaatctattttatccactttaaaactattcaaagatagttttactgggtatataattctgaaatgatagtttttttttctcttagcactttgaagatattactcattttttttcccttgctgtctggagatttcttcccagtctaattatcattctcttttgtaggtgatctgtcttttccaattttctgctttta

SEQ ID NO: 273213 - DNA, 471 bp, Homo sapiens
gctgtgaattcataatatttcatcttgcagtgattaaaagaagatgctatacatagtattattggaattataacaggtaatattatgttgcctgaataaaagattattaaggttattaatacccacagattaccaaggtttctgttcaggtttataactctcagacctgagtgactttgcctttatctttcactattggtacaatgagaatatctgcaattagataatttgcaattatgtaggacaggtatgtaacaccacaggagagcagaagctgcagccggcatggcacatgaggaggaagactcagagacgcctgacatatgtaacactagaatgtataatacaaaaacatacataggctggaagttgataaataaaacaaaaattctaaatgtgttcgtgtattttaaaggacttaatctttttacggtaaaatgattagtgcgtattgacataaattttaaacag

SEQ ID NO: 273214 - DNA, 231 bp, Homo sapiens
tagttttagctcttacatttaggtctttcatccattttgagttaatttttgtatatggtgtgaggtccaagcttttacacgtgcatatccagttgtcccaatgccgtttggtgagattcttcttttttttttttgagacaaaatctcattctgccacccaggtggaggttacagtgagctgtgatggcaccactgcactccggactgggcaacagagcaagaccttatctt

SEQ ID NO: 273215 - DNA, 448 bp, Homo sapiens
caaatatcttgaagtaacccaaatgccacaaacaggtaaatgttcatacaatgaagtactactcaacaacaaaatggaatgaccactgatagaggcaaattctaaatgttatcctgagtgatagcaggcagacacaaaagtttcattcacaagaaacacttaaattttaggcaaaacaggccaggcgcagtggctcatgcctgtaatcccagccctttgggaggccgaagcagggggatcacaggagtttgagaccagtctggccaacatgttgaaaccccatctctactaaaactacaaaaattagcttgatatgatggcacacacctgtaatcccagctactagggaggctgagggaggagaattgcttgaacccgggaggtggaggttgcagtgagttgagattgggccactgcactccagcctgggtgacacagcaagactctg

SEQ ID NO: 273216 - DNA, 292 bp, Homo sapiens
aaaactacagctagaatatagggtctcatgtcccagccaggcttcaggaccaccccaggtaactgcctgaaccaggaactctttgcaaagtgtcagcatctgaaacggggagagcccattgtaatgggggtttttggcaggcctgggccactctgggcatggaaaccaggcctcccagactacagagtcctgcaagagaagaccctgcctgcatcattcagaccctaatgcccctggaagcccacactccacatcatcagcactgatcctcagcaggggcacctgtgttgct

SEQ ID NO: 273217 - DNA, 420 bp, Homo sapiens
ctcagcctcctgagtgactaggactacaggcatggtccaccatgcttgcctaattttatttatttatatatttggaaagatggagtcttgctatgttgccctggttggtatccaacgcctggcctcaagtggttctcctgcctgtaatcccagactttgggaggctgaggcaggaggggttgcttgagcccaagagtttgagaccagcctgggcaacatggaaagaccctgtctatacaaatttaaaaatttgctgggcgtggtggtgcacacctgtggtcccagctttgtgggcatggtggtgcacacctgtgagaggctgaggtggaagattccctgagcccaggaggtcgaggctgcagtgagccgtgatcacaccactgcactccagcctgggtcacagagtgagatcttgtctca

SEQ ID NO: 273218 - DNA, 1025 bp, Homo sapiens
atggggcaggtttgattgccatctcaattttgcaagaaggcaacaggggttcataaagattcaaaaccacctctgcctgcctcaaaaacatttgctctcagccattggaccgataataaagcaggaggggttgcaggggcacagttgtctaagcacagctgctcccttccctctaggagccgttcaacagcccggtgatcaatatacttcctagtcatcagcgaagggtaggcgcttaatgaatgcttctccgcaaagtggatcacaatcacgaagaaaccaaagcttacacttccgttccccatatctcccacagatccaaaagaccacggggcccaggacccggtctccatagcccagccatacccgggggttttcaggaaagcctcactcgcgtcctgccgggcgatccggggtggttgagttgggaggggggctaccccagtttggaagcccaccacgtccaaatatcccatccaggaggcgcagagagcaacctcagcatgcataacaaagcagcccgcggccgcgttcacagcaggcttggcgggggttcgggaatttccacagggtctcggcctcccccactgtgggctcgcgcctggcgcccctcaccgggcttccaagcgctcttgtcggtgtcgctagaaaactcgcagagattggagctgagaaaaggcgggcaaagttccttttgataagttatgaatggggaaaaagtgtttgtagaactcattgttaaaaccacggagcccgagactcggccggcgccgggccaatcggaacccggaggctattttgaaatctctcccgtctcagccaacaggcatgcaggaggcgaatccccgcgccagcgccggccaatgagcgcagcgctatgctaaggagtcgggggcccggcccctccgactgtcagcgggttaaagatggagccggcaggcgaggggccgccacgaggtgcagggtcgtctggacggggacccgggggcagacgatggccgggatcctcttccgtctaaccctcc

SEQ ID NO: 273219 - DNA, 992 bp, Homo sapiens
actgctccaaggtctgcccgggccctggcttggtcttgagagaggaaagagaccatctggtcagcaccctcctcccagacagcagttatcagcagcccccctcctctgcgggaagaagagctgggacttataattgcccacacatgtggggcaggcagtggaaagcaccgtggatccagagtcaggagacccagtgcttgccctggcttgatttaaatccaccgtgtggccaacctcagaccccccacatcccatctctgggctccttccgcagctgggaggcagtgagcgctgtgggtaaccagcaccaggcttgggcatcagatgactatgcattgaccccgagtcagtttctggctgactgtgtgaccccggggcagcaccttgcctctctgggcctcaatctccttctctgtgagcagcaggaccgtgtgtgggctccatgagacaacagcattggcaaggtgcttaccacagttcctgcacttcacagctggacctctggccactggctgagagaaccactgctctcctggcctcctgcattggaacacttggctgtgaaattaatctgcaacctgcaaaaggctctgcccacagaagggacctggacaccatgtatgttccaaagatccgtgtccatcctccaggcacaggccacagtctgactctgagaccagctgccttctaggctaaaggagggtgctctgggcattggctcagaacaggctgctgctgaatgcagtgggaagggagaaagggatgaaaaggtcttctgaaatgcccacccatttcttgcatttgattcagaacccagtgggcagtgggttcttggaatgggaatctttttggtgccccctgtcttctgacccagagcgttaggagggaagggaaggggtgttgggccccttcccagggtcagggcttgtagcacctcagctgggaagcagtgtgagcatgatgatataacaggaaccaactcgttcttagca

SEQ ID NO: 273220 - DNA, 383 bp, Homo sapiens
cagttattaatatttaaaaacaaacattttgggtgactacttgactgttgtgtgtggattgttgagatggtattgtaatcaatgatctgttttatctctgatggtgatgatgatggtgataatgattattttattgctgcagtttactttgtgtactttgtgagcatttttttttttttttgccctctacaggatggcagtcagatggctcttagtagctatagcaagttgcttttagacacttatctttcaatccaccaactgtgacatttagagttttacatatggttgagatccactcttacgtgtcatatatttgtactttaggatgtttgcaataaatgtgtgtctacctcccccaaataaaataaaataaaataata

SEQ ID NO: 273221 - DNA, 380 bp, Homo sapiens
aacagtttctagaatacacttgagtgctcaatagacatagctattatagttaattgaaatggaattggcaatgtgggaaataagaaatcacatttttggccaggcacagtggctcacacctgtaatcccagcactttgggaggccgaggcaggaggatcacttgaggtcaggagttcgggaccatcctggccaacatggtgaaaccccatttctactaaaaatacaaaaagtagctaggtgtggtggcgtgtgcctgtgatcccagctacacgggaggcagaggtgggagaatcgcttgaacatggtagacagaggttgcagtgagccaaaatcataacactgcactccaggctgggcaacacagcaagactccatctca

SEQ ID NO: 273222 - DNA, 465 bp, Homo sapiens
tctggactggcgataacattcctgagcagttttcgtacggggaaacgggccccaaagccctccggctcaccccaggtgccctaaaccaccactcattttgctactgacatttcctcccgcaagtcccagcacctgcctccactcccacccattgcagatccaggcacagctcacctgtatcccagcccctaatctctatgtgcaagtgcaccctgatcactgattactgtgttctacatgcattccaaagagttacttcctacttgcccaggactgcagaccagctctgactagaacagaccagcaagcgtctttgctatccagtgtgctgaactacaccttctccaataagatctgaactcttattgtccttccttatgtacctgcccccccaggtctagaataccatagtttccttgtagttgttcttttatcgaagtttaataaatctttgtattaaattta

SEQ ID NO: 273223 - DNA, 385 bp, Homo sapiens
cggaataggagaaaatttttgcaatctacccatctgacaaagggctaatatccagaatctacaaggaacttaaacaaatttataatagaaaaacaaccccatctaaaggtgggcaaaggatatgaacagacacttgccttcacatttctaagggcaaacaattttgtacctagacttctataccaaataaaaacattttcagtatacaagaaatgagatttcttgtatatctttctgatttaaaaagtgggggccctgtagtaccagctacttgggaggctgaggcaggagaatggcgtgaacccgggaggcggagcttgcagtgagtggagatcgttccactgcactccagcctgggagacagagcgagactccgtctcaaaaa

SEQ ID NO: 273224 - DNA, 336 bp, Homo sapiens
aagttggccaggctgctcttgaactcctgacctcaggtgatccacctgccttggcctcccaaagtgctgggattataggcatgagccaccgcaccctgccaactgtctgacttatcttaaaaggctaaggacctggtttgtttgtcaaattttgaaaatagatgcctcagttcataagatttccatattgtgtggcaggcgcctgtaatcccagctactcaggaggctgaggcaagagaatcacttgaacccgggagacagaggttgcagtgagctgagatcacgccactgcactccagcctgggcgacatagtgagactctgacaaaaaaaaaaa

SEQ ID NO: 273225 - DNA, 374 bp, Homo sapiens
cttgaattgtagctcccataattcaaaagagggacccagtgggagggacccggtgggagataactgaatcatgggggcagtttcccccatactgttcttgtggtaatgaataagtctcacaagatctgatggttttacgaggggaaaccccattgcttggttctcattctctcttgcctgctgccatgtgagacatgcctctcaccttccaccgtgatggtgaggcctccagagccacgtagaactgtgagtccattaaacctttttctttataaattaccccgtctcaggtatgtctttataagcagcatgaaaacagactaatacgtaatccatgagagttccatcctccaaaaactgaaatacaactatga

SEQ ID NO: 273226 - DNA, 236 bp, Homo sapiens
tttttttttccttttggcatactgaattggggtcctgagtttttattttcctttcacaagttcaacatccagtcgcattattaatcaaaggttagggtcaaacaaaaacattgtcagataaggaggggctcaaaaaatgggtctcctgtgcaccctttcttaggaagctactggagaacaggttttagcaaaagaagataataagaaagagaaaaatgcatgttaaaagataattt

SEQ ID NO: 273227 - DNA, 329 bp, Homo sapiens
gtagggctgggcttccttggggtctgaggacgtgagagggcagagttaatggtcacctgtgtgagaggtgcggctgcaaacctgagggatgagactgtcttgggaggcagagcaagatggcctgtgagtagaactcttctgagaccactgacgtttcagttccttcacaccaagcgtgagtaataaacatttaaacaaacaaatccatggctgggcatggtggctcacacctgtaatcccagcactttggcaggctgaggccagtggattgctttgaactcaggagttccagaccatcctgggcaacatggcaaaaccccgtctctata

SEQ ID NO: 273228 - DNA, 456 bp, Homo sapiens
tgagctagcagatggtgggtataaactctgaagtcctacacagaaatcccccaactacattccaaattcaggtgacactggagtttacaaaggcacaaaatctcactgaaaattagtgctctggtgcctggtatggttggaaggtgggcacagaattgattcaatcaccaccatgataagatagttatcttcttagggtaggaggaaaggttagagataaaaatctaagataatagtgttccaggaacatttttaatatgaagatagtaaaacttcctgtgaatcacgttcaatgtttttatgatagtcataatgccataaaaagcctttttaaatattatgtcacacaatgaatttttataataatcctgctatcatcatttttaaaatgaagatactgaaatacagcagttcaatgtaattaaagtaatggtaataaaataataaaaacaatgg

SEQ ID NO: 273229 - DNA, 332 bp, Homo sapiens
cactaaaataacaaaatccaaagagttatagctaataatgtaacaaaggagataaaatgaaatcataaaataatccaaaagagggcatatagagaggaaaaagtgaagacagcgacaatagggacaaagggataacaaatagtaagatggtagatttaagcttaaccatatcaaaagttgtattaaatataaatggtctaaagatttcaattaaaaggcagtgacatcagatagactttcaacaaagcaagaggccaggtgcgctggctcatgcctgtaatcccagctctgtgggaggtcaaggcaggtgaatcacttgaggctcagagttc

SEQ ID NO: 273230 - DNA, 400 bp, Homo sapiens
cccagttgcacccggaaggagcggtgtgagcggtccaaggagccccgcaggtttgcctcggagatgaagcagtgtgtccggctgacggtccatcccaacaatatctccgtctctcagtacaacgtgctgctggtcctggagacgtacaatgtcccggagctgtcagctggcgtcaactgcacctttgaggacctgtcagagatggatgggctggtcgtgggcaatcagatccagtgctactcccctgcagccaaggaggtgccccggatcatcacagagaatggggaccaccatgtcgtacagcttcagctcaaatcaaaggagaccggcatgaccttcgccagcaccagctttgtcttctacaattgcagcgtccacaattcgtaagtggccccagcct

SEQ ID NO: 273231 - DNA, 480 bp, Homo sapiens
tacctgaatgttcataggagtattattcataattgctacaaagtggaaacaacccaaatacctattaaccgatgaataaattaaaaatggtatatacagtggaatattagccagtaatgaaaagaaatgcagtattaatacatgctacaacactgctgaatctgaaaacacagcccaaaagaagccagtcaccaaaaatcacattttatgtgagtccatttatacgaaatgtccagaataggcaaatccatagagaaagaaggcagattaatagatgtctagcacagagggacttgagggtaagtggggaatggctgtggaatttctcgttggggtgatgaacatattctaaaattgattgttgtgatgggctcacaattccgtgaatatattaaaagccatcaaactgtacactttatatgggtgaattgtatggtatatgaattgtatctcaataaacctgttatttgataacaacaa

SEQ ID NO: 273232 - DNA, 464 bp, Homo sapiens
taaaccatgtaggattatcttttttgcctttagtgaatgtaacttttaaacatatattgttgtatttttcttatacctgttggaacagattagtttgggacgtactacatatactatattctgtaagcttcatagtcttataaaatatggtttttccatcattctcagcaaactatcgcaaggacaaaaaaccaaacaccgcatgttctcactcataggtgggaattgaacaatgagaacacatggacacaggaagggaaacatcacacaccagggcctgttgtggggtggggggaggagggagggatagcattaggagatatacctaatgttaaatgatgagttaatgggtgcagcacaccaacatatgtatgttggtacaatatatgtatacgtatgtaacagacctgcacgttgtgcacatgtaccctagaacttaaagtacaataaaaaataaataaaat

SEQ ID NO: 273233 - DNA, 458 bp, Homo sapiens
ggcctaacttatgtgtcatgcaaaggatggctcttggaaaaatgcaaagaagcaggggccgctaagggagagatgtgaaggtcaaggaagctctgagctcctgacagccgcccttccagccttctcctgccttccatagagagatgctatggactcttggtccagagactcaaattcaaggaaaagaagaggcaacatgtgcagtgttgatccttgagttgaacaaagagtggtcaggagaagaaaccaacaagaaatgtaacctacctccagaactcaggaactcagcaaattctcccagattgtgatacctcatttctgaggacttcatctttaccaaatctttcaatccaaagcaaacgaatactgaaaattcatgtatccaaagcaaatgaatactgaacattcacgttgagatgatctttaaatgtaattaaatagagataatgtaactaaaa

SEQ ID NO: 273234 - DNA, 443 bp, Homo sapiens
ggcctaacttatgtgtcatgcaaaggatggctcttggaaaaatgcaaagaagcaggggccgctaagggagagatgtgaaggtcaaggaagctctgagctcctgacagccgcccttccagccttctcctgccttccatagagagatgctatggactcttggtccagagactcaaattcaaggaaaagaagaggcaacatgtgcagtgttgatccttgagttgaacaaagagtggtcaggagaagaaaccaacaagaaatgtaacctacctccagaactcaggaactcaggtacccttaaggatatcagaaacaatgaaatatggattggcagaagcatcttcaccaccatcttcagatgtaattaatgcagctgttgaatttggttgactatccacctataattaccacattgcccattacagatttttgctgccttttcttgc

SEQ ID NO: 273235 - DNA, 496 bp, Homo sapiens
cggccggtgcgacacgacagaagggttcagatctggattctagactgagtgctgattgctaagtcataggaaagctctctgagcactaggtgtctcatttaaaatcagtgaattgagctagattaattctttattcttaatgttaggttgtaatacttggcactgttaagacattgtagatgatcagaaaaaaagaaaagcaagacctggaagggatgaatgtagagtcagcttatttccaacagtgagagccaatactgagccaaagcatgggcagataggctgaagatagcagccgccagcgccacagcagcagctgatgtctgctgaatgctttctatatgtcaggctttgtcctaagtgcttttatatgagttaaatccctttaaccttacaactctgaggtgggtgtttttgccacagttctatagatgaggaaactaagctttagagaagttaacacatttgaccatggtcacacagtgtaagtggcaga

SEQ ID NO: 273236 - DNA, 627 bp, Homo sapiens
gcagcttaattagtaaattttctcagtaaccttggtggtaacatgaccaggcctgagttgtgctctcatagagggcagttaggtgttctcttacagtcttgcccctcattgcaccttacacttctcttttcctcttttataaaactcattttattcaacagatctggattctagactgagtgctgattgctaagtcataggaaagctctctgagcactaggtgtctcatttaaaatcagtgaattgagctagattaattctttattcttaatgttaggttgtaatacttggcactgttaagacattgtagatgatcagaaaaaaagaaaagcaagacctggaagggatgaatgtagagtcagcttatttccaacagtgagagccaatactgagccaaagcatgggcagataggctgaagatagcagccgccagcgccacagcagcagctgatgtctgctgaatgctttctatatgtcaggctttgtcctaagtgcttttatatgagttaaatccctttaaccttacaactctgaggtgggtgtttttgccacagttctatagatgaggaaactaagctttagagaagttaacacatttgaccatggtcacacagtgtaagtggcaga

SEQ ID NO: 273237 - DNA, 467 bp, Homo sapiens
cccacaagggcagggctcttggttttgttctctgatgtgtctcaatatctagcacataataggcactcaataaatacttgttgatttcaaaaaaataaataaataaatatctgttgaagtctctactttcagttatttttgtttatatactcagaagtcggactgctagatcatatgataattctgtttaattttttatggaaccaccatacttcaacatgaatatttttacaggattaatgcagcaaagcttaaatgcaagtaatcattatcctcactgctggttttagtaaaataattaaaacaattcacacacactgtttaataacttattcgcagccaggcatggtggctcacgcctataaaatcctagcactttgagaggctgaggtgggtggattgcctgagctcaggagttcaagaccaccctaggcaacatggtgaaaccccgtctctactaaaataca

SEQ ID NO: 273238 - DNA, 342 bp, Homo sapiens
gaaatcaagttactgtttcatttacctctttgaataaatagaaagatgttcaggtaaaaccaagtgattatgatacagatctcaccccctccctccccaacctccacccaagcaaaagtttccaatggttccccatacacttttggaaacagagctttgtggcatatggaaggaatttctaccccctgcgtatgagcaaacccatctggtttagttggtttggccaggtcttagaaatacattgacaaacacgtgtatgtcaggggtaacttgtagtcttgctgcttatattgctcctggggggaataagaaattcatgtaatatgaacagtctagttttta

SEQ ID NO: 273239 - DNA, 438 bp, Homo sapiens
gataaggatgtgtggaagccggagccctgccggatctgtgtctgtgacactgggactgtcctctgcgacgacataatctgtgaagacgtgaaagactgcctcagccctgagatccccttcggagagtgctgccccatctgcccaactgacctcgccactgccagtggttgtaatttatttatttcctgttcaacataaataaattacttgcaagcactgcaaacacgctcccatagatgctggtcgtctctgcaaagcagaggggctagttatccatgggacctggtagctggggtagaaaggaaaggccacttctcacttgcaggttgaaactgagtgaacgagcctgagacactagaggggtccttctttgcccaacatctccaaaaacatttgcttccaagacacatgaaggacagatgtgattctacaaaaaaa

SEQ ID NO: 273240 - DNA, 411 bp, Homo sapiens
ggaatactgacaaggctgtgggcaggcagtgagacagggaggcaggcctggccgtctgcttttcctctccctctctttgaccaaaattccatccatgtaaccctgttcctatagctgccttccttccaggaagagatctgcgcagttgctacttaacaaagcctagaagaacccaaccagaataattttgccaagggctagaattgaaatatctgccaccttctgtagctcatagaatcactgtatttctgagcaagaaatcttttatttttttagacagagtcttgctctatcacccaggctggagtgcagaggttgtagtgagctgagatcataccactgcactccagcctgaataacagggtgagaccctgtctcaataaaaaataaataaataaagtaaaaaaaaaa

SEQ ID NO: 273241 - DNA, 295 bp, Homo sapiens
agctggggggtcctggcaagatgacgagtagaggcagtgctcaagcagtgagcatcaaaggatggggctaacctgcaggagtgtggttggaatgatgggacctggatgaagtaaagaagaaataagacgggccagtttctggactcagcaactgggaaaggtgtacaggtccaaagcctgatagggtctgaaagcaagcttatgacacaagggtgttgagggagtgagatgatggtcatcagatgcggattctacaagactggattttggatgggatcaactctatctaactcta

SEQ ID NO: 273242 - DNA, 539 bp, Homo sapiens
tttttttttcaactaatgaaagatccattcatgaagccctatctcccaattaagcgggcactttccatcaggcaccgcagcagacgctctttaccggatcaagccaggcccccggatacagtgagccctgtgtgaggaccacagctggcatcccaaagtcagcagagtcctgcacagggtgggcccaggtcagagctggatggtgggaaatgcagtgtgttcacctccaccctcttctgcaagtgagcttacacagggaaatccagagtagaagtgaacagttcaaaacagcggttccaactgttaagaagaagggtgagtggatgaaaagaagtaaatattagttgaatacctattatgggccaagaactaggccagacactggcatgttatctagctcaattaacagcaacactctgcttggcacatattcacagtaaggctcaggcaggggaagcaacctagctagacacaaatgtccaggaagtggcaatgagatgtgtattgaggttgcaatgattccagagactgtatttgtt

SEQ ID NO: 273243 - DNA, 841 bp, Homo sapiens
agttaaggccttagtttagtggaacactcttagatcaggttccctggcccaataagaaacaggggtgttagggaagtggaattggaagtctaggcattttctgggtcaagcaaatgcagatgatagcagctaccccagaagagcatgtgttcagccctcccacaaatgctgtagacactggatctcataatggaagacttaattttaccttacctacaagtgttttgcatatgaaggcattctctgtcatagttggaatgagctcagaaagatgaaatttagtttctagacaaacagtattgctgcttgtttgggcaagcaaatgttgaatggttgctagagtgtgtcattcaacatgtagcatttctaggataatgtatgataagtgtttttccttcagttgttatgttcctcattttagcttgccataagtaaagcttaccatcttattccattacagatactttttgtcacaggttctataataaacatgaattgcaaataattacatatgatagatgtttggatggatatcttctaaaatattttaaaataatactttattgggctgggcatgatgactcaggcctatagtcccagcactttgggaggctgaggtgggaggatcacttgagcccatgagttccaacctgggcaatatagtgagaccccatctctacaaaaattaaaaaaagatagctgggcgtagtggcacatgcctgtagtctgatttactcaggatgctgaggcaggaagatcacttccaggagtttgaggctgcaatgtgctgtgatcacgccactgcatttcaatcttggcaacagagcaaaaccttctctca

SEQ ID NO: 273244 - DNA, 291 bp, Homo sapiens
gtggcagggtgctaagcgcttctcggcaacaggactgtgcacaaggcctctgcctcttgtcttagctgctgtccagccttccagctctgtggctgggactcaagtacctgaacagtgaatgggtgtgggggtgagccatgggcggaggcaggcgctgggagattgtgtcattagcaactgagtcaggaacagagggccagggagacagtgatagcatgggggtgcatctgaaatgctgacagaggcaaattccctcttctcttctacttaaaaggggtcggatccttcctc

SEQ ID NO: 273245 - DNA, 396 bp, Homo sapiens
atacccaacaacattctttgcaagtactcagtaacgaatcaccatgatttcctgggccgtaagacaaggatcaaagttatatggagtatgttatctaactctaatagaattaagttagaaattaatcagaaagataaaaatctcaaaaattttgaaacttaagcagcatgcttttaaataatccgcgattcaaagaagtcaaagggaaaagagatttttttttaaccgaatggattataaaaatgtaacctttgaatttgtgggttatagctaaagcagtgcttggggagctaaccatatacctgtaaaaatatatatatatatatatgaatgaaaagaagaaggacttaaaatcaggaattttagtttttaccttcagaagccagtaaaagaaga

SEQ ID NO: 273246 - DNA, 759 bp, Homo sapiens
tttcctagcatttttacctaatactgatgaacttcatttgagataggtagagtgtggtaggcaaaaagaatatctgagctttttctgcctccttctttgtgttgcccactttagtcctctaacaagccctgagcttctcctctctttgcacttttgccactctgtccccttatctgaaaggcccctgctgccatttctacaatttgaaatgctttacatcgtttcaaggctttgctcaaatgccttttctttcatgagacctgcttcgatggccctgataggaagtaatcatcgcatattttcttccccaatgatacttcgtttatttcttgctcaaaatatgaatttatttatgctttttattatagtttcatgtgtatctttgttttcccctcattaaatgtgcactcctgagaggcaggagcaatttttgctttatctttgtctcttctagtaggagtagcatcattccttttatatgatataattgtatatatttttatactgaattgaaccacaaaactcttcttctaaatcccgtgccaacatcatccaaatatactaaaaaaaaaaaaaaaaactggaaaagtataatactccttcttatttaaattgtctattggtattccttttttttcttaaaaaatcaaaacaaaacaaaacacttgtttcgttgacttttgtccaacaatggattaaagtgagctgctgtggtggttcactcctataatcccagtactttaggaggccgaggcaaga

SEQ ID NO: 273247 - DNA, 503 bp, Homo sapiens
atttccccttccagtggtacctgcttcagtcctccacattaccaaggctggaagaatctttctagatgaggagtcagcggtgtcataatcctgctgaacttccccctgctccagcaaaggctactaatttagttcagggtaaaatgcacgttgtgagtacagctcctcaagtctttcttgacctgctctaacctcctttataagcctcatctctctctagaccccaaacgtgcccttggctctggccccagagttctcaccaggagctgcaggtggtattggagtcacctgggcacttttccaaattaaccagccctggaagcttctctgtgtccgtgtcagtgggaggaggagtgaggaatgggtcagggagactggcagcagggggaggagggctgcctgtgtactgtttcaaatagaaccataggccaagccttctacctctctaagccttgactttctcatctgtaaaatggagagaataaaaccttcttgagcagatg

SEQ ID NO: 273248 - DNA, 408 bp, Homo sapiens
cgaactatgagaagtgaaaagctcgcaaatggaactgatctagaaggccccaagcttagctggatcctcaggttactgaattttaggatttgctcagtcttcaggttaatcatagttgtgctgtttgtttccagattaactatgaaacttgacatttaaaataattctaggccaggtgcggtggctcatgcctgtaatcccagcactttgggaggctgaggcaggaggatcacttgagcccaggagttcgagaccagcctgagtaacatggtgaaaccctatctctaccaaaaatagaaaaattagctgggtgtggtggtgcacacctgtagtcccacctacttgggagagaatcacctaagcctaggaagtcaaggctgcagtgagccatgacggtgccactgcact

SEQ ID NO: 273249 - DNA, 415 bp, Homo sapiens
ctatggattaagaagtatctcttctcttctgaattacaaattcatgcaaatgcccctcattggaagactaatttaaaactatacagaaatgagatgctggaaatatagttccaggtttcccccctataatgcgaaggtaactatagaagggaattgcaatgatgccaagtttactctagtataagcctactccagttcatttatcctcacagctacaatgaaatggtgttacttggaggaatatgtcccaatttatccactcttctgccaatggacatttagattactattactaaggccaggcgtggtggctcacgcctgtaaccccaacacttggggaggccaaggcaggaggtcacctgaggtcaggagttcaagaccagcctggccaaaaccgtgaaaccgtgtccctacc

SEQ ID NO: 273250 - DNA, 454 bp, Homo sapiens
atgctttccagctattgcctggtctaagagggagagttgcaggggtcagtcatcttgacctggtcctccaatgaattaccttgtcatttcaccatcgattctctctttttctttttccacctctgagcatgaaacacccttgatggaaatccagttgtaagaacaaactatttcttaccttcatgtgagatgtaggtaatatttcatgttcctgtctttaaaaaatcatattttctacctttctgaggacttaatgcagaagaatttagcctgtagcatgcactccacctgtcaacttgaaagagaagatattgctgattatgtcttttatgcaaaactgtaacctccacaatggtgtggatcaccacatctgtctttttcacagttgggtaattgctacctatggcaaaatctaaaacatgtcaagtgctcaataaatatgcattgaatgaaa

SEQ ID NO: 273251 - DNA, 259 bp, Homo sapiens
aacaaactaacaaaaaaatgaaattactggaaatttggagacagtagggtagttggtagtattaaagaatagtagtgtgcgatggttggtatgataatggtattgcaattttgctttttttttaaaagagttcttggctgggcacagtggctcatgcctgtaatcccagcattttgggatgctaaggcgggaggctcatttgaggccaggagttcatgaccagcttagccaacatggcaaaaccccatttctactaaaa

SEQ ID NO: 273252 - DNA, 385 bp, Homo sapiens
agaatcgagctcgtacacgtcagcactccttggggagggtgttatataatatatgtgtcagtaggaaggcagtaagaagattggagtaagacaggatggggttacatgtatataaatgaataaaataagtactgctaaaacttgagtctgataaacttttttgccccgaagataatcatcccactgaaaagaaaactctggggaaaatatgccagatactaggaccaagcacggagacaaaccagatacagtgctttcaaagaaaacatgcttgctgtcctttgttaccagtgtaattgtaattattgtttattctgtgttaagtgactgaatttcaatttttaccttttaaaaataaagagaacctctttttacttctgtattg

SEQ ID NO: 273253 - DNA, 917 bp, Homo sapiens
ggtaccctcatcgctacgccctcaccgatatatattttttgtgctaaggacagagcaattagtttttaccagataagcctcgggtattatgtttgtctaagaaacattctctgtgtatgtttaaattgtaattatttcccaaaagctgaggaaaatgtttcagcacagtgaggatttgacgtctgcactgagaacagctgagtttatttgtgccatttagaaattcgtaactgtaggctgggcgcagtggcttacgcctataatcccagcactttgagaggccaaggcgggtggatcacctgaggtcaggagtttgagaccagcctggccaacatggcgaaacactgtctctactaaaaatacaaaaattagctgggcatggtggcgggcgcctgtaattccagctactcgggaggctgagacaggagaatcacttgaaccagggagtcggaggttgcagtgagccgagactgcgccattgcacaccagcctgggtgacgagagtgaaactctgtctcaaaaaaagaaaaaaaaaaagaaatttttaaccgtaaatagaacttggggagggtgttatataatatatgtgtcagtaggaaggcagtaagaagattggagtaagacaggatggggttacatgtatataaatgaataaaataagtactgctaaaacttgagtctgataaacttttttgccccgaagataatcatcccactgaaaagaaaactctggggaaaatatgccagatactaggaccaagcacggagacaaaccagatacagtgctttcaaagaaaacatgcttgctgtcctttgttaccagtgtaattgtaattattgtttattctgtgttaagtgactgaatttcaatttttaccttttaaaaataaagagaacctctttttacttctgtattg

SEQ ID NO: 273254 - DNA, 391 bp, Homo sapiens
aaaatgtggtatatatacacaatggaatactatttggccataaaaaggaatgaaattatgtcttttgcagcaatgtggatggaactggagatcattattttaagtaaaacaatcgaggcacagaaaatcaaatattgcatgttctcactcataatgtgagtgctaaaagatgtgtacacatggatgtggagagtgaaatggtaaacagtgaaaacttggaaggaagagggaatgggagaggagtggatgatgagaaattagtcaatgggtacaatgcatgttatgcttgtggtggataccctaaaagccctggcttgaccaacatgcaacctattcatgtaacaaaactgcacatgtaccacatcaatctgtacaaataaatatttaaaaa

SEQ ID NO: 273255 - DNA, 295 bp, Homo sapiens
ctcaggtctctcacttggctcctctcacttggaagttgctgctgtttcatgggccctctcacagaggggagggggtctaatggtggaagtagttagtaggggcggtggccctggggctggtgacttggggagacttggagcagagtcagggaagatctggaattgctgattggatttctcaccaggtatccctgttccagccaagtagtcttgtatcctctccttgttgaagctgaccggctttctgtttcagtgtgaattcctgttcccctctcctctttactactacacacac

SEQ ID NO: 273256 - DNA, 302 bp, Homo sapiens
agcctatcccttaagagctggttaacatgatgctgtctttgagatcctctccttttataccagacagaatcatttgctttatcccgttgcccttggaacatacctctattatagcacatatcacattatctcattatcatttctttgtgtgcctgcctaactctagactctgctctctggatcaaggactctgttttatccatctttgtcttcccagtacccagtacagtgtataatacacaacaggtacacaatcagtattgaccacatgattgagtgaaatcaattcctaaatactttga

SEQ ID NO: 273257 - DNA, 680 bp, Homo sapiens
catggaagtcaactggggtcttctgggaaagatattcctcccttataagaaacaggtgcagggagatatgtacccattacctctccctggccccagctttcctgctttggacatccttgtgtgatgatgtgttgttactgcagctatcttgcaatcacaaggagatggctgccaacaaccaaggctggcagagcgagaagatggtcagagcctggacctacgatgacatcaccaagccactgaactacctggtcactgacctactgagcctaggaccacctacctctagagattttgttaagagagataaatcaaatgtccaaattgcttaagcaaattttagttggctattctgttatttgcagttgaaaacaccctgcctgataagactgtcattgtctaatgcaattttaaaattatgccaccacaaagaatttcatgagtagattatgatttctggaataagtcagcactcttctattagcctttcactttccatgttaagattttcattacatgcttttaaattttaatcttaataactgtcttatgtattttaaacctagacgcttctttgaaaactactttgataatgaaagtaaaatgtagatggacttttttgctttaattatcaacatgataaatattctcaaaataaatgctgtaatgaaagacatttt

SEQ ID NO: 273258 - DNA, 298 bp, Homo sapiens
gtgggtgggtagatgatggtaggaggtggcaaacgtttgggtggggatctaaagggacagttaattcagtctagacaggttgactttgaggtatctaagtattccaagacatcctgcatttgacagttgggagaaagagggtttggagatcaagagggattgtggccagagttactggttgtgggtgtttgagacaatgggaatggataagtttaaggaaggcacgtaggaagaggaaagtgggcaagagcagttagaggaaggagagctggaagaaatgtaggttaggagtgtttgg

SEQ ID NO: 273259 - DNA, 416 bp, Homo sapiens
gtagattacagaagagattgtggctttgttttgctagcatgttccctcttgcttgtgcactctgatgaagcccgctgccatgttgtgagatgctccatggagaggcccatgtagaaagaaatgatttctatagtaattatgtgaaatagaatttatcagattcccttgtttgtagtcacaaacctataggaaatcaacaaacaccaagtgcatcttttacagctaatatatgaaagaaacttgatgggggtttccagaattttcctcaaaaaatacagggggcaatatattatagaggcatgtcagaaaattaagcacaattgtgatgtttatggtatatgtgaactttctaaagtttgtaatttcttgttatttattttctcaacctaaataaatattcgttttcttacctaaaa

SEQ ID NO: 273260 - DNA, 421 bp, Homo sapiens
acccgttacctggcctttttaaaaaaaaaaaaaaagccttttcttgcagtggtatcttttctttgagttacagtgttgttcatcctttctttgccgaaagaatgaatcccactgcttcacgaagttaaggaaaactgatgtgctggtggtttttaatctttgttctgagctgttatgcattaatagctttctttttgtttttgaatttaattagtaaaatttcaccagtgaaccaaaagctctttttttttctattctaaaatgctagctttaagatttctgagaactttgtgtcaaagaaatcttcgaaaagttactgaagtatacagaagaagttcacaattttaaacgtgcaggtgatctgggcgtggtagatcacacctgtaattccagcatttcgggagccaagtgggcggatcac

SEQ ID NO: 273261 - DNA, 851 bp, Homo sapiens
ccacaggatttctggtaggttggactgtggtgttggtgtttgcagtccaaagagttgctgtgatttttctgtgcctgtctgtctttctttgagacttcttagattatctcatttggcgtcctttcacccaagagttaaccaagcgaggaatggtttcctcgctttcttcctaccttttgctggtggagctgctttcgaaagaagcactttaagaggccgacgcgggcggatcatgaggtcaggagattgagaccatcctggctaacactgtgaaaccccatctctactgaaaatacaaaaaattagccgggagtggtggcaggtgcctgtagtcccagctactcgggaggctgaggcaggagactcgcttgaacctgggaggcggaggttgcagtgagcggagatatcttgtcactgcactccagcctgggtgacagagcgagactccctctaaaaaaaaaaaaagccttttcttgcagtggtatcttttctttgagttacagtgttgttcatcctttctttgccgaaagaatgaatcccactgcttcacgaagttaaggaaaactgatgtgctggtggtttttaatctttgttctgagctgttatgcattaatagctttctttttgtttttgaatttaattagtaaaatttcaccagtgaaccaaaagctctttttttttctattctaaaatgctagctttaagatttctgagaactttgtgtcaaagaaatcttcgaaaagttactgaagtatacagaagaagttcacaattttaaacgtgcaggtgatctgggcgtggtagatcacacctgtaattccagcatttcgggagccaagtgggcggatcac

SEQ ID NO: 273262 - DNA, 382 bp, Homo sapiens
gattcttaaccatccttggggataagaaatgacagtcaggatgtgataattgctactctcctggtattgggtcagtaagtgtttgtggaatgaggaaggatgagagaactgggaagatggatgaggagatggcacctccagttttccgataacttaatgaggaagagaatagatttggctaagaagacactaagatgctttcagtcttttacttaattccttaggaagatagaaggtaatgaaaaaaattgtcaattttgtgacaggatgtgtctacatgagagactttcccacgaatagcataacttacctaatataataccttgtattatattctgatttacaaagtagtgatcatcttattaaatgttagagaaataca

SEQ ID NO: 273263 - DNA, 354 bp, Homo sapiens
tttgtaattttagtagagtcggggtttcaccatattggtcaggctggtctcgaactcctgacctcaggtgatccaccctccttggcctcccagagtgctgggattacaggcgtgagccaccaagcccggccaaaaaagagagctcttataggcccttccttgctttggagctttatctgctctgtgatgcttatctaaaatagccataaggtcactgatatttttaagcatttggaaattacttcagctgggtgccatggctcatgcctataatcccaaccctttgggaggctgaggtaggaggtcctttgagcccagcttgggcaacacagtgagacactgtctctgcaatta

SEQ ID NO: 273264 - DNA, 437 bp, Homo sapiens
cgtgctggggatgaggtattgtgctgcttctattttagaggaaaagtgactgaggcacagagaggtggagacacttgcccaagtttgtctcctcgtgagcagcaaggctgaaatgtgagctatgcctgcctgaatccacagcccatccacacacagtccccagtagacagtggtgccacagttgaactcagaactggctgattccaaagcccagtgtgccctgtggcttcccgctggatttcctgagcagtctggaaggtttacaaatgggcacagagggaggctcccagaagctgggacaatgctgggccccagaactccagaaccctctaagtcaggggtgtccaatcttttagcttccctgggccacactggaaaaggaactgtcttgggcgacacgtaaaatacaccaacactaacaacagcagatgagctaa

SEQ ID NO: 273265 - DNA, 674 bp, Homo sapiens
taaaacaatttcccatgagaaccagggagagtcagcaaggaaatatccatattagcagagacaccccatttcactgggagactggctcccagacatacaagaacatgagcccctgagcccccacactccatctgatccagctgaaggcagctccctccgccagctccctcggaaggaacgtgctgccgacccctgctggtgaaccgggctccaccgagaccgcattccctggcttcccaggccctcttcccgctgccagctcctccaaaggctaaggaaccagctccaggtcgcttcccaacgctcagctgggcgggcctgagaccaactccacgccagtggccggaaagccaagtgaaagctggtgactctgccggcagctgcgtgttacagaccagcagagtccagccctcaaagcgtagctggaggaaacaaaggctttcttctttcccctcttgctttccagctttcttttaatcaacacgtattttaataatgaaaaataatcacatactttaaaataattacttgaacctaaacaaaaggacagacaccactccctcacttgggcaggagttttaacctctgcccacagtcaccgtaagccgagctgtcttgggggtgctgccagtgaccagcggcctgtgtggggatctggctggaggagggttcac

SEQ ID NO: 273266 - DNA, 728 bp, Homo sapiens
taaaacaatttcccatgagaaccagggagagtcagcaaggaaatatccatattagcagagacaccccatttcactgggagactggctcccagacatacaagaacatgagcccctgagcccccacactccatctgaaaaccctcccagtagcccggaaactggccacaggggcatgcagtttgcagagaatccagctgaaggcagctccctccgccagctccctcggaaggaacgtgctgccgacccctgctggtgaaccgggctccaccgagaccgcattccctggcttcccaggccctcttcccgctgccagctcctccaaaggctaaggaaccagctccaggtcgcttcccaacgctcagctgggcgggcctgagaccaactccacgccagtggccggaaagccaagtgaaagctggtgactctgccggcagctgcgtgttacagaccagcagagtccagccctcaaagcgtagctggaggaaacaaaggctttcttctttcccctcttgctttccagctttcttttaatcaacacgtattttaataatgaaaaataatcacatactttaaaataattacttgaacctaaacaaaaggacagacaccactccctcacttgggcaggagttttaacctctgcccacagtcaccgtaagccgagctgtcttgggggtgctgccagtgaccagcggcctgtgtggggatctggctggaggagggttcac

SEQ ID NO: 273267 - DNA, 584 bp, Homo sapiens
cctaaggaagcaaagttttagccgatagttgataaatatgacctgcagtggttgacaagcttgactacatataagtagtattcaattataacttggcttcttatggtatagattcctatatgctgtgagtcaaataatatcctctggagcttaacaattacaagtaataacactgatagatttaatttgcaacacagatgttattcctgtctcttagttcctatgttaatcaaacatttttcgaatgtctacctagctgtgcaagccagtaagcccagtgatgtggaatattcaaaggagcatggccccatttttattatatagctggggagaaaagagtcacatggtaaattaactaatgaatcagcatgaggaaagagccaagccactgttttaaaagaagacatgttttctgaattcagaggatggttagggaaggaagaggtcataggcagatccagtttgaacggtgcccagaaggaagaaaggaagttagataaatgtagagaaaaaggaaaggaaagggaaggtgaatcagcttgagcagacatgaagggaaagtggaagctattcatgaaggactc

SEQ ID NO: 273268 - DNA, 429 bp, Homo sapiens
gaagctgatcatcctacctgtaccctgggacccgtttctctccagcagaatgtgcacatcagccctgtttataatggcttcaaaactgcctccatctacggcaggctggataatacattgtgtgtgttcacaacacagaaaccaccacagacagcaaggagaatggatgatccacagctcctcacaacaacatgaatgaatcgcacaaggtgagaaaatggaggtccacttggccatggtgaagaggtcacatcgatggcagatggagtttcactcttgtcgccaaggctgtagtgcaatggcgtgatctcggctcatggcaacctccacctcccaggttcaagtgattctcatgcctcaggctcccgagtagctgggattacagtgtttctgcccggccggtctttatcatgacctgagaagtagtta

SEQ ID NO: 273269 - DNA, 376 bp, Homo sapiens
gaagctgatcatcctacctgtaccctgggacccgtttctctccagcagaatgtgcacatcagccctgtttataatggcttcaaaactgcctccatctacggcaggctggataatacattgtgtgtgttcacaacacagaaaccaccacagacagcaaggagaatggatgatccacagctcctcacaacaacatgaatgaatcgcacaagatggagtttcactcttgtcgccaaggctgtagtgcaatggcgtgatctcggctcatggcaacctccacctcccaggttcaagtgattctcatgcctcaggctcccgagtagctgggattacagtgtttctgcccggccggtctttatcatgacctgagaagtagtta

SEQ ID NO: 273270 - DNA, 537 bp, Homo sapiens
ttcctgaagccattttcagggcagaagtgctttacccacttcattgagaaaccacctttgcatgcagtaccctgagctgtcttcagcacaccaagcatccacaacatgggaaataccgtgctttaaatgttgctttaatcacagtgctcatgagtaagggcatgtcctgtctcttatccatgaaaacactcccacaaaatgaagtcacacccagtatctgttaacggagatactgagtgggtgaagaagactcattccctaatgcaattcaggtcacacagggtaaaaaagaaaaaaaaatccttttctgttgaggatacagatggagagaaaatggaaaatgcctttcaggaagcacaagcctagttttctaattgtgtttcagtgaacacgcaggtgaacttacctgtgtggcttggtattgtggtgggttttcagcttcttctccaccaaatcctttgaaaagcagcagtggcagaaacaaataacccaattaaaaacaataatagcaacaataaaaaaagaaaagatgaagaa

SEQ ID NO: 273271 - DNA, 574 bp, Homo sapiens
accttgctcttatcaggaaatttcaagcatttgctgttattcacaactgaatgtaatgtctcacttcgtttttaactttgtatgagtatacctgactaaaaacactaatgcggtttcttggcaacaaatacttctgttcatgtattttagaaataagcttattaactgtttataacaactgcatactaacaattattattttttaatgaagaagctacattacaacctcccattaacatcatgtattagatcaagttgataatgttaccatgttatccggtggtcactgtgagtcagtgttgccatgtggatgtcaggcatatttttcctcatgtagattttacttttcatgcttatattcttagtttttatctggatcatgaattttcatctattctaaataccaaaggtgatctcatgttcttatgagtgacttctgaccaaagaccaccagtggcataagtgtcgtcaaagagggtgtaataatatactgtggtaatgaatatgaccaaaagccatagatgactgtgagatgtgtgagatattaaaagatagtcacatttcgtgagaagag

SEQ ID NO: 273272 - DNA, 422 bp, Homo sapiens
caagccctccagcggtcacccaagtacacatggaaacagtgagcatgggggacatctgtgcagggccatgcctgtgcctgctgcaagttctctctcttcaaacctgtctctcggctcttgattcacacatgatcagctgagcattcagttgggacaactgcaagacctcaaactgggcaaaagtaaccataatgccctagatcttgtctgagctgtggaaaaggaatgggagccgtcaatctgccttggagaacagtgaaaacagccttggagacagccagattgctccctcctctgtgtaactaacagataagactcctctttctgttgggtgtggtggctcacacttgtaatcccagcactttcagaggctgaggcgggtagatcacttgaggtcaggagtttgagaccagcctggccaa

SEQ ID NO: 273273 - DNA, 303 bp, Homo sapiens
cagaattttcaaatcaccgaaccccaaagttatgggaatttgttgccaagggagaaagacagtggaatttctgctttcctgatctgcagaaactataaaactgacccaatagatatggatatcgcctcatcagcaaagcagcactctcgcatattctttcctgaagggcttgatgcttcctgtctggtttctagctctgactgatgtagagggtaatgtaaacaccataaagaatccatagggaagttcatataaggccaaaaacggaatctgaaaataaagtatctaaatatacatgctaac

SEQ ID NO: 273274 - DNA, 562 bp, Homo sapiens
ggagcacagatggaggaaacttagcctgcccattatacttcattgtttggtagactaagaaagtaactggtattgctgttttctgagtaaccagttttctcaggctatagtattcttcctgggcatcaacagtgggcactaagactttcacatgctatggccgaaagtgctttaacatttttcttggggaaattttatattagagctctcaactttttaaattaggaagtgatttttccctaaaacagggaatagacctggcatgatagccatctttgaaacttgccacagtcttcctcagcatacttggttggaacgctgtaccaagatgctactggatactcaaaaaatcccttttcttttaaactctaaggaagggtattaaaaaaacatcccaacagtatttaaaaacaaattaaagcttgggatcagttttaaaaagtgtcatggctgggtgtgatggcttgcacttgtaattccagcacttcgggaggccaaggtggaaggactgcttgagctcagtctgggctaaacataacaagacactgtatcttaagaaaaa

SEQ ID NO: 273275 - DNA, 740 bp, Homo sapiens
gccattagcagtcattccccatttccttccatgccttcatccctaggcagccactaacctgttttccatttatatagacttaccaattctagacatttcagataaatgaaacagtaagatgtggccctttgtgactgactttcacgtagtgggttttttttttttttttcttttttgagacaaggtctcgctctgttgctcaggctggagcccagtggtgcaatcatagctcactgcagtcttgacctccctgggctcaagtgatcctcctacctcagtcttctgtgtacgtgggactacaggggtgcaccaccatgccctgctcattttttgtatttttttgtagacacaaggttgcaccatgttagccaggctggtttcaaactcctgggctccagtgatctgcccacctcagcctcccaaagtcctgggattacagacatgagcgaccacaaccagcctctcttagtatgtttcaaggttcatctgtgttgtagatcttactggcttttaaagttaacatttagtaagtttgattcttgataggatttataattaatttttaatcatagaaatattcttaaaaatattaattgaacataaagttgatacaataaaggtgtagactttgtggcttcaggaatcagtttttttcacaattgactctacatgaatataatattttgttgctttttcagaattttaagtaaaactaatatttccatattgtatttcgctca

SEQ ID NO: 273276 - DNA, 424 bp, Homo sapiens
ctaagacaagagagcacactttcactatgtctgttcagtattactttggaaattctaaccagtgcaataatgcaaaaaataaaggcatacagacagaaaagaatgaaataaaactgttcttatgcacagatgtcatgactgtccacatagagaatcccacagaattttaaaaagattcttggaactaataagtgagtttagcaaggccataggatacaaggttagcacacaaaacacccattgcatttccatattactagctattaacaattggaaactgaattatgaaaaataataatgctccaaataataaaatacttctatatttcacataaataaccaaaatatgcaggatttttataatgaaaattataaaatgctgatgtaagaaagcaaagaagatctaaataaatggagaaacata

SEQ ID NO: 273277 - DNA, 448 bp, Homo sapiens
tatccatgaatattttgagagtataattccaacagataagatcattataaaagtaggtagctagacaattaaatgctagaattgtcttttgtaattgatatttatcctgctctatataataaataatgcgtttataattcagttaattttttcagtgttactagtttaggaacatctgacatgcattgaccattataaatatatttaatcatgtttacttttgctgtgaaaatatacaatttgggggcactgggttttgagccttacagattttattttgagtcttatttgtatactaaatattaaatttaggtttccataagtgctttacatttaacataacacatgtacatgtacttgtttcactagaatataaaaatgttttatgtcttggtgtactttacattttctaacataattgtctatatagaatataagggcatatttt

SEQ ID NO: 273278 - DNA, 440 bp, Homo sapiens
ctattttatcagccaacaatggtgctggaaatacatcacaaatgttgattctgaccaccttaatacagtaacgtcaacaaaaaaagtacacagaatgggaaggatctaagcactgaaaataacaggcataaaggtaattgtctacaaagcagtactaggccaaacttggtggctcatgcctgtgatccctgcactttgggaggccgaggcgggaggatcatctgaggtcagaagtttgagaccagcctgaccaacatggcgaaatcccgtctctactaaaaatacaaaaattagctgggcgaggtggcaggtgcctgtaatcccagctgctcaggaggctgaggcaggagaatcacttgaacccgggaggcggaggttgcagggagccaatatcacgccactgcactccggcctgggtaacagagtgagactcagtctca

SEQ ID NO: 273279 - DNA, 347 bp, Homo sapiens
aagggggagagtactacatcaagggtacatcccgtgggacaaaagaatctgaacaacagccttcagtcctaggccttccttcagacagcctacccaaatgagaaggaaccggaaaaacaaccctagtaatatgacaaaacaaggctcttcaacaccccctcaaaatcatactagttcaccagcaatgggtccaaccaagaagaaattcctgatttacctaaaaaagaattcaggaggttagttattaagccaatcagggaaggactggagaaaggcaaagcccagtgcaagggaaaaaaatgattcaggaaatgaacggagaaatattcatgggaatagacagctta

SEQ ID NO: 273280 - DNA, 1130 bp, Homo sapiens
agacgtttgttttaaaattaaaaaagcagtcacttactagtcagaaagccttctgaggattcctgctgtcagtatttcagacaattgtgtgttccaggcccaaacttgaattccacactgactcaggtgtgtctggtatcctactgctatatattttgcaaagaatgctcccacaatcgttcatgtaatctgagagtgagttataattatgaagagcagagctggtcttatatacagaccaagcacacagcaccaacgtggtattttaagaggtgcccttggaaggtgtttttgtcttactgaaaagaaagaatcaggcagatgtggatttgaacatttgctctgcacttaccagcttgtggtctttgagaagatcacttaatcccttttagcctcaggtttttcatctgaaaaatgggaataataatatctcaataatatataacataaagcaggggtattagaacagtacctctgtataccggagagtaagagctcaatgaatgcccccttcctcctggtctgtgcttccctggtgccctggattgtgttgttagagaggcatctacttgggatatggcagtgtctcaatgttctggttcaaaattaaacatcattaagtgtaataggttcaggcactgagtcatctgtcactagcacccacgcaggactcatttatctgataaccaactcagaccaagggggcagagagctctcctacccactcacagaggtggttcaatcaacagcctagctggataaatggatcattgttcaggaacatggtgataaggagggaaaggccagaggtgggagaccacacctaagtaaacgggagttccccagagggaggctatgaccaagggtgcttggagtagaagacaagaaagtctgagctcgtacctagagtgaaatgacccccagccccattccattttttaccccttcattttacaatcttacttggttcaaagtataaaaacttcattatgaaaaataattttttaagcataaaaagtgtattaatgtccctactcaatattgaacatactaggaagagtatttcattgcactgcaaataactatgagaatcacatacaaacatgagaactataatttcaaaaaagaaa

SEQ ID NO: 273281 - DNA, 532 bp, Homo sapiens
tccatgttgtagtatgtatcagtcctttattcatctttatggatgaattatgtatataaatttatgtatataccacattttgtttattcatccgttgatggacattgatggacatccattgatggatattgatgacattttgtttattcatccattaatgggcacaataaccaaaaagacatttccttttggttattgtgagtagtagtgctataaacatgcatgtacatgcatttgtttgagtacctgtttcaattcttttggatctacacctagaagtggaattgcagggttatcggtaactctaggcttaggtttttgagagacctccaaactgtttttcacaacagctgtaccatgttatattccgaacagcaacatataaagtatctgatttctctacatcctattacagccatcctagtaaatgtaaagtagcatctcattctccttttgacagagcaatatgtgatcagcttaattcctctaaagtcaaatttcagtagtaaaataaagttgatgatgaagatgt

SEQ ID NO: 273282 - DNA, 423 bp, Homo sapiens
ttttagaggcggagtctcactatattgcccaggctggtctctaactcttgggctcaagtgattctctcacctcagccttccaaagtgctaggattataggcgtaagccaccgcacccagcccttttttatttttaacatgtgaacttacaccagaagttgattattatgcttgttaagataagctttactttaaaattacctctgatcacgataagtaaaaaaaattataattgtgactagaataaaatctataattctgactagatttctttaaaatctgcatttattatgtcaaagtagatctattattgataaacttgcactcagtgtttagaaagcttatttgtatagtctcatcttgttttattaatgtaaaaagtacgcatgtttgtgagaactttaccaaaatcttcatctttgtt

SEQ ID NO: 273283 - DNA, 185 bp, Homo sapiens
ctggcacacaaaagaccctcctgacaccagctgacctagactcacactttcaaagatcccatcagagcccaccatcctgggagcatcaccgacatcccttcctccggcttctcgaatttgcatccgacctttgaatacccctccaccccgcaatttgcacatgagcacagttaccccaacactga

SEQ ID NO: 273284 - DNA, 474 bp, Homo sapiens
ttcagacctgtggatcaagaagaaacatgagatgaccacagaaaatacggttgctgatccctgccttcaaggaatgctggccagttttctggagactcccagcctctcagctgagaccacaggtagttggtcagactctatactgcaggaggtaccctgtgcacatgatcacccaaatgggctttctgttccagaagaagatggcactgagtcacttttctctgttgttaccctctaaatacaactacataccccgctaattagtcaatggaccatgatacaaggactctgaaagccgagagaaggaaggcagactggctgggagcttcaagacttgagaggtctggcactggcttcaccttccacttttccaccatgctgtgacacaccatgaggttctcaccatatgtggccatctgatcttggacttcctagcctccagaattgtaaacgaaataaatctctcttctttat

SEQ ID NO: 273285 - DNA, 479 bp, Homo sapiens
gctataaacctattccataagtattctagtcctatttgttgatatggtttagaagaatgtataatgcttaattgttttcttaactatttgtaaaacatttaattaacacactgaatcatttataaggacgtactcatgcaaatgcatatttaaatttagtcctttgttggggaccctaatgtttgggtcatggggggatatctctcatgaatagattaatgccccccaaggggaggagatgagtgagttcctgttctattagttccacagagctaactgtgttgttaaaaagagtctgatacttcccttctctctctctcgcttcttttcttgccatgtggtctctgctcatggcgactcccctttgccttctgccatgagtggaagcagcctgaggccctccaaaagcagatgccagagccatgcttcttgtatagcctgctgaactgtgagccaaataaacttctttataaattaaa

SEQ ID NO: 273286 - DNA, 480 bp, Homo sapiens
agaaccaaactgaactggaatttaaaaattcactacaaaattttcataatagtgttggaagcattaacagaggaatagatcaagctgtggaatctcagagctcaaaaactgattcttcaaatcaactcaatcagataaagaaaaaaattttaaatatacaaatcttcagagaggatactcaatctgtatccactgaacaatttctcatttcctgcttcctccagtccggagtaaccaccattctactttttgtttctaagaatttgatcactgtagataacctcatttaagtggaattgtgtagtatttatctttttgtgattggcttatttcatgtatgtgaaatgtaaaaaaaaaatgaagctaacaaatattttattaaaactaaacattaatgtgtttcatgccactgaactgtacacttaaccatggctaaaatggtaatcatattttatcacagtaaaaaaaaatggaaaaaca

SEQ ID NO: 273287 - DNA, 88 bp, Homo sapiens
tttgagaatcatgatcatattcactttttaaccttatcctttaaaaatggtctgcttggtagagggttaaaatagaaagacaacatac

SEQ ID NO: 273288 - DNA, 359 bp, Homo sapiens
ttctggtcttgactgtctgtgagagccttcctggtggaaacagaattgttagtcagctgtcatctccatggtgattttttaaggctaagtgctgaaccagatttcttttcattatgggagtgaaaatgaactcagcggattttctccccgattcctctccattttctgttttcagacttctccatcatgttcttgtgcctggcagtgttaaggggctactatttggttggaagaagcctttggaaaagttgttgaagagtcacgtgcacaagtgatgtgctgagcagactggatcttgcctgatggccagaaaattaaaacaacactgaaattaataaaaattcaaactcccattctgc

SEQ ID NO: 273289 - DNA, 202 bp, Homo sapiens
ggcacattaaatgtttcaggtggatccaggtggatggatgaggctcttggctggaagaaatgctatttgggaaatgccaacaggtgaggtggagagctggcaagcagaccacttgcaaagggctctccagccaaaatgatttgtgtgagaccggaggccctgtggtgctgggggcaggtgaaatgtcagagctacagtgggg

SEQ ID NO: 273290 - DNA, 217 bp, Homo sapiens
acttcatctcatttcatcatttcatctcatgatttcatttcatctcatttcatttcatcatttcatttatttcatcatttcatcatttgacttcatgtcatcatttcatatcatttcatcatttcatcttttcattccatcatttcatcattacatttcatcgtttcatttcctcatttcatcatttcatttcatcctttcatcatttcatctcatc

SEQ ID NO: 273291 - DNA, 162 bp, Homo sapiens
ttttggcatacatgtagaaaagacagtgctagagagatttcattctgcacatatggcctagatctgcagcacataaagttgccaagaagtgtattagaagtggtaaagtgttggaaaggagctgaataacgttgattaaataaatggtgcttgctaaactgt

SEQ ID NO: 273292 - DNA, 410 bp, Homo sapiens
gcgacgaggagggcggcgcccagagcagggactgtgacctggcactgggctatgtggcggccgggcatgcggagctggcctggacccaggaggccccggtcagctcggggccactcctgtcccccgtgcccaagctgtgccgtattaaggcctccaaggccctgaagaagaagatccgcaggttccagccgacggccctgaaggtcatgaccatggtgtgaggtgcagtgactgcgtcaagagaagcctgctgcacacaggggccctttccatgcagtgtcctgtgcatgtctgggtttcagtgtcgtcttgccaagtcgctttatcttccgaggccaccgtttaacaggagtccccgcagatgggttctgccctgtggagtatggccgtgagtccccgccccagcaaag

SEQ ID NO: 273293 - DNA, 396 bp, Homo sapiens
gggccgggccactgaaatggcctccctgagagtgcctgcctttattcagaagtagaaagggatgaaacacgccctagtctcctgcagcacccccagacttgataggattaggaaattccagcctggcaaattctagtcagaccggttctctgctcttgaaccctgacagtgcgtgccagtgggacctggaagttcattagtgattctagtttcgccgtgaccttctgccctgtgatcttttgtcgcccttgaagtatgtgatctctgtgacccacaccctgttcgtgcactccctcctctttgaaaattgctaataaaaactcgctggttttacggctcagggggcatcacggaacctgcggacatgtgatgtctcccctggacacccggctttaa

SEQ ID NO: 273294 - DNA, 474 bp, Homo sapiens
ataagtagatgatgactggtcactgattttttgtctagaccccctgatgggctccaagccagctgagtctcaatcatgtgaagaggaacagggttttcatttgagcgaaaaactcacaccactcattcttgggggtgtaactgaaaccacaaatctagcatgttctaaggaacattatcaggcacagtcaggatccagttcaagatatatctagttgaccaaacacattccttatataggcagtcattcaagagctcctacgctcagaaactgctatcagtacatgacgttccttgttattcagtgttcttttcctaattttcaccattttaatgtttatttcctcttcaatatatgagtatattaagtatgtaatcaaagtatataagttaagaatagtaagtgtgcaaactcttatgtgcttccctgtcttcacatggcaaaaaagtaaatatttctattttggctgaaaca

SEQ ID NO: 273295 - DNA, 656 bp, Homo sapiens
aattaacattttttgagtgttcatctctcagtccctctatggccatgaaggtgggagatgtgactctgtttagtctcaagtaaagaaatgcaaactgagataatgggtacaaatggagatgaagcaaagccctgtgatgttcaagttcctggtttctgttaccattcagtctggctggacctctgcctttcccatggtaacatgacctttctaatgaattctcccttttcatctaaactgtttcagattgagtttctctcacataactaagagatctgattactatagcttcggagcttctaaggcatcttatgcacttgtctcttccccactgttcaatctgaagcatgtactctgccctttagcaaaaatcacaactccaccaggtgtggtggctcatgcctgcaatcccagcactttgagaggccaaggcaagaggattgtgtgaagccaggagttcgagtccagcatgggcaaagcaagaccctctctacaaatgaatgtttgaaaaaaaaaaaaattaaggccgggcatggaggctcacaccaataatcccagcactttgagaggccaagacaggaggatcacttgaacccaggagtttgagaccagcctgggcaacatagcaatattctatctctaccaaaaaaaaaaaa

SEQ ID NO: 273296 - DNA, 566 bp, Homo sapiens
gctggagtgcagtggtgcgatctcagctcactgcaacctccgcctcctgggttcaagcgattctcctgcctcagcttccccagtagctggggctacaggtgcatgccagaatccctggtaatttgttgttgttgttgtattttttagtagagatggggtttcaccatattgcccaggctggcctcgaacttctgcgctcaggcaatctacttgcctcagcctcccaaagtgctaggattacaggcttgagccaccacacccagcctgatgataatttcttgattacagattatttgcgaggcactgtgcaaagtgatttatgcacatcatttcatttaatcctagcaataaccttaagagttaggtattattattcccaattttacaaacaaaggaattaaggctcaaagaagttagtttgtacatagtcgaacagttgggtagtggtagagtttgaattcaaacctaagttagtctgagcctatcttatattagccaccttgttccacagaaagcagttttgtttctttgaaggacagggcagcgaatgggcagtgaggcaaggt

SEQ ID NO: 273297 - DNA, 268 bp, Homo sapiens
gccagcccattcattcattccacaaacaccaaagcacccactgcaggcccaatgtgtactccagatcaggaatgtcaccagacaggcaggatcaggccgcagagtccaggaagtcccccgtcaccccggcgggtgactacgcatcagacgggtggctcacgttaatggcctggtccctgaggaatggcaccccttgttttgtagctgggtgtgcgcatgcacacacatccggccctttctctgaacacctgcattacttccacttctg

SEQ ID NO: 273298 - DNA, 355 bp, Homo sapiens
gacagtgacaaggttcccgatgagcacttctccatgctgctgcctaccatggagggcatgggagaggactggggatgggacagggagcaggaaggggttgctcagtcagtcagtgctggcagagggaggggcgctgggaaggcactgcaggccctgtgtctggggcctctcagcacaaggactgggctttgcacgcgaggactgaagggtcaaaggcgagggccaaggtttcctacgtggcattcactcgggagggctcctgaagctggagacacactgccttactttgtgcgtgtttttctctatgcattatccagtatttggctatgtgtgcatttagctcaataagcaatga

SEQ ID NO: 273299 - DNA, 376 bp, Homo sapiens
gtagtcagcaactctcaccctcacccgctctgtgaatgttcagctccaatgtgtgcgggtgggacccatgcttgtccctgccaggcttaagccctgtctgtcagcatcacgggtctgtctgcagctgcctcatttctgtggaaaaatgagcagcagcccactgggtatttccagtgagcaacggtgggttttatgtaaagagtcagaataagcacgtgtaaacacggctgtggccggcacttcaagagggctgtggcccgtgggccttgttttggagaaattcgctgagggaggggttggaaccacctcacagcaggagcaagcgaaggaacaggtgggaaaagtgcagacgcagaggatcaccgagctgtcgccc

SEQ ID NO: 273300 - DNA, 482 bp, Homo sapiens
caggtttacccttcttttaggcactgacctgtactacctgcaatatcttaaaatagaagcactgaaatgccattgtaaagaaagggacatgacagtgtccagaggacaaggccttgtctcagcagaatcagtttcaggagctgaaactccttccttcttacagctacagcacttctctggtggttacatgacagcaagcaattgattctggaagtatttaggaggcaagattaagccatcattgtctgtgttctcacaatacccagaaacaacacctattgcagcctttgcagtacttcattgcacttaactttttgtccatctgcctccttctcctgtctgtaaacacggaggtggtttctgattcatccaaatctccagccccaggcaggtcagggcacagaacgatgtaggctgttttcactgttcccctaaataagtgcctgacccatagtaaacactgaataagtatgaactacagt

SEQ ID NO: 273301 - DNA, 445 bp, Homo sapiens
aacctggcatgagcatgaaactggaaattaacaaggaatgatgcagatgaacacctgcagcaagaaccactctacacctgtccacaggatgtctgaaaaatgaggctgtgttcccacaaatctgtattagatggaactgaattaacaacagtgctccagaaccctggaccatccagcctaaattccatttggggatgagatgcgtttttgcctcagaatcccaagcggtaagcaccatgaacccctcagttcatatctcaatcttcctttctattggattttgttctcaatttctaacttcttactagattatatctcatttaattctacttgttaaagctgatttattctaaaatttgatgaagcaaaagtctggattttgcctcaatataataagaaccacttaattataaacattgatgcagggctttgctaacctgcattt

SEQ ID NO: 273302 - DNA, 2129 bp, Homo sapiens
  misc_feature (384)..(384): n is a, c, g, or t
  misc_feature (1073)..(1073): n is a, c, g, or t
  misc_feature (1770)..(1770): n is a, c, g, or t
agttatgactgacccttcttgactcctgccacctgtctgtcagttatcttttaaagtacagttagggtctcggatttccagaactggggctgggatggcctttgagtgtcaggcattcctgttcttggtggaggtggactgctcagcctcaggtcccagtgctgggcccgaggagggacagcgcgaggtgtgctggcacctgcagtcttctttcttgccaccgcataggacatcactagacaaaagacatcaaaatcagatgctgttgtcccacgttgccatctctctcctcaaatcagtgtcccaatattcaggccgacttcggttcatcctgttttagctgtgcccactagaatttaaaatgtggccgtgcagctcctgacnctgctgagggtgcctcggaaccagaagactgtagagctgcttttctcccaggggagaaactaatgatttgcagaagctagtaatttagagtctatggaacttgccccaggctctcccttccctcctgctttcagtggtactgaggagctgtatttaatctgaacagaaaattccattttcttctgatgattttgtgactatatgaaaatggaattaagggattgtagatttcttccccacaagcatattttaaaatccagagtaaaaataaaaactttcgcagagtaattgagaataaaggtgagaagttttctaataatactttaaaaaattctcatatacagataaattagaagaagcatgaagacttttccttaaagaaatgttcctttccctgcactttgaatagatggacaaaattagtatgcagggacagatccaacttttgtgggagctcatacactttggtgtcggtgcggagggggtggttcttctatagaaaaagaatgcaaaaatatctcccttttgcagaatgttcacattctgcacgtgtgagctgctgttctcctcacctgggcctggagaacatgggtgagatgctgagccccagggcttaggccagctgcctctgcgtatggaggctgtgtgtgcccctcagctgtgccagggaggagtcacagcagacggcntgctgccatcctaatctctgtggcacacaggagaatgtccccacccccaaggaagtccccatgctaattctagaatacgtggctatgtcaccttacatgataatccagagactttgcaaatgggattgagtgaagggtctggagatggtcctggattttccagggagccctaatggtaaccacaaggtccttataggaggaaggcaggagggtcagagtcagaaaaggagcagtgaagacgaagcggggtcagggtgattcaaggaaggggctgcgagccaaggggtgtaggcgcctctagaagctggacaaggcaagggaacgggttctttccgggagcctctagaggcagccagccctgcccacaccaagaacgtaagaggatcgacacgtattgttttaaacccctacacctgcgttaatgtgttaggctggactggctccagcctctcccctctagcctctcagcaacctccacagttaggccctcctggagacccctcctggctgcctcaggccatctcctgtacatccctcctcctcccctcacccagcttgttctttctccccacccccatcttccttatttttcttcttttctttgcaacctcaaaacataaaccctcaagctcatttccgcagcctgatgtgcagtcttcctctctgtcttgtgtctctcctctcacccatgcctccntgggggacagaaggctacaccgtgtggctctggcagcccctcactccacacagtgtaggcatgtgctgttctatcacacatggacactaagagatcttgtcaagtagacagagactaagaggacctatgtgttcatgacactttttaaaggtctgagctgcccattcagctttgcatgaaaatggagattgggagttttgaccaccccatgactgtggcttgttgtgagtgtctgctgtgaagtggcactgcctcttcacaatatcgttggaattccatttggccaggtgacaagaaagtattcacaagcctaaggaggaacttatctgctccttcctgaggaaatatgtgcccccacc

SEQ ID NO: 273303 - DNA, 1727 bp, Homo sapiens
  misc_feature (338)..(338): n is a, c, g, or t
  misc_feature (585)..(585): n is a, c, g, or t
  misc_feature (698)..(698): n is a, c, g, or t
  misc_feature (861)..(861): n is a, c, g, or t
  misc_feature (1103)..(1103): n is a, c, g, or t
atttaaatgtctgtctacccagacttactcgttcaaaaactgtctcatttacattttgtagaagtagagtaccatagtggatagaaccacaggctctggggctgtcctgtctggggttatttgctagctctaccacttaacaatcttagacaagtcacttcagtcttttttttgagacaggatcttactttgccacccaagctggagtacagtttaagagctcactgaagcctctacctcccagactcaagtgatccttctgctttagcctccctaagtattgggattataggcatgagccactgtgcccagcctcacttctctttttttttttttgngatgggcccttgcactgtcacccaggctggagtgcagtagcctgatcatggctcataacagcctcaactttctgggctcaggtgattctcctgcttcagcctcccgagtagctgggactgcaggtgcatgccacaactggctaataattttttgtagagacaaggtctcgccatgttgcccaggctggtctcgaactcctgggatcaagcaatttgcccacctctgccttccaaagtgctggtatcncaggcctgagccaccgtgcctggccctcacttcattgttgatgccttagctccctcatttgtaaaatggggataataatagcaccaacttatgtggtggttgtgagaattcantgatttaagctataaagctggtattcttggccttagcttatcttgaggggggtggtatttatttacaaataaaaggattatcagcacttagctcagtgtctggcacatggaagaaggcttttaatgaatgcagaatgaatgaataaatgagagcaaatggtanagaatgagcctacacaaaggagatgtttctcctctagttctaccagttggcaagatccctacagctaaaaacagttccaccatataatctccagacctggcctggccacagagtagatcagactaaaaatagagcctgctaagcttgataaaaaagactgatattggcacaccctgtccttccagactcctgcaagcctcgctacttctactctggtgtctagaatccacctcacaggaaanactaaagaaatgttttcctttaatgtccaaaatcacaccagcatatttggaagttagttttcaacaaaggttctactgactgagtcagttccctggatttagaaggaaataaatttcttaagccctaactagaacaagaaatcaggagttagttcatacttagttgaagaatgatcatgtatgaattcataaatatagtcaatgactacaacaaaaaaatttcgtgatcagaatgcctatttcagttggatatgagtgatcagatggtagtatgtgtacccattgatgccatacaaattttgtaggaagctggtagagaatttggttttaaagaggtctgtgttggccgggcacggtggctcacgcctgtggtcccggcactttgggaggccgaggcaggtggatcacgaggtcagaagtttgagaccagcctggccaagatgttgaaaccccatctctactaaaaatacaaaatttagctgggcacagtggcaggcacctgtagtcccagctactcgggaggctgaggcgggggaatcgcttgagcccaggaggtagaggttgcagtgagccgagattgagccattacactccagcctgggcaacagagcaagactccatctc

SEQ ID NO: 273304 - DNA, 1569 bp, Homo sapiens
  misc_feature (338)..(338): n is a, c, g, or t
  misc_feature (427)..(427): n is a, c, g, or t
  misc_feature (540)..(540): n is a, c, g, or t
  misc_feature (703)..(703): n is a, c, g, or t
  misc_feature (945)..(945): n is a, c, g, or t
atttaaatgtctgtctacccagacttactcgttcaaaaactgtctcatttacattttgtagaagtagagtaccatagtggatagaaccacaggctctggggctgtcctgtctggggttatttgctagctctaccacttaacaatcttagacaagtcacttcagtcttttttttgagacaggatcttactttgccacccaagctggagtacagtttaagagctcactgaagcctctacctcccagactcaagtgatccttctgctttagcctccctaagtattgggattataggcatgagccactgtgcccagcctcacttctctttttttttttttgngatgggcccttgcactgtcacccaggctggtctcgaactcctgggatcaagcaatttgcccacctctgccttccaaagtgctggtatcncaggcctgagccaccgtgcctggccctcacttcattgttgatgccttagctccctcatttgtaaaatggggataataatagcaccaacttatgtggtggttgtgagaattcantgatttaagctataaagctggtattcttggccttagcttatcttgaggggggtggtatttatttacaaataaaaggattatcagcacttagctcagtgtctggcacatggaagaaggcttttaatgaatgcagaatgaatgaataaatgagagcaaatggtanagaatgagcctacacaaaggagatgtttctcctctagttctaccagttggcaagatccctacagctaaaaacagttccaccatataatctccagacctggcctggccacagagtagatcagactaaaaatagagcctgctaagcttgataaaaaagactgatattggcacaccctgtccttccagactcctgcaagcctcgctacttctactctggtgtctagaatccacctcacaggaaanactaaagaaatgttttcctttaatgtccaaaatcacaccagcatatttggaagttagttttcaacaaaggttctactgactgagtcagttccctggatttagaaggaaataaatttcttaagccctaactagaacaagaaatcaggagttagttcatacttagttgaagaatgatcatgtatgaattcataaatatagtcaatgactacaacaaaaaaatttcgtgatcagaatgcctatttcagttggatatgagtgatcagatggtagtatgtgtacccattgatgccatacaaattttgtaggaagctggtagagaatttggttttaaagaggtctgtgttggccgggcacggtggctcacgcctgtggtcccggcactttgggaggccgaggcaggtggatcacgaggtcagaagtttgagaccagcctggccaagatgttgaaaccccatctctactaaaaatacaaaatttagctgggcacagtggcaggcacctgtagtcccagctactcgggaggctgaggcgggggaatcgcttgagcccaggaggtagaggttgcagtgagccgagattgagccattacactccagcctgggcaacagagcaagactccatctc

SEQ ID NO: 273305 - DNA, 395 bp, Homo sapiens
catttccaattaatcttggaatgagagccgagggcaagaagccagcggtgcctgagggatgctaaagagccaaccgatccagggaaacaaatgccagcgagggaccccacagcaaagagacagacactgtgagcaactctcctgttaccatgaggcttgcgaggcgtgtgtgcgggtctccgcattggcaccatctgccaattcctcaggaggacagaacaaaccagtgaggcatgaagattagattatgtaacgctcgaggattgctgttttcaaagaggaaacaaatggaatgaattgatttgcttgtcaaagtcatgtcactaaaggagatctattccctccccttctaagaggacctcattaaagagtggaatgatttcacagattcagaa

SEQ ID NO: 273306 - DNA, 407 bp, Homo sapiens
cttttattaaaagttctggccataaaagagaaacacctattaggatagaagaatttagtaaaaatagtagtaataacaagacagtttggaatatgtcatatattcagtaaatttcaaaagtcttcatctcatttaaaatacagtattgtgcccatagatcctgaatgcaatacctttgtaccctagggcttcctctttcctacactaaaaacattctatttaaatgcagattttgatttgcaatctaggaagaggattctggaagaatgggaagaaggacaactctgcatctattaattttagttttatgttattcgcgtttttcctctcatccttatctcctccagcccttccttcctgtaaaaggatcctttctaaacatacaaataaagacatgcttagaattt

SEQ ID NO: 273307 - DNA, 197 bp, Homo sapiens
atgcctctgaggtacactccaggtaaaaaaaaaaaaaaaggagcaattcacttttactaggaagaatcagggaaagctgcatggaggaggctggttatagctgcccttgctgtgaagaaattcagaggaaaatttctgaatccaagagggtcatctactttacagacaatcaaatgagacctgtgtcccttgtcccg

SEQ ID NO: 273308 - DNA, 479 bp, Homo sapiens
acccaacccacagtgtcatttgtgagcacacagtctggcttcctttgggggatggtggctttcccgttaccagcagggttatcagtaattcacacccacatggctcatctacctgaaggatccagactgctgaagcagaactgcaacactaaagtctgtgttgggtggaagcagccatgtccctgctctgggctaggtggtgtggatgaggcatagaggaacatgtctggctggacacatagctcaccataggaacatgtctggctggacatataactcaccatggacactttctgctggacacccagtgtctgtcctcattctcaagctgtttccacagcttcaaacacatcaagaagataagcggctgaagacaaaggttaggaaaagtggccatccaccacctgagcccgctgatgagtcctaaagacaccagtgcctcctgagtgaggtgtgcggaggacacagcaccacctgca

SEQ ID NO: 273309 - DNA, 540 bp, Homo sapiens
tgtctgccaagatgacttttgggatggcattactccagtcagttgggctcaaaaaactgatttttctcagcacttgcagcttccacttctcaaagaggacattttgttttttgttttgtttttgagacagggtctcattgtgccaccgcactccatgctcggtgacagagcgagactctatctcaaaaagaaacagcaacaataaaaagaatcactgggggtagggattatttgaaaatgcagattccggccagatacattggctggcttacacccgtaaacccaacgctctgggaggccgaggtgggagggttgcttgatgccaggagtttgaaactagcaggaacaacataatgagaccccatctctacaaaaaacaatattagccaggtgtagtggcacacacctgtagtcccagctacttgggtggctgagataggaggatcgctttaagccttggagtttgaggcttgctgtgagccatgattatgccattgctctccagcctgggcaacagagcaaggcactctctctaaaatt

SEQ ID NO: 273310 - DNA, 483 bp, Homo sapiens
cgagatcacgccactgcactccagcctgggcgacactgcaagactccgtctcaaaaaaataaaatccaattatcctctttatctgtctctttctcaacataatatataaatgtatatatatacacacacacacatatttttctatgctgtgtgtatgcatatatatgttatatgtgtgtatatgtatattatatatataacatagagaaagatgttttaatatctcaaatcttgatcagtcttacatgaaagagactatatagcatgtccaattctcttaccatttatgataactctctactgattttgatgtgatcatatattcctgcatcttccttatgatattgctaaagctaagagtgctccattctctaggaaaatgcgttgtcatattcctaaatgttgactaatactctatatatcatttatgaagaggttattatgccaaagtaggaaataaagtgaattttcatatgtcatata

SEQ ID NO: 273311 - DNA, 548 bp, Homo sapiens
atccattcacctattgaagaacgtcttgtttgttcccaagttttggcaattaggaatcaagttgtataaacattagggtggtggtaacgtatggaaggaagggaagtgttctgtagttctgtgattagatcatagttttatcattagctcttagtgaccctgtgtccctaggatgtgacctttacgagttcttctcagttttgttttatttacctcttagatgagacaagaaggctagtgggggctggcgttgggtatttgccttccaccaagtctgttaggctctggtaagatagtttctcttgaggacagacattgtttagaggaacaaaatgctctgggcatatttcatagaggctaccttattttccttttaaaaaaataggccgggcacggtggttcacacctgtaatcccagcactttaggaggccgaggcgggtggatcacgaggtcaggaattcaagtccagcctgaccaacatggtgaaaccccgtctctactaaaaatgccaaaattagctgggtgtggtggcgggcgcctgtaatcc

SEQ ID NO: 273312 - DNA, 488 bp, Homo sapiens
gaatagaatagagaactcagaaataagtatttgtatttacagccaactgatttttaacaaaagcaccaagaacatttattggagcaggacagtctcttcaataaacgatggtagggaaactagatatccacatgcagaaaaatgcagctcaacccctatctctcgctatttacaaaagccaactcaaaatggatcaaagacttaaatgtaagactcaaaaccatgaatctactagaataaaatacagggaaaacacttcaggatattggtctgggcaaaaattgtatggagaagacctcaagagcacaggcaaccaaagcacaaatagacaaatggggttgcatttcagtaaaaagcttctgcacagccaatgaaataatcaacagagtgacaacttgcagaatcagagaaaatattgcaaactatttatctgacaagctattaatatccaaaatatacaaggtgaaactcaacccatcagcaaaaaa

SEQ ID NO: 273313 - DNA, 379 bp, Homo sapiens
tgcacctgtgaggcccaagaccagccccggctctcccaaaaccgtgttcccgttctcctaccaggagtccccgccacgctcccctcgacgcatgagcttcagtgggatcttccgctcctcctccaaagagtcttcccccaactccaaccctgctacctcgcccgggggcatcaggtttttctcccgctccagaaaaaaggatctgtgctgggagctgtttgaaattcgaatgagtctttcagagaagtttatttaacttgtaaaacttcaggtcctttcacaccatttcagcgttggatcacagacagctcttcctttatatcccagcaacttgagtttatttttcaaataaaagtctgttttcccataaaatgccaaa

SEQ ID NO: 273314 - DNA, 594 bp, Homo sapiens
ctctctcagactcagcttcctccttgaagactgggatgctatgtagctcagaggaaacatacacctgaaggtgctgccccggggggtgcaatgacctgttactgaggctggatggaggatggcatccatcatcagctacaggtgcctcctctatctacaggttcctgctccatctatactagccacctcctggacaagggctccagtgtcctccatgacaccagctttctccagagcctgtgcaggatttccttcctctaccctgaatcagggtgattcttaaaggacagtttcaggaacatataggggcacttgggtaatcttggtcagtaactgacctttaactatcatccatgtgaacatctacagttagggattttcttggtgatgtttggcaaaaagtaaagaattccccaagtgtgaagcctcattcattcacttattcaacaaatagttattgagcacctactatgtgttaggccctgggccaggtgctgggaatacagcagagacagacctggctcctgccctcatggagtttgcagtcattcattcactcactcggtgccgatgatagcgagggatcctctagat

SEQ ID NO: 273315 - DNA, 249 bp, Homo sapiens
gtgtggacgtgtggtgtgtgtgtggagatgtgtggtgtgtggaggtgtggggtgtgtacaggtgtggggtatgtggagatgttggggtgtgcaggtgtgtggaagtgtgcaggtgtgtggaggtgtgcaggtgtgtgggtatgtgcaggtgtggggtgtgtggtatgtggtgtgtgcaggtgtgggtatgtggaggtgtggggtgtgtggaggtgtgtgatatgaggagtggggtgtggaggtgtgggg

SEQ ID NO: 273316 - DNA, 945 bp, Homo sapiens
tcttaaagaaggcctttttcctgttatcacagaaaacaatggcagcagcctgtttgccaggggtagcagaccctttcttctgcctcaacacacttggtggataaggcatactgtcactgggaacagctgctcactccttgtgatgcttaatggaggtgtgggaatgatggtggataggctatgcctcattaacatggggagtctcgaaactggaaaaagtcccactgttgccctctttctccccatccctcctctcctccatggagaattactatgctgtagactaagaattttttttaagtggatgcgtagttatatctatccctggaaatgagctagacttccttatttcaaggaagaattaccatcctcattaaaataaaagctgctgtttattaagcgcttactatctgtcaggcctgtaacttactagcttttcagaactttacctatctcacttcatttagtccacagaacagccctatgaagtgatattattatcttcctcttacagttgaggtgaccgagactcaaaggaacatgagagctcttggtctcgtggattagcttcagaatctagcaggggagaggcatccttggaaattggcagatttggtttggaatctcagtgagcacttcttctttaaactcaatggaagctaagcagagtttattaatctaaaaacttcttagacaataggcctgataatggggaatgaatccctgcttaattatctcaccagatgactgggtagtgacctaagatacactttcttcagtttctgggtaggattttagtgactggtttcccctgggatacatagataactctcctgctgcagtccttaccaactgccaaacccagatctcacccatctctagcttcagtaagtttgagtctcctcccagctcatccactttattccaccaaagaaaaatgtgaac

SEQ ID NO: 273317 - DNA, 322 bp, Homo sapiens
agagctcatgagtcacctagtgtgggatggggtctgggtctgcatttgttccggtggttgcttctaatgtccagccctggttgggagccactgccttaggtcaccaactcttcctggttactgctccctgtcctttttcttgtcttggtggaatcataagataattggaattttacggtgacatgcaaaccttctatagtttcttgatcacattttgtgatctgcttcattgagatttttttgtaatgaaaatttgttaggtggtcctgtagtacattctccattctcccgttccttggtttacgagggaagcctgctgaat

SEQ ID NO: 273318 - DNA, 294 bp, Homo sapiens
cactgtggcctgtcatgtgctgttttttatgaacccctagacatagacatagtgatggatgaggcagggtgcgagggtcaagatcccgtggtttgttcctctgtcccaaggtgggagtgagtgtacctagtttattctgaagggggaggtccccatcctttccataggaaccatcaagagcgtgagtttctgcagcgtcctcacattttaggaagtatctaacagttgctttgtcaaggagttcgagttcttacatccaagttattttatctagactgctgcaaactcactagg

SEQ ID NO: 273319 - DNA, 483 bp, Homo sapiens
acattcttgatgtattatttggaatgctcttcagaactccaagctgctattcttaacagcatctgagcaaagaaaatgctttggacatgatgggtttcattcattcacttattttctaaaaagtaggtactgactaagaataacctatgtcctgggcatttcatcaggtgctagagaaatggagataatttggacacagttcttgtttgcaacgcttttacctccaaggagaggagatagtcatagtcacaccctggattgtgggcagtcttattaggagggtaacaaagttcatgcagcctgctggaaaatcctgccacttgactatatttttaagttttccaactgtgctactgatggatcatttatttcctagaatggtctcaaggatgttaggagaccatttggtaaatcaggtatatgatgaccgaatcttttagcttgaggcaaataaaacatgctcacaagttaagtaagctcaca

SEQ ID NO: 273320 - DNA, 463 bp, Homo sapiens
actagaatgaaattcaacaaagaggatgcaagttcctcaaaagaggaggagcagtatgaaggaggacagtcctgcagcagcccagagaacagctagtgtgtccacaactgtttatttaataaacagaataggagcaaacatctggatgatcttggtcccatggtaaatttttgtgggtcacatagttagtttgagaatcatcattctaggaaaaactaaaaccttcatacagtaacgtcaaagttgaaataaaagaaaatgaaaatgtggcacgatacgaagcagtgagtccagctggcatttaatgataatgcttcacatgccactggtttagtgaaataaaaatacatcttcattatggatctacaggattaatatttccataacctccatattttacatggtctatattttcaatttcaggcagcacaaagcattgcacaaagcaattacataggttacc

SEQ ID NO: 273321 - DNA, 528 bp, Homo sapiens
ggaactcctttcagagcaggcctgtttttagccttctaggatatttagcctcttgttgatgggagatttgttcctatcatttgcatatactgctccatctctgagctttgcttagagaggagaatttggacattcatttgggtattctaagaaagggaaagggaacaagctgtgaagctaaggtataggactcagcttgtagattctcctagaggaaacttttttttttttttttttgagaacagattatccagtaagcaggaggtagaggggaacgagattgaactttgctgacctttgatgtgaggcgctcagccagggccaaggggagagcctggcaagattggcagcctgaagccatgggccagggggccatggtgacctgagacaagtggactctgtatagtggccccctgcttccccttctacctcccctaccctatgctaaggggactcgtctccacctcgtaaaggaaactccccaagggaatccctgtcccctattttcctatccttctacccttccaa

SEQ ID NO: 273322 - DNA, 541 bp, Homo sapiens
ggggtgcgcttccgcgggcggggcgcggagcccgccgtctcggaggccgcggctcggcccggcactgcggagggccgcttgatttcccggaacccaggtcgcgcggctgctagggccggagccggtggatccgagcgggtgccaccagcggcggcgcgccgcctcccccggtgggagcggtggttgggccaggctgcggcagagcgttcgctcggagatggcggagcagccgcgacgcggcccgtggccccgaaagcagggaagccgggcagccccgggacgcggcggagcccggggacagcggggacgccgcccagtcctccgggtatgaagctaaaatgcagcggctaagaacgcggctctggagcttgacaggcctgacgtcgaatcccagccctcccaccaactgagctgtgtgatcctgggcaaggttctaagcttctctgagttactcatatgtgaaatggggataatggagcatgtaccttttccctacctcttagggctggtgtgaagattaaatatatgtgaagctcttaga

SEQ ID NO: 273323 - DNA, 772 bp, Homo sapiens
  misc_feature (583)..(583): n is a, c, g, or t
ggggtgcgcttccgcgggcggggcgcggagcccgccgtctcggaggccgcggctcggcccggcactgcggagggccgcttgatttcccggaacccaggtcgcgcggctgctagggccggagccggtggatccgagcgggtgccaccagcggcggcgcgccgcctcccccggtgggagcggtggttgggccaggctgcggcagagcgttcgctcggagatggcggagcagccgcgacgcggcccgtggccccgaaagcagggaagccgggcagccccgggacgcggcggagcccggggacagcggggacgccgcccagtcctccgggtatgaagctaaaatgcagcggctaagaacgcggctctggagcttgacaggcctgacgtcgaatcccagccctcccaccaactgagctgtgtgatcctgggcaaggtagaggggaacgagattgaactttgctgacctttgatgtgaggcgctcagccagggccaaggggagagcctggcaagattggcagcctgaagccatgggccagggggccatggtgacctgagacaagtggactctgtatagtggccccctgnctttcaccccactgagtacgcttacccggaaagccctaatggctaaaggggggatctacagtctcgcagcgctcgttagaaggacaatttccaccagagggaaagtcccgtggtacaccgttattttctgcgtacttccttatcataccgcctatccagagagacgtccctaagcccatattcgaactg

SEQ ID NO: 273324 - DNA, 718 bp, Homo sapiens
caaggactgtttcttttgttaccctgtttttcacatggtgctcaaccttatgtttgtatataattgatactctttccatattgttgattcgttgtgaatttttaaaaattaagagctaagacttaggaagttttaagatacttgtttacatgctgtgagttagggcttctcctaataagagattgtatgattgagttatgtgctaacgtgtttctgcttgattagttgacttcaagtgctcaaacacagcaaataattgcccaattgaagatgtctaacattattagatattaagctatttcagacccatactaaatcatccatttgaatatagtacaagaaacttctttattgggacttatttttcctctttacaaaatacctttgaaaagagatagtgatatagtagagtgagggaacctgagttccttgactatgtagtatatgaacatgggcctgtcatattaattttctgggactaacaatttgtactattaagtaaaagttaccaatcaaaatccctttctatttttttcagttaccacctgtaaagtctggtagttatagtaatcctacctgagtgggatgttttgcagaacctcagttgtttccactcctctgacttaggataatgactgtttcttgtgtgggggccacagatgccaggatttagatatgctatcattagaaagcaaactaatttttcacaggtttctac

SEQ ID NO: 273325 - DNA, 173 bp, Homo sapiens
ttttttactaggtaggtactagcatctctgtggagaaatcacttttgtgaaatgtaactaatatttatcatcctcataaaagtgacgaagtagactgggcacggtggtttacacctgtaatcccaacactttgggaggctgagaagggcggatcatgaggtcaggagatcgag

SEQ ID NO: 273326 - DNA, 599 bp, Homo sapiens
aagggagagggaaatatgactgggaattctttagagattgagagctgtactagcctggcatgcagacagcagctttagaatcagatctgccttctggcggcttcccacctaggagccatgggacctttgtgaagtcaccaattgtgctgtggatgcttcatttgtgaaggagaacaggactgccttatgaggaaactgaggtacagatgggaaacttgctcaagttcacacagcaattaagtgatcaagtccaagagcaaaaccaggcaggctggctccagagctcacgatagtccaccactgctttccaccatcactacggaatcaagtccatgaggatactcaccttatgtcagttgcctaagttggaaattatagaatcttcaaattggaagggacgttatcatccaagatttcaactttctactcactgcaaaatcccttctggaacttcccagattgatgaattttcatcagctctgcttgagtactcccagtgacttggaaaaaaaacactgtaatatggatatgaaatataaactgttcatggataaattattgcataataaaaacatgcctaatggctacactcccctaaa

SEQ ID NO: 273327 - DNA, 1552 bp, Homo sapiens
agttgtccagggctccctgagggaggccagcacaagagctctgccataaaaggacattggacagaagtgaagagtccaatcagaaactctttttgagagactgaacgcaaagcattcagagagtcagcaggctggagaggccaagacacacacacgaagaaggcaggacactcttctcctcctgcggttggactccaggctctatgaccttcaaactccaggacttacaccagttgcccctgggcactcaggacttctgcttcagactgacagttgcaggacagtgcagcattttattttaaagataccccacaacgtaggtggccagtcctgctgcaggtgcggtttcaagcctttggagtttgaccttctagtccaaggtcattacagctgcaggcagaggctcccgcggggaaaagagcatttcctgggacgctggaactaaatgaacggcccactctccagttcagcccttgcctccttcccgacacataaagttcaagagccacggtcctgagtgcataggaacagccccatcacccttctccctctgggcaagctaggagcagcggtgcgaggctccatttcttcttctctgcctcctggacctcagccacctctgctcaggcacaggccagctgcccaggcgtcctcatctggcgaccagctctgaccgcagccctggtctgctctcggggtcgggcccacacccctcttcttcctcctcttcctcccaaggcctgggctcgggtccctcttctcacctttccctttcttgcgttgcaaccgtaacttgggaaaacccttcttgatcttcctctctcacctcctttcaaacacatgcttgcaggctttttcccgatctcatccttagggcagatacgctcccttgattctgaggtctttgaacttgctgtgaagccacactacctgcgtcccagggtctccagcttgcagatggactgtggtgggacttctcagtcaccaagattgagagctgtactagcctggcatgcagacagcagctttagaatcagatctgccttctggcggcttcccacctaggagccatgggacctttgtgaagtcaccaattgtgctgtggatgcttcatttgtgaaggagaacaggactgccttatgaggaaactgaggtacagatgggaaacttgctcaagttcacacagcaattaagtgatcaagtccaagagcaaaaccaggcaggctggctccagagctcacgatagtccaccactgctttccaccatcactacggaatcaagtccatgaggatactcaccttatgtcagttgcctaagttggaaattatagaatcttcaaattggaagggacgttatcatccaagatttcaactttctactcactgcaaaatcccttctggaacttcccagattgatgaattttcatcagctctgcttgagtactcccagtgacttggaaaaaaaacactgtaatatggatatgaaatataaactgttcatggataaattattgcataataaaaacatgcctaatggctacactcccctaaa

SEQ ID NO: 273328 - DNA, 1473 bp, Homo sapiens
agttgtccagggctccctgagggaggccagcacaagagctctgccataaaaggacattggacagaagtgaagagtccaatcagaaactctttttgagagactgaacgcaaagcattcagagagtcagcaggctggagaggccaagacacacacacgaagaaggcaggacactcttctcctcctgcggttggactccaggctctatgaccttcaaactccaggacttacaccagttgcccctgggcactcaggacttctgcttcagactgacagttgcaggacagtgcagcattttattttaaagataccccacaacgtaggtggccagtcctgctgcaggtgcggtttcaagcctttggagtttgaccttctagtccaaggtcattacagctgcaggcagaggctcccgcggggaaaagagcatttcctgggacgctggaactaaatgaacggcccactctccagttcagcccttgcctccttcccgacacataaagttcaagagccacggtcctgagtgcataggaacagccccatcacccttctccctctgggcaagctaggagcagcggtgcgaggctccatttcttcttctctgcctcctggacctcagccacctctgctcaggcacaggccagctgcccaggcgtcctcatctggcgaccagctctgaccgcagccctggtctgctctcggggtcgggcccacacccctcttcttcctcctcttcctcccaaggcctgggctcgggtccctcttctcacctttccctttcttgcgttgcaaccgtaacttgggaaaacccttcttgatcttcctctctcacctcctttcaaacacatgcttgcaggctttttcccgatctcatccttagggcagatacgctcccttgattctgaggtctttgaacttgctgtgaagccacactacctgcgtcccagggtctccagcttgcagatggactgtggtgggacttctcagtcaccaagattgagagctgtactagcctggcatgcagacagcagctttagaatcagatctgccttctggcggcttcccacctaggagccatgggacctttgtgaagtcaccaattgtgctgtggatgcttcatttgtgaaggagaacaggactgccttgtgaaattacggatggtgctactaaaacatatcaataatttgaatttcacttttgtggatgctttaaacatcatagtcattagaaggtggatctggctgattgtactttaagttttcagtttgagctggagctttgtattataacaggagggtactggacaagaacaacacaataagataggaccctgtcccagagatgactacattgaagttcagagagtttaagtaacttgcccaaagtcacatcgctagtgaatagcaaaacgaggattcaagcctaggcctgcctattttcaaagtttatggaaggaattaaaacatttcttagtctaat

SEQ ID NO: 273329 - DNA, 1459 bp, Homo sapiens
agttgtccagggctccctgagggaggccagcacaagagctctgccataaaaggacattggacagaagtgaagagtccaatcagaaactctttttgagagactgaacgcaaagcattcagagagtcagcaggctggagaggccaagacacacacacgaagaaggcaggacactcttctcctcctgcggttggactccaggctctatgaccttcaaactccaggacttacaccagttgcccctgggcactcaggacttctgcttcagactgacagttgcaggacagtgcagcattttattttaaagataccccacaacgtaggtggccagtcctgctgcaggtgcggtttcaagcctttggagtttgaccttctagtccaaggtcattacagctgcaggcagaggctcccgcggggaaaagagcatttcctgggacgctggaactaaatgaacggcccactctccagttcagcccttgcctccttcccgacacataaagttcaagagccacggtcctgagtgcataggaacagccccatcacccttctccctctgggcaagctaggagcagcggtgcgaggctccatttcttcttctctgcctcctggacctcagccacctctgctcaggcacaggccagctgcccaggcgtcctcatctggcgaccagctctgaccgcagccctggtctgctctcggggtcgggcccacacccctcttcttcctcctcttcctcccaaggcctgggctcgggtccctcttctcacctttccctttcttgcgttgcaaccgtaacttgggaaaacccttcttgatcttcctctctcacctcctttcaaacacatgcttgcaggctttttcccgatctcatccttagggcagatacgctcccttgattctgaggtctttgaacttgctgtgaagccacactacctgcgtcccagggtctccagcttgcagatggactgtggtgggacttctcagtcaccaagattgagagctgtactagcctggcatgcagacagcagctttagaatcagatctgccttctggcggcttcccacctaggagccatgggacctttgtgaagtcaccaattgtgctgtggatgcttcatttgtgaaggagaacaggactgccttgtgaaattacggatggtgctactaaaacatatcaataatttgaatttcacttttgtggatgctttaaacatcatagtcattagaaggtggatctggctgattgtactttaagttttcagtttgagctggagctttgtattataacaggagggtactggacaaggtgagttgctgatagcctccccccacctgccaacagacctatcattagatggaatgtaatggactttggccagttgttctccaccccagctctgacttagcggctctggcaagaatggatatatgagcctaaatacagagcttgttgtgctaaattt

SEQ ID NO: 273330 - DNA, 938 bp, Homo sapiens
agttgtccagggctccctgagggaggccagcacaagagctctgccataaaaggacattggacagaagtgaagagtccaatcagaaactctttttgagagactgaacgcaaagcattcagagagtcagcaggctggagaggccaagacacacacacgaagaaggcaggacactcttctcctcctgcggttggactccaggctctatgaccttcaaactccaggacttacaccagttgcccctgggcactcaggacttctgcttcagactgacagttgcaggacagtgcagcattttattttaaagataccccacaacgtaggtggccagtcctgctgcagggcagatacgctcccttgattctgaggtctttgaacttgctgtgaagccacactacctgcgtcccagggtctccagcttgcagatggactgtggtgggacttctcagtcaccaagattgagagctgtactagcctggcatgcagacagcagctttagaatcagatctgccttctggcggcttcccacctaggagccatgggacctttgtgaagtcaccaattgtgctgtggatgcttcatttgtgaaggagaacaggactgccttgtgaaattacggatggtgctactaaaacatatcaataatttgaatttcacttttgtggatgctttaaacatcatagtcattagaaggtggatctggctgattgtactttaagttttcagtttgagctggagctttgtattataacaggagggtactggacaagaacaacacaataagataggaccctgtcccagagatgactacattgaagttcagagagtttaagtaacttgcccaaagtcacatcgctagtgaatagcaaaacgaggattcaagcctaggcctgcctattttcaaagtttatggaaggaattaaaacatttcttagtctaat

SEQ ID NO: 273331 - DNA, 823 bp, Homo sapiens
agttgtccagggctccctgagggaggccagcacaagagctctgccataaaaggacattggacagaagtgaagagtccaatcagaaactctttttgagagactgaacgcaaagcattcagagagtcagcaggctggagaggccaagacacacacacgaagaaggcaggacactcttctcctcctgcggttggactccaggctctatgaccttcaaactccaggacttacaccagttgcccctgggcactcaggacttctgcttcagactgacagttgcaggacagtgcagcattttattttaaagataccccacaacgtaggtggccagtcctgctgcagattgagagctgtactagcctggcatgcagacagcagctttagaatcagatctgccttctggcggcttcccacctaggagccatgggacctttgtgaagtcaccaattgtgctgtggatgcttcatttgtgaaggagaacaggactgccttgtgaaattacggatggtgctactaaaacatatcaataatttgaatttcacttttgtggatgctttaaacatcatagtcattagaaggtggatctggctgattgtactttaagttttcagtttgagctggagctttgtattataacaggagggtactggacaagaacaacacaataagataggaccctgtcccagagatgactacattgaagttcagagagtttaagtaacttgcccaaagtcacatcgctagtgaatagcaaaacgaggattcaagcctaggcctgcctattttcaaagtttatggaaggaattaaaacatttcttagtctaat

SEQ ID NO: 273332 - DNA, 701 bp, Homo sapiens
cagttattaagtggcaaagaccggatttgaatcaagatatctgatttttaaaattcaccttgtttcaaagcattttacttcacctaagaagttaatacacctcacaaccagataactccttcttttcaattagactgtgtctgtatctgggatcagttgcgaagcagaagtatgacgtgactaaggccaccgctgggttaggatacccccatccaagattgagagctgtactagcctggcatgcagacagcagctttagaatcagatctgccttctggcggcttcccacctaggagccatgggacctttgtgaagtcaccaattgtgctgtggatgcttcatttgtgaaggagaacaggactgccttgtgaaattacggatggtgctactaaaacatatcaataatttgaatttcacttttgtggatgctttaaacatcatagtcattagaaggtggatctggctgattgtactttaagttttcagtttgagctggagctttgtattataacaggagggtactggacaagaacaacacaataagataggaccctgtcccagagatgactacattgaagttcagagagtttaagtaacttgcccaaagtcacatcgctagtgaatagcaaaacgaggattcaagcctaggcctgcctattttcaaagtttatggaaggaattaaaacatttcttagtctaat

SEQ ID NO: 273333 - DNA, 284 bp, Homo sapiens
ctagcccagacctcagagctctgatttgcataaccagtcgcctgctgtacatctccacttggatgtctcacagacatcttaagcttaccatattacaaagtagcacactttgtttcccccagaaattatgctctccctacccctcaactctgtatctcccacagccacccatttacctaagttagaaacctaagagcaattcttgactcattcattttcctcccttttcaaatcctggatgatgtaaaaagctaatcctgattattttatcaccaaaataaatt

SEQ ID NO: 273334 - DNA, 220 bp, Homo sapiens
tttttttttttacaagttctccaggtgattttaacaggcaaccaatgtagaaaagccatacttaagtcacaggactgcctatgtccttatttattttacctatggctcaggtaaaaggaagatttcaaaaggaatacttgacagaactcttctaataattctgatgtgaatggtggaacatgctacttataaaaatacagaagaacaaaaaatacactat

SEQ ID NO: 273335 - DNA, 238 bp, Homo sapiens
gtttgagcacagaggcaagggatgattattcacatacacatggtaggcactcaataaatatggaatcgaggaattgaagtacatttactcagtcaatgtttattgaatttgctcaataaatgtttattgagcattaactaactaaggtcctgctctcaggaagctcacttcctggtagatttactaccaaatgccagttctgtcagatccaatttgctcttgtgttctcccacggcct

SEQ ID NO: 273336 - DNA, 452 bp, Homo sapiens
taccaaccagaatattcacagaatatacacacttattttattcttgaatatagagctaagaacatgaatgctgtgctaatttttactccataaagacattataaatcagttttatcaaagcttaagtacccaccctaggacaaaaataaattattctgacctatatgccaaggaactaaaggagatctccagccaccaaaaaacctgtgaggaactgaattcctaccaaagaactgaaagccttggcttaacagcctatgaggagctgcattctgccaacaaccatgtaagcaaacttggaagtgaatcttcctgcagatgcgatcgcagccctgggcaagacttttgtttgcatctttgcgagagatcctgaaacagagaacccagctaagccacacccagattctgacccagggatactctgaaataataaatgttcattgttgtttttt

SEQ ID NO: 273337 - DNA, 425 bp, Homo sapiens
attttgacatgtgaatatgtctacaaaaccatcacctcaatcaagataatgaacacagccaccacccccaaaagtgtccttgtgccccttttcattcctacatctctccgcttcctgactccttgatttctaggaaatcacgatcttctgtcagtctgttttagttttcattttctaggattttatatgaatggaatcacagtctatgtatactttttgtctggctttcctcacggcataattattttgagattcacccatggttttgcctgtatcaaaagctcattcatttttattgctgggtactcttctattgtatggttatagtataatttatttatccattaacctgatgatggacatttggattgttttctggttttggttattataattaaagtggctatgaacaatgtggctatgaa

SEQ ID NO: 273338 - DNA, 455 bp, Homo sapiens
gtgtggggactatccctagctttgtgactgaagacttgccaggtcctggaagcatctgggaagtgttttggttgaggagagttgaatgtttgaagaagaaaatatcagagtgacattcctgctgctggctcccctctgatgtaccgcccttgtgctttctcctactgcacttgcgatccagcagcctacaaagaacatgtgctttcgaatgaaagccctgctccagcactcactagctagttaaccttaggagtattatttcaaagctcttggagcctcggttttcctcatctgttaaaatgggaccataaatacttaactcagtgttgtgagagtgaaattatgttatgtacagggaagtacacatagcaagtatttgatatgtgttaatttctctttctcgtccttactggatgggatcagagggatggataaaccagttaccacttcaccag

SEQ ID NO: 273339 - DNA, 1070 bp, Homo sapiens
ggaaacttaaaccaaagtctattttcctatttaagaaaactggactctgggccaggtgcacctggcccagagtccagttttcttaaatgggaaacttaaaccaaagtctattttcctacaaagtcttcgttggattttttcataatcttttggattttccatgtaccttctcacctcaccctaacatagaaaaatctctctcttatctggttataaggtcatcatcatctttttcttctttatttctttttttttttgagacagggtcttgctcaggctggaatgcagtagcacaaccatggctcactgcagcctgcctgccaggctcaagtaatcctcccacctcagcctcccaagtagctgggactgtaggtacacaccaccaggcctggcaaattacatttttttttatagaaaaggggtcttgccatgtttcctaggcagatctcaccatgtttcctaggctgatctcgccatgtttcctaggctgatctccaacttctaggctcaaaggagcctcctgcctcagcctcccaaagtgctgggattataggtgtgagctactactgcacctgaacctttttttttgatagaaaatgtgaaaagtgcgttaacattttgaagcatgtatttgcccccaatttcaatgtgtatatatactcataaaattaaaagacagttttactttaagcaactgacccatcttcacaacatttacaaacaaaaacaaacaaacacaaacacaaaaaagcataacaaaacaacagagggggggggcagagtgtagaaaagaatcacaacaggagagagaccacactatcatcagcggcaccgccacatttatttctgtcaacgaggtggccccccataaagagagcagcataactaaacagcaacaacaaagccgggacgatcaaaacagctgctagatacggcgaaaaacgcgtgtcgacgcgagcaaaatgttggtagagaaaacccatcaacacagggggaggagacaacgtggtcgacaaactactgaggaaaattaaacgcccgcaggcgaaaatacaacaatgaaaggaatg

SEQ ID NO: 273340 - DNA, 556 bp, Homo sapiens
gcgttcgagacgggaaacctgggtagaaaaatctctctcttatctggttataaggtcatcatcatctttttcttctttatttctttttttttttgagacagggtcttgctcaggctggaatgcagtagcacaaccatggctcactgcagcctgcctgccaggctcaagtaatcctcccacctcagcctcccaagtagctgggactgtaggtacacaccaccaggcctggcaaattacatttttttttatagaaaaggggtcttgccatgtttcctaggcagatctcaccatgtttcctaggctgatctcgccatgtttcctaggctgatctccaacttctaggctcaaaggagcctcctgcctcagcctcccaaagtgctgggattataggtgtgagctactactgcacctgaacctttttttttgatagaaaatgtgaaaagtgcgttaacattttgaagcatgtatttgcccccaatttcaatgtgtatatatactcataaaattaaaagacagttttactttaagaaatgaaaaattaaaaaattaaacagtt

SEQ ID NO: 273341 - DNA, 324 bp, Homo sapiens
tgccttaccgtttagcagacaatgctgggattgtgcgtgcatctcgtcagtgatctttcctataaatgtgactgtactcaatgactttgcttttacaattccagccagtcttttgatattgaacatagaatgtatatgatcctggaaaccacgaggagggtggtacaggctgtgttttttttttctctctctctctcttttttttttttagttattcaatcagctacaaaacatccaatccttgaagtcctttattttacccacaggcctgttgctaagaatcaaagccacatgccactagccagtaccccaaaggacggcttt

SEQ ID NO: 273342 - DNA, 525 bp, Homo sapiens
actgcctagaagcttgtttctctgctacaattagaatttaatcactggtaatttaagactaatagacccacagatggacatctgtaattaggaaagtatttttgcttttcgttgcaccactcagtttttttcccttttttaaaaaatacatttttgtgttagtgaagcaaactactaaaagtactgaaaatactacaagttgttatttgagttatttcctctgtaaaattacagcaactcattttcagctggctagttagctatctgaaaggaggatagctgtgctagctcaatgcttgcaacacagtaggttctcaggaaatatgttacatgaaataaattaaagatggaatgaatcaatgagtgaacccatgaatgaataaactaatgagagttgccccaatttctctccatctctaggtaacagttctgctctctgcccaccttttgtaccatttccccatcaacaacatccccaacaacagcacacgcacactggcaccaaccagtgtgattatatgaatg

SEQ ID NO: 273343 - DNA, 328 bp, Homo sapiens
ttctcagaatttgaagagccaatatactggcagtaagaaagtgagatggctggacatggtggctcacgcctataatcctagcattttgggaggccaaggcgggtgaatcacttgagtccaggaattccagaccatcctgggccatatggctagaccttgtctttacaaaaatagccagatgaggtgacttgtacctgtggtcccagctatgcaggaggctgaggtgggaggattacctgtgcccaggaggttgaggctacagtaagctgtgattgcaccaccacactctaccctagcctaagtgacagagcgagactccgtctcaaaa

SEQ ID NO: 273344 - DNA, 385 bp, Homo sapiens
  misc_feature (22)..(22): n is a, c, g, or t
acctacatagcaaagggattcntgtattaagaatagaccaccacgcctggactcccagtgagccttcaagaaggtccctttggtgcatgaagctagttcctggaggggcctctccctgtgaccacccccaggaaggttcccttactttctaggggacatgagtcaccctctcacatgagactggcatcttgatgtccccttgatgaaacccccccagaggaaaacccccttcagatgctaaatgcaagggccagccagctcccctagtaactggtttgttttgattggagaatcgtatggtgaagagtgtttccctctttgatctggtcacgagggagctcagaaataaatctgcagcccacttccagcagcagaaccagacatc

SEQ ID NO: 273345 - DNA, 240 bp, Homo sapiens
ggagaaaaagatcctgagtgttgtcttaaagaggcattacgttatctgctgagaatgtcaggagatcagggggatcggtgcccccctcccacctcaggtagaggagccatcagtcccagctggaacccaacacacagggctagagctttatctgcctgaggcagccaggatgtccggcagaacaggtgctggagaccctggtagtcagagctttccaaaacatgttgacttgatttccct

SEQ ID NO: 273346 - DNA, 358 bp, Homo sapiens
cttctcaaggttgaaaataaaaaaatttttgataaattatttctagagtcatagtcaatgaaaaaattatttcaactaaacaaggattttgttaacatacagaatttttataagttaacacacaagctttttaagtttctaaggcctggacttttcacgtgtgtttcaaggaatagattgagttcaaaaaaccttaaattttgctaacacaaaaattttttttgtccaggcatggtggctcacgcctataatgccaacactttgggagactgaggccagaggatcatttcagaccaggaggttgagaccagcctgagcaacatagtgagacgccatctcaattaaaaaataaataaat

SEQ ID NO: 273347 - DNA, 585 bp, Homo sapiens
gttacttaaccttttcagttaaggcaacattgctacctttcaaggagtgagtgattgaagtcaagaaagaagccctgcttgggattagagaaactgaaaagaaatacgatgactcattaaaacagtttgaaaactatagaaaggtcaacaatttaatgcaaatattaattaaatgcctagaaaaagaaaagggaggcaaaagtgagtgaagaagaacatctattgcccttcatatgtgtcaaccactgagctacgagctttacctatatgaattgaattgattttcataaccctataaggcaagtactatttttatccccattttacatatgaagaaatcgtgccacagagaagtttaataacctgcccaaggtaacacacagtagagcagtcaggattccaattcactaactactgctttatcctcttccttggcactacataccagtgactgctggggcaacaaaaatgtagaaaacatggtcccagtctttggaggactcatggggaaacaccatacaatattctgactttgggaaagtgacctaatatttctaattaaaatggaaattaataaccccttta

SEQ ID NO: 273348 - DNA, 464 bp, Homo sapiens
agggtgcagttcagagagcttgaggatcactggacactctgtgtagttagttacctttcttgctttttcatgactcaatctttcactgaataggtttggcagtaaatttcactaagatttcagaaattcgaattataatttcagttctaccaactggatatatttacttaagtctgttttctgttctaaaaaatttgaaggttggattcagtagcctctaaccattttcagtttaaaaattctgtgattttaagcagtttttgaaaacttactctttggatgatatcttagaggaatgtgtttcagcatttccacatttagaagaggcaatctttgctttaaagaaaacagctgtttcactgtatgcaacatggactttgttaattgtacttgtgatctctattttgtaatagctaccatttgttgaactctaaagtattaaagatttttttcattgcaaacca

SEQ ID NO: 273349 - DNA, 433 bp, Homo sapiens
tgaataagcattttctaagaagcaaggaaactgtggacagagggaatagtatctctaaagacactgtcaagaaagtgtatgttgtgttcactgattggagtggctgaattatagattgggtggcatgaagtgggaaggatgagtttggagggaccatattatgaagggccttttaataatgattagtaattatttttcgtttataggcaattaaaaacaaaaaaacaggagcatggctttggactattagtagaaactttaaatccaaaactagcttatgtctctataatagcattttaaaaaatgtacacattaaaagttaagattgcactttgggaggcggaggtgggcagatcacttgaggttaggagtttgagaccagcctggccaacatggtgaaaccccatctctactaaaaattcaaaaaattagc

SEQ ID NO: 273350 - DNA, 124 bp, Homo sapiens
gggggggaggtgccaggacaacccacagacatcggaacagcatggcctgcccacaaaatgtggccagcgctgggggcctggggccatgtgctcagccaagatcaacaggctctgtttaaagctg

SEQ ID NO: 273351 - DNA, 411 bp, Homo sapiens
ttaaaggagcagctgccaacttttcagaaacacgatcaccttccctcctcctgcaaacagtaggtaccattattttctccaatttactgatgaaatagaggcagaaaatggctccgtaatttgctcaagtatttcgttgctcagctagtaaatggcaaagctggaacatgaactactaacttgtacactctcctgcttctccagatacactgaaaaaaggcaggcggcactgttcgtgagatgcatgagctttgcactgtggtccagcacatctctgttgtaggcttcctcatgcctgatcctgaaagggtcactcctaccctttccaaaaaccactacaggtacagcgggacactaatcccttcaggttcacctgatgttagggaccaaataaaagcttggaaaggtttt

SEQ ID NO: 273352 - DNA, 382 bp, Homo sapiens
tgagcctaggttccctacctggcttttatctgcaggaatccagatgtgactcctccccaggctccctatgctcttccccacacccctgttggcaaccactgattttttcactgtccctatagttttgccttttctagactgtcatagggttggaatcatacagtatgcagccttttcagattggcttctttccattagcaatatgcacttaagtttcctttgtgtctttttgtggcttgacagctcatttgttttaagcgttggattaatagtctgtcttttgggcataccacagtttatttattcacctattgaaggacatcttgttgcttccaatttttggcaattatgaataaaactgctttaaacattcatgttcagg

SEQ ID NO: 273353 - DNA, 825 bp, Homo sapiens
caaaaaatacaagttgtattttacttctggttcattaaaatattgtgtttagttggattttttcctcctttattttcagaaacataaaagaaattgttttatttcctaaaggataaaattggatatagcctctttagtagacactatcacagttctgttgtttgctgtgttcatttgcttaatgaattgcgtgagaacagtcactgtaatgaaatatgtgtgctgggggtggggggaagggcatgggaaatgttttatgaaaaaaagttataagcctaatactatgaagtaacatctaatgcagttctttttaagtgcaatatatttatttctgctagaaatatattatcaaccttatgtaatatttgaagcattacatattatttgtaaacagcttaaaattatatattaccccaattgtacataagtacaaatgtgtggatattagtttctttcattaaaagtggtgtttttttaaaaatacatttgcacccatttacacctttcattcactgacactgttttatgatgtttggtacctgtttcctcacctgacaaaaaggattagataagattgtgggtcccagctggccactcacaggctggacacagcccgggattactgcatagtattttgagtttgtctttagttgcatttgaaagccttggaaaagacattgctctcaagttcccactattttccattttctgcacccagtccccttcattcgtgtatgctacccaatgaaccctcagaatcacatgattttgcacctctctgtactgaattatactgaagactccataaaacttaaaaacgcctgt

SEQ ID NO: 273354 - DNA, 1007 bp, Homo sapiens
aaaagttttgcagagtatcgcagtgcctggttcatggttatccgaggaaaacaagtctcagccctggcacaggagcacacatgaaaccattgcagtgagtcgcctgctgcccactttggaatctgtccctcagttggacaccgtgtccccacccctgactcaccttcatgacccaacccgcgagccctgagggtggtactccacatcccccacgctgggctgcgggtgcctgtttctttctaagaaatagaatgcctcactgccgtgagctgtccctcctagttgccagcggttctttctcttgagtaattttacctgttgaggggctgtttgtaccacaaaaagagtgacagacctggttatatgagccttaatttttacactgagtgttaatttctgtgcctatatgttaacatctaattcataaaactattttgagagttaaaagcacccattaagtccctgacagtaagttctcaataaatgttactttaacaacagcaacaacaaaagtagctgctagaagagtaaactcaaagagcaaatttccaaaagaggaaaataaaataagaaaataaaacctgaaaaggacaaataggaaaaagacgaaacaagtaatgacataataagccataaaaatgaataaaaatatattactaatcagtaaattcattaaattttctagataaaaagcaacagttgtcaaatatttttaagaatctgtctcagccaggcgcagtggctcatgcctataatcccagcactttaggtggccgaagtgggcagatcacttgaggtcaggagttcctgaccagcctggccaacatggtgaaacctgtctctattaaaaatacaaaaattagctgggcgtggtggcgcgcacctctaatcccagttactcgggaagctaaggcagagaatcacttgaacccgggaggcagaggttgcagtgagtcgagatcgtgccactgcactccagcctgggcgacagagcaagactgtgtctc

SEQ ID NO: 273355 - DNA, 380 bp, Homo sapiens
actcagggcatacctggtgaataaattaattagttccaaacattgacttgttctttactggaagaagttgcttttattcattaaatttaaggctgatttattcatccatccatctgtccatccatccacccgtccgtccatctgtccatccatccattcattttaaaagtcttgatgcgctgggcgcagtggcttacgcctgtaatcccagcactttgggaggctgaggcaggtggatcacgaggtcaggagattgagaccatcctggctataacacggtgaaaccccgtctctactaaaaatacaaaaaattagccaggcgtggtggcggtgcctgtagtcccagctactcaggaggctgaggcaggagaatggtgtga

SEQ ID NO: 273356 - DNA, 456 bp, Homo sapiens
aatatatatttggttgcagcaaatgctatgcagaaaaaaataaagcaggtaagagggataaggagtacaggggaaaacaatgcagtgataaatagggtcatcagggaaaaaggcctaactatgaaagtgatatttgtgtcaggatgtgaagtcagctgtgtgagcatttgtggaagatattttggacaaaaagaacagccagtgccaaaactttaaggacagagactgcctgaagtaatccggcaagcaaaccagtgtagcttcaacagcaagtggtgaagaggacacaggaggtgaagtcatagacagaaaagggaactgaggtaggtggagacaggttgtgtggaacctagtaggcctgttgtgaggattgtagctcttgctctaaggtagaatgccagttcctgctttgagtagaggagtgacatgatctgattagtttgtggacagaagcaa

SEQ ID NO: 273357 - DNA, 463 bp, Homo sapiens
aatatatatttggttgcagcaaatgctatgcagaaaaaaataaagcaggtaagagggataaggagtacaggggaaaacaatgcagtgataaatagggtcatcagggaaaaaggcctaactatgaaagtgatatttgtgtcaggatgtgaagtcagctgtgtgagcatttgtggaagatattttggacaaaaagaacagccagtgccaaaactttaaggacagagactgcctgaagtaatccggcaagcaaaccagtgtagcttcaacagcaagtggtgaagaggacacaggaggtgaagtcatagacagaaaagggaactgaggtaggtggagacaggttgtgtggaacctactaccccccttccaaaaattttgccactgtctccagtgaaaaaagccgttgacaaaacatgtttgtttataataccttgagttgaaagacctacaatataaacccaatgct

SEQ ID NO: 273358 - DNA, 441 bp, Homo sapiens
actccccagatgcctctaatatagacatctcaagtttggtttctgccatgaaatcgaggcagtttccaacaaagatccaattttcaaatgtgctgggttgccacctggcctcctctaactctgcatagcaatggtgaccttgcagatataatcaagaacccaagcttgccctcttcaccctcgccttgggtttgaattgcaaatagaaaatgtggggccgacctgtggagaggtcaccatgatgtatggagggtccatctctaatatgactgagctgggccccttctccaacctttgttcatttgtgctgcagattttcaaagcatttgaaatcggagctttcaggatatctgtgtgaccattggcaaataattgttaatagatccgatggtgtgactttattccatacctgctctgcttcaacccaacaacaaaaaaaga

SEQ ID NO: 273359 - DNA, 408 bp, Homo sapiens
ggggaaggacacacacagcctgggtgagtccccgaatcactgtaccgagtggaagatgtcagaggaaaccacgtacgcactgcaggaggccattatgcaaagctctagaagatgcaaattaacctacagtgactgaaggcagaaagaaaacaaaaagcagcccaaggcgaaaaagtcgatcctgtgccctgagcacaggcagtcctgaggtgcgagcggtttcccaccaggctcttcttggcctttcgagaacttcagcccctctctgctgtttcctgttgctggcatccactttcccatctcacaatattttctcctgtctggtctcctgtatctgaaacccactgctacgggatctcccctctttctggaaaatgttcattaaacaggaaacaaacccaaaaaaaa

SEQ ID NO: 273360 - DNA, 368 bp, Homo sapiens
atggcttctggtgtttatacgtatttcaaaactcatcaaattgtactctttaagtatgtacagttcagtgtatgtcaatgatactgcaataaaattgttacccacagaaagaaaacaaaaagcagcccaaggcgaaaaagtcgatcctgtgccctgagcacaggcagtcctgaggtgcgagcggtttcccaccaggctcttcttggcctttcgagaacttcagcccctctctgctgtttcctgttgctggcatccactttcccatctcacaatattttctcctgtctggtctcctgtatctgaaacccactgctacgggatctcccctctttctggaaaatgttcattaaacaggaaacaaacccaaa

SEQ ID NO: 273361 - DNA, 550 bp, Homo sapiens
ggcttttgagatgagaaatatatggttttggtaggagttgaggtcaaaaggaaggcctagtatctctaattctgatccacagggttctaacttaactttgcaaagtaagacatggatttacaactgttttatatagtgcatgctgtgcacctacttcccaaatgcacttcgatttttttttttttttttttttttttgtcataaagagtctgggctccttcctgttcttctctctacaactcagcctgtacctgagtggtactagctattcttatattgcttttctatggaggaaaacacagtcttctagagctgaaatcttaagaatgttttgggaagattagagagcttctttagaaaaagtttccaggcatttaatcatacttagtatcttagttcatttgtgcggctatagcaggatacctcagattgggtaatttataaacaacagaaatttatttttcatagttctggaggctaggaagttcagaatcaagatgctagcaggttcagtatttggtgaaggttgctctttgtttccaaaatgatg

SEQ ID NO: 273362 - DNA, 325 bp, Homo sapiens
caactttatctccaattttaatctcaatgcctcttattttatttacaaataattttcataaatgttagagatacaaagtaaatgaagaagactagacaaatttttttctgactttccaagagtttgccatttatcttgaaagacataaagatttttttttaatttaaaaattagttcaccatttaaaacaatgaacaatctagtggtatacaaaatggaaggagaagaaagaaggctataggcttgaaaaatcatctgctgtgcaaattttcagattaaattgatggaaaaattatccaagtttgaagaatctattcattgtggc

SEQ ID NO: 273363 - DNA, 502 bp, Homo sapiens
tcacttttccaaattatatttgagcaccaccatttctgccactcagcagtgtgcccagagcgggctgagcagcccgctactcagcgggctgagtaggctcacagtttgtcggcggtgtgccttgttcccattgaagccagagccgctggcctctgtggcagcctggacgccaggcctctctctttcccactagggtctcacaccaggtggtctctctctcacaatggcatgtgccacagatgctcccccaggttagggcacttaacggctatgtctgggagttcttatcacctaccagtccagtcaactgatgtgtctgaggcctcccattcattgcagactgcaagtgtgaaactctcaaaatcccagaaatcagtaagcagtattgttatggctgtgtgaataaatcacacatttatgaagttacgttttggctatgaaagttaatatgagctcactgtagatattttggaaaatataacagaatacaaagaaaaaaatt

SEQ ID NO: 273364 - DNA, 410 bp, Homo sapiens
gtgtactcaagagctttgaaaactgaaaagtgtcatggaatggcacagaatgacattaagggttttgggtttttatttttcacattggatatcatgagactcattctgaggaaattggtataaatcaagcgtgagactagaaaatgaaagctggtaaaatgagccctgagatgattccttgagctccaactctggtgcaaattaatcagtttgtctctgctgtctgggactcactttccttatcttataaaatgagatagccagagaagataagctcaaaagacccttctagctctgacagtgttcttctgtggttctatgaaaatgacttctgttgggctgaactttgtagtaagttaggtttagaactccacacacctggaaaggaaagagagcaggacaagattgag

SEQ ID NO: 273365 - DNA, 594 bp, Homo sapiens
cactggcagactaatgataaagacactggggtgaacctagccattctaacgggagagactcccagctgacaccaggcagtctaatgatagagacacttgggcgacaacaggcattctaatgtgaaagactcctggctgactcaaagctgtctaattatagagacagctgcatgaacccaggcattcgagagaaagatacccctggccgaccccaggcagtctcatcatataaaaacctgggcaattccagacattctaatgggagagactctcggccaacacaaggcattctaatgggagagattccttgcagacagcaagcaatctaacaatagggacacctgggcaactgaaggcattgaaatgagagagactcctggtcaaccccaggtaatctaatgaaagtaaaaactgggcgacccaaggcattctaacgaaagatactttcagccaacaccaggtggcctaatgacagaaacacgagtgacccccagaattttaatggaagagactcctggttgagcccaggcagtctaatgatagagacacctgtgcaaccctatgcattctaataaaaaagagtcaccaccgaaa

SEQ ID NO: 273366 - DNA, 568 bp, Homo sapiens
gtcaactgtggaatatcctcttaaaatattttataaaacatggtttacactcaatacacaataaaaaaatagatatgtgcaggattttactgtcttatttttttcattctcaaatcggatataagacagacataaacccatacacgcctttatgtttgttaatgtggttatgtttaaacatttttttgagctttttctcacattagaagcgctggcaagagatgtttttttgtgttatagccttgggtagcatgctggtatatagtctgtgaagccaggagagtaactatataatgaattgaccattaggttatgtaatggggatgactatctttatagccttgggtagcatgctggtatatagtctgtgaagccaggagagtaactatataatgaattgaccatttggttatgtaatggggatgactatcttcagatttattttgacaacttgatgcgaaccaacggtagacccgctcatcagggtgtaataggaacatttaatgaaagaagatataatgaagatctttaggtctcttcttgtcatgtcattttattgtgtctgaaa

SEQ ID NO: 273367 - DNA, 292 bp, Homo sapiens
cccccaccccacgaatacacatggtgaagagaggttcacttctgttcctgttgctgagtttcagctatgcccctcggcctcggaggatggctcacctttactgtgaatttctagctgaaagaacaatgctgagaacagggataacaagaggacctctctaacaaatgcatctgctagttacaaaagggctgggaagaacggctcagggacattcctcccagacccaaggaaagggaatggagacacattttgatgttttctacatacttggtcaacttgcagctactataga

SEQ ID NO: 273368 - DNA, 445 bp, Homo sapiens
aacacttgtgaccataggaatatagcagtgctaaggcaaaataggtcttaacttgacttttcctgtcatttgctgccattgtttgccaaaggtctagcacctatcttcagaggaaagtcaagaaattagtgctcagatggtgggatgaattcctgaattattgttggctctagtagtttcttcagatcaattttatagtttctttagaactagaaaattaggtctcagaatggcagttggccacccaatgtgtataatacaattactcaaccagctgcttgaaagcaaggggcaacagagaagtcagctactggctcaggcaacaggaaatttgatgatactccttggtcaaatcattcatttaacatacatttatatagaacctttctgtatcaggcaccattctaggtaccacagataaaacaataaagagaactgacaaaac

SEQ ID NO: 273369 - DNA, 467 bp, Homo sapiens
caagagggattgtttcagagagggcatctcatgtgcagaaaaacaggttgtgaagtcaaacgcagctcagattctcaccagctgtgcgtgtaccctgacgagtcccctcaccattctgggccttagtcccctctgaaaaatgggacatgggcaccagagagactcctgagagctcccttagtgctcttagaggagacaggggaggtctcctttatctttgacccctaacccctcagacttccagaggcgggaactgcagcgatgatacaaatggtgtggtggaaagaatgccgttttggagtcaggacacctgggtttgaatccacttgcagccacttgcaggctgcttgaccttgaacgtatcgtgtcgtatcgtttcaccttgggatctgtacctgtgaagtgggtgaaagttaaagagataataaagtaacagtcgtgaaaccagcctggagcctcctcacaca

SEQ ID NO: 273370 - DNA, 1503 bp, Homo sapiens
  misc_feature (6)..(8): n is a, c, g, or t
  misc_feature (11)..(11): n is a, c, g, or t
  misc_feature (13)..(20): n is a, c, g, or t
  misc_feature (27)..(27): n is a, c, g, or t
cattcnnnagngnnnnnnnnaccaagnagcagcttctccgctccttctaggatctccgcctggttcggcccgcctgcctccactccagcctctaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagtttgcctccttcatagacaaggtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcagctatatgaagaggagatccgggagctgcagtcccagatctcggacacatctgtggtgctgtccatggacaacagccgctccctggacatggacagcatcattgctgaggtcaaggcacagtacgaggatattgccaaccgcagccgggctgaggctgagagcatgtaccagatcaagtatgaggagctgcagagcctggctgggaagcacggggatgacctgcggcgcacaaagactgagatctctgagatgaaccggaacatcagccggctccaggctgagattgagggcctcaaaggccagagggcttccctggaggccgccattgcagatgccgagcagcgtggagagctggccattaaggatgccaacgccaagttgtccgagctggaggccgccctgcagcgggccaagcaggacatggcgcggcagctgcgtgagtaccaggagctgatgaacgtcaagctggccctggacatcgagatcgccacctacaggaagctgctggagggcgaagagagccggctggagtctgggatgcagaacatgagtattcatacgaagaacaccagcggctatgcaggtggtctgagctcggcctatgggggcctcacaagccccggcctcagctacagcctgggctccagctttggctctggcgcgggctccagctccctcagccgcaccagctcctccagggccgtggttgtgaagaagatcgagacatgt

SEQ ID NO: 273371 - DNA, 1072 bp, Homo sapiens
  misc_feature (6)..(8): n is a, c, g, or t
  misc_feature (11)..(11): n is a, c, g, or t
  misc_feature (13)..(20): n is a, c, g, or t
  misc_feature (27)..(27): n is a, c, g, or t
cattcnnnagngnnnnnnnnaccaagnagcagcttctccgctccttctaggatctccgcctggttcggcccgcctgcctccactccagcctctaccatgtccatcagggtgacccagaagtcctacaaggtgtccacctctggcccccgggccttcacttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcagctatatgaagaggagatccgggagctgcagtcccagatctcggacacatctgtggtgctgtccatggacaacagccgctccctggacatggacagcatcattgctgaggtcaaggcacagtacgaggatattgccaaccgcagccgggctgaggctgagagcatgtaccagatcaagtatgaggagctgcagagcctggctgggaagcacggggatgacctgcggcgcacaaagactgagatctctgagatgaaccggaacatcagccggctccaggctgagattgagggcctcaaaggccagagggcttccctggaggccgccattgcagatgccgagcagcgtggagagctggccattaaggatgccaacgccaagttgtccgagctggaggccgccctgcagcgggccaagcaggacatggcgcggcagctgcgtgagtaccaggagctgatgaacgtcaagctggccctggacatcgagatcgccacctacaggaagctgctggagggcgaagagagccggctggagtctgggatgcagaacatgagtattcatacgaagaacaccagcggctatgcaggtggtctgagctcggcctatgggggcctcacaagccccggcctcagctacagcctgggctccagctttggctctggcgcgggctccagctccctcagccgcaccagctcctccagggccgtggttgtgaagaagatcgagacatgt

SEQ ID NO: 273372 - DNA, 1455 bp, Homo sapiens
  misc_feature (6)..(8): n is a, c, g, or t
  misc_feature (11)..(11): n is a, c, g, or t
  misc_feature (13)..(20): n is a, c, g, or t
  misc_feature (27)..(27): n is a, c, g, or t
cattcnnnagngnnnnnnnnaccaagnagcagcttctccgctccttctaggatctccgcctggttcggcccgcctgcctccactccagcctctaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagtttgcctccttcatagacaaggtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcagctatatgaagaggagatccgggagctgcagtcccagatctcggacagcatcattgctgaggtcaaggcacagtacgaggatattgccaaccgcagccgggctgaggctgagagcatgtaccagatcaagtatgaggagctgcagagcctggctgggaagcacggggatgacctgcggcgcacaaagactgagatctctgagatgaaccggaacatcagccggctccaggctgagattgagggcctcaaaggccagagggcttccctggaggccgccattgcagatgccgagcagcgtggagagctggccattaaggatgccaacgccaagttgtccgagctggaggccgccctgcagcgggccaagcaggacatggcgcggcagctgcgtgagtaccaggagctgatgaacgtcaagctggccctggacatcgagatcgccacctacaggaagctgctggagggcgaagagagccggctggagtctgggatgcagaacatgagtattcatacgaagaacaccagcggctatgcaggtggtctgagctcggcctatgggggcctcacaagccccggcctcagctacagcctgggctccagctttggctctggcgcgggctccagctccctcagccgcaccagctcctccagggccgtggttgtgaagaagatcgagacatgt

SEQ ID NO: 273373 - DNA, 298 bp, Homo sapiens
atttttatatattttttctagagacaggatcttgctatgttgcccaggctggtctcaaactcctggccttaaatgaccctcctactgtggcctcccagttgctgggattacaggcatgagccaccgtgcccagaacctcatctgagtcttgaaactaaaattaacattcctttgactttgtcctttggcagactgtttaatcagttctactgagcaggtattatttattttacaatgttaaaaaaaaaaacctacatttttaaaccctaaaaataaactaaaggaaaaaaatataaag

SEQ ID NO: 273374 - DNA, 369 bp, Homo sapiens
gctccaggcaggagtccggacttcctcaggggagtctgcaaggctggggcaagagagaccagtcaggcactggcctgggtgcagaatttcaggggctaccaaaaaacacagtagttgagatgagtaatattgagatgtatttttttaagtcaaaattaatgcaaaaaaaaaaaaaaaaacctgtgataaaggaaatatccagattttaaatagagtcagtaatagtggtatgccgagccatattggagcctgaggctaactgaaaaatcagcaacacggatcctgtctttatttgatatttggatattttgttcattacagatagttttgcattaatttttattttaaaaactattgtgttaaatatta

SEQ ID NO: 273375 - DNA, 238 bp, Homo sapiens
aattacacacatgagccattgagcccaaccagataagatgatctttaagggcccttcccatggtaccatatccaagtcagcgagactgtggctatagcaagtttaacataaccagatacgctagtattatgggctgcatggtgtgccccccacccctaattcatgtattgaagccatgaccctccagaccttagaggtgaccttattggaaccagagtctttacagaggtgatcaagt

SEQ ID NO: 273376 - DNA, 462 bp, Homo sapiens
ggctgctgaggagagccctcggagatgcagtgcagaagcctctccctgacgctgctgatttgggggtaggcatggaaatgtagagagtaccgctcagagaagaatctgccctttgcagagcggatctcagcccaccatggaggccctgtgaactcggtggaaggtgggatcatctcggcgtctgactgactgattctgcttctgcttctaagataaagtggatcaccgagaagacagcccctttacgtctggttctgactgcaggaaggcctggttggtgaagtagaaaatgttggaatcttgagtgagcagctgagttgttttgaagtttggacaattgagaaagaaaacactaagcagtgtcagacacggattccagaaaagcccacgtcacaggcttaaagaacagatgtgtgtgggcacatgatgggaagccacaacggaaaagctagttaactggag

SEQ ID NO: 273377 - DNA, 453 bp, Homo sapiens
tgggccaatgtgtaaagctgtttatgaagaaatgtcaagccagaggggctctactacaaatttggcaaaggacaatttcaggagaagctcttggccgctgggttctcctggccaccatgaacttcaggaagtgggtgccatagcagcagcctgaactacagaatctgggcactggtgtagctctgtatgccctccgtgtcagatgctggagatgtcatttgcattgccagagtttgccaagggtgcacacagaaagcagattgaaaagcaccctcttggaacatctctccaatgccttctactcacaaagtttaacatcattaacacgtgacaaagaagaactatttaatgggcccagatctatttatgaagacaatcaagtgggagtttggagtggataacccaaatttggataactggtgaataataaaatgtatttatttctgctggtgt

SEQ ID NO: 273378 - DNA, 506 bp, Homo sapiens
tcagaataaaaccaggaatggctttcaactctgctggaatcatcaataaaactagtgatcattcagaaatactagataacatgagtggtctccacaaggaaagcccagcaatttgtaggatttccttaggcaacagactcccataacaccaggttaacagaggactctgggccatctccaacaccgaactataccccaagggctctgaagtcaatccaggatggcatgaggttactccttggtcctaaacttctccccagatagctgtaaagctagaaaaattttattactgggtacatgtatataatcatccacagatgcaaggtctctatatgagagggggactgtcttgtataatttaaaacgcttagcagcattcctggctcctggcttctacccactacataccagtagcatccatcccactccagttgtgacaaccaaaaatgtatgcagacaatgccagatgtctcctgggtaccaaatgagcccaggtcaagaacatt

SEQ ID NO: 273379 - DNA, 564 bp, Homo sapiens
atcctaggttttgggctaatatccacttatcagtgagtacatattgtgtgagttcctttgtgaatgtgttacctcactcaggatgatgccctccaggtccatccatttggctaggaatttcataaattcattctttttaatagctgagtagtactccattgtgtagatgtaccacattttctgtatccattcctctgttgaggggcatctgggttctttccagcttctggctattataaataaggctgctatgaacatagtggagcatgtgtccttcttaccagttggggcatcttctggatatatgcccaggagaggtattgctggatcctccggtagtactatgtccaattttctgaggaaccgccagactgatttccagagtggttgtacaagcctgcaatcccaccaacaatggaggagtgttcctctttctccacatcctcgccagcatctgctgtcacctgaatttttgatcttagacattctgactggtgtgaggtggaatcttagggttgttttgatttgcatttccctgatgattaaggatgttgaacatttttt

SEQ ID NO: 273380 - DNA, 292 bp, Homo sapiens
agaagatatgggaatatgatgggacaaacttgagacatgctgttgtagtaaacattgtttttttaaactaagcttaaaaagatttgctaatttctgaatacagattggcaataataattgaaatcatgcaaggagaccggggagacttcctaggagcctcgtattcaagtgctgattaccgtaagctaagcacctgaatgtagctagggaacatttggatgaccattaattaatttctgaataggtatccattatgattgtcaagatatgatatttacttatgagaggaaaa

SEQ ID NO: 273381 - DNA, 386 bp, Homo sapiens
ctcatagatggacagatactatctgtcccactactactcaatgcaaggtctacagtcagatgagcatctaacacaatttggtttgcagagttttcaagaaagcagtgtattttatctgtacagctgcccatttcaactgtcccttctatgctcataggaggaggaaaagaaggcccttggaaattgccattctggaattgaaaacttaaatcctccagacaaccattaacttttaaaggacatctaaaagtgcagctctgtgataaccaagaagatgatggtgatagttctgcctatgactgaatacacaaatctcttaaacctctacagctgctcaacaaaacaaagaaataaacattgcattttgcagagaatccattctatca

SEQ ID NO: 273382 - DNA, 434 bp, Homo sapiens
ctaattccatcttatttatctgagattgaaatgctcttagctattgaaatcttcatggtatctaatgctagtagtattcagagtcctggaacttctacacagatactgcagatagttttgaaaaggtgtgaagacaaccagtctcggagcaatgatgattatcaagctgcagtagaaaggttaattatggctgctcgtatatcagatccaaagcttttcgttaaacacatgactgtcaatgttaataaggaacaggtttatagtttggaacattgttctgccctgaaatggttaaaagagaatatgaagtgggctggaaaggtttggcttttcagtaaccattagctaataaagtctgctttttttttttttttagttcaagtaatcattgttgaaaataaaaggcaataaaaatagacagttttcactatatt

SEQ ID NO: 273383 - DNA, 435 bp, Homo sapiens
acttttagaagaacatggtgagaagactatcatagcttagtaccagtaaatgtaaatgactatcttttgaagaaactatatagcttttttaagagtttctgactttatgaggtgttcattttataggtgtgaagacaaccagtctcggagcaatgatgattatcaagctgcagtagaaaggttaattatggctgctcgtatatcagatccaaagcttttcgttaaacacatgactgtcaatgttaataaggaacaggtttatagtttggaacattgttctgccctgaaatggttaaaagagaatatgaagtgggctggaaaggtttggcttttcagtaaccattagctaataaagtctgctttttttttttttttagttcaagtaatcattgttgaaaataaaaggcaataaaaatagacagttttcactatatt

SEQ ID NO: 273384 - DNA, 424 bp, Homo sapiens
ttttcccctaaaatttcatcattcaataaccagtgttattggcttgctatatattttctctagattttataaagtcatagcctacatatgtatacatgttagtatatattaataggtttgcacttctgtgtacttgtgtgaaagaataatcttctgttcctagctaaaaataaattgctatatataatatatagtgcttgcagtttttttctctaaatttacaatatttatcatggacatctttttatgtcagtacacaaggatctatcttgctgttattaacaaatatctgtcagccaggcgcagtggctcatacctgtaatcctagcactttgggaggccatagtggaaggatagcttgagaccaggagtttgaaaccagcctgggcaatgtagggagaccccacctatacaaaaaataaaa

SEQ ID NO: 273385 - DNA, 425 bp, Homo sapiens
aaaacaaacatcttatatgtacccggcatccaatacgggcttattgattatatttgtgttccagaacaggaactgaagggtgtgcaggaagtggtgaggaacttctgagcaaatctcagtgtaggactccttctgagttttcggtgatatttgatcatcaactgcttaagcccaaagaagaatgttcctgccccctagatgtgctgttctggttatccaaatgacggggctgtcaagtgcgagttcttaacctgactttcatggatgaacttaagggggatctgtaaaattgttttttctttctttcttttcttttctttttctttttccttttcttttttttttgagatggagtctcactctgttgcccaggctagagtgcagtggcacgatcttggctcattgcaacttccgcctcccaggtt

SEQ ID NO: 273386 - DNA, 456 bp, Homo sapiens
ggtcacttgagaccaggaggtcaaggctgcagtgagctgtggtcacgttaccgtactccagcctgggtgacagggtgagaccgtgtctcaaaacaaaacaaaacaaaacaaaaaaaaccaaaaaaacaaaccaaaaccaaaaccaaactttaacatgttctattattttatatataataaatctattttatctattattttacatatgccacaaagcaagatatttatagcaaaataaaatgaaatatcttaaaacatgtagctactatgactttaaatgatctattggtaagatcatttactctgcaatgtgaatgccattaaagataagttttaggccagtgtggtggctcatgtctgtaatcccagcactttgggaggctgaggtgggtgaatcacctgaggctaggagttctaggccagcctggccaacatggcgaaacccagtctttacta

SEQ ID NO: 273387 - DNA, 367 bp, Homo sapiens
catagagtttctgattctgtaaatctggggtgaggccctaggatttgcatttctatcgagttcccaggtggtactggtactgctggtcggtctggagatcacacctcgagaaccactgtattaagcacttactgtgacgccttagcgcattatttccttatgatcacgccgtttttacaatgaaggaaacagagtcctccatcgctgaagagacttaaccaaggtcaccagcctgtcctcttccactcgcacttacacagtgcatgtaaggagtccaggagctttttatggaactaactaatgaaggaataagctccaacatcccatggaagtaaaggaaaaggaacaggggaataatgtaccctaa

SEQ ID NO: 273388 - DNA, 503 bp, Homo sapiens
ctgtcatcctgggcttagagcaaagtaccctggataaatgttgactcagctatatctactccttaaattaaagtgctttactttctgtatcccaactttttaaagcaaatacaggaaacaacacaagtgagacaatttctgcatgtgccatggtttcaaaatcaatagcacttcaactgccaaacaggctctttaaactttaatgaagaatggattagttggtagaacaggagaaattcaagcctatcaccagttatagtaaagggtccttgcaacatttcttgaaacctattaagtaactttttttggtgcccagtgtttcaatatcccacattttaacgtcagaggtagctaaattatttcaaaggaaaaggctgtcttttcatgaacacatacaaatcattacactggaaattcacagacattgctgcagtcccttcctccaccagagactgctgaaaaggaaattagattgcattttgagtgagcaggaggtcagtgac

SEQ ID NO: 273389 - DNA, 297 bp, Homo sapiens
tagttgccctcaaattgagtgtgcattagaatcacctgaagggcttcttaaaccatagatccctgcgccccacctccagagttctgggtccagtaagtgggaggtgggagactctaacaagttcccaggggattctgatgctgcttatctgggaactgcactctgaaaaccccttgtcttggaaaatccaatggaagtttcctgtctttgtccatctaagcgttcactaaaatcatagtaaatgccagagcatgacttgttttggggaatggatggaaggactgcacactccagcca

SEQ ID NO: 273390 - DNA, 430 bp, Homo sapiens
gtatttaccatcttacatgccatctatcttattttttttaccgtgtttattgtctgtgtccacaatggaatgtaaggtctctgaaggagggattcttgtctgttttgtagtgatatttcctcgacacctacaacagggcctgacacagagctgactagttcataaatgaagcagacatgtaaaggcatgtgcgtaaaaagttctcagaggcatattcctatcctggtgagtcaaaaagctgcaggcagggagatggaactcttatgagattcacatactgtgagaaaacaaaacaaaacaaaacaaaacagaagctaggtatggtggctcatgcctgtaatcctggcatttgggaggccattgtgggaggactgcttgaggccaggagttcaaggtcagtctgggaaacctagcgagaccctgtctctac

SEQ ID NO: 273391 - DNA, 492 bp, Homo sapiens
tgagggataaaagactatacattgggtacagtgtacactgcttgggtgaagggtgtgccgaaatctcagaaatcaccgctgaataacttattgatgtaaacaaacaccacctgttccccaaaaacctatttagataaaaaaaaattaaaaaaagtaaaagtattttgatttcatcatcttgatataaaatttttaagtgtctggggcttaaagatactctttcaaaaacttataaagaaattattactgaaatatttgtacatatgagcaagagtgttatatataccattgtctgtaatagaaactatggtaagggaactaaattttcaccactaggttactgtggaaataaactttaggatatcatataaatgaaacactgggtccataaaaaatattgatattatgttgtaatttcaaatgttatcatagaaatgtatttccatgaaaagatagtaataaagatgtaaagagggttacaaagataacaag

SEQ ID NO: 273392 - DNA, 382 bp, Homo sapiens
aaaagaaaaaaaaaaaaaagagagagacacccaaactaaagagaaggaaaaaaaggtatgaacagctttactttcaggggaaaattctctgaaattttcttgaagcagaagaaagttgatctggatagaaataaaaacaaaatacaaactttccagtatcaggctaacacaaaacaaatcaccaagtaagcacacacaaactaggaactgaaagttccttttggacattgtgaataaagcactttttaaaaggtgttttccatgaatatgcttatgaaaacgtgcttaaaggtgggaaggccatgttagcagtctaagatctgttctgagtaaagatgttccatccagagaaacactgatggcgagtaaaccacatgtcctt

SEQ ID NO: 273393 - DNA, 443 bp, Homo sapiens
tttttttttgagacagggtctcactctgtcacccaggctggagtacagtggcatgatcaaggctcactgcagcctcaacctcccaggctcaagcaatcctcctgcctcagcctttctagtagctgggactacagtcacgtgccaccatgtctagctaatcttttaattttttttgtagagacagggtctcactttgttgtccaggctggtctcaaacacctaggctcaaaccatcctcccaccctggcctcctcaagtgctgggattacaggcgtgaaccactgcatcttgcccctcttccttaaaacaataacaaataccagactctccccattttccaagtgtctaacgtttggtgatccaggatgccactgccagctacaggtcagggtggggacttatggaagtcaggtgatacgtggagtttctaacagagtctacct

SEQ ID NO: 273394 - DNA, 296 bp, Homo sapiens
gaagataaaatagtcatgagcatgttttcgtctaatgacatacattcagaatatgtaaagcaaaagctgttaaagaataaggagaggctgggcacactggctcgcagctgtaatcccagcactttgtgattacagcactttgtgagcccaggagttcaagaccagcctggacaacatggggaaaccccatctctacaaaaaaaatacaaaaagccaggcgtggtggtgtgagcctgtagtcccagctacagtgaggacaggcaggaggatcacatgagcccggagagattgaggct

SEQ ID NO: 273395 - DNA, 563 bp, Homo sapiens
atccattgtttctgttgagaaatgagttactgtcttagtgttgctcctttaaaaataatgaatttttttctcacggctttaatcatttttctccttggcttttgttttcaacagttttactacattgtacccagctgtggttttctctgtgtatatcctggttggggcaagccagggcttcttaaatcacattttgaagtagaattttaggtgttagaggctgagaaaggtaggaaggagaggtggatggggagaggttcattaatggataccaaactatagaccaaattatagctatgtaggaggaaggagttctggcatcctgcagcactctcaggtgaatatggttaatgatgatttattgtatgttttcaaaaagctagaagaaaagattttcaatgtccacaacacaaagacatgataaatgtttgagttgatagatatgctgattaccatgatttgatcagtacacattgtacacctataccaaaatcatcactttgtatcctataaatatgtacctacaaatatgtacaattattatgtgtcaactaaaaagaaaa

SEQ ID NO: 273396 - DNA, 523 bp, Homo sapiens
tctgtcataagacgttcacttaacaggtgctatacctcaaaggacagatattgtcatttttgtttgctgcaggcttaattttgttcccctaaagttcatatgttgaagacctaacccccagtacctcaaaatgtcactacatgtggatatggggtcttaagagagacaaataaatgattatgaggtcattaggatgggccctaatccaatctgcctggtattcttgtaagaagagaaaatttggatgcacggaggcaccacggttgtgcacgcacagaggaaaggcctcatgggaggacacggcaagatggtggccgtctgcaggccgaagagaaaggccccaggagaaaccaaccctgcttgacaccttgatcctagacttccagcctccagaactgtgagaacgtaaaattctgttgtgaaagccacctactctgtggtattttgttatggcagcccaggcaaatcaatacatgattaaactcctctgatgcttaagtacctcacgtattaaaaaaaaatg

SEQ ID NO: 273397 - DNA, 709 bp, Homo sapiens
gctacttgaagacccagaaaaattgattcttacttgtctttgttatcaagaccctgtttcatacctaagtactggtgaaacatgctctagtttgtgagctatttgagtagaactaatggaaagatgaaataatagtacatcaatagttacaatgaagaaactaattatcccagagagtttttgagcatatgggtagtgtttgtgaatttaagtttgttccccacattgtcagtttattctaaaattatcaccattttagacttaaagaattttaaagccaaaagataagcaaacagacttgcttaggtcctgtagcaaattaattcagaccttgaacaacatttcattgtgctgtttaggaagtgttaagtatattgagattttccatattactgtgttactatcatacttaaattttagaagatgatcaaattattttaatgactaggactatgcttatgaagttagcatttcctgcccttatttatagaaagcacttgatatatttcacaaaggtgaggagattaactttttagggaacaagtcatttaaattcttgaaccagtttccatcttttaggctatatgagtattgaatataggagaaaagagaaaagtatgcatgtttctcaaaggctctttctttaaatgtcaccagcagatctaaacagtatccataggcacctatggcaaatttactgaaaaaaaaa

SEQ ID NO: 273398 - DNA, 133 bp, Homo sapiens
tggaaatcagtcatttcttctccccttttgttaaatatattaataactccaagactcctttaacaagtgtgttttctctctgctaagatgacactctctaccgcatctcaagtggtttaaccaaaggtcgacg

SEQ ID NO: 273399 - DNA, 545 bp, Homo sapiens
tgtaatggctttgagatataattcacacatcacacaatccacatgttttctttctaacaaaagatacataattatatacgttatgggtcacatttaacatgcataaacagattttgtcctacagcaactgttgagtccatttgcatataagtagaacactaaggtggaaaaattaccactatctagagcaaaaactattacaaacatgtgcataaatttcccaatatatataaggagattatatatatatatatatatatatatgaccttcaaatttgtcatgaaaattttagtcacatataaacctgtgtgacgaacagtacagttttacaaaaaatattctgtgctttaaaccagcagaatgtttatgcacattaacaggtaaatttctacctctgaggtttttatatcttagaagaggaattgcttactagaagagtaggaagatatgagattatatatgtgcatgtgcacgtaatgaatatggaaccgaggctcatgactaattcttgtttcttaatggtatgatgaatcaaagaattaag

SEQ ID NO: 273400 - DNA, 285 bp, Homo sapiens
ggagagaccttggccgagggaaaaacaaccccaagaagcctggagtaagtggtcccgaggcggctcaagacagtttggttttattcattttagagagacaggaattgcagggaaaatcatgaattagtgcctggaaggtgtaatttccttaggcagaaagggagggacctggccgggcacggtggctcacgcttgtaattccagcactttgggaggccaaggcgggcggatcacctgaggtcaggagttcaagaccagcctggccaacatggtgaaaccccgtct

SEQ ID NO: 273401 - DNA, 443 bp, Homo sapiens
tcttccctaacctccatagaaaacaaattattttgttagaactggagggtggtatctgtgatttcaagatggttcttcgccattttaatctctctttatctcaggttagacttttgtttgcaattgtgattttcaaagaaaaggtccttgtcaaatgtttcaagtagaacacagcaacacacatttatttgcaccccaacttgtcaacaaagcgtggggacaggcatgaaggaaagatgccattgcctgccagtgtttaacttcattgctgcccaactcagaactcatctgactaaaaacacttcttaaccccaatgtttttctgtcattttaggatttcactgtggcacaaaatgttcctgcggtccaaaattgagaagggaattgaaacaagggaaacttttactgttatgaaatataataaatagtgcttgctttacaaa

SEQ ID NO: 273402 - DNA, 420 bp, Homo sapiens
tgttctgtttctcttctgtaacacaaagagtactctgcctccctaggccataaataactccagggaccttggaatatgacatacgattatgaattgagtttcataactatcttaaatgactcattgtgactatcaggtttaatgaaatgctgcttctccattttttttcagaagtatacagtaggaaagatgccacaaaattactgagaggaatgtaatgataaactaacttgccaaaatattcttgtgaacaagaggccaaataaaaatggtgaaatgagttttcaaaaaagaatcaaacaacagaaggcaggcatatgtagtgatatagtatgatgatagaagaaggaggacaaaaagttcaaagacctgtcaagtgaatataaacagagtcaaagtgaaaaaaaaaaaatttaaacg

SEQ ID NO: 273403 - DNA, 456 bp, Homo sapiens
tctgattagccacatggtggatattttaatgaaatatttgctaacttctaaaaagcaggagattttattttatttttttaacttagatttctagttttgcctggggaatcagaagactggtacagtggatccacatccccaaagcagctgtagctatgctgggtagcagctgccttcttaaacctggcgtattctctgtcagtttgccaaagtctccactagttccccaccaggctggctttactcgtccacatcctgtctaccccagtgggctcgtaagtgtgtgatccctggcctgtgttgctttcttccctaccagccctcactgctggcagttcccacagcagccatcatgagtgggagagtattaagacatggaagcatgctgtgtaaggctttctcagacccaaagaacatgagagagaaaaaacacaaacacttcattcccacccatga

SEQ ID NO: 273404 - DNA, 186 bp, Homo sapiens
tttttacatgacttttctttttctgtccataaatcctctatgaccgtgtggcatcaccagagtctctctgaacctactctggtttggatgccagggaagggggttggcaaggtgcccaatttgcaaattgttctttgctcaaactctgttaaatttaatttgtctaaagtttttatcttaacaagg

SEQ ID NO: 273405 - DNA, 657 bp, Homo sapiens
agtcccagctgacctgggaagctgaggcacgagaatcgcttgaacctaggaggcggaggttgcagtgagccaagatcatgctactacactccagcctgggcaagagagcaagacattgtctcaaaaaaagaaaaaagaaaaagaaagcaagagttggctcctgtcatttctctgctcaaaactcctcaatggctggttcctgtttcactcagaataaaatccaaagtccttaccatggcctgcatggtcccaccagctgaggccaccttctgccattttcctcttcatgctttgctccagccgcagtgacaacttgttctttccaccacctggatgaagctttccccaaatatcctcacatctgttttcctcacttccctcaagtcactgttcaaatgtcactttatttaaaatagctgccacttctgaccctctgtcactcttgatcaccttaccctaccttgtgtctttcttagcaactgtcacaacttcacattttttttttttggtctattttccacccccacagacacccaaactgattttatataaaccccttgaaatcaaggactttgcctgttatggtgctgctatattccctgtacctagaacaaagcctcatacctggttggagctcagtaaatatttgtgaaaaaa

SEQ ID NO: 273406 - DNA, 315 bp, Homo sapiens
atgtacagatagcaaataagcatatgaaagacttgaacatcattagtcattgtggaaatgcaaaataaaaccatattgtgatactacacacctgttagaagggctaaagttttaaaaactgacactatcaaagtttcaggaaggacacagagtaactagaactcttaaacattgctactgagagtgcagcatttgtacgtcactttggaaaagagtggcaggttcttataaagttaagtgtatttaccccagcctgggtgacagaatttacaccagtctaggtgtatttacaccagccggggtgaccctgtctca

SEQ ID NO: 273407 - DNA, 476 bp, Homo sapiens
cagctctgaccaaggctggttggcaggggagtgtcacggagagacagagcagaagtgagtggggtagggccaagccatttccagctgtgggctcaggaaggcttgaaggatagttgataaatgagtgatatctggaaggacaggagaatttccgagagtggaggtggagccctcgtgtggaggaaacagcctgcacaaagacaggggcaggggggttcgtgtggcagttttcctgacctgccttgcccctggaggctacagccagttgtgtccctggagtagaatgctgaccctcaccattcccagctcaccccaaggacctccccaccccattgtgacactacttcctggacaccagtggagctcaaaggttctgcttccaagggtctggctgggcctggattgtggtcaggtgggccctggctttggcttgcggtcctgcctacagggaggcagggccgggagggtgtggagag

SEQ ID NO: 273408 - DNA, 214 bp, Homo sapiens
gtagagctggggtcttgtcatgttgttcaagctggtcttgaactcttggcctgaagcaatcctcctgcctctgccttctaaagtgctgggatcacagatgtgagccaccgcacccagccgggaaaaattatttaaactatttgaactgatctctgaaggttcatatgtgtcacatagtacttgcctctttatttttctggatcccaaagtccaa

SEQ ID NO: 273409 - DNA, 241 bp, Homo sapiens
gacaatgaagccacccggcccctaccactttgactccctctcgccctcctcaccgtcagtccacacagcataattaggatcaaaactgaatccacctgatccctggacacagctcagacactccttgccactaataccacaggaagcaaggtggcaactcctaagcatcagaataaattcagttaaaaaacaaaaatccgctcatctccccctggatgaaattcatgtttctggaagaaaa

SEQ ID NO: 273410 - DNA, 434 bp, Homo sapiens
acgcgtgggttgaattcctggcctcaagtgatccacctgccttggcctcccaaagtgctgggattacagctgaccactgcccccagcctgtacttctttttagtagaggtggagtttcaccacgttggccaggttggtttcgaactcctgacctcaagttgatctgcctgccttggccttccaaggtgctgggattacaggaatgagtcaccatgcctggcccaacttttctgctttgtattttctttttttttttctaatattccttttttgcctacagaccaatttttaggtttttaaattctgtatacatcctgtgtggccttgggcaagttacttaattgcattgcaacttaagttttcccttttgtacaaaggagagcatacatgagaattcttctgaggatcaaacgtgtgtatgcaaaggggctgca

SEQ ID NO: 273411 - DNA, 241 bp, Homo sapiens
ccagagcttcttgcagaaacacagacaaatgaaataatagctcttctccccatggggttatactgagtacagcccattaggcagaatggagccatattacatggttttgaaagaagaatttaaaagtcatataaaaggtaatgtactgggctggacagtagagtaaccagatgcgtgaagtagacaaagttgacattaacctctaagatcggccaggcacagtgactcacacttgtaatcc

SEQ ID NO: 273412 - DNA, 407 bp, Homo sapiens
gtcaatacccaaggggctgttgacctcagaggcactccacacttttccaagagggtattgcaaaatctgcaccattcttttaaaaggcaaaatggtgactttctgcctgaaaacagcctgaagtcccttgtggtcctctgagtccacgcttcaaagatgtttctctccttagacactagtgtggcatcagaggtccaccaaaggtggatgtctctgcaaatactttccaaattacttgttgcaggaagctgattaatgctattttaacagttaaatctgaaaaaatagaaccagtgtctttaaatctgtgttgtgattatctcaggtaatagacttggcatttgtactatgagtctgttgggcacaaaatgttcaattgcctgaacccaataaggaatggatttttc

SEQ ID NO: 273413 - DNA, 482 bp, Homo sapiens
ttttatgctgactcagccccactctgtgtcggagtctccggggaagacggtaaccatctcctgcacccgcagcagtggcagcattgccagcaactatgtgcagtggtaccagcagcgcccgggcagttcccccaccactgtgatctatgaggataaccaaagaccctctggggtccctgatcggttctctggctccatcgacagctcctccaactctgcctccctcaccatctctggactgaagactgaggacgaggctgactactactgtcagtcttatgatagcagcaatcacacagtgctccagacccatggggaagtgagacagaaactccccagagcatctctacctgggccagtctcagcctgtctccaccagagagggtagctctcccatctctcctgtctaagtgcttgaggtgaactttgcttatgacttcctcttttccttttcaaaataccaatctgtttttccacacctt

SEQ ID NO: 273414 - DNA, 400 bp, Homo sapiens
atcataaagcaaaaagaacattcttaagaagtaactttcttctgttgacaagcacttggacttaacgttccacgaaaacaggaaatcctctcctttctcgtaggcagagacgcatccctgcagtcacaggggcttggcctcagatgtctagggtgtactgagggggtgttgccatgttgaccatgtgcgtcctctctggctgccacaacagaatactgcagagtggggggcttcagtcacaaacctttattgctcacaatcctggtggctgaagtccaagatcaaggtgtgggcagggctggtctctcccaaggcctctctcctgggcttcagatgccgtctctgcatcctcaagtcctcacccctctgtgtgcacctgtgtctgcatctccttcctaca

SEQ ID NO: 273415 - DNA, 587 bp, Homo sapiens
ggctttacggcctttacagtgctggccccggtggccacccacctgcctgcccaccgtgctcaccctgcctttgaatgcccagcctctttgccccacaaccaatgtgacctggcttaggagcatagctgaagcaggtcgctaaggaaaaaccaagcaacgggactaatgggatgttctgaaagacaaggacaaatcaagccatttgtcagaacattggttataagagggaaaatttgggaataactctactacctaacagaataggaacgtaaattcagaacggatacttaaaagaaaatgtaagcagtcttaaaattttattcatgagtatgcaaaatatatgttaaatgagagaaacagaacaccaaattgcatcagcaatatagttaatatctatgttaaaatacatagtacacacagcaataaaacactaaacagatttataaataaacattaatgatgcttgtgccagggtggtacaattggagtgatggttctccattttaaaaattgatagatattactttggttaattaaaagtctgcctgtagattttctaagccttcgaagcactaaaagcaattttt

SEQ ID NO: 273416 - DNA, 91 bp, Homo sapiens
ccccggtctgggagggaggctcacaatccctgggcagactgagctagggacagtgatcaccatctttcctggcctggctgggggtagaaaa

SEQ ID NO: 273417 - DNA, 484 bp, Homo sapiens
ttatttaagtactgatgggccattcacagatcattgtccactatgccatttaatgcctaaacaatcctttgacacaatattcattctcattttataaataagatatagagaagtcaagactggctcaagatcatagctcttacccctgctcttactattaataatatatcctaaaatactaactggcaaataataaatgttaatgaatagtggtttatcttgcatctcagcaaagctatgtccaattttagatatcacattctttccatcactttttgctttcagagcgagtgacaaggttataaaaacaagaaaaaatatagcgttaggctattttataaacagtatagtagaaaactctaatcaaatttctcaagttttctcaatgccattatatttctcaattctttcagagaactcttctgctcccaaaacatccaatatacaacaaaaatgtatgatttttatagtaaaatgactttcc

SEQ ID NO: 273418 - DNA, 148 bp, Homo sapiens
ccacccttccaagcagccatgctaataggggccatcgtaattgtccagcagtaattcatccagagacagattcgtgttggccatatctaatggcctggctctcggtccccttctgtctcctttatgactcaagctaattcacgatgtg

SEQ ID NO: 273419 - DNA, 378 bp, Homo sapiens
aatgttttgcttggtttgctgtaatgtttgtttggtttgatgctcttaatatagttaactagttactccagctggaatttatttggtaaggagtaaagtgctaaactaatttttcctcctgaaatagctaactaattatcccaataccattcactaaataataatctctcccagcagtgcgttagtctaaagaaagacagtatctgctgctctctaactgcaaagctttgaggtttcaccctaatatcagcacttacactaggaaactgaagtcagttactttatctcaggcactgaggccacaaaacaggataaagaaaaacagttactttcttcgaggattcaaataaagataataaattgtatttaaatccaaaa

SEQ ID NO: 273420 - DNA, 164 bp, Homo sapiens
aatgttcttcttgatgtaagtaattactacatagtccttcctttgtgataaatcatttagctgcatatttgttttactcgccagtaattaaagaccagtaacttaaaaatttcaaattttatgtaatcttaaatcaagcctacaataaaaaaaaatgtgcaaaa

SEQ ID NO: 273421 - DNA, 165 bp, Homo sapiens
agcatctgtaatcccatatctagaaaaacatgtttaagtagaaattcaggttcacaaagatgagttaaggattctgctaataaatagaattgattctattaatcttttctaactacgtgacatgaacataaacaataagtcagaagagaaataatttatcataag

SEQ ID NO: 273422 - DNA, 356 bp, Homo sapiens
gcgcccttgtcatcattgggatatcataggcaagccaggtgttccagctttagccagctgtgcctgaccccacctgggcctgcactgaacaggaaactcggggcacaatggacacctctatccagcccattgtctgaagcagagagcacttgatggtaaacaaagatcaagtacatacccatctgcttttactgcaattggctattacctgtaattgccatttattagcctatagattgaactgcacaatccaatataaaacctgctgacagaagtgcacagggctaaaggaacaaagccagaagatcctatccaacatgctttattgtctcaccatcaagggatggagaaaattt

SEQ ID NO: 273423 - DNA, 477 bp, Homo sapiens
acagttgctcctttttctctctggttttcctggactatgtgaccaggaggactgtcttttcaaagggaatttagagcctcactctcctggatacctgttacttcctggctgtcaacccttaaaggaccccagtgaaatgatgtgcatatgaaaatgtagtttggggatgactctacctgaaaactccaaacagggaaaaagacctcaattacgagaggcatagtgacctgcctcacctaatcctcacccttgctgctcctgatgcaaagccaggcacaacaagggaaatccatgtccaaagcatagtgtggtctcaactcttagaaactccctgggtttcccttttctcttagccacatgctaaccagttgcttctcagtgtttctcttcaatagaaaaataaggttttatatgccagcagcctatccttgtttttgcattttaaagacttagttatttatacgtattttaaaatga

SEQ ID NO: 273424 - DNA, 440 bp, Homo sapiens
atgctacctcctgggaagccctgagaggaaggatagttaagaattcatattacccagggaggtctggccttgccctctttggctacagggaggcaatctctaggctctggaatgtcatgcctcataggggtctctttatttgcctggggtctttgggccaggtggtaccagttctgtctctagaggggctggggacgagagggcagccatgtgggcagtatttgaatgagctccagcaaaagctttggacaccgaggcctgggtgagcttctctgggaaattgacactgtgacagtgacatgtctgtgactccactgggagaggagaacagagattccacgtttagagccctcctgggctctgccctttgggcttcatcacttggctgactttaatctgtactctttttgctgtattaaactttaactgtgagtataaca

SEQ ID NO: 273425 - DNA, 424 bp, Homo sapiens
agttgatggtaccctcagaattgaattaattctgtaattctttcaatttttaaaatgtcaggcaattcttcctcattgaattcaggaaattagttaatcatctgccttaaaagaactaacttgtttgaatgttgaactggtggctcattgatggtttctgagatgtactatttaaataagtatgtgcatgttataaaatatatttggctatgcctagtgttgctaaattttaaatgttcttttaaatgtaacattataagaaccaattaatgatgaaggaattacacagaataacaaaatgcttgcaaatgagaccaagcaatttgcttagttatactaagtaaacagagtaagttctagaaatggtcaatattgcttttgatcaaactgatatactcagagtgattaatgcctgaaagatggg

SEQ ID NO: 273426 - DNA, 489 bp, Homo sapiens
ctatttctgaaatactgaatttgtacggggaaaaaagcaatattcaattaaatatgattgacttactaaaacattacgttaggaacaaaaatgtaacatttattccaagaatatcttctgggatcagctccattctacttccaccatgcctacattttctaattctactctagttatgaataaacatgaagcttgatactcaggagtgaatacgcccacggcttaagctgattctaggttctaatagaaacaactcgtagcttgaaagaggtgttgttcttttacaataaagcagaatctggttcaataatgtaaaagcagaggtagtcctgcaggaattagactgtgtcatttgatttttatgggagttattgtctaatgagagttaatgattaagcacatttggttgtattgtcttttggttgttaacctattctacaaagtttattacaaaaaaaaaaaaacaagaaaagcatttcactttcaaca

SEQ ID NO: 273427 - DNA, 502 bp, Homo sapiens
gggcaggtgaactcaggagagatgtcagagagtaggtgatctttatcctaggttttgatgagagggcaggtccttgataggaagatacagagtacagtataaaaatagatcagcaacagcaatagaaacattttaggaagagtttttttggcctctctggaaagatttacacggggaaagaatgttctcttcctcattttgttaattttacatcagcaaccagaatgaatctctcccctccctggttcccagcacacctcccctgcacctccccagcagcttccctgcagcttcgaggtctttctattcttattatagttatggtgcatgctcctgtctctccctctagtatgaattcattcagatcaggggctgtgtcctgttcggcttcttattcttgacaggccttatcttgccgccttgcccttgtaagcacttcataaatgcttgttggcttgaattttcaccaggaattaaagaaaaaagttttacacagataata

SEQ ID NO: 273428 - DNA, 564 bp, Homo sapiens
tctttcaagaaaggatgaaacaaagatatttttcagacatagaaaagttaaaagtaatatattatcagcaaacctggactatgagaacagtgtaaaagcctttcaggaagaaggaaaataaagaataatatctttgtgcagatagaaacatggatccacacaaagaaatgaagagcactggcaatagtaacaccataagtaaatatacaatacctgcccttattacttaaatatcttttaaagataattggctgtttagaaataatagcagtgtcatgtgagttctgcagcatgagtaaaagtaaaatatatgacaacaataacctagagagacttaatggaaatatagtttgtaaggttcttagactgtgtgtaaagttgtataatgcctattaaaagttggctattacaagttatctttaagttaaaacatctgtatggtgtaatccctaaagcaaatgctagagtaacaaaaacagtgataatattacaatattacacaataatatacaatgcagcgatgaaatagaataaatgtttcaaatgcttgaaagtagacaaaaa

SEQ ID NO: 273429 - DNA, 291 bp, Homo sapiens
ggcgggacacggggtgtgaaagagaggagatgaggagtcagcacatccagccaccccctccaaacacacctgggaaaagggagaaccccggaggacagcccagtgggagagtggctcacaacaagtccacatacatcttgtgggactcagggaccagccagacacaggaccagggtatacaggtgctgacttttgagttgtccacggcactaggaggcacatgccccagcacctccccaaattggaaatctgggggtacaacctctgtacacacatgcattccagctcgca

SEQ ID NO: 273430 - DNA, 550 bp, Homo sapiens
gctgcctctaggcagcagctcaggagcagtgggcaattgagagcaactcctgagagcactaaaagaaatcacattgcttaaatggcatttacaccgaggggtggggtggtagtggcaggagtctcaaagctttttccgagggcactgtggcaagaagtccatggtgggaagagtggcatccaggtgtcctctatccaaggaggcagctgttcttattcaagggtggggtccattttcttcctccaaagtcaaagagattctctttaaaagctcaattgtgacttctgggacatcttagcaagagacactgagcgtcttcatttcctctctccatttcaggacacacctcccttggaggagtgctttctacctggaaagcagtgcatgtatcagtggaattctgcttagcacaacagaattgggaggtggagcagggagaatgaggccaccctggccccactggggggtcacaagacagctacttcatgcctgagaacagggcagaatcaggctgggcaaatagtagggctgagggactacccgctgcatc

SEQ ID NO: 273431 - DNA, 298 bp, Homo sapiens
ggaagaacatcagccctgctgagacctgggtgagggtaacaggcacagctctgtttccaggctaggtgtgggttctgggcgcctaataggtttccagtaaacgtctgtcgagtgactgggatggacggggacgggaggaagcagtcaggagatgtgccggtgccacttgcatccctccttggaggcccttgtgcctctgctccaggatgggacaaccaggagatgggataggaccctaggacccctgttgtaaacttctggatcttggaaaatcaagactaggggtcagtccgatggc

SEQ ID NO: 273432 - DNA, 419 bp, Homo sapiens
tcttttttgagtttttatttttaccagaaaatgacagaaaggttaaggtgattccacattaggaaatatatataaaagtaaattacttgagattgtaatgaattattaaggaaagattatgaaaatgtagccttggtaggctgggcgcggtggctcacgcctgtaatcccagcactttgggaggccgaggtgggtggatcagctgaggtcaggagttcgagactagcctggccaacatggtaaaaccccgactctactaaaaatacaaaaatagctgggcatggtggcacacacctgtaatcccagctactcgggaggctgaagcaggagaatcacttgaacccgggaggtggaggttgcagtgagctgagattgtgccactgccctccaacctgggcaatagagagactccatctcta

SEQ ID NO: 273433 - DNA, 786 bp, Homo sapiens
agcttgtcgtgagccgagatcgcgccactgcacttcagccgggtcgacagaacgagactcagtcttaaaaaaaaaaaaaaaaaaaaaaaaagagatttccatgtttcactgtctatgaggagtcaccattttctgtgaaaatgaggtcctatgctttattaagaaaatttgatttttaagaaaaatataaaaatttttaagaaagtaggattttttttttttaactacatggagcaaagagtgccagacagcattctaatgtacagaaatccaaaaagcatcctgctctcccaggccttctcctggctcagagtgggggcagctgggatcacgtgtgctgggaagggcctggttggacttctttctccctgatggtggccaccacgaggcaccttggcagagaaggaacaggggaagctgagaccaaacacagagatgacacagctcctctgaagctaggctggagggggagaaactgccttgaggggtgttgggcctcataaaagcctgtttgtctactgtgctgtgaagtgatcctcaaagctctcagaggaaggcctcaacggggtggcacccttcatgcagggggctggttgtgaaacaggtgatgcttctcttttcaaataatttagacacatttagtggtcacattcctactgagctgaagtatgggccccctatggaactaagtggagtcccttgtattgacgttggcccagcacctcacccacgttttctgggcccactatctccacgtttgcaaaatgggttcctgtgaaaagtttc

SEQ ID NO: 273434 - DNA, 230 bp, Homo sapiens
tagaaaataaggtggtctgaattaaataggggttgagaaaggcaaaggcctcccaagaggcctagatcttttctcctctctcctaataaagagctgcacaagtatatccttagaatgcctgcgtggccacagaacacactgtgaagacaggtggtattttgacattagggctgttttaggaggacaggattaaggctttaaaaagcaattcttacaagatgtagagacga

SEQ ID NO: 273435 - DNA, 536 bp, Homo sapiens
accatatttcatactgattaagatcagtagtttgaagtttgacttttgttagggaataaaaaggttacatttgattgccaggacattgttaaaagactgaataatatagcatttataaaaagaaaccaactttgatataattgataactaaaattttaaaaatactcttttagaagttaaattgctcttgtatttagaaaatctgaaatattcaataaattaaaatgaagacaaaatgaggacataattttgatttatccctaaaagataaggtcacttgtgaaaaagaaaccaaatacagtttttctaatcctcaaggacaattttttaaagtttgcaaacttaaaagaataccatatagtagtcagcctatttttaaaaactgtatagtattcaacctgtttaatcttgtcaaattatatactaagaataatgtgtgtcaaatacagtaggtggcactgtgataaaacttttgttcctataaagagttgcgttcaggcttcatctgtgtatactcttctacctgtggtgttgct

SEQ ID NO: 273436 - DNA, 289 bp, Homo sapiens
cttccacaaaggaactcatggcctgttatcaaggtgactgtgcaatgaggaaaagaaaatgatgaaacttttggagagttactgactgaacaccagctgtgaattgatactaatttctggagacaaaacatgagtttgtccaccagtcagtgtcagagcttatggaggtcagaagatcaatggagttttagcttagatccatcttatagtgacccagtgggtcgccaaacccatcctgcagttacttctccagttccagaataaataattggatagaaatagtcagcaa

SEQ ID NO: 273437 - DNA, 434 bp, Homo sapiens
ctgtcaaccaggtattctatatccagcaaaactagtcttccaaagtgaaggtgaaaaaatggcattcccagataaaacttgagagaatttctccctgtcagactgtcttataagaaatattaaagcaaatcttcaggctgaaaggaagtaacactgtatattagtttgtatccataggaagaattgaagaatgctgggaatagtaaatatgtggtaaatataaaggagttttcaacattgtttggttggatttatagcaggtacatgaaatatatatatgataatagcacaaaggagttaggaaaaggacataaattatagtttctatttgactgatattaagtattattgtgatatagattgtgataaattaagacacattataatccctagagcagttgctaagttactaagaagataactccaaaaatgta

SEQ ID NO: 273438 - DNA, 92 bp, Homo sapiens
ggtgggtggggtgcaggtggttagattgtcagtaaaagcacctaagccctgggtaaattctccagacataataagactgactctgaaagatc

SEQ ID NO: 273439 - DNA, 452 bp, Homo sapiens
tctcccccattgagaggtgtcttgtatcatgcacaaaatctctgtattttggggtccttttaaaaatttctgttccattgtctgtttaacctttttttatatgtaaacttttttcgttgttgttggagacggattctcgctctgtcacccaagctggggtgcagtggtgtgatctcggctcaccgtaagctccgcctcccaggttcatgacattcttctgtatgtagactttttttcttatagcagttttaggttcacagcaaaattgagtaaagtacagagtttccatatacccgctagccctacccaccccacacatacacagacttttgtccacaatcaacatcgccaccagagtggtccatggttatagctgatgagctacattgacacatcgttatcggagtggtccatggttataactgatgagccacattgacacatcgttatcc

SEQ ID NO: 273440 - DNA, 296 bp, Homo sapiens
gaaaaagagacattcttggtcacacttacctgaatacgaagtgaggatgggggctctgcataccctgctgtgggaagcatggcgagaggcaggtgaagtgaggatgggggctctgcataccctgctgggggaagcatggcgagaggcaggtgaagtgaggatgggggctctgcagaccctgctgtgggaagcatggcgagaggcaggtgaagtgaggatgggggctctgcagaccttgctgggggaagcatggcgagaggcaggtgaagtgaggatgggggttctgcagaccctgc

SEQ ID NO: 273441 - DNA, 318 bp, Homo sapiens
atgctacaacatggataaaccttgaaaacattatgctaagtgaaagaagccagtcataataggctacagatggtaggattccatttatatgaaaaggcagatctcgctgggcatggtggctcatgcctataatcctagcacttggggaggctgaggagggcagatcattagagaccagcctgggcagcatggcaaaaccccacttctaccacaaaaataacaaatattagccaggtatggtggcacatgactgaggtcggaggatcacctgagcccaggaggtcgaggctgaagtgagccatgattgcaccactgcac

SEQ ID NO: 273442 - DNA, 378 bp, Homo sapiens
atggttgatgggggttagaggaggtgccataatggtggtaatttaaaatactccccttgacaaaggcttttgtgagcatgttctgtatgtggaagaagtgctgtcttgtagcatgccctgttgacgtggaagacaggctgggaatttgtttcttctgcccttcctgaatctgaagctctttcagctgtgggcaccctggggcagcagagttcaatttacagctgtggtgagaatgttgagggagggacttaagtggactctgtcttcttcactgtggccttgaagagacagctctccacactgtctggcttcctctcctccctctcatcatctcattaccatggctatacagtttgaatgacactgaacaaaaaaatg

SEQ ID NO: 273443 - DNA, 394 bp, Homo sapiens
agaagatggtatgtgttctacaggataacaaacttatagtaatttgacagtagggtagtggctcaagggagacaaatagatcaatataacataatggaaagcacaaaaactcaggcaaacatggagacttactttcagacgaagatggtactgcagatcagtggagaaggtgcagtcttttaaataaatatgctagttgaattggatatcatatgctgggagccttgacccctatgttataacagaaacaaggaatcagtgtgaggtgaattatagatctaaatgtgaaaagcaaaacaataaaacttctacatgatgatatatggaaatatctttgtgaccttgctgacaagatttcttaaacagaacacaaacaagcactaaccatcaagag

SEQ ID NO: 273444 - DNA, 761 bp, Homo sapiens
cctggtcctgttggtgaaaatgaagggctcttgttccaggcctgtcaccttggcaccctttaattaacagtgaactcacttcattctgtgattttaaaagctgatgcatttcacccaaatgaacgtaaccccacctatttgtcgttgaagtagagctttcctggaggaccacatcttctcgacaggtcgcaggtctggccttgcccggcgctggtgagccccagctggcttagaccgtgtagctcgtctgttaaagtctgaccagaagtggccgggcgcagtggctcatgcccgtaatcccagcaccttgggaggctgaggcgggtggatcacgaggtcaggagttcaagaccagcctggccaagatggtgagacccgcccccccactccccatctctactaaaaatacaaaaaattagccaggtgtggtggcaggcgcctgtaatctcagctactcgggaggctgaggcagagaattgcctgaacccaggaggtggacattgcagtgaactgagatgacgccactgcactccagcctgggcaactgagcaagactgtctcaacaaaaaaatctggccagaagtccagacagagggaaagtttatcgccgcagagacagatgtaggggtggtcaagagcgtggccctctgtgaggaggatgtaaagtcctccaggcccagctccggggctctctggtactagctccaggcgcagagggagtctctgagaacagggttgctggggacagccgcggtgcctga

SEQ ID NO: 273445 - DNA, 695 bp, Homo sapiens
cctggtcctgttggtgaaaatgaagggctcttgttccaggcctgtcaccttggcaccctttaattaacagtgaactcacttcattctgtgattttaaaagctgatgcatttcacccaaatgaacgtaaccccacctatttgtcgttgaagtagagctttcctggaggaccacatcttctcgacaggtcgcaggtctggccttgcccggcgctggtgagccccagctggcttagaccgtgtagctcgtctgttaaagtctgaccagaagtggccgggcgcagtggctcatgcccgtaatcccagcaccttgggaggctgaggcgggtggatcacgaggtcaggagttcaagaccagcctggccaagatggtgagacccgcccccccactccccatctctactaaaaatacaaaaaattagccaggtgtggtggcaggcgcctgtaatctcagctactcgggaggctgaggcagagaattgcctgaacccaggaggtggacattgcagtgaactgagatgacgccactgcactccagcctgggcaactgagcaagactgtcgggtggtcaagagcgtggccctctgtgaggaggatgtaaagtcctccaggcccagctccggggctctctggtactagctccaggcgcagagggagtctctgagaacagggttgctggggacagccgcggtgcctga

SEQ ID NO: 273446 - DNA, 803 bp, Homo sapiens
cctggtcctgttggtgaaaatgaagggctcttgttccaggcctgtcaccttggcaccctttaattaacagtgaactcacttcattctgtgattttaaaagctgatgcatttcacccaaatgaacgtaaccccacctatttgtcgttgaagtagagctttcctggaggaccacatcttctcgacaggtcgcaggtctggccttgcccggcgctggtgagccccagctggcttagaccgtgtagctcgtctgttaaagtctgaccagaagtggccgggcgcagtggctcatgcccgtaatcccagcaccttgggaggctgaggcgggtggatcacgaggtcaggagttcaagaccagcctggccaagatggtgagacccggctctgtcgcgctcccctatctcatacatgaagaatagcgcaatagagatgtaggcacggtgtgtgtgtgcacggggcctgtgaatctcatggtagtcggagaagctgaagggcagagagagttggcgctggaagcccagggagggtggacgatgggtcggcgaactggagactgacggccacatggagctgcacgaggccgtggggctatgtgatcaaagaatcaacaaaaaaatctggccagaagtccagacagagggaaagtttatcgccgcagagacagatgtaggggtggtcaagagcgtggccctctgtgaggaggatgtaaagtcctccaggcccagctccggggctctctggtactagctccaggcgcagagggagtctctgagaacagggttgctggggacagccgcggtgcctga

SEQ ID NO: 273447 - DNA, 445 bp, Homo sapiens
ccttcaaatttatatgtcttgagatacactattcagattattctttagaaagcaatcatatctgaaaggagtggagctagtatgatgctttttagtatgcaaaatccctattcctatgaagagtcattattcaaaaaacactacttaaatttgtaagttttttatataaaagtagaatttaggagtaagaaatacggaattagccaaagcaggaagatcacttgagaaattcaagaccagcctgggcaacatagcaagaccctgtctctaaaaaaataaaaaataaattagtcaaacatgatgctgcatacttctagtcatagttactactcaggaggctgaggtgggagaattggttgagcccaggaatttgaagttaacagtgacctatgatcacaccactgcagtctagccttggcaacagagcaggactatgtctcttaaa

SEQ ID NO: 273448 - DNA, 423 bp, Homo sapiens
ccttcaaatttatatgtcttgagatacactattcagattattctttagaaagcaatcatatctgaaaggagtggagctaaaatccctattcctatgaagagtcattattcaaaaaacactacttaaatttgtaagttttttatataaaagtagaatttaggagtaagaaatacggaattagccaaagcaggaagatcacttgagaaattcaagaccagcctgggcaacatagcaagaccctgtctctaaaaaaataaaaaataaattagtcaaacatgatgctgcatacttctagtcatagttactactcaggaggctgaggtgggagaattggttgagcccaggaatttgaagttaacagtgacctatgatcacaccactgcagtctagccttggcaacagagcaggactatgtctcttaaa

SEQ ID NO: 273449 - DNA, 1103 bp, Homo sapiens
ggcacgaggcgaaccctgctccgcgcgagaatttttttgattccttcttatttggagaaatctccagctgctctgatgatagcctaagaagactgcatgctgcttcctctcgatgccaagccagaccctctcacaacctcggatctcagtccttcatggagacctggtcccagcaggaatggcagtgcaggaaattggcgcccagatggttcttccatgtgaagttgtctcgggctctgggctgacgagagaacacctggtaaccaggttagccctctgtcagtcacccagggcagggcagcatggtgcggattcagaggaggaagcttttggcatcttgcctgtgcgtcacagccaccgtctttctgcttgtcacactccaggtcatggttgagctggggaagtttgaaaggaaggagtttaaaagttccagtttgcaagatggacatacaaaaatggaggaagcacctacgcatcttaattcatttcttaagaaagaaggattgaccttcaacaggaaaagaaaatgggaattggacagctaccccattatgctctggtggtccccgctgacgggggagactgggaggttaggccaatgtggagcagatgcttgtttcttcaccatcaaccggacctacctccatcatcacatgaccaaagcattcctcttctatggtaagcaggactttcgcctttctcccttgtttgctgtggtcttcctccaaagctgagttacagtttacctctgaaaagtgatggtggagctccccttgaaaacactttgacacccctgatttcctttgcatttgctctgtggaaggcctgagcatttagcagacacaaaaaagaaacaagcctggccgggcgtggtggcttctgaattctctaacacctgtatctctgaagggttggataagggattatgatcttctagttgtgctttgagatgaagcaaagttaaatgttgagtttaatttcccaaattgtagcagaagcttctagaaagatttccattacattcacaaaaaatatagataatataatgggcatttatgtacctatcacatagcttaaggcataaaatattacatgtataattg

SEQ ID NO: 273450 - DNA, 315 bp, Homo sapiens
gtgggaaggcaaggaaataggggcttaccacccaaaagatgggaggcagaagatacccacctgagttgcccagagcccacagtgtttgctttctcaccactccggactccacctttgagctctttgcgagagatgtggatttccagctttgaacaatccaagaaagaagcccaggcactaagcttattggtatttggcaaacctggtatcctgcagccgagcatgaacatgaaatacattagaacttggcaatgagagatcccatctgttggtttccagggatgtaagtgagtaataaaagctgtttcaagttta

SEQ ID NO: 273451 - DNA, 3327 bp, Homo sapiens
cccaggcttgggctcatagggagaaaggaagctgcgctgcattctgcgggacgaaccctgctccgcgcgagaatttttttgattccttcttatttggagaaatctccagctgctctgatgatagcctaagaagactgcatgctgcttcctctcgatgccaagccagaccctctcacaacctcggatctcagtccttcatggagacctggtcccagcaggaatggcagtgcaggaaattggcgcccagatggttcttccatgtgaagttgtctcgggctctgggctgacgagagaacacctggtaaccaggttagccctctgtcagtcacccagggcagggcagcatggtgcggattcagaggaggaagcttttggcatcttgcctgtgcgtcacagccaccgtctttctgcttgtcacactccaggccttggataccgttgagaatctaatgaaagtcacgggccctccccagggagttacagactccatgcaatgcttcaatgatcagcggcctttatctaacaccaggagcagcgagcacataaaagaggtcatggttgagctggggaagtttgaaaggaaggagtttaaaagttccagtttgcaagatggacatacaaaaatggaggaagcacctacgcatcttaattcatttcttaagaaagaaggattgaccttcaacaggaaaagaaaatgggaattggacagctaccccattatgctctggtggtccccgctgacgggggagactgggaggttaggccaatgtggagcagatgcttgtttcttcaccatcaaccggacctacctccatcatcacatgaccaaagcattcctcttctatgggtactgactttaacatagatagcttacctctgcctcggaaagcccatcatgactgggctgtttttcatgaagagtccccgaaaaacaattataagctctttcataaaccagtgatcaccttgttcaactacactgccacgttcagcaggcattcccacttgccactaactacccaatacttggagagcattgaagtcctgaagtcactccgatacctagttcctttgcagtccaaaaacaagcttagaaaaagacttgctccgctggtgtatgtacagtcagactgtgacccaccatcagacagggacagctatgttcgcgagctgatgacttacatcgaggtcgattcctatggtgaatgtttacgaaacaaagacctccctcagcagctgaaaaatccagcctctatggatgccgatggcttttataggatcattgcacagtataagtttatcctagcttttgagaatgcagtttgtgatgactacatcactgagaagttctggaggccactgaaactgggggtagtccctgtatattacggatcccccagcatcacagactggcttccaagtaacaaaagtgctattcttgtatcagaattttctcaccccagggaactggcaagttacatcagacgactggattctgatgacagattgtatgaggcctatgtagaatggaagctgaagggtgagatctctaaccagcgacttctgacagctctcagggaacggaaatggggagtgcaagacgtcaaccaggacaattacatcgatgcatttgagtgtatggtgtgcaccaaggtgtgggctaatatcaggcttcaggaaaagggcttaccacccaaaagatgggaggcagaagatacccacctgagttgcccagagcccacagtgtttgctttctcaccactccggactccacctttgagctctttgcgagagatgtggatttccagctttgaacaatccaagaaagaagcccaggcactaaggtggctggttgataggaatcaaaacttttcatctcaagagttttggggcctagtattcaaggactgatttcaaaaatgatcagaatgaaacagactagagccttcttgaggtttattttctaggttgccttaatatttgaacataatagctattctgttgactatccatcaggataataattagttgctgcagtactcataatgagccctttcaaggaatagatgtaaattacccttaggggtagccactatattttttatactaaaaaaggaaatatttcttatggacactggttatcttccatgtccgtgtctgtggacccacatacttactgccttttgtggaaattcacctagagtgagtactttccttgtgcaatggagggagacgatctagctatagattcttgatactcacctcactctcaacagcttattggtatttggcaaacctggtatcctgcagccgagcatgaacatgaaatacattagaacttggcaatgagagatcccatctgttggtttccagggatgtaagtgagtaataaaagctgtttcaagtttatccactatccactcttcaagtgaaaagaacttatgtgtgtctaccttcttctccataccctgagccacctctctcactttctttagttgtgccttgccctatcgcctcccattttcccttcaaagtagaatgtcttgtaaagacacagtaactcctgtgtgttttgattagtgagatgttaccacttaccccttctgctgcgcagaataatattaagaattgctatgcttatgattcaggctggacagcctggacattttgagcagcgcgagagtagaagtgaatacccccaggaactccaattgtgctgaagctgatttgtctgttcgtaggatgatgtgcagcctgtcacagtggcagccacaggcattcagtttgtgggcatttcctgtcatttcggatcctgctatagggaaggttcagctctcctgtctggggcatctactggagcacctcagaagacaaggaggaaaacactggctcatgttttctttccatgtgagggaggggaggtttctagatgatactaaaagcctgttgccactgttgtgtcatgatttccattcttcatcatggaaagccacaagcctcagaaggcagccagaggacaggaagagtctgtgatgctcatgtctgtgtcatggcatgagggggaattgacgagtgcttgcttagcatcagctctcattgtattgaaggctgtgcccttggtgtgcttagcagtgagcagcgtcttcattaggtagctctggctgggctttgtcagccagcgtgtgagaaaggagaaccaaaaccaatacctccttatagaagccagaaggatcacattggatgagagaaggtgtctataactgggttcttcccaatcccagctctttcattaactaaatatgatcttggacatatctcttaacctcc

SEQ ID NO: 273452 - DNA, 3261 bp, Homo sapiens
cccaggcttgggctcatagggagaaaggaagctgcgctgcattctgcgggacgaaccctgctccgcgcgagaatttttttgattccttcttatttggagaaatctccagctgctctgatgatagcctaagaagactgcatgctgcttcctctcgatgccaagccagaccctctcacaacctcggatctcagtccttcatggagacctggtcccagcaggaatggcagtgcaggaaattggcgcccagatggttcttccatgtgaagttgtctcgggctctgggctgacgagagaacacctggtaaccaggttagccctctgtcagtcacccagggcagggcagcatggtgcggattcagaggaggaagcttttggcatcttgcctgtgcgtcacagccaccgtctttctgcttgtcacactccaggtgaaactgaggtttagtgaatggacgtgtcaggcagaaacaaagtcattgaaatagaaggtcatggttgagctggggaagtttgaaaggaaggagtttaaaagttccagtttgcaagatggacatacaaaaatggaggaagcacctacgcatcttaattcatttcttaagaaagaaggattgaccttcaacaggaaaagaaaatgggaattggacagctaccccattatgctctggtggtccccgctgacgggggagactgggaggttaggccaatgtggagcagatgcttgtttcttcaccatcaaccggacctacctccatcatcacatgaccaaagcattcctcttctatgggtactgactttaacatagatagcttacctctgcctcggaaagcccatcatgactgggctgtttttcatgaagagtccccgaaaaacaattataagctctttcataaaccagtgatcaccttgttcaactacactgccacgttcagcaggcattcccacttgccactaactacccaatacttggagagcattgaagtcctgaagtcactccgatacctagttcctttgcagtccaaaaacaagcttagaaaaagacttgctccgctggtgtatgtacagtcagactgtgacccaccatcagacagggacagctatgttcgcgagctgatgacttacatcgaggtcgattcctatggtgaatgtttacgaaacaaagacctccctcagcagctgaaaaatccagcctctatggatgccgatggcttttataggatcattgcacagtataagtttatcctagcttttgagaatgcagtttgtgatgactacatcactgagaagttctggaggccactgaaactgggggtagtccctgtatattacggatcccccagcatcacagactggcttccaagtaacaaaagtgctattcttgtatcagaattttctcaccccagggaactggcaagttacatcagacgactggattctgatgacagattgtatgaggcctatgtagaatggaagctgaagggtgagatctctaaccagcgacttctgacagctctcagggaacggaaatggggagtgcaagacgtcaaccaggacaattacatcgatgcatttgagtgtatggtgtgcaccaaggtgtgggctaatatcaggcttcaggaaaagggcttaccacccaaaagatgggaggcagaagatacccacctgagttgcccagagcccacagtgtttgctttctcaccactccggactccacctttgagctctttgcgagagatgtggatttccagctttgaacaatccaagaaagaagcccaggcactaaggtggctggttgataggaatcaaaacttttcatctcaagagttttggggcctagtattcaaggactgatttcaaaaatgatcagaatgaaacagactagagccttcttgaggtttattttctaggttgccttaatatttgaacataatagctattctgttgactatccatcaggataataattagttgctgcagtactcataatgagccctttcaaggaatagatgtaaattacccttaggggtagccactatattttttatactaaaaaaggaaatatttcttatggacactggttatcttccatgtccgtgtctgtggacccacatacttactgccttttgtggaaattcacctagagtgagtactttccttgtgcaatggagggagacgatctagctatagattcttgatactcacctcactctcaacagcttattggtatttggcaaacctggtatcctgcagccgagcatgaacatgaaatacattagaacttggcaatgagagatcccatctgttggtttccagggatgtaagtgagtaataaaagctgtttcaagtttatccactatccactcttcaagtgaaaagaacttatgtgtgtctaccttcttctccataccctgagccacctctctcactttctttagttgtgccttgccctatcgcctcccattttcccttcaaagtagaatgtcttgtaaagacacagtaactcctgtgtgttttgattagtgagatgttaccacttaccccttctgctgcgcagaataatattaagaattgctatgcttatgattcaggctggacagcctggacattttgagcagcgcgagagtagaagtgaatacccccaggaactccaattgtgctgaagctgatttgtctgttcgtaggatgatgtgcagcctgtcacagtggcagccacaggcattcagtttgtgggcatttcctgtcatttcggatcctgctatagggaaggttcagctctcctgtctggggcatctactggagcacctcagaagacaaggaggaaaacactggctcatgttttctttccatgtgagggaggggaggtttctagatgatactaaaagcctgttgccactgttgtgtcatgatttccattcttcatcatggaaagccacaagcctcagaaggcagccagaggacaggaagagtctgtgatgctcatgtctgtgtcatggcatgagggggaattgacgagtgcttgcttagcatcagctctcattgtattgaaggctgtgcccttggtgtgcttagcagtgagcagcgtcttcattaggtagctctggctgggctttgtcagccagcgtgtgagaaaggagaaccaaaaccaatacctccttatagaagccagaaggatcacattggatgagagaaggtgtctataactgggttcttcccaatcccagctctttcattaactaaatatgatcttggacatatctcttaacctcc

SEQ ID NO: 273453 - DNA, 2409 bp, Homo sapiens
cccaggcttgggctcatagggagaaaggaagctgcgctgcattctgcgggacgaaccctgctccgcgcgagaatttttttgattccttcttatttggagaaatctccagctgctctgatgatagcctaagaagactgcatgctgcttcctctcgatgccaagccagaccctctcacaacctcggatctcagtccttcatggagacctggtcccagcaggaatggcagtgcaggaaattggcgcccagatggttcttccatgtgaagttgtctcgggctctgggctgacgagagaacacctggtaaccaggttagccctctgtcagtcacccagggcagggcagcatggtgcggattcagaggaggaagcttttggcatcttgcctgtgcgtcacagccaccgtctttctgcttgtcacactccaggccttggataccgttgagaatctaatgaaagtcacgggccctccccagggagttacagactccatgcaatgcttcaatgatcagcggcctttatctaacaccaggagcagcgagcacataaaagaggtcatggttgagctggggaagtttgaaaggaaggagtttaaaagttccagtttgcaagatggacatacaaaaatggaggaagcacctacgcatcttaattcatttcttaagaaagaaggattgaccttcaacaggaaaagaaaatgggaattggacagctaccccattatgctctggtggtccccgctgacgggggagactgggaggttaggccaatgtggagcagatgcttgtttcttcaccatcaaccggacctacctccatcatcacatgaccaaagcattcctcttctatgggtactgactttaacatagatagcttacctctgcctcggaaagcccatcatgactgggctgtttttcatgaagagtccccgaaaaacaattataagctctttcataaaccagtgatcaccttgttcaactacactgccacgttcagcaggcattcccacttgccactaactacccaatacttggagagcattgaagtcctgaagtcactccgatacctagttcctttgcagtccaaaaacaagcttagaaaaagacttgctccgctggtgtatgtacagtcagactgtgacccaccatcagacagggacagctatgttcgcgagctgatgacttacatcgaggtcgattcctatggtgaatgtttacgaaacaaagacctccctcagcagctgaaaaatccagcctctatggatgccgatggcttttataggatcattgcacagtataagtttatcctagcttttgagaatgcagtttgtgatgactacatcactgagaagttctggaggccactgaaactgggggtagtccctgtatattacggatcccccagcatcacagactggcttccaagtaacaaaagtgctattcttgtatcagaattttctcaccccagggaactggcaagttacatcagacgactggattctgatgacagattgtatgaggcctatgtagaatggaagctgaagggtgagatctctaaccagcgacttctgacagctctcagggaacggaaatggggagtgcaagacgtcaaccaggacaattacatcgatgcatttgagtgtatggtgtgcaccaaggtgtgggctaatatcaggcttcaggaaaagggcttaccacccaaaagatgggaggcagaagatacccacctgagttgcccagagcccacagtgtttgctttctcaccactccggactccacctttgagctctttgcgagagatgtggatttccagctttgaacaatccaagaaagaagcccaggcactaaggtggctggttgataggaatcaaaacttttcatctcaagagttttggggcctagtattcaaggactgatttcaaaaatgatcagaatgaaacagactagagccttcttgaggtttattttctaggttgccttaatatttgaacataatagctattctgttgactatccatcaggataataattagttgctgcagtactcataatgagccctttcaaggaatagatgtaaattacccttaggggtagccactatattttttatactaaaaaaggaaatatttcttatggacactggttatcttccatgtccgtgtctgtggacccacatacttactgccttttgtggaaattcacctagagtgagtactttccttgtgcaatggagggagacgatctagctatagattcttgatactcacctcactctcaacagcttattggtatttggcaaacctggtatcctgcagccgagcatgaacatgaaatacattagaacttggcaatgagagatcccatctgttggtttccagggatgtaagtgagtaataaaagctgtttcaagttta

SEQ ID NO: 273454 - DNA, 1977 bp, Homo sapiens
cccaggcttgggctcatagggagaaaggaagctgcgctgcattctgcgggacgaaccctgctccgcgcgagaatttttttgattccttcttatttggagaaatctccagctgctctgatgatagcctaagaagactgcatgctgcttcctctcgatgccaagccagaccctctcacaacctcggatctcagtccttcatggagacctggtcccagcaggaatggcagtgcaggaaattggcgcccagatggttcttccatgtgaagttgtctcgggctctgggctgacgagagaacacctggtaaccaggttagccctctgtcagtcacccagggcagggcagcatggtgcggattcagaggaggaagcttttggcatcttgcctgtgcgtcacagccaccgtctttctgcttgtcacactccaggccttggataccgttgagaatctaatgaaagtcacgggccctccccagggagttacagactccatgcaatgcttcaatgatcagcggcctttatctaacaccaggagcagcgagcacataaaagaggtcatggttgagctggggaagtttgaaaggaaggagtttaaaagttccagtttgcaagatggacatacaaaaatggaggaagcacctacgcatcttaattcatttcttaagaaagaaggattgaccttcaacaggaaaagaaaatgggaattggacagctaccccattatgctctggtggtccccgctgacgggggagactgggaggttaggccaatgtggagcagatgcttgtttcttcaccatcaaccggacctacctccatcatcacatgaccaaagcattcctcttctatgggtactgactttaacatagatagcttacctctgcctcggaaagcccatcatgactgggctgtttttcatgaagagtccccgaaaaacaattataagctctttcataaaccagtgatcaccttgttcaactacactgccacgttcagcaggcattcccacttgccactaactacccaatacttggagagcattgaagtcctgaagtcactccgatacctagttcctttgcagtccaaaaacaagcttagaaaaagacttgctccgctggtgtatgtacagtcagactgtgacccaccatcagacagggacagctatgttcgcgagctgatgacttacatcgaggtcgattcctatggtgaatgtttacgaaacaaagacctccctcagcagctgaaaaatccagcctctatggatgccgatggcttttataggatcattgcacagtataagtttatcctagcttttgagaatgcagtttgtgatgactacatcactgagaagttctggaggccactgaaactgggggtagtccctgtatattacggatcccccagcatcacagactggcttccaagtaacaaaagtgctattcttgtatcagaattttctcaccccagggaactggcaagttacatcagacgactggattctgatgacagattgtatgaggcctatgtagaatggaagctgaagggtgagatctctaaccagcgacttctgacagctctcagggaacggaaatggggagtgcaagacgtcaaccaggacaattacatcgatgcatttgagtgtatggtgtgcaccaaggtgtgggctaatatcaggcttcaggaaaagggcttaccacccaaaagatgggaggcagaagatacccacctgagttgcccagagcccacagtgtttgctttctcaccactccggactccacctttgagctctttgcgagagatgtggatttccagctttgaacaatccaagaaagaagcccaggcactaagcttattggtatttggcaaacctggtatcctgcagccgagcatgaacatgaaatacattagaacttggcaatgagagatcccatctgttggtttccagggatgtaagtgagtaataaaagctgtttcaagttta

SEQ ID NO: 273455 - DNA, 402 bp, Homo sapiens
gcccagccaggatcagaggttttctactgggagaaaatacctcccagtaaaaaacctctggcagggagacccttccaattcaccccctgccccccttttttaaacaggtgaaactgaggtttagtgaatggacgtgtcaggcagaaacaaagtcattgaaatagaaggtgagtttgagattctcgtaagctcctggttgtagagaaacaggaagtaaagctcagtctgtcttcctgggtcaaaattggatggcttcctcagaatctcctattgttatcacttttgaaagattgcgttcttggagaagcaaggactattctgagaacaagatagtctgtatcttgtagtaagtgtagaacacagacatctatattataagtaaatcttgacatgtgcttctag

SEQ ID NO: 273456 - DNA, 3043 bp, Homo sapiens
ggcacgaggcgaaccctgctccgcgcgagaatttttttgattccttcttatttggagaaatctccagctgctctgatgatagcctaagaagactgcatgctgcttcctctcgatgccaagccagaccctctcacaacctcggatctcagtccttcatggagacctggtcccagcaggaatggcagtgcaggaaattggcgcccagatggttcttccatgtgaagttgtctcgggctctgggctgacgagagaacacctggtaaccaggtcatggttgagctggggaagtttgaaaggaaggagtttaaaagttccagtttgcaagatggacatacaaaaatggaggaagcacctacgcatcttaattcatttcttaagaaagaaggattgaccttcaacaggaaaagaaaatgggaattggacagctaccccattatgctctggtggtccccgctgacgggggagactgggaggttaggccaatgtggagcagatgcttgtttcttcaccatcaaccggacctacctccatcatcacatgaccaaagcattcctcttctatgggtactgactttaacatagatagcttacctctgcctcggaaagcccatcatgactgggctgtttttcatgaagagtccccgaaaaacaattataagctctttcataaaccagtgatcaccttgttcaactacactgccacgttcagcaggcattcccacttgccactaactacccaatacttggagagcattgaagtcctgaagtcactccgatacctagttcctttgcagtccaaaaacaagcttagaaaaagacttgctccgctggtgtatgtacagtcagactgtgacccaccatcagacagggacagctatgttcgcgagctgatgacttacatcgaggtcgattcctatggtgaatgtttacgaaacaaagacctccctcagcagctgaaaaatccagcctctatggatgccgatggcttttataggatcattgcacagtataagtttatcctagcttttgagaatgcagtttgtgatgactacatcactgagaagttctggaggccactgaaactgggggtagtccctgtatattacggatcccccagcatcacagactggcttccaagtaacaaaagtgctattcttgtatcagaattttctcaccccagggaactggcaagttacatcagacgactggattctgatgacagattgtatgaggcctatgtagaatggaagctgaagggtgagatctctaaccagcgacttctgacagctctcagggaacggaaatggggagtgcaagacgtcaaccaggacaattacatcgatgcatttgagtgtatggtgtgcaccaaggtgtgggctaatatcaggcttcaggaaaagggcttaccacccaaaagatgggaggcagaagatacccacctgagttgcccagagcccacagtgtttgctttctcaccactccggactccacctttgagctctttgcgagagatgtggatttccagctttgaacaatccaagaaagaagcccaggcactaaggtggctggttgataggaatcaaaacttttcatctcaagagttttggggcctagtattcaaggactgatttcaaaaatgatcagaatgaaacagactagagccttcttgaggtttattttctaggttgccttaatatttgaacataatagctattctgttgactatccatcaggataataattagttgctgcagtactcataatgagccctttcaaggaatagatgtaaattacccttaggggtagccactatattttttatactaaaaaaggaaatatttcttatggacactggttatcttccatgtccgtgtctgtggacccacatacttactgccttttgtggaaattcacctagagtgagtactttccttgtgcaatggagggagacgatctagctatagattcttgatactcacctcactctcaacagcttattggtatttggcaaacctggtatcctgcagccgagcatgaacatgaaatacattagaacttggcaatgagagatcccatctgttggtttccagggatgtaagtgagtaataaaagctgtttcaagtttatccactatccactcttcaagtgaaaagaacttatgtgtgtctaccttcttctccataccctgagccacctctctcactttctttagttgtgccttgccctatcgcctcccattttcccttcaaagtagaatgtcttgtaaagacacagtaactcctgtgtgttttgattagtgagatgttaccacttaccccttctgctgcgcagaataatattaagaattgctatgcttatgattcaggctggacagcctggacattttgagcagcgcgagagtagaagtgaatacccccaggaactccaattgtgctgaagctgatttgtctgttcgtaggatgatgtgcagcctgtcacagtggcagccacaggcattcagtttgtgggcatttcctgtcatttcggatcctgctatagggaaggttcagctctcctgtctggggcatctactggagcacctcagaagacaaggaggaaaacactggctcatgttttctttccatgtgagggaggggaggtttctagatgatactaaaagcctgttgccactgttgtgtcatgatttccattcttcatcatggaaagccacaagcctcagaaggcagccagaggacaggaagagtctgtgatgctcatgtctgtgtcatggcatgagggggaattgacgagtgcttgcttagcatcagctctcattgtattgaaggctgtgcccttggtgtgcttagcagtgagcagcgtcttcattaggtagctctggctgggctttgtcagccagcgtgtgagaaaggagaaccaaaaccaatacctccttatagaagccagaaggatcacattggatgagagaaggtgtctataactgggttcttcccaatcccagctctttcattaactaaatatgatcttggacatatctcttaacctcc

SEQ ID NO: 273457 - DNA, 3237 bp, Homo sapiens
cccaggcttgggctcatagggagaaaggaagctgcgctgcattctgcgggacgaaccctgctccgcgcgagaatttttttgattccttcttatttggagaaatctccagctgctctgatgatagcctaagaagactgcatgctgcttcctctcgatgccaagccagaccctctcacaacctcggatctcagtccttcatggagacctggtcccagcaggaatggcagtgcaggaaattggcgcccagatggttcttccatgtgaagttgtctcgggctctgggctgacgagagaacacctggtaaccaggttagccctctgtcagtcacccagggcagggcagcatggtgcggattcagaggaggaagcttttggcatcttgcctgtgcgtcacagccaccgtctttctgcttgtcacactccaggtcatggttgagctggggaagtttgaaaggaaggagtttaaaagttccagtttgcaagatggacatacaaaaatggaggaagcacctacgcatcttaattcatttcttaagaaagaaggattgaccttcaacaggaaaagaaaatgggaattggacagctaccccattatgctctggtggtccccgctgacgggggagactgggaggttaggccaatgtggagcagatgcttgtttcttcaccatcaaccggacctacctccatcatcacatgaccaaagcattcctcttctatggcccaagaagaatcaccacctttggcagaaaatgatggtactgactttaacatagatagcttacctctgcctcggaaagcccatcatgactgggctgtttttcatgaagagtccccgaaaaacaattataagctctttcataaaccagtgatcaccttgttcaactacactgccacgttcagcaggcattcccacttgccactaactacccaatacttggagagcattgaagtcctgaagtcactccgatacctagttcctttgcagtccaaaaacaagcttagaaaaagacttgctccgctggtgtatgtacagtcagactgtgacccaccatcagacagggacagctatgttcgcgagctgatgacttacatcgaggtcgattcctatggtgaatgtttacgaaacaaagacctccctcagcagctgaaaaatccagcctctatggatgccgatggcttttataggatcattgcacagtataagtttatcctagcttttgagaatgcagtttgtgatgactacatcactgagaagttctggaggccactgaaactgggggtagtccctgtatattacggatcccccagcatcacagactggcttccaagtaacaaaagtgctattcttgtatcagaattttctcaccccagggaactggcaagttacatcagacgactggattctgatgacagattgtatgaggcctatgtagaatggaagctgaagggtgagatctctaaccagcgacttctgacagctctcagggaacggaaatggggagtgcaagacgtcaaccaggacaattacatcgatgcatttgagtgtatggtgtgcaccaaggtgtgggctaatatcaggcttcaggaaaagggcttaccacccaaaagatgggaggcagaagatacccacctgagttgcccagagcccacagtgtttgctttctcaccactccggactccacctttgagctctttgcgagagatgtggatttccagctttgaacaatccaagaaagaagcccaggcactaaggtggctggttgataggaatcaaaacttttcatctcaagagttttggggcctagtattcaaggactgatttcaaaaatgatcagaatgaaacagactagagccttcttgaggtttattttctaggttgccttaatatttgaacataatagctattctgttgactatccatcaggataataattagttgctgcagtactcataatgagccctttcaaggaatagatgtaaattacccttaggggtagccactatattttttatactaaaaaaggaaatatttcttatggacactggttatcttccatgtccgtgtctgtggacccacatacttactgccttttgtggaaattcacctagagtgagtactttccttgtgcaatggagggagacgatctagctatagattcttgatactcacctcactctcaacagcttattggtatttggcaaacctggtatcctgcagccgagcatgaacatgaaatacattagaacttggcaatgagagatcccatctgttggtttccagggatgtaagtgagtaataaaagctgtttcaagtttatccactatccactcttcaagtgaaaagaacttatgtgtgtctaccttcttctccataccctgagccacctctctcactttctttagttgtgccttgccctatcgcctcccattttcccttcaaagtagaatgtcttgtaaagacacagtaactcctgtgtgttttgattagtgagatgttaccacttaccccttctgctgcgcagaataatattaagaattgctatgcttatgattcaggctggacagcctggacattttgagcagcgcgagagtagaagtgaatacccccaggaactccaattgtgctgaagctgatttgtctgttcgtaggatgatgtgcagcctgtcacagtggcagccacaggcattcagtttgtgggcatttcctgtcatttcggatcctgctatagggaaggttcagctctcctgtctggggcatctactggagcacctcagaagacaaggaggaaaacactggctcatgttttctttccatgtgagggaggggaggtttctagatgatactaaaagcctgttgccactgttgtgtcatgatttccattcttcatcatggaaagccacaagcctcagaaggcagccagaggacaggaagagtctgtgatgctcatgtctgtgtcatggcatgagggggaattgacgagtgcttgcttagcatcagctctcattgtattgaaggctgtgcccttggtgtgcttagcagtgagcagcgtcttcattaggtagctctggctgggctttgtcagccagcgtgtgagaaaggagaaccaaaaccaatacctccttatagaagccagaaggatcacattggatgagagaaggtgtctataactgggttcttcccaatcccagctctttcattaactaaatatgatcttggacatatctcttaacctcc

SEQ ID NO: 273458 - DNA, 1271 bp, Homo sapiens
cccaggcttgggctcatagggagaaaggaagctgcgctgcattctgcgggacgaaccctgctccgcgcgagaatttttttgattccttcttatttggagaaatctccagctgctctgatgatagcctaagaagactgcatgctgcttcctctcgatgccaagccagaccctctcacaacctcggatctcagtccttcatggagacctggtcccagcaggaatggcagtgcaggaaattggcgcccagatggttcttccatgtgaagttgtctcgggctctgggctgacgagagaacacctggtaaccaggttagccctctgtcagtcacccagggcagggcagcatggtgcggattcagaggaggaagcttttggcatcttgcctgtgcgtcacagccaccgtctttctgcttgtcacactccaggccttggataccgttgagaatctaatgaaagtcacgggccctccccagggagttacagactccatgcaatgcttcaatgatcagcggcctttatctaacaccaggagcagcgagcacataaaagaggtcatggttgagctggggaagtttgaaaggaaggagtttaaaagttccagtttgcaagatggacatacaaaaatggaggaagcacctacgcatcttaattcatttcttaagaaagaaggattgaccttcaacaggaaaagaaaatgggaattggacagctaccccattatgctctggtggtccccgctgacgggggagactgggaggttaggccaatgtggagcagatgcttgtttcttcaccatcaaccggacctacctccatcatcacatgaccaaagcattcctcttctatggtaagcaggactttcgcctttctcccttgtttgctgtggtcttcctccaaagctgagttacagtttacctctgaaaagtgatggtggagctccccttgaaaacactttgacacccctgatttcctttgcatttgctctgtggaaggcctgagcatttagcagacacaaaaaagaaacaagcctggccgggcgtggtggcttctgaattctctaacacctgtatctctgaagggttggataagggattatgatcttctagttgtgctttgagatgaagcaaagttaaatgttgagtttaatttcccaaattgtagcagaagcttctagaaagatttccattacattcacaaaaaatatagataatataatgggcatttatgtacctatcacatagcttaaggcataaaatattacatgtataattg

SEQ ID NO: 273459 - DNA, 898 bp, Homo sapiens
gatctcagatacctggaaccactgacttttgaacttttcattacttgaaataaatgttcttgttgcttagccacttttaggtgatatattacgttctggtgaaagcattcttcctaatacaagctgagagcttacagctaggagacaacctccaggagcagagatcacacactctcgggcagaaaaacagcttctgtattcttccctgtttaccattctggcatcaatttcaagtgctcagtccctcaagctctttcctctttacaaaagcccggctactgcaacaaagcatcctgtctgctgtaagtttcaagagactctttgaaactactgaccatctttctcactgcattcatgctgcaacaacccaaatcctgcaaagctctgactgaatcaggaaaaagtgaccttggtagctagtctccaaagatggccaccaccaatacttgccttcctgcgatatatatcatactccttgtatcaggaagagaagtgtaattccctccccatgaatctaggctggccttagtgactttcttggccaatagaatatagcagaaggcacattctgggatttgtaagactaggtcgcaggaagccttatggcctctgccaggcctcttgcaatgcttggccttggaacactccctcctacaagccagctgccatgctatgagaagtgcaggtcctgtggtaaatccacatgtggtcactccagtcaacggtctcagcaagcccccagctgactgtcaactatgtgaatgagcctgcagatgactccagccccagctgccatctgactgcagctgcatgaaacacttaagcaagaaccaccttgctgagccctatcaaccccggaaccatgaggaataataaactgtttttgtttttgttgttg

SEQ ID NO: 273460 - DNA, 753 bp, Homo sapiens
ctcttgtaattacagatctacctttagcacagaagtagccatagacactatgcagatgtgtgagttggctgtgttccagttcaactttatttgcaaatacaggtagcaagccagatttggcccaagagccctggtttgccaaccctgctttatggtgaggtaaggtctatggggcgttatttttgctcctccttccacctttcgttttatacttctgggtgttttgaaattaaagtgagatgaatgtggccattccagtagtctacagtttgaccttgacatactgaagtcaaacaatttttttttttatattttcctaagttacattcttgttaggtagcctttcccctttttgagacagatgtaagaagaaaatgttttttactttataagctcttacttcagaagagggtaatgagttttatactgtaaacacttcagttggaacttaaaagatattgagatatattcctttttaatcaggcaaaactggaattgaaatttatttgggtagctaatcagaaaactaatcaatcaaatgtttttttcctttttttttttgagtgcaaagctgagacccgactctttatttggatgggctgttcctttaccttatcatacgttaattgatgtaatgccaggtcaagaaacagcattttcagttaaatgaaatactgtgctgctgttaataatgagtcctctgcagatgtatggcgatgtctttgtgaactataatgaaatgtgagaagaatg

SEQ ID NO: 273461 - DNA, 735 bp, Homo sapiens
aatcccagcactttgggaggccgcaacagggggattgtctgaggtcaagagtttgagaccagcctggctaacatggtgaaaccccgtctctaccaaaaatataaaaaagtagctgggtgtggtggcatgtgcctgtaatcccagctactcaggaggctgagacaggataattgcttgaacctgggaggtggaggttgcagtgagccaagatcgcgccattgcactccagcctaggcgacagagcgagactcttgtctcaaaccgaaacaaaaaaacaggctcccagggcacaggccaggccactgaattcaagtcttcagctcagaggccagggaagctgtgcctttagtcttgcatccccatgtgggaaccactgtcatagctgaaggagcaccttatcagttggatttctatcagcttgagagttgggtaaggtaaattattggagaacggtagggggtccttaggaatctcaaaaatctcatcaagtagaatcctccagccactgggcagggaacactatggaagtaaagtcaggaaatgagagtgcagaggtacagtctcccaccagagggttgatcttgcctaaaatctgcaaatgactaaatcatgaccttttctttgaatgagaattgtggagtcagaccatctgaatttgtacctgttcccccagcttctaaactttgtgagcttggacaaattacctaacttctctatgccctggctttcccattt

SEQ ID NO: 273462 - DNA, 524 bp, Homo sapiens
atgcacaaaccccatgagttctacttcaagaccactacctatgataaacaacatgacatgtaccaggatgttgattgtcatgctatttgtaatagagggaaaagaaacatcattactcttccttagtaggaaatggaatagcatacagatattaaaatgaatatgctgagcacagtggcccacgcctgtaatcccagcacttcaggatgccaaggcagaggatcatttgagcccaggagttgaagaccatcatgggcaacatagtgagaccccacctctacaaaaattaaaaattagccaggcatggtggcacattcctgtggtcccagccacttaggaggctgaggtgggatggtcacttgtgccggggaggtcaaggctgcagtgagctgtgatagtgccactgcactcccgcttgggcaacagaatgagaccctgtctcaaaaaaataaaatgaataatagatttacatagatcgacatgaataacactcagaaatataacatcccgtcttcaaaaaaaaa

SEQ ID NO: 273463 - DNA, 221 bp, Homo sapiens
ctggaacgctgctgcctctcccctagagcgtgcgtaatgctccccggctgtgtccctgggctgatttctcgttgcaggtctcagctgggttgtcactcctctctgcaaagcttccctgacctcatctccctctccaggtcacgttaggtgcctcttgtctgtgtccccagccacagcccgcatcacaaacaagactataattgccctcgtgcttgtctgtc

SEQ ID NO: 273464 - DNA, 361 bp, Homo sapiens
taactttaaaaatatttttattacaagcagtccagactctcagggcatctcattagactattaagtagtccagcatttacccagaattctgtttccgcttttgcaatggcacaggtatttatttgctttgatgaggaactgtccttctgacttgatccccagctgttttgaatttggggcggggctttgtctttttggcccaagaggagaggttcagaggccacctcctccccggcaggtaggccaatccggacatgtcctgaccatcactcacagcccagagtcctattctggggctatttgctcagagctctgcacgaggccaagtttgtctgaatgccgctctgtacgacggcgctga

SEQ ID NO: 273465 - DNA, 373 bp, Homo sapiens
gaatttgataagagatgatgtgttcaatgaataataatttttgattcactttatgggtattatgttgacaagtcatatagactttctgatagaaattatatctgatttgacggatagattcaacagtgaggattagctttgccaattatactttattttccaaaaattaaactagcgaattctcccaatattaaattcaaaacaggttttgatggtaaatctatttggagcacatatacaatttaacaaaaactaaatcccgtgctgctattaaatgtataatattttaaattatcagctttaagatatggaagtacattcaactttttcccaattattttagaggttatggcaagcaaaaatgtttgaagac

SEQ ID NO: 273466 - DNA, 217 bp, Homo sapiens
gacagcagagcattaaactaagcagagcactaaactaagcacggcaccctccgcgaccgcacaagtcacaggcccatgaagctcgtcatgcctactgggtacatactattttattctttttattttagtccgcccatgaaaactaaggaacaaaggcataagtggtcaacggacagcaccatctgttataagccctttatgatctttcagaactttc

SEQ ID NO: 273467 - DNA, 1192 bp, Homo sapiens
aaacttattatgctctccaaaaggagctgtccattcagggaaaatcggtagcaggaggctgctcaacacaaggccaaccgcccttctagcgacgtgctgcctcttgctgccacagcaccacaccaacgcttcagcgctttggagtgcaagaagcaggcagatcgcttttagaaattagggaaaagagtatttgagagctactcacctgtttttaaagcctccccatgaagcttccacatctctgtctttctcctgcactgtaaggccctggtcctggcccagaaagtcagagtcacagcctagacacactgaggatggcatccagagtgtcctggcctgtcatcctgtccatggcagaatgagtagttagtacatagggcctgtgtgcccaccaggctaggatgtgatttgatggcgcactctccaatatggcagccagtaaccacagtggctgcttggatttaaattaattcaaattaaataaaatttaaaattccattcctcagtcacactagccacatttcaaatgctcaatagtcacccgtggctagggctacctcactggacagatagaacatcttcatcatcacagaaagttttgttgggtggtgctggtactccagtgccatcatttaaactggcatgagttctttgaagggcccccaaaatccacgtggaggaaaataaaaaatggtatatcaagtactagccagggagcacagctacctgtacatccttccctctgctcattcattcgttcaggaatgtcatcgtgtacctgaatacacaaggcacaccagggttgacatactcaggacctgccaaaatgatccagactgtgctcctgctcttaaaggactgcccatttggttcaggggataaatgtgcacaatggccaggtgtggttgtcacgcctgtaatcccagcactttgggaggccaacgcaggcagattgctcgagcccaggagttttgagaccagtctgggcaacatagtaaaaccctatctccacaaaaaactagcaacgtgcggtggtgcacgccccatctctaaaaataaagtaaaagtattcccagcagctcaaaaggctgaggcagaggaatcacttgagcccacgatgttgaggccgcagtgagccaagatcctgccactgcactccagcctgggcaacagagcaagaccctgtctcaaa

SEQ ID NO: 273468 - DNA, 295 bp, Homo sapiens
tcctggacttaagtaacctacctgcctcagcctcccaaagtgctgggattacagacgttcaccaccgtgcccagccttgatgggagattttaaaatgcatagtaacagtagaagcaaaccctgttactttgtttacctcatgtaatgtcacaggaaatgtcagtttacttcatgcttaaaatgcatgaagaaaaaatattctgtcagttcaaattcgtttcctattgacaaaattgcataattttggccaggtgaggtggcttatgcctgtaatcccagcactttgggaggccga

SEQ ID NO: 273469 - DNA, 383 bp, Homo sapiens
cccctcatggtgggcaagaggcatagcaagtgacctacaggacatgttacaaaaggccataaggcctgccttgcctacaaatctctctttcatgactgagccctcccttcatgtccattctgaaattatcactcttatatttactaatggttggaccagtggccccgtaagtagggtgaatacactccagagcctggcaagcagatgcatctctagaagagaattccatgtctatttatttttattgtatccctttaaaaattttagtattgtgggctgggggcagtggctcacacctctaatgggaggccaaggtgggcagactgcttgagcccaggagctcaagaccagcctaggaaacatggtgagaccccatctctata

SEQ ID NO: 273470 - DNA, 464 bp, Homo sapiens
gtgtctggtgacagtgatttccaggcatttctgcaggctctgttcctggaataactttccattctgtgcagtgggcacttcaccggactgggctagagaaagttgaggtcctcactttctggcatcttcagtccagttcctgagaggaggagctgggtgcttgcattctggcctccctaggacctccccacttgtgcccctccttggggccccccagaaacctgaggatagagtgcattgcctcagtaagcatggaggggcgggcaggttttggagatttctcaggggaatctttaagatccaggactggctcctgaagattcctgatctaatgaataagatcaggcagaaacaattccatatttttatgggaatttacaagagttttttgttttgttttgttttgttttttgaaatggagtctcactctgtcacccaggctgaagtgcagtggcacgatctca

SEQ ID NO: 273471 - DNA, 956 bp, Homo sapiens
agtttcactcttgtatcccaggctggagtgcagtggtgtgatctcggcttattggaacctttgcctcccaggttcaattgattctcctgcctcagtctcccaagtagctgggattacaggcatgcgccaccacatctggctcattttgtatttttagaagagacggtggtttcaccatgttgtccaggttggtttcaaacccttgacctcaggcgatccacacgtctcagcatcccaaagtgctgggattacaggtgtgagccaccgcaccctgtcaagatttttttaaagctctaatttttctcctactgggtttttctcgtttgcgccctccatctttctctctgtctctttttgggtaaacctttttgtctaattctgtctattgtattcctcaaacacaggaagcaagctccaatgctatgagatgctccatgtagagacccacataacaaagggtgaggcggtgctcagacgagtagagagaaggaaagtcaggctctctgtccacactaaaccctgtcaattttcacatgagtcagcttaaaggctcatgctttcccagtccagcttcagttaagaccacagcccccagtctcataaaagacctgaaggcagaggtagccagctgaactgtgtccagattctggtccacacaaattatgagatattatatgttgttgaaaagtgccgacttttagggcaatgttgtcagaaaggagcagatatctaacctcatctcccaggccctaggattctccatccctctgcttatctctttctcaggctgtctgcagccaaactagtccctttttacctctgccaaactcacacctatgagttttttcactaagggtggctttttcctgacacatgcttgtgcagatgcctccctgctgtcatcctcatcatggattaaaagtcacctcagtgacgcctgagttcctcccatgcaa

SEQ ID NO: 273472 - DNA, 188 bp, Homo sapiens
tatgacgcacatagcagtcttgcctgttctggacagtggtctttcattgactctttggagtatgtaccctctttccctctagtatataatctctggatctgagggtaaccatgagaaatccctttgtcttgcagctgcccaagaccatgcttctgtctgtgagttccccaataaaccaccctttaccg

SEQ ID NO: 273473 - DNA, 145 bp, Homo sapiens
gtttccactgtggcaaattagcgatgatgagaatgtatagtctggataacggaatggcgtatatggtgaaatataccaggaggtatactggcaggagcaagggactgggttttctcccccgtgcaagctgttcttgctgtgtttc

SEQ ID NO: 273474 - DNA, 581 bp, Homo sapiens
tactctggttagaaatatattactaatctaaactttgttgttggctggctctgaaaaatcagaacattagaaatggttcgcttcacttgtgcaaagcactttaaactgttcaagtagtttaacatattcaagaggaaaataaagagcatttaactttatttacagccttaagtggagttgggagccgagctgaacttagaaactttgaccaaaagagcgagttaggggcgaggatgcgggcgtgggccaagcggaagagcaggagccgggaagaagcccggtgagaagagtgcagagcgctcgaacccacactccgcgagggtccccaaagcagacagcgggcgctggcggtgccagggaagccgactcctctttgcgctctaggcccactgtggggttggggctcgtatagaccccagggcacagccagggcgcctggaccctaggcgcaggcctactgagccgcggcgaagtctaggcgttgtctgaaggccgcggtgtgccctcgtcgcgccctgggctggcgggccaatatgagcggcaggcccagagagcgcaggtgggggcgaccctcagatcac

SEQ ID NO: 273475 - DNA, 291 bp, Homo sapiens
ggaggaaacagcagccatgggcaccgttggaggcagaggcattctgactcaagggacgggcccacctctggtttctggcgctgttgactttagcatgtggtgagtgttgtgcccttgggcatatgtgcactgagatcttgaggacttctgttggagaagtgtctgtcttcttctttctgtggcatagttttttggaactgcctcacgtgtgccctgtgttatggtcagaatgtttgtgtctccccaaaattcttatgttgacattctaaccctccatgggatggtggcatt

SEQ ID NO: 273476 - DNA, 420 bp, Homo sapiens
tttagctttttctacattttccaaatttcctgccatgaaaatattattatatctttaatcagaaaacacatacacacattctaataacaacaaaccacaaaattatcatagtccacacccttttatgtatataagatgtaacctggcttagaagaaacaactttatctaaataacagtctgcagtttttattatattttcatttatttaaaaagtatctcttagaatctgttgataaaacaaatttaaataatcattcaggattgtaatcatggtttttttttttaatcacatattaaaaagactgaaaggacatgaaccaaatgaaaataacggctttgttcacgtgatggaatatgaatagtttcttctttagtttctaaatgctctacaatgttatacatgttgtgttatatactgc

SEQ ID NO: 273477 - DNA, 97 bp, Homo sapiens
ctaataaatgtcagaggcgggacccataccccttctgtctgactatgaaaaccatgagctttctattttatgatggcatcctacagactcttagtct

SEQ ID NO: 273478 - DNA, 290 bp, Homo sapiens
aaatagagcattgtttgagttcaccattagagggcgccttggtacctctgtggatttaaaaattaagccttagttttagttaaaatagaattttctctttcactcttaaaaacactgagccatacagccgtggtctgctaactgctcctgcattgatttatgagtcattcttgggtgaacaaaaccatacaccatggaagtagtctgtcattttttaattttatagctcaggggctcgccaaataacagtgtaaatcattgtagaacaaccacagttcattcagagtttg

SEQ ID NO: 273479 - DNA, 281 bp, Homo sapiens
gcggcggccagctgttgggggacagatgttgggggagccgagaggggagctgggggaggagcctcggggccgggacctccgagaagcggtcgttttaacctcttaattgctggttctgggttttttttccccctctggcttcttcccctacgggtttacctagaagggaaggagcagagagaataggtagggccccacctccaacccaccttgttcgcctcacaggatctaaagccttcaagaaggtcttgaacctaaaataagtgaacctccgtttgagt

SEQ ID NO: 273480 - DNA, 404 bp, Homo sapiens
gtctcattctgaggtagaaggatgggaacatgcctgcttaagcttccttccaacatggctgcctggaggcagggagctgagttactacctctggggaaagaggagctggccagtgaggtcaggaaaattgggctgctctctccacacaccccacccatgttctgacctcctgccatctgtctgtgccacctcccttgtgcccttgtgcctaagtggtcactttctgccctggcatcccagctgtgggaccccttctgccctcctggatgatagctgggacaggaacactggcttttaaatcacaatgcgtttggagaacaaccacagaacagctcaacccaagaaaccaaaaccaaatagcacagacacaagacagaaccaaagacgagtcgctttgggggaga

SEQ ID NO: 273481 - DNA, 373 bp, Homo sapiens
ctaaaatctagattcttattaattcttctaagtgaattggtaaagggagcaaatgcacttctttactattgattcaaaacataaggtgacgacttaataaataatttagattttttcattaattaggcatctcctgagataaggctgaatattaaaaagcatcagtactgaggtttgcactcctttagaactgggctttgggttatacctgaagacattaaacaccccgcctgtggtgtttacttcattattcccatatgaaaaatgaaaaaatttattccaatacctgcttctctttgggattagaggaaaggcattggtgaaactcagaatgcctggactttgattctggctatatatcttaaacaattaa

SEQ ID NO: 273482 - DNA, 535 bp, Homo sapiens
aactcctggcctcacgtgatctgcccacctcggcctcccaaagtgctgggattacaggtgtgagccaccacacctggccaggaggcgggggctctcaaatgatggcagggggaggttacagtcagagatgcaggcagtgctaacatttactgagcacctccaagaccttctctatcgtctcaggacccagggaagctcccttgtgagccggggttacacttcccactttataggcaggaaaactgagtcttggcagacatttcctgtctgtgtccaggagcttctggagctgttggccccaaatgccttcctctgccggaagagccccttttgagaagggaagcagagcttggaattccccaccctccaccatagaaacacacttcctttttatggacactcactggaggaacagctctagagacagccctcacttccccacttttacccagtaccagccctaggcctggctgcaggcctctcccagccccaggagccccccaacacctgagaccccgtctccaactgagcgcgt

SEQ ID NO: 273483 - DNA, 442 bp, Homo sapiens
ttttttttttttgagtcggagtctcgctccgttgcccaggctggagtgcagtggtgtgatctcagctcactgtaacccctgcgtcctgggttcaagagattttcctgcctcagcctcctgaggagctaggactacagacgtgcgccaccatgtctggctaatttttgtatttttagtagagacgggttttcaccatgttggccaggacggtctcgatctcttgacctcgtgatccacccacctggcctcccaaagtgctgggattacaggcgtgagccattgcgcccggtcgtgcatcactattttgatgcatcatcttcaaaccaccctgccccagcatcactggactgccggtgtgcccagcctcccctgcacagcttcccactctgctcacagagaagacggtggaggggggagcccaggcgtgggttttccgtgtgct

SEQ ID NO: 273484 - DNA, 586 bp, Homo sapiens
gaagtagggtaacagtatgagagtatgtggtgttcccatctgtccaccaggccctaggagctctctccccaaagtaactggtgctaatggtttgtcgtgtgtccttccagagatatttgatatttaatatctataaatcttgatttaaaaggactcttctgtaccctttaaaatgatatattttaaagatcattcgtgtcagtactaattggacccatttcgtgtatagagatggatattttaggacactcctgtgttcaccgcttctttttcataaggcaccttcatcatcgcagcagctgcctttggaaatcttcccttgcctctcacaaggagattcatctgattgtctgagttgattttttgtgtttttttaaagggtttggagttaagaacaggtatgtgaatcacacagatcatagtgccattctaagctgcaccagcttattagctatgagactgtaggcggcaactcgatgtttctagcctgagcatccttatctgtaagatgggaagagtgcttcacagtcattggtacttagtgaatgcaagttgtctcatcctttctgcttcatggaaatgtatc

SEQ ID NO: 273485 - DNA, 487 bp, Homo sapiens
cggcggggccgccggatccagggacaatggggtggggcgggctttccctgggtgggcgcagcggcttcctgggtccccctcacgctctgggtcagagttcctttacaggcggacctgagaggcaactcaccgactcctgccctggaccctcctgcgccactgaaccccctgacctgggagcctcggaacctagggctcaggagatgaaccaggacttatccgaaggtaccaagtgaacttctaggaaaagtccaattctcagatgctggatgtcttccaaaaatgaagcaaattagtaacttagtagctgagtcaactaatcctgttagatggtcaacactggtttttttattttaatatttttaagtggcaactctagtgtgtgagaaaattaatgtgacagctgaatttgtagaaagctgctttgactctcttgggccccttcataagccctggaactaaataaaagtctagtgaatacaagtaa

SEQ ID NO: 273486 - DNA, 532 bp, Homo sapiens
cggcggggccgccggatccagggacaatggggtggggcgggctttccctgggtgggcgcagcggcttcctgggtccccctcacgctctgggtcagagttcctttacaggcggacctgagaggcaactcaccgactcctgccctggaccctcctgcgccactgaaccccctgacctgggagcctcggaacctagggctcaggagagcggccgtgggtcccatcaggctttcccctcggatcctctgcagatgaaccaggacttatccgaaggtaccaagtgaacttctaggaaaagtccaattctcagatgctggatgtcttccaaaaatgaagcaaattagtaacttagtagctgagtcaactaatcctgttagatggtcaacactggtttttttattttaatatttttaagtggcaactctagtgtgtgagaaaattaatgtgacagctgaatttgtagaaagctgctttgactctcttgggccccttcataagccctggaactaaataaaagtctagtgaatacaagtaa

SEQ ID NO: 273487 - DNA, 560 bp, Homo sapiens
gagaccatcctggctaatacggtgaaaccccacctctactaaaaatatcaaaaattagctgggcattgtggcacgctcctgttgtcccaactactctggaggctgaggaaggagaatcgcttgaacccaggaggcggaggttgcagtgagccgagattgcaccactgcactccagtctgggtgacagagcgagactccgtctcaaaaaaaaaagaagttttatacatgaggcccatgaggtcctactgggtgctgggcacttttgtaggccaagcacaaaacagacaaggtccctgccctagtggggctgatgttccagccaggaggccagatgacaggcagtggcctgggaaactggagcagttaataacacgctagaaggtagataatgcaatgggaaaaaaaagaaaacaacagcagagtagaggggagggcagaagcaggtggggggagcagccgaagcttcatcacagaggaaactcaaatatccccaggttgcaagagatggccgcttcttttggtcaacttctcaaaaagagtactaaaatgacatcacatct

SEQ ID NO: 273488 - DNA, 411 bp, Homo sapiens
ttcttacacttaagtctttaatccattttgatttaattttgtaattaaaattaaatcaaaaaattaaattactctgggttcttttctcagcataaaaatgtagagattttcccagcaccatttattaaatagggaatcctttccccattgcttgtttttctcaggtttgtcaaagatcagatagttgtagatatgcggcgttatttctgagggctctgttctggtccattgatctacactgctgttttggtatgagtaccatgctgttttggttactgtagccttgtagtatagtttgaagtcaggtagtgtgatgcctccagctttgttcttttggcttaggattgacttggcgatgcaggctcttttttggttccatatgaactttaaagtagttgtttccaattctgt

SEQ ID NO: 273489 - DNA, 432 bp, Homo sapiens
acagctctattttaataatttttctgttgagaaaactagtagatttcttgaattctaagagttctacagggattttattcatcttaactattttgacagatttaaaaattatgtagtaagactttatttcaatgttgacaggacgggttcccatgtgtgtttttgcagagggttattcctgaaactgacttgttactcggaccactatagtttggtacacagtaagaatgatgaactaactttcgctgtagaatgaactgagtgacagttcttgcttgcttgagaaaaatatactgagcatctagattgggccaggtagtgttgctaggtgctcgggatatatagtagaaaaacaagcctgtcttttttaatgtatgcaggatatctctggagaagtaagagagggtaaggaaagctggatatgttcctgct

SEQ ID NO: 273490 - DNA, 1449 bp, Homo sapiens
  misc_feature (829)..(829): n is a, c, g, or t
  misc_feature (1252)..(1252): n is a, c, g, or t
  misc_feature (1343)..(1344): n is a, c, g, or t
  misc_feature (1367)..(1367): n is a, c, g, or t
  misc_feature (1384)..(1384): n is a, c, g, or t
  misc_feature (1389)..(1389): n is a, c, g, or t
  misc_feature (1422)..(1423): n is a, c, g, or t
catgatcttaatttaaaatgaactgttggatctctctttcataaattaagtgcaaaactctactttctgcctttcttcttgtgaccagagtaccagttgactcatctcagttataatttgtttaacaggtttcatttgcttttcccccttaatacatgaatccttttatgtgtttaacagttatttgtttcagagggtctgcattgcataatgccatgagcagccaaggttttcacgtaatgattttttatgaaccatgcaaagacagctcaagttatgtaaatctcagtgaactctctagcgacaagagtcccaatccttaggcttcatcatggagctgcttctctctcaatgtatttgaattattggtctagccaacctcttcttttccccttgctgcagtattttaggaggaaggaacaggctaaatcctagctagacgtgcgcatgcattctggtatttaagagccaataaaatatagccaggaatcaccttgtctcctgtaccatacttggatttgtagttcagatcttcaatgtagtgcttaaaagaaacacacactggggttttcatggtgaagtccagggcaagggcatagaaagaccacttgaccctggatggaacaacatgtggaaaccctccttgccctcctttttatcttctttactttttttactatggccagggttggaaatgtgggtggatgatgggttttacttctttgaaatgttaagtgtggaactttgaaccatgctcggtcttccctggatttagcaagaattgaaggctgtgctcagagaggttaaaggaagcatctgcttctctcantacaaggttgatggagatgattagtgtggtcaaggaagaggagattgtttctgccgtgcagctaatggaaagtgctttgggaacattggaaaaaagcatctcttgctagaagaccttgatcatctgtctcttggctgtagaggtggctccttggggttcatgtgaggccatgtcaaacaaaaacagggagaaattgtgtccaaattcgtgcttagatgtgtgtctgactcagtgttttcctcctttataaagccaagataaatgatttttgaattaaacattgttttggcacttcgtactttcattcattaagagggatgatgaacctgtcaggccataatagctagcctggaattttccttgccaagtctgtcctccttgaatagtttgctatttatgctgatgatttggagcaaggaggtngaaaatagtcatattatttgtccctacaagggaaaatacagcagcaatgttaaaatgataatgacgccaggcgcagtggcccacgcctgtnntcccagcactttgggaggccgangtgggcggatcacctgnggtcnggcattcaagaccagcctggccaacatggagannccccgtctctactaaaaatccaaaaa

SEQ ID NO: 273491 - DNA, 890 bp, Homo sapiens
atcattccaatgttacataaattgtttcagagaatagaagacaagggaatacattcttaggtttattctctaagtcatctatctttaattctaaaaccagacaagaatggcttaaaaaaggaaaattatagttccattttacttatgagtatacgtgccaaagtcttaaatacaggtctacagacccttaacctcaattttgaaatcgactaacctctgaaaaccaaagatttaagaacttggcagcacaacctgatttggcctattctcattgatggcaaaacctgacttgaatggatgtaagtctgcttacaatcattgtttagagtgagtatctgtacagttcactgtgaaaacatgaatgtgtttgaatactggatgctgacactcagtttgctaaggttgttaaaaaatacccagtttttgcaccatgcattattactagtgactagaaatgtttgatttctgaaacatagcttattccaagggttttaaataagggattttgggggatttaatagcagaaaaaccttgaacagtatgtaaaaggaaaatcatatccatgttggatttatatcagatgtgcaaagggtggcttttaatagaaaaatctgtacatgtagtttacctcatcaacaaactaaatgagaaaaaatactataatgacaatagatgcagaagaaagacttgataaaatttaacaattcttgggaaaactgctaaattaggaacaggtaagaactttcttgaaaacgtgtacacagacaagcaaaatttataataaacatcatctatcatcctaaatgaggaaatacattccctttttaatcaaaaagaaggcaaataaaacatcacttctattcagtgttatatggagatcctactcagag

SEQ ID NO: 273492 - DNA, 1196 bp, Homo sapiens
gttttgaaacatctgtttaccagtcacagcactggcattggaagaaaaggatgccaattaacaacagaggatcttgaagcttatatttatgtcttttctcagcctggagcattaagtggcccaattaaccattaccgaaatatcttcagctgcctgcctctcaaacatcacatggtgaccactccaacactactactgtggggagagaatgacgcattcatggaggttgagatggctgaagtcacaaagatttatgttaaaaactatttcaggctaactattttgtcagaagccagtcattggcttcagcaagaccaacctgacatagtgaacaaattgatatggacatttctaaaagaagaaacaagaaaaaaagattgacttttctttatcttctatgaagggtctgtaatgaaatctctaaataatttttaaaaattgttcatcaacttctttatgttttattagaaaaaaactgttttaatgtgctttatcataaataaatatcctgacaaatggtattgaaaaaaatctgagatcatgtgaacatataatacaatgttgattttcttctggtgtattttgcacagacaagcatctgccttaaaatatatacacttgtacaaaaaggaagtttggagtaagtgcttccattttggtttcttgcttttttttactctgttaacatatggtgccttttacaaatgtatattaaagattagctgtgccatattataaggcaaacctgaaataatataaattttcattctattgttcaaaaaaaaaaaaaaaaaaaaaaaacaaaaaaaaaaaaaaaaaaaaaaaaaaaaaaaaaaaaaaaaaacaagagaagagagaacaacagaaacaacaaaaaaaaaaaaaaagaggggggcggcggcgcgagcgcggcgaaaaaaagatcaaaccccccacggcggggacggcggacgaccccacgacggtactaagaggagaagcaaggaaagaacagagcggacacaaagaaagagaccgccgggccaaagaaaaacgcgggtgtgatcgaaccagaaaaaccaaaaagacaagaccgcgcggcgcgaaaaaaagaagacgacgaagaacgacacccaaacggacgagcgagagcagacgacaagaaaaacgaagacatacaaaagaaagaagagacgagggaacaagaaaaaaaaggg

SEQ ID NO: 273493 - DNA, 626 bp, Homo sapiens
ttggtcaggctggtctcgaactcctgaccccaaatgatctgcctgcctcagcctcccagagtgttgggattactggcgtgagccaccacgccgggccagagtccacatttttaatcaaggccccaagtggttaaaaaaataacttaaggagcactgtgacatgggaatattgatccccttaagccctttttaaagtgctgaggcttaatcaggagacccttggtcttctttctttttttttattattaaattggaattgtaaaattcctcctggaccttctcctgactaactgttttaatccctgtacctcaggctgcctgtcattggcaggacaaatgcacaagaactgatttccctggagagggttcttggtgtcacatggtgggagatgctgtcttgtttaaaaacaaagaaataaaacccttcattgaactcgatggtctccctgaagaggctggaaacgtaatccagtggtgtctgtttgtttccagcccatgttgttattaatcctgttacaaatgataatgctttgcctttacaggcttgctgtctcggaggagttttctgtattgcctgctaggccctgctgggtgattaagccactcactcagagtcttacaggcca

SEQ ID NO: 273494 - DNA, 283 bp, Homo sapiens
caaagggttcactcttccatttgctcttctttccaagaaatcataaaagcacataagacatttttatcattttctaatttaaaattaaaactagaaatttaaatacatcacctgtcttagtatcctcgggttttgaaagtttcatgtttcggttcttattaattcgttatgtagatttcacttgttgcctatgtaactgcatttattgttaagtaattgaacatttacagtttttttgttgttgtttatatgtgattaaagtgaaataggctgttcaaatcta

SEQ ID NO: 273495 - DNA, 404 bp, Homo sapiens
gtagtaggaaggcaaaaaaggtaattgaaagaccctgttcttcaaattaccaagagaaagatgtcgtgcaaggaataggacaatgacctttctgttatttgcattacggcttgataattatcacaagtacattcagtttgagagtttctcgatctcttctcaatgccttcaaatagatatgttacaagacatggcaaattgattctttacctaagcgaggccagtttcatgttccaaaaatatttcaaagccaaatacacataactttataaatttagccactgttttttttccccttgactgttttattcttgactgccatagccaagagttaatatagttgcgttttcttaaggaagcaacataagttctaacaataaatctgtgaaaatgaatttgtgatt

SEQ ID NO: 273496 - DNA, 182 bp, Homo sapiens
cccctcaccctctgccaagttctagaagtgcacagcattcctgaaggcctggttcaaataccatctcttctggtaggcaggcagagctcgtcactccctcctcagcatgcccacccctgacactgagcactcttgtccactacctaatttgtcatgttgtcatgaagttagtgtttgatgaa

SEQ ID NO: 273497 - DNA, 351 bp, Homo sapiens
ttataacagcccaaaactggaaactgttgaacaggccaggcacagtggctcatgactgtaatcccaacactttcggaggccaaggtgagaggattgtttcaggccagtagttcaagaccagcctgggcaacacatcaagtccctgtttctacaaaaaacaaactttgctgggaatggtggcacgcacctgtagtcccaactgctcaggaagatcacttgagcccaggaggttgaggctgcagtgaaccacgctaatgccactgcactccagcctaggctagtataaacaaggtcaaaagtaatatgttcaggatgggtgtggtggttcacgcctgtaatcccagcactttc

SEQ ID NO: 273498 - DNA, 473 bp, Homo sapiens
tatatgtatatcaattttatatatatatatatataaaatgtatgttggtacacatgtgtgtattcatttactgacttgccctaattgaacaatcaactcagtcaaaacagagggtacagtagccacatacacagggttaatttgtttctttcacaataccggcaaaaagtgatgtcagaagcttctgtaccattctccagagctgctcctaccctaaggactaggtgtaggtttttgctgcttgggaaacgtgttgttaggagtggtcaggcgtactcctggagacagttcaggctcaacttttcagaggatcactgtcaattctgacaccaagtttcaggtttggcaagagggacataaaaatattctcaagttataatgatagaaaaaaaatccaagcttcaaagaggatcagctttgcctctcccaacttgcctctgcagacataaaaagggtgggactttttgggagaa

SEQ ID NO: 273499 - DNA, 271 bp, Homo sapiens
atatagctgccagtaaactggtaggaatgtatatgtcctctaagagataagtcatatgccttttacaattctttaattatttaccagtcagtgtatttccagcattgaatctaaaaatcctaaaacaagttatgctattatcagtgttctaattcccttagtggtctagacacatgttatataaatatttaattgcaatcactccatcaaaactctatgacaactgaatttcaggattctagtatcattttaaaagaaatatttgatcttt

SEQ ID NO: 273500 - DNA, 684 bp, Homo sapiens
ctgcctctgctaaaactttatattgcaagtgaaaaagagcttgtccctttagctattctcttatggcatgctgggatgttatgaaccatccatcataatttgggatgaaatgtaaaatatttaagctagtcttctgggttaaaagggggttaaagatgatgattctgtgatctctctaagtaccttaactgacattctttctataagtagcaccataattttgctaatttttcttatctttatgttgaccagtttgttccactttttgaagtaacttcattgaactttctgctaacgtatcctttccatattcccctctctcatccctgttctccttcagtctgctaggtcaaagtataaggattctcaaaaatgcagagtaattatgaaaattctgtttaaaaagcttcagaatagaatgtttatatagcattgatttggagctaagggctatattctggtaacataacaaggtgctatctagtgaatgtgtgattgtgtagtcatggagctgatgtccctgccatagaattacagaattatctaaaaagggaaatctataataatggccttcaatgctcccacacttggactagccattgccataggcagaaaggcaatctcatctttactgtgtgtgcaaacagtactttaatgtaatgtgtgcttaatataagctttctt

SEQ ID NO: 273501 - DNA, 346 bp, Homo sapiens
atgttacctagaatatagcccttagctccaaatcaatgctatataaacattccattctgtttaaaaagcttcagaatagaatgtttatatagcattgatttggagctaagggctatattctggtaacataacaaggtgctatctagtgaatgtgtgattgtgtagtcatggagctgatgtccctgccatagaattacagaattatctaaaaagggaaatctataataatggccttcaatgctcccacacttggactagccattgccataggcagaaaggcaatctcatctttactgtgtgtgcaaacagtactttaatgtaatgtgtgcttaatataagctttctt

SEQ ID NO: 273502 - DNA, 469 bp, Homo sapiens
gaaattatttcaaattattttaaaaattaaaaatgattaattcgcatttgctatggtccaaatgtatccaccgaatttcatatgttaaaacttaattacccatgtgataagaggtgggactttcaggaggtgattaagtcatgaagacagctgtcagggacgagagtagtgtccttttaaaatggcgtgagagagcaggttcataccttttttgcccttctgccttctgccaagtgagaatgcagcaagacagcagacactgaatctggcaccttcatcttggacttctcagcctgcagaactgtcagaaataaattcgtttttttataaattatccactatcaggtattttcttagcagaactaacaagctatgaaaacattgcatatttttgattgtcaaaatgaagttggatattgttaaatgtgtttgaattctttgattttgctaaatacaatggaatgatctg

SEQ ID NO: 273503 - DNA, 405 bp, Homo sapiens
actacccttttggagcagaaactcgtggtatctaactaaacttcatatacacccagccttcaactcagcaatccttctttctagaaattgaccctgaggttagactttcaacaatatggagggaaagtcagctcacagttattcatcacagcatcatttgtaattacaaaatactggaaacaatctaaatatctctatataggagagtcgttgaataaactactcacacaatgggtacaatgcagctgtaaaaaaagaatgagaatatctgaagtgaaatgcagtggtttctagaacatactgttaagtggaaaaagcaaggtgaaaagactatctaattctaaagtgtatggtatctttcctaaaagaaaggggaaaaagaaaagtgcatctgctcatctgtac

SEQ ID NO: 273504 - DNA, 346 bp, Homo sapiens
tagatcaacacaaaagagactccaaacgtcttgaaagcaggaaccatgtcttatctccttttttccccctatagtaaatatcacacattaccttcagaagagaaattcaatacttttttatttgaatctaacctttatacctagcatatgacatcttaacagaaactgctgtgaatttacccaacgcttagcatttagagtgatgacagactcaggaatccatttaggtctctaggtcctacgaaatccaatcaaatcctaaggcaatcttttcaagatcaccaagtaagagcacgaagtcttgagatttaattattactctgggtagtgcctcatactaataaaa

SEQ ID NO: 273505 - DNA, 705 bp, Homo sapiens
tatattcccagcattttttaaaagtttactcattattcccttttttcagatgaaaatacatatacaaagagagtgatttgctcacagtttcacaaccaggaaacgtttgcaccagagcccttccctctggtctgagcaaaaagtatatatataatataacgagtgacaacacgcttgcttttttccctttttagtgtgaaattgagtactttttcaactcacagatcaccaaaatgtaaccccctaaactgttaagccaaattcttaacctactgagtaaaaaagagcggggctcctccccgtggcttcgtcatttgaaaagcaactaacaagaacctcaaacatctatccttgctaatttcctgctttcagatcagtaggtgctgctaaaaagatctaaactgtggactcattcatcattcagtcagtattaacctactatgtgccgggcactgcatgaatacacaagaaaatcaggttccagccgtcactgttgaatggattcttcagtccgtttatgtatatttttgacatacaacttttcaaataggtagagtaattcggtgaggtaattcttaaagtcctgtatctaacctcagtccccttccaaaatgtcaaatacattttgttttgtatattaaatctaaatattaagttgcatttgtaaacattgccagatggaaatgtagaatatcaacaagataa

SEQ ID NO: 273506 - DNA, 167 bp, Homo sapiens
gcacagtgaagttcccggcaatgactcattttctgatattggtgcctgaattgcagcttccgtggctgccacttcaggaagataacgtgtgacccggagcaaggttatcagaaactgccgatagaggtttgccacctcccaccatgaatacggacgctgataggagg

SEQ ID NO: 273507 - DNA, 81 bp, Homo sapiens
gcgttgccataattagaagctattgataacatttttgctttacttaaagtaaaattgttttgcatattgttacatatttgc

SEQ ID NO: 273508 - DNA, 282 bp, Homo sapiens
ctccctgcccggctctttgtccagcaatgcctaaggtcgggacagcctggcatccctgctgcaggcgtgccttttcccaacgtgcctgctaaaccccacagccacactaagcacctgcaaacgtggttctcatgacctctttggacccataaaatgtaaacacatttttgagtcaccgtcctatgagcctgggaggtagactacccttaaattccagatgcgctgttggcaccaaacttctgataccaccttctcacctggaaggccctggccacaatcctc

SEQ ID NO: 273509 - DNA, 488 bp, Homo sapiens
tttgtttaggttcccaagttctaaccttgcaagaaaggactgggggaggaagtgaaataatataatagcaatcagtaaagtgaaggatagctttccatttttgcccttgactacatttctcttctacaaacaaaatttacaataatgcaacatcacccagttgtgtagtggtcattgtatgtgtaaggaaagtaactactttcctgtttttgtgattcacaagattggatttctcctattggcatataattgccaatataaatcacttgtaaaatttttagtttctggctgggtgcggtggctcactcccgtaatcccagcactttgggaggccgaggtgggcagatcatgaggtcaagagttcgaaaccagcctggccaacatggtgaaacctcgtctctactaagaatacaaatattagccaggcatggtggtttgtgcctgtaatcccagctactcaggaggctgaggcaggagaattgcttgaa

SEQ ID NO: 273510 - DNA, 438 bp, Homo sapiens
tgctttgaaggcaaatatttgctttccatattaaaaaaaccactttttagagtatgtaaaatgacacactaacatgaactaaattcataatgaagccaaattctttttaaaaatattaaatctataaaattagaaaaccatttcacccttttgtgtaaaatacctatgctaatgccttgctcactcgttttttaaaaaatcaattttaaggagaataaagaattctgctgcaaaaacaagttgaaagtctaaaactcgtttattgcggtagaggctccaagatcacacacgtccattagaggtattcagtgcagggtcactggagggtcggcaagagacagccaattagatgtctgtttttcctttcaaagtcctgtctgtttccttcactctcttcaaaacaccctaagtagacatatatatcatgaagtcaaagcg

SEQ ID NO: 273511 - DNA, 444 bp, Homo sapiens
tcctgcactcacactccaatatgcacctaagttatggggtcatgttgaggttccagactgcagaaggggatcgaattatgtttcattgtattgagtcacaaatatttcaatgtaaagtaaaaattttggaagttttacgtaacagaatataccttacaggaacagtagataggtataaaatgacttcggtttgcataacaaagaaataattgtgatgagtaccagactgtgaagtccctgaggcaaggttatcatttgttttctggcacatgagaggcatacaaatttatttttgctgaataaataaatattgtcttcaaatctttacatttccattctagaaatatgctaaaaaagctaatctgtaatagatatagagttagcacatgacaaagttatagctgctttgtgatttttttaaaataaagaacatgtatttgcatt

SEQ ID NO: 273512 - DNA, 416 bp, Homo sapiens
agaataaccaagttagaaatgggaagaaattatttgtactagtaacaaaataataaaatacttatatccttctcattttttttagttatatgtcagaaatgaagaaaattataaaatcttactcaagtatatcaaacaagggattttgaaaaataccttatttttggatgggaggactaatatcataaaaataccaatttatcccaatttaatatataaatataatgcaatcttaatctgaattggacttggtcaaaataattaataattccattgaaagactaaataaaattcaagattttgaaaaaggaatgactagacatgtgatttaacatttattaaaaatgtaaaaagctcttatattagttttctattattcctgtagtaaattactacaaacttggcttaaaacaaca

SEQ ID NO: 273513 - DNA, 352 bp, Homo sapiens
cgattgcggggcccgccgagcccacgcccaccgggaactcgcgctggcccgcaagcgccgagcgcagccccggttcccgcctgcgcctctccctccacacctccctgcaagctgagggagctggctccggccttggccagcccagaaaggggctcctacagtgcagctgcgggctgaggggctcctcaagcgcggccagagtgggtgccaaggccgaggaggcgccaagagcgagccagggctgcgagggctgccagcaggctgtcacctctcaataggacgtgaaggtcggtcggggtctggttgtagaaggctttaaacaacaagctaataaatttatacttcacactgt

SEQ ID NO: 273514 - DNA, 262 bp, Homo sapiens
ctgctcttcctgcttttggtcaagctgcccagcacgtacgcttcgtgcgccagtggtccgtctttggcaagacattatgccgagctctgccagagctcctgggggtcaccttgggcctggtggtgctcggggtagcctacgcccagctggccatcctggtaggtgctgtgtggccaaccaggacccagggtcccctccccagctcccttgggaaggacacagcagtattggacggtttctagcctctgagatgctaatttat

SEQ ID NO: 273515 - DNA, 316 bp, Homo sapiens
ctgctcttcctgcttttggtcaagctgcccagcacgtacgcttcgtgcgccagtggtccgtctttggcaagacattatgccgagctctgccagagctcctgggggtcaccttgggcctggtggtgctcggggtagcctacgcccagctggccatcctggtaggtctcgtgtcttcctgtgtggactccctctggagcgtggcccaggccctgttggtgctgtgccctgggactgggctctctaccctgtgtcctgccgagtcctgggacctgtaaaccctgctgtgtgtggggctttgggaaacgccgccgggggg

SEQ ID NO: 273516 - DNA, 466 bp, Homo sapiens
aatacagaaagtgataggatggattaaaaagcatgacccaattatatgttgtctataagaaactcacttcaaatgttgtaatataggcaggttacaagatagaatgtatccttcaccataaaacaaatctcaacaattttaaaaataattaaagtcatgcacttgttctttgatcacagtggactcaaactaggttatgaataacagcacaataacagaaaaatctccaaacactaggaaacaaaacaacatacttctaaataatccatgggtgaaagaagaagtctcgggggaaataaaaatactttgaactgaataaaaatgaaaatagaattgttgggatacagctaaagcagttatgagagagaaatgtatgacactaactgcatatgttaacagagatgaaaagtctcaaataagtaacctaagctcccagctcaagaactgaaaaatagaagagcaaaat

SEQ ID NO: 273517 - DNA, 462 bp, Homo sapiens
ttgagacagagccttgctctgttgcccaggctggagtgtagtggcacagtcatggctcactgcagcctccgcctcctggattcaagcaattcttgtgcctcagccacttaagtagctgggatttcaggcatgcaccacctcacctggctaattgttagtagagacatggtttcaccatgttggccaggttagtagtgatgacctttttcatcaccaaggaaaaggtacatggatgtgttttggtcaagcaaattgggatccacaaaacttaatgggtgtggcagacttgtcacacttgcttcttcccgttgccttccctcctttcctcttttcattcccctgtcttgctcctgtttttctatcttaagacattttcccttgctacctgggtacttagccctagagggtttgtagcatccagatcccttggtcatctattaccaagattcagaaaggagaagt

SEQ ID NO: 273518 - DNA, 131 bp, Homo sapiens
gcttttgccacatatgggcagaggtgagtgttgagaggactgggtatgaagttgggaacccaagtctgaatcctggttcagccatcattaaatgtgtgaccttgggcaagttacttaacctctctgagcct

SEQ ID NO: 273519 - DNA, 485 bp, Homo sapiens
atctcagcactttcatgcatcttatgagaagcaacacgcatgataattaagcatttctatgcatgcagagctttggttagcttggtaaagggtatgttcagcaattctggtccctgccctccagaaaaacttgcttaagatgcaccaatatgcattattaaatataataacacatcaagtaaaaactatgcctaacactcgcaggctatcatacagacttagaattattgagatgatttttcagatggtaacatttaatcacagagaagctgaataatttgccgaagtttactttaaaaaaaatcagagctacgataccaatgttcagtacctttctttcttagtataatcccctactttcaaaataacctttatagatatttctagtatctacgctaagaaaaagagtaatggtgaaagactgagagaagacactgctttttaaaggctatagaaatctggtacatggcttctttgaagaaaaa

SEQ ID NO: 273520 - DNA, 482 bp, Homo sapiens
tcagccagacggtgaccagcctgaggttagagaaaaggccagccctccctgtattgaacagtgtcaccccatgtgaggcaggtgagcacccagatgcctgggtgggtttggctagagatgctcagattgccagagagagaaggtagatttgtagaaatatcgacataagtagtctcgtcatcatcaataaatgtttatgatttgccttcagtgtaccaggctctgctacatcgttcataaaattcctcttaaaaagagtcgcattctttccctgcagaaacttaccatctagttagagatcacagaaatgaaacccagacactgtgaagtgactgttgacaaaggcagggagatagcgaggcatggtggttcaggcctgtagtctcagcaacttgggaggctgtggcaggagaattgcttgaggccggtacttcaagaccagtctgaacaacatactgagacccatctctttgaaaaaaaaa

SEQ ID NO: 273521 - DNA, 346 bp, Homo sapiens
cgtgcctgcctgtagttccagttacttgggaggctgaggcagggggatggcttgagcctgggaattcgaggctgcagtgggccaggatggcaccaccacagcccagcctgggcaacagagaaagaccctgtctcaaaaacaaacaaacaaaacataaaacaccaagaaaaagccctctgtccagagatgaaaaaattctcagggagaaaagggaagaggaaaagatattagcttatcactacctagaaaaatctgctatttatagtattagttttttttttttaactaaacatatactgaatactccagtatgctggttctcatcagaacatataatctatttttc

SEQ ID NO: 273522 - DNA, 497 bp, Homo sapiens
ttgccttctggctttatgctgagaataagtaagcacattcctcgcctagtccagccacacccagatgctcctccaaaggtcctgggcagaggcctggttcagcagacccgggacagggtcgctgggctctgcttctagcaggtgtgatcctgccttctacaacgacatatcttccagccccagggcactcctatgagactctggcaaatacttgggttgaaatctgggtcactctgatggtcagaaatccatcaaacagacgtttactaagtgcctacaaagcagggtgctacacgcagcggagacgggacctagttcaaatcccaattctgtttctttccagctgtgcgaccttgccattgtacttctccaaagctagtgtcttcaccgctctgcaaaatatggcaaagtcaacggtagctctcatcaccactggtaggtactgtggtgatgtggtgggaaggggtggatcaaatcatgcacaaaaaacttgaagg

SEQ ID NO: 273523 - DNA, 524 bp, Homo sapiens
ttttgctctctctgtcacccaggctggagtgcggttgtgcgatctaggctcactgcaagctccacctcccgggttcatgccattctcctgcctcagcctcctgagtagctgggactacaggcgcccgcaaccacgcctggctagttttttttgtatttttagtagagacagggtttcaccgtgttagccagatggtcttgatctcctgacctcatgatccgccctcctcagcctcccaaagtgctggaatcacaggtgtgagccaccgcgcccggccctggcattcttgataaacacattatacattctccctagtaaggtgacatttcaagcaaacatgcatcatgatcttacccataaacagtcaggtcacaccccgaacatgttaataagtgagttagatcaaccaattttcaatattaatacaaaatcatctgtggaattctcaaaaatatttttacaaaaattagcagtatgatttaaacgtcgacgcggccgcgaatttagtagtagaaggcaaccgc

SEQ ID NO: 273524 - DNA, 1021 bp, Homo sapiens
gacactgcttttccccaaatcaccagtgagctccatattgccaaatacaaatcaaacttttctgccagttgtcctactcgaactccccttgatgcctgacacagctgaccacttcttcctaaactccagtccccattcacttttgtgatcctactctcatttggatttctctctttattacagtgatgtcctatttatttatttatttttaagaagctcttcatctgcttgaactcccaatgccagtatccttctgagacccattcttaactttatggctttttttctcttctcttgtctcacaatctttgaaggaatctcaggcacgtgaatgatgtttacatctgctcagatgctgcagatacccaagtctttatctccagcttacacatcccaaagctacatatctgtcttctgctcttctcacagaccaaagcccatccatgactacagataacgtatcatctttttcccaagggataacactcttgatctacttggaaaccaaagccataaatctcaattcatttcatgttcctgaaccttgcttcctctccttttctaaacatacaatcgcacagtcctgaagatgttcactttttatcttgctaatatttcaattattctgtatacttctactgaactttagtccagaaacgcacacctcttacttggactattccaatggtctcctaactcccaccatcagccatccatctgttcaatattttcttcacagtattttaaaaagtgattttaaaaatgtaatcatattgtgaaaccgtttaatccacttggaataaaatgtttaatagatggatcgttctggcgggaaaagcattgtgaatattagctaaatgagaaaaagataatatctggaacttcgtacaagttctcaagcttaatttcagtatattaatgaattaaatgtaatttctgaaaattttctaaaataaacgtagttgaaaatttaatatccttgaaatgatgaagaacattttcaattttaacacaaacgagg

SEQ ID NO: 273525 - DNA, 201 bp, Homo sapiens
caggggttaaatgtgggggtaaagagaaaggtactaatctcttctccatttctgtaattttggcaggaggaaggtgggcgtgaatataagaaggcaacaggctgggcacggtggctcacgcctgtaatcccagcactttgggaggctgaagtgggcagatcatttgaggtcaggagttcgagaccagcctggccaacatgg

SEQ ID NO: 273526 - DNA, 358 bp, Homo sapiens
gagttaaaatttttcttttagtaaagacttttctgaatcatttagtactcttttctttttcagttaatatttccattaagaattcctgatgtttctttattctaaagccaaatataaatcattgttattattttagttcatacatgtcttaacatactctactaatgttaatgatcaggagttgactaacttacatttgattaatttaaaatccctcaattccgttcttttgtttgccctttaaaccctgcactgtcaagatctaagaatcccaaatgaaaaatctactgagattttatttatttatctctttgtaattatagttttattgagattaaaaaatttatcatctaaaagt

SEQ ID NO: 273527 - DNA, 518 bp, Homo sapiens
tcttttaaaaccagcagtccagcctctgttgcctgtcaagcaagtctgtgtaggccagattgattcaaaccagatctacttccaggccctgtttcacaccgtttccaataggatatgaatcagacaagataccatcaaccaagcattcagtcaggaaacagggccctggtcagacttttggggtgacctgccttacacggccaggatccagctctagtgacagcatctattataatgctgaggaatgggaacacactaaaaactcacaaagtgtgctttggagccaggcggccggcagccatgggaagcgtgctaagtgtggaaattccttcaagcctttcaagcaactcaaagtcataagctaaggagagatttcaaaactccaaagagaaattccactttccttttcctcagctccagtctttccattccaaacacgagtcctgctggtttgagccacttcatgaatgtgggattgttagggtcgttgcagagacttgccactatttttcttaggt

SEQ ID NO: 273528 - DNA, 305 bp, Homo sapiens
cctacttttaacatatgatgcaaactcctaaaaatctgtaaatacaaggataaaataccttactttttctatcttgaaatagtatttttataacttaccattttcttctatgttatggatttagcttgtaaatatctgttaacaaattggttctacaagatatataaaaatctcatgtgacttttcacatttgctctttattccagtttgtacgatagagaattctctatttcatcatcttttctgcaaatgcaataggaaattcttttgtgtttttggcctttaaattcagtaaaaatgttaaa

SEQ ID NO: 273529 - DNA, 453 bp, Homo sapiens
agtgctataaaatccaaatataatgaaaattccttagtgtgtcaaatgcataagatcattgggataattagtgattagcagtaatatatatgaatcacttggatagtatactgtatgcattatagtaggcatttaatagttaataacaaacatccttgtcactgagtggaatgaaacaagcattaagaactgtttaattttttcagtgtgaggcatttcatttgtaaggcagctaccaagaagagagaaagaaggagatacaaattttgtgatttgttttctatgaaagaaaaaggttaaatgcatgttttcacttttttatgtgtaaacttcatgttttaaagaattattcattagtttcctttggaaaacttgggtcaaatcattcttctgaatgtccattagaattcctgtgattcagaaaaattttagatcctcaactttattttgaaa

SEQ ID NO: 273530 - DNA, 448 bp, Homo sapiens
ctactcttggtggagaagtctgtggttgtgcaactctccagagggatctatgtctgtccagtacaccaaccccagccatgctcatgttcatagggtttgggcatttgtgcattccaattgttgtaacagtttcctatgagtggtcaaagtcatgctctgaagtccagattatgatggagcaggcagccttagagatgtcggggcagtgcaggataaatgagacaaagaggctacacctgccccacctgactcccagcatcccagccagcttcactgtgtgccatcaaccccacgtgaagggcatcccaacctcctccttcaccacttattattatacgatgtaacttataaacaatttaaagcaggggtctcaatcccccagaaacagactaataccagcctgtggactaataggaaccaggccacacaggaggaggtgagcagcagg

SEQ ID NO: 273531 - DNA, 382 bp, Homo sapiens
aggagggagaggcctctgtcttcctcccttccccacccgcctcccctggagagcagggaacggaacaaagcatccctgggaccggcttgcacctgctcagaaggtgaggatgagcttaaagctttccttgaggagattgaacccgagcttgtcctgccgcggtcactgtggggaccctgctgtccacacctctggggacccgtccacgcaggcatctttctctctgttccggggggctgacaccctgggcctctcctctggggtctctcaccacttggaggagagatgggctcgccgcaagctcccatcggccgctgctgttgctgggctgcctgtgccttccctttgaagctacaattcacattcatggtatctgtgtaca

SEQ ID NO: 273532 - DNA, 433 bp, Homo sapiens
gcagtgcgctatgatcgtgccgctgcactccagtctgggcggcagagtgaaagcttaggctaaaaatctttaaaacatgttttcatcctaccatattaatttggaagactggctttaaatatcacgtgggacagtaattatagaacatgtactgtgggctgggcatgatgactagcgcctgtaatcccaacatttttggtggccaaagcggaaggatcgcttgagcccaggagtttgagagcagccagggcaacacagtgagaccaggtctctttaaaaataaaaaattagccatatgcgtggtggtgagcacctgtggtcccagctacttaggaggctgaaggatcacatgagccaaagaaatcaaggctctcgtgagctgtggtcgcaccactgcactccagcctgtatgaaaaaccgagaccctgcctca

SEQ ID NO: 273533 - DNA, 301 bp, Homo sapiens
agcgagggcagctcgcttttgaggcagggattgctgaatgaggggagtggctttccaagttaggcgtttaggggaagaataccaactgtcagggacgaatgagagaacaggccaagcagccctggagggccaagtgaggaggcctctgttggagtgcctgaaatgtctggcttcgggaccttggattctttaaatgatgcaatctcctggcttctgcagagttgaaatcaaggcttagatccccaaaccatctgtgagcctggatacttatgcatggaagttaaagtttacagtgactcta

SEQ ID NO: 273534 - DNA, 500 bp, Homo sapiens
cctgcttggccagcgacagatcctttgctgctctgtctgccggttcttgaggtgaatgtcggaatccattatctttcgggaaagctctctggggcagggtaggttttcttactacatacaagttcttaattagttatcgttttttaaataaccacccctccccctatcgcttatctgattcgtaggtatgctttaattctaactttcttcctgtcctctctggtttttcacacccccagaagagtagcgcgcatcagaatcacctggaggccttgttaaaatactgacttctgccccacaactccggagttgctgatttagtagtgggggagggggcggtggcagcccaggttctcaggtgatcctgaagctgttggtcctgggaccacattttgagaaccactgcccaagaaataagtgatgctcagtaattaatccctgaattaacggaaagttggatttttatctactttgcaatctagaaagggtacgaggtctat

SEQ ID NO: 273535 - DNA, 262 bp, Homo sapiens
ttggcctcccacagtgctgggattacaggcatgagctaccgcacccagcctgagaccaccttttgcatctcaagattgtgaaaccaaggcccattccaccagcctggggactctttttatagatatgatcctcctttttcctgtgactaatgaatttgctgcatgatttctattcttctgaggttagttttctgagtaaggtgaccactcacaaaggcactttctttgtggcattctgagcctagattggggcccatcaatt

SEQ ID NO: 273536 - DNA, 86 bp, Homo sapiens
gggtggggtgacttgaagatgaaggtctggacaacgtaataaccaggtctataaataatacaatcagaaacatttgtttccaaggc

SEQ ID NO: 273537 - DNA, 899 bp, Homo sapiens
gatataaacccatcatacctaagtcaagaagcatttggacttatgatagtttgactcacaattttttgactttacaatgggtttactggggtattaaatgcatatttgacttaaaatattttctttttttttttcaggatgtaacccccattgtaagtcaaggagtattggcatctacaacataataaagtcacaaaatatctccacaaaacaccaaatataaatgagttgggagaaagcataaaaaagtattgggccatagtggtatcagcatctgtgtgagagacagcaaaggaatgtacccaggcttctgatggtccagagaacacaattcactaatgggtaaatgtaaagggccaatctagaatagtagccaaactgggaggggattccacacaatctgatttgcaagtgaaagcaagaggacatcaactcaataaagtctgagatactagagcaatatggctatgctcaaatctaacaaaaaagaactgcttccaacatggaatccaacagtaaagagaaattactgagagtctaatcaaaattgagcagacagaagcaaagaaaagagaaggttgagaaaaagttggacaacggagtcaggaagagagcagaatcgagaatttttttagaagtcattttacaaaaacaagaagagtgggagcactagagccttgaagacagaaatggtatcatgaactatccaccctatttaaaagtacaaaaaaaatcattttacttaaaaaaaatgaacaacagaaaatagcagattcttcctaaagttattgtaagggaataaaagcatacaaagaataaaagatgtccctatgaataatgaaagcatgccagaaagacatgctcacataagatgaaaactgtgacctaatatttcaaag

SEQ ID NO: 273538 - DNA, 290 bp, Homo sapiens
gttggctggaatgccactccctcagggatcacatctgtgtctagaactcccagggacttggtaggttgtaagtaaggtttgaagattattgtttgtgcttgttttaagacaaaaactgtcttcatggcctctgtgaacagcctcccttcattctgttggaatttcctgttgactttttttatcctggcatactgagatcttaaatgatggttgttttagatgttggcctgccttgctagattggggaagttctcctggataatatcctgcagagtgttttccaacttggt

SEQ ID NO: 273539 - DNA, 449 bp, Homo sapiens
acaaagaaataactcaaattatcatctcagggataacacattacaagagggcaattaagcacactacctggcattacacaaaagattgatatctcgttacaagagcacagatgagttcagatttcacaatacaggaaatacactcgtcaccaccgtctctctttgaataaacaaatttcgggtcccacttgccagcgccactgagtaactagtatagggaaagaaaaaacttttcaagaaaaggaaaagattgacatgtggccaatttcttgtagaagagctggagaagaaagagagaaactcaggatcctagagaaaatcaggttgatgttactgaagtgaaagattaggttccctcttagttataaacaagcttagagaaaaacagacatgtacccaataggcccttgagaagagaaagcaaaataaataaaaccatcagagccaaa

SEQ ID NO: 273540 - DNA, 217 bp, Homo sapiens
tgcaaagcacgttcaattggctgaaccgaattggctgcaactccagccccaacgggctctggggaataggatttcaggcttttcaacagctgctggaggaggagggtggactgacgagtatgtgagccagcccctaggacctttccctgttgtaaaattttataatgaatatgtatttaaccagcaaaacacatccagaatgccccatttagggacc

SEQ ID NO: 273541 - DNA, 380 bp, Homo sapiens
ctgcccatcaacagctgtgtgactctcagcatctcacgccacttctttgcacttgagatcacaatcccctctgtgacaactctatcaacttcctgctatgtgctagaaagcacactaggcactaaaatcaagcatgttgggatcactaggtatccatcaaatatgttcatgcaaatgaattaacaaacaagaaaaactatactctgatgctagtcaccatctgttgaaccaaaataatctttaaatgaccagaaatactttcttccctgcaattctgttactatgggttggtctaatgaggttggtttatatccatgagagaaaacagcactccttggtccaatatactgttttaataaactttattaaatttccattga

SEQ ID NO: 273542 - DNA, 218 bp, Homo sapiens
cacattatccgttaaattagattttgaatagtgttgaagtggggaaggatttgagaaaaacatatgcaccaatatttgaagtaaatctatgcttgagaattcctgctgagagtgattcttcagaaaattctaaagagaactttcatgagtctgaccagtgccctgaagagtgtgtgatgtttgaagatgaaatgtcagaaaataaagacaattgtgtc

SEQ ID NO: 273543 - DNA, 285 bp, Homo sapiens
caccatcagccatgttgaagtgcacagttcaggggcacaggcacattcacggccaccactgtcacctccagagcctcctcatcttcccgggctgaagccctgcttgcgttaaacacccactccgagtccctccccagtccttctccttcctggtctgtgggtgtgagggctctggggacctcgagtgagtggggagtggtggatttgtcctgctttatccacgcacctgccaatgggtccttttcaagggtcccagagaactcaggcagcaggcagcccgcgagc

SEQ ID NO: 273544 - DNA, 559 bp, Homo sapiens
agtttattttagccttaaagttatagctacaacaaattgaaccctgtagttattactgaaagagagtgtggatattttaagtatctcctagtataatatgacattgttcatgtggacttattttaatgtttatttgaaaattaattttttaattattttgtatattttgagttagaaaaacacactttatcttagacaccaaagccaaattattccaagtgtatgctatacaccgcagtgcagctctgcttctctcccaacctaccctggggccatttttggcacaatagttgttcaaatgtagatcactatgctgaatgctcatgctggatttgaccagtatgcagtattttagtactttttaaaaaatgtatgcttctttttgaagactataatttacaatttttttaataatgtgcaatttaatatagataaccaaaatctttttaatgaaaagatctttacaattgcttggaggataagattattttactgtggaaaaatgtgatactcttagtaaatgcaataaaaactttttagcaaattcaaaaaaaaattt

SEQ ID NO: 273545 - DNA, 294 bp, Homo sapiens
ccgcgcccagctaatttttgtatttttggtagagatggggtttcaccgtgttggccaggatggtctcgatctcttttgacctcgtgatccgcccacctcggcctcccaaagtgctgggattacaggcgtgagccaccgtgcctggccggggattataacttttagaagaaggtaggattgtctagaaatgtatgtgaggtggctgtgattcaaagggaagttctatgcagttatttttgtttcattattttgtctttcagtgttggggggtacaaatagtccaggaaaagaagt

SEQ ID NO: 273546 - DNA, 437 bp, Homo sapiens
tgctggctgcagactcatgcatacacatcacggtggtttctgggtggttgatgctcatcaccctctgacttcatttcttttttcctttgcaaaatggctattgcccagaggcagcatctcttttctaaaaagtgaacatgccagaagggtttttggaaactgccttgctatctgtaggagccagatgattcacagggatgaaccaatgtacataacaaggatacctgattggattaccaattagccgtctccacctctgcagggtggttggaaagaagagaaaaggcagtgtttagtttgggcaaataccaaaaggactttatcattctcatcaaggcatcagcgtggcacattagacctcttccaagccattccactggaacttctctctccaaatgctccagcaagagtaaacttgttatgcaaacattggatca

SEQ ID NO: 273547 - DNA, 634 bp, Homo sapiens
tacagtagaaagtcagaaggtcacaaagcttgcagggtaagtgacacaacttgaaactgcttggccctctttaaaaagaaataataaaatgggagagaatgaagcaagtttacctaacacgtctttgcaaggtaaaaagatggcctatcagaaggtccatgcagatcaaagagctccaggacactcacagtacttagacaatgatgaccttcaagccactgcccttgacttagagtgggacatggagaaggaactagaggagtctggttttgaccaattccagctagacggtgctgagaatcagaacctagggcattcagagactatagacctcaatcttgattccattcaaccagcaacttcacccaaaggaaggttccagagacttcaagaagaatctgactacattacccattatacacgatctgcaccaaagagcaatcgctgcaacttttgccacgtcttaaaaatactttgcacagccaccattttatttatttttgggattttgataggttattatgtacatacaaattgcccttcagatgctccatcttcaggaacagttgatcctcagttatatcaagagattctcaagacaatccaggcagaagatattaagaagtctttcagg

SEQ ID NO: 273548 - DNA, 519 bp, Homo sapiens
attttcatcctactgctttgccttttatgagatgaggctgaaaatgattttctacttattttctctccttgatcttttctaccacctttcagatcaataaaatatgataacagtgactcacaactttcctacaagagtttgtcagaagagctcttaggaatgattccattctaaataagcgaagctttcacctttgtgcctactcattcgattcatgtgtgttcattcaaccattaattaaatagataacagcatccattgaatgcattgtgccgaggctgtgtcctaagtctctgttccatcaatgctcaggaaactgtcatagactgctatttattaaaatgaaccttagaaaaaataaggcaaacttagttctgtgtgctattattgcttctcaatagagatactcttatgatctaaagttgataaataatctatgattttgtaatgtgtattccacatttcatcttttcccttttgcagctctattttttaataaagcctgtgttatttttaaag

SEQ ID NO: 273549 - DNA, 866 bp, Homo sapiens
agggctgggagataatacagcaaaaagcctgccatgtcctggtgacaggagcccatttcagcggccaaaaaatctttccaacagcttctgttttgctggtaaatgtctgtgtttgtgttggttgtaggaggaaacctgggaaaacaagttgggttctggatgagaaaatgggtgactttgttataggatggagcaaagagaatcacaagaaagctcaatggcatttgaccccaaatggaaaacccaaaatgacacttccattaggatattcctttgttttggaagaacagggtgagaagaagaaagacaggggcaaactttaccagacatgcccttcaccagccaggattagtaactgaagaggaaggagagaatgctgggtgcactccagctgctgggacccttctctttccatctcactgtacctttgcttctggaggaaggaaaatacattcaagtcctaggaagattctgaaggtcaaatgagggaaaggagccctgcccagcaagatgtatcatgtcaagccacctgcttctatcagtcccaaatccaccatcaccttagttcctgactgcaattagcacaactgtgttatcacctgctctaactttagagagagactgcatttaacatcaagaatgagggtgcttttgggaaaatgaaaaaaaaaacaaacaaaaaacagatgaacatcatttcagaaaggaagaggaaaaatgatgatgattctccttgatatgaaataatgaacttcaagctctaaaacagaacattgcatagaacaagaggaggacagaggcagaaaaacttgcctgtgaattgaaagatatgagatagtctggtaccacaatgaaactacctgtgg

SEQ ID NO: 273550 - DNA, 984 bp, Homo sapiens
cgtggatgttcctgctcttgctggggggagcctgggcagcgtgtggaagcctggacctcctcactaagttgtatgcggagaacttgccgtgtgtccatttgaacccacagtggccttcccagccctcgcactgccccagagggtggcgatccaaccctctccctcctgctgcaggacactccagggcacaggaggacaaggtgctggggggtcatgagtgccaaccccattcgcagccttggcaggcggccttgttccagggccagcaactactctgtggcggtgtccttgtaggtggcaactgggtccttacagctgcccactgtaaaaaaccgaaatacacagtacgcctgggagaccacagcctacagaataaagatggcccagagcaagaaatacctgtggttcagtccatcccacacccctgctacaacagcagcgatgtggaggaccacaaccatgatctgatgcttcttcaactgcgtgaccaggcatccctggggtccaaagtgaagcccatcagcctggcagatcattgcacccagcctggccagaagtgcaccgtctcaggctggggcactgtcaccagtccccgagagaattttcctgacactctcaactgtgcagaagtaaaaatctttccccagaagaagtgtgaggatgcttacccggggcagatcacagatggcatggtctgtgcaggcagcagcaaaggggctgacacgtgccagtagagacagggattcaccatgttggcaggctggtctggaacgctgacttcaagtgatctaccgctcggctccaaagtgcgggattgcaggccgattctggaggcccctggtgtgtgatggtgcactccaggcatcacattctggggctaaaacccctgtgggaagtccgacaactgggttatacaacatctggcgtactgactgatcacgaaatctagagcagggcgcatcttggtaagctaattcctaaaat

SEQ ID NO: 273551 - DNA, 168 bp, Homo sapiens
cacacgccctctgcaccctccacagcacccaccagaaccctagtaaccgcgtccacgtgtggctgtgaccacagtccttctgctcctccccaggtggcagcaaccccaagcctgcttcattcacagctgcatcaccgggacccagcaggggcatgccacgtggtgagt

SEQ ID NO: 273552 - DNA, 341 bp, Homo sapiens
tactatgacactaaaagctttttttctagaacaggagacacttcaggtgaaagcattcattctcctactaactatggccttggagccaggttttatctctcactgtaggaaattggccgccccaggtgtgagctatgaagactcctttttgccccagtggctttggggttgaaatgctgtcgaaaagcttttatggctctgtagacccatctttttgaccaagccttgatcacacatggacatccaagggtaatcatggacccccaattgtgggtgaaaggatggatcatttatctacctgattactgagagctttatttgtctccctctgatagcaaaaa

SEQ ID NO: 273553 - DNA, 386 bp, Homo sapiens
ataaaataaattggtattttaactattatgctttttatttcagcactatctcagagtgagacagcatttgtttaaatgtttgttaaatgtttattctcctaaacatttaataacctgatctgtgccataagctggactaggtgttttcaagtatatttcagttatttatgacatatgcaaatataaaataataagcaaaatgatgtaacactgtcatattattattattgttccagctatcagtatagtgcctaccaaagactgtacagatttatctctatgcttcattttgggcttgagcccaggtagagagaaaggtaaattttgctcagaaatgtatactgttacccagcttctttatactacaaatagcttgaaagaaaaaa

SEQ ID NO: 273554 - DNA, 356 bp, Homo sapiens
tgttacctccactgcatatttcaaaccttattctaagaattttattttatcattttttaaagtcaatttctcttcttcgttaacatgatgattaaatactaatcactaagtgcttatgctaacaccaaggatgctttgcttaagcagtgaagaaatcaaaaatacaatgtttccaattctgttctaggactgatgtggaagtcataaaaccagaaacaacacggacctcagctcttcagcggtaaacactctaacctattattaccgctcttttttttttttttttttgagttggagtcttgcactgtcgcccaggctggagttcagtggctcaatctccactcactgcaacctcc

SEQ ID NO: 273555 - DNA, 290 bp, Homo sapiens
aaaaaaatggaggtagaactgaactctgaggatgtttaggatttgaataagagaaggagagagcatcgcagatgaagaaagcaacatgcacagaagtgtcgagtaaggagagtattgcggtgtgcacaaatgacagggaagggtcagacctaaaagaagaggatgttatgaactgaacacagaaaaacatgatggggtaagggagggcagctgtggggccttgggagcaattagaatttggattccgtgtgataggcaagttggttcttgaggaaagctgtgggatgatg

SEQ ID NO: 273556 - DNA, 488 bp, Homo sapiens
agatagggacacttcaacaaatgaaaatattaggcaatagcactattgaacataggtgcatcaataaatattaatactaacaaactaatcccaacaacatgtcaaaaagatcattcatcatgatacagtgcgctttaacgtagggatgcaaagatagttcaacatacagatccataaatgtgaaataccacatcaacagaataaataacaaaatccatatgacacttgataggtacagaaaaagcacttgataaagttcaccatgacttcctgattatgaacgctcaacaaatgaggtatagaaggaatgtagctcatacaataaagaccatatacgataaatccacagttaacatcacacttaatggtgaaatatgaaaaacatttttctaagattaaggacaagacaaggatgctcactctcactacttctattcagtgcattaatggaagttctactcagagcaattaggtaagagaaaaaaaat

SEQ ID NO: 273557 - DNA, 96 bp, Homo sapiens
gaagattctgccctgttcactacagaatcctgagtttggttcctaagtctagttctttctgtctgatatttgtgttacttttaaagcgtcagcatt

SEQ ID NO: 273558 - DNA, 381 bp, Homo sapiens
agggcttcatatttccaaattaaactctgtattaatgacttagaatattctctacttgcccaaacacaaaataaaatgcaacaagaacctttatcacatgtacctgtatcatagacatttccgaaaacaatagtttcatttggtgaatagctgaattacaacataaattgaattcctaccctaaccccacaaggtagattctgttaaagtggaagcattgattgagaaggaatgggattatggaaattgaaataggagatgtgggaagatcctaatgaaggtgggaacactggactcatgaactctgctaagtgtttttgccagtaaaagcagccattctttccttgcttgagtgggttagcccattccacaaggtagttg

SEQ ID NO: 273559 - DNA, 452 bp, Homo sapiens
gagattcaccatctcctttcttctagggacttcccagaggaactgttgttaccagtttagcatgtatccttccaggtcttttctttgaatttgtatgtatccatgtgtatatacatgtgggtacatatacatacttttagaaatgattttgtttgtgtcttattgacatattttaagtaaatggaatcattctgtgtatgattttgcagcttgcttttcttcacttaatggcatttcttagtgaagcttcccatttcagtacagactgagctacctctttttttggtaggggtcagttgtagagtattttgtagaacaaataagtaatagtttatttaaccattcactcagggacaaacttcacaatgtctctaggcttttttctgtttatgctgaatattcttgtatatgccctttttcgatagagtttatagaacagtatgaaaaaatga

SEQ ID NO: 273560 - DNA, 429 bp, Homo sapiens
ctaatccaggatgcgctcaggattccctctccactcaccatgaagaacttcaagtagcggccacactttgcagtgcctctcactcaggctgcgatatcctaagcgtttaccttcattccgtggaaactcttgaaacagcccatgtcaatcatgactcagcagtttttccttaccatgaaaacagcagagcaatgggtttctccatttttagagttaatgcattagctataaatgtaattccatagtagatatgaagtgcaacaaaaaaaagtctgggacaaattctgccacttttcagagggtaacaggagatggttgactcaagatggaatgtaagaaccctcatggcctccctacccttctctttaacctcttcatggttgtgcagaataaacctctaatacttctgatgagtgaggcaaatggcct

SEQ ID NO: 273561 - DNA, 467 bp, Homo sapiens
aattcttcagagaagatctccaccaagaacactcaacccacattcaggcagaatatgcaaggaggcaaactgttgtggactacgcgatctccacatggaagatgtcacatcaaaaaataaaaataggccgggcgcggtggctcacgcctgtatttccagcactttatgaagccgaggcgagtggatcacctgaggtcaggagtttgagaccagcctggctaacatggtgaaaccccatctctgttaaaaacacaaaattagccaggtgtggtggcacatgtctgcaatcccagctactcgggaggctgagacaggagaattgcttgagcccaggaggcagaggctgcagtaagccgagatcgtgccactgcactccagcctgggtaagacagagcgagactctgtcaataataataataataataataataataataataataataaataaacaaacaaaaactctg

SEQ ID NO: 273562 - DNA, 538 bp, Homo sapiens
ctagaactcaacaggaggtcattattatttgttacattaaattataactttcctctgctcttctaaagtatatatgttttttgtctcttagactgtccaagggcagtctatggctacatcttttgtgtcttttcctcagatgactagattaaaaatcaagatgttattcatccttgctaatggtgggaggtcatgataacacatcctttccctcctaaggccctcaagtcagtctcatctatagggagacatttctttagttaaaggcactgtgtttttaccactaacattaaacataagatatttttaaagacattgcataataggaatcttgaaattaaaatatcatgctctactgtctacttcccaagaagaccatcataaggtacggccgcaaccgtcttaatgtctgatgagataattaacctttagaaatattaaactacaaataaatataaaacaacctttagagaactgtatggtatgcactggtttgtggtaatgcattagaaataaaatgggtgcagagaaatcacta

SEQ ID NO: 273563 - DNA, 497 bp, Homo sapiens
ggatgtcagtagggacttgctattatgatgatattgagctgaaatttatatttctgaggaaaatgaaaggctatcagaagtcatttgttaaaatttctttattctgtcttccccatccccatcaatatttctccctcttttaaaagactattgcctagaattttatagaataagccctcctattctgggaaactgtactgtggtcctatttatattttgtttgaagggtaattttcttttaatgtaagactaatgccatgttagaattagattctgtgaaaatatttcttgaagctttgaatatatgttatacctatttatgcaattcaggaatgctttctggtagtgaaatgtaatgttaaaaaataccaaaaaaagcaagtataagtttgagctaaagttaatgactttctaattgacttatttctgtttgggcacgctggttgatgcatgtgatatttgtatagaaataaattgaatggataatattgttaggg

SEQ ID NO: 273564 - DNA, 89 bp, Homo sapiens
cgttggtagcaatttcctcagccaagattcattgttgctgacaaaacaaggagggttccatcccattaaacattcatgaagcctgatca

SEQ ID NO: 273565 - DNA, 338 bp, Homo sapiens
aaaaaaaaagcaaaaaaccccaacccgatttcacttatttcattaattttgaaggttacaggcctggaagattttggttgtcagacattaagatttgttttcagaaaactgtttgttttcagaaaactggtcttttcctttacagcctggaacccttgcaaatatgtgagatgtaggaatttctgtgcttaaattcaggtaccacccaagggtctgccctacctccaccctccaggcctgcccccacaaatcagcccagtgcagcttccggtcaggtttgttgatgagccggatgctggtgctggctctgagcatccttttcagcctgccacctcttc

SEQ ID NO: 273566 - DNA, 544 bp, Homo sapiens
aactctcttgtatatgtgggttaaagaccctcagcctcaagccaagcctcctccatgaggagccatctcactattgactggctagtgccaggtatggccaccagcccaactgaaacgaaatgttgcgttaaaacaagtgtaaatctcatacaacaggcaaatgcagaagcaatgtggtctcgcaagttgtaaagaggacagtcgcaattttgctggacttcaacctgggtagaagacatgagggaactctgtcactgaatcacggcagagttcaaggccacttgtagactatttcatgttacagaaggtagcctttagctactaagcaaaggcctcggtttctcatttctttcctgttcatcttcttggtcatccttcttccgcaagggaaacgagcccaagcaaaaggcagtttcaatattaatttgaccgaggttttgtgcagtttattatcatccaggtaatcaggtgcaacccagtctgcctagcagcccccctctctctgctctgtgttttcatttaataaacattttggtctacttac

SEQ ID NO: 273567 - DNA, 273 bp, Homo sapiens
gtgcaagctaggatgtgagagacaccatccaatttccaaaaaaattcaattaccaaacaaatgaagcttaaatggcaccgggtagagccaactttagaaatgaccaagacagagagctttccctttcaggcagtaaatgccatggttagtcaggcaggggagtctagcaggaggtagagaaggtggaggggtgcagaggggacggtcttcaggagggaggaggaggcgcaccaggtgtgtgagctgggcgcacaccaccaacgccctgcaagg

SEQ ID NO: 273568 - DNA, 447 bp, Homo sapiens
atttcaaaacttactacaaagttacagtgtggtgctggcataaagatagacacgtagaccaagggaatagactagaaatctcagaaacgaacccttacctttatggtcaagtgatcttcaccaagaccattcagtggggaaaggacagtctattcaacaaagggtgttaggaaaacgggacatccacttgtatgaaggtggatcctcccctcacaccatatacaaaaatggacttgaagtggattaaagacctgaacataagaactaaaaccataaaactcctaggagaaaacataattactttacaacattgattttggcaatgatttcttgggtatgacaccaaaagcacaggccacaaaagaaaaaagtagataaattgaacaacataaacactgaatttctgtgtatcaaaggatgccatcaggagagtggaagtcagctcac

SEQ ID NO: 273569 - DNA, 325 bp, Homo sapiens
tttttttttaagtttaatttaaagcaatttgacatggaaaggttattactttagttgccaataaaagctgtacttttaacataagtgtacagtaggccctagggtatgtgactattatcttttctgcaattatgtggtgttctacataaatgtttaaaaaaaacttggaaatatcaaaagtactaacttagatacaatatgaaagttgaataaagagagaacgaaaacccgattattttagacacaacatgggttgaggtttcctcctagaggttatactgggaacaacaccagctggctttgaataaattaattcaaactatat

SEQ ID NO: 273570 - DNA, 497 bp, Homo sapiens
aattatttttaattaatactgaaattttcagtttaggcagttgacactaggttctgccagagttctaggcagaattgcataagatctcaagatgtgtttactccatttattcttcctttttggaaccctttttaagttccaacctcagatagtccttggacatcctaaactgcactttttaatgtggtttatcttcatgccagaatttctagaggtcacaactgtatatttatttttttgtttttgtttgttgtttacttcatgaatgtgtgcatatatgtgtctatattgtgtgtgtacaacttgatgatagagtatgtaagttattaacttgtatgtcagtaaggctcatcttaaagacaatgaacattttaaatgagaacttgttagcccaaatgatcctaatagcatgaaatattttcgagggaggaatatgttatttaaggtatatgttaagcttttataacatattcctcccacccctcaaagaaaaaaaa

SEQ ID NO: 273571 - DNA, 191 bp, Homo sapiens
gggttctagggtggacgatggtgatggccacacatcatagtgaatgcacttaatgccacacaactgtgtacttaaaaatagttaaaaccactcatttcacgttaaagagccttcggtgacagtctcaggtgagctgatgtcatgagcgggagacagtgagggtgtggacgtgtggttcatggtgcagcagg

SEQ ID NO: 273572 - DNA, 426 bp, Homo sapiens
aagtaaataaataaataaataaatattacgtagaatcacagtaagtttctgagaagtttgatcggtcccttggggagtggggccaggctctctggttcttcttggtatgacccaagaggtcatcctccttgaagataaggaaacaactcaccttgccgtcttcagctccttgtcatagaaagtgcttaataaatgacaaaaatatgaaatggggcatgtccatcatctaattactttgctcagagtaacagtgctcagaaaagtgaagatctaagtgtgatgttgcagcaattagacatccataagaaaaaagagcctaactgaagatggatcgtaagccaggcatggtgtcaaatgcctgtagtcctgcctgcttcagaggctgaagcaagaaggtcccttgagcccaggaattcaagtccagcc

SEQ ID NO: 273573 - DNA, 187 bp, Homo sapiens
gggtttgtgaaggcaagataaaactgaagagtttgtttttattcattcaatagatactgagcaccgtgtgctgggaatacagcagtgaacaaaaaagctaaacatctctttctttagagagtgtcagatagtagtaaatactatggcaaaaaagcagggaggattgtgaggaatgctggcggggtgg

SEQ ID NO: 273574 - DNA, 665 bp, Homo sapiens
ctctagtccaaaacagtaatcatgtgactatttaaaattaaaattatataaaatgaaaattgtagttcctgatgtgactgaggaactagcctcatttcaagggctcagtagccacgtggttagtgactaccacatcggtttggatagtggagatattaaacatttccatcactccagaaagttctgtgggacagcactgctctagaatgaagcagtgccgtaggtgtccgaagatgcaagttctgattctaccttctcccttccacacaaacacattctcattctctcttcatccaatctgattctggtgagcaaggaatcccctcagatttaagtttattactctcccaaaggactattcctaaggttctaggctcatagtaaataatgcacatagcttcaagaattctcaagaacccttgtagctgggaactgttttctagataagatcactaccttcaattgtttacaaggtggatttgggcaggcaacagatactttattttatattaagaaaaggtaggggttaaaaataaggcattgatggccaggtgaggtggcacgtgcttgtaatcccagtactttaggaggctgaggcagaaggattactggagcctaggagttaaagaccattctgggtagcatagtgagacctcgtccctgga

SEQ ID NO: 273575 - DNA, 353 bp, Homo sapiens
cgcatgcctgtagttccagctactcgggagcctgaagcatgagaaacacttgaatccgggaggcagaggttgcagtgagccaaatttgagccactgcactccagcctgggtgacagagtgacaccctgtcttaaaataatatataataataataaataactgtcagagagggtcagggttcagaatgaaaactctgagttttgagttcctcactgtccctgatttttatttctgcctattcctgaagctatttatttgggattgcctctctccgtaatgagtcacttatctcccaatcaccacaacttagagcccgtagaatcaccattgatatcaatttgcctctgtcctac

SEQ ID NO: 273576 - DNA, 281 bp, Homo sapiens
attccctcttgcatgggagagagtactttgactaattcaggtcctctgctggaaggttagtttccaacaaaattcctccttcctccacctgtgagttctgattttctacttggaaagaagtgaagaatggggcttccccagcagagggaagccactgatgtctggctacctgtggacaggaagcatctgggattctagtatagttccacaggaagaggcttaaaagggaattccccaccaaaagtctgatgcaggcacttagccgacggggtcaaaaaaaa

SEQ ID NO: 273577 - DNA, 594 bp, Homo sapiens
actcagatgggcaccatcagcgctagacaagaattctattcctcttatccaggcctcccagagccatccaaagtgacatctccagtggtcacctcttccaccataaaagacattgtttctacaaccatacctgcttcctctgagataacaagaattgagatggagtcaacatccacctgacccccacaccaagggagaccagcacctcccaggagatccactcagccacaaagccaagcactgttccttacaaggcactcactagtgccacgattgaggactccatgacacaagtcatgtcctctagcagaggacctagccctgatcagtccacaatgtcacaagacatatccactgaagtgatcaccaggctctctacctcccccatcaagacagaatctacagaaatgaccattaccacccaaacaggttctcctggggctacatcaaggggtacccttaccttggacacttcaacaacttttatgtcagggacccactcaactgcatctcaaggattttcacactcacagatgaccgctcttatgagtagactcctggagatgtgccatggctaagccatccctctgtgga

SEQ ID NO: 273578 - DNA, 572 bp, Homo sapiens
cagtcgacctccagggagctagagactgagatcacagctacatggacaaccactcatgcctacacgatggagtcccagtaagaactctggacactgagacatgggtcagcatccctaactggcaatactttgtgtatatcttcatcacacagtgtgcatgtccacaagtccacagggcgaggacaacagaaattccacacttgaagggacttttccttcactctgctcaggatcctctttccttggctgattttactttgtatcctttatctgtagtaaatgataaccatgaatgtaacagttttcagtgagttctatgagttcttctagagaattctcaaacctgagggtggttttgggaatctcctcaaacttgcacttggtgtgagaagtgaggacaattttgaagactgttctctccagttctcagttggctacctctgttggggtggttaaaatttgcagtggatgacactcataaggataaactttaaatattataaatgtaatattaaaatttattaaaatttaaaatgtaaaatgaaataaaaatcatccatgaccccaaaaaa

SEQ ID NO: 273579 - DNA, 684 bp, Homo sapiens
tggaggtgacttctctaattccctctcccccactgagctctggttctctgctcttcgggagaaccacattagttgactcttactaggtcctagaagttttactccattttctaattacatgctcaggactactccagaagggcttgctattagccccatgtttcagatgagaaaatggaggttgggagaagtcatgtgtccagggacacaattgggacttgggacccagtcccaactgggtcccaagttggaccgggacacccctcccctgccagggcccttgccctgtcttagttgccctgagctacggttcttgtggagggcaacagggtgggcagagggagaactgagctcagccaagaccgccctggcttattttacagcaaatcccagaccaataaggtctttattaataaataaatccgcagtatttctaagaacttttaaaacctaaccatgatactgctgtcatgcctaaaaatacattccaaaatatcaagtatccagggtttaagtgtttctgtattaaattttttttttttccgagacggaatcttgctcttgtcacccaggctggagtgcagtggcacaatctcagctcactgcaaactccatctcccgggttaatgccattctcctgcctcagcctcccgagttgctgggactacaggcggccgcaagctt

SEQ ID NO: 273580 - DNA, 335 bp, Homo sapiens
aactctagttgtggtatgatcaaaaagtacatactattaaaaatgttagggatctaaaatttatatacatattatgtgttaaaattaacatttcaatacaaatacaatagaaaaaggggagcagataaaaaaagaaactggcaatacatagattttttacatgttatcaacatacgaaaataaagtactgaatctgtttaaaatatcaaattctactcatgtgttaaaagcgtgttttgagtagttaggacactcaaaatgctgattacatctccagcacgtagcccgtgctggatatttatatatctgatcctacctatttacaagaaaaataa

SEQ ID NO: 273581 - DNA, 301 bp, Homo sapiens
ggtgggacttgtaaagtgattcatggttatgagtgtagacccgggaatcagataaactgggctcaagtccaactccagcacttactccctgtaaatgatcagtcctttctagaacccagtttccctatctgtaaaaccgaggcaataaaatggagtcatcatctcacagggtccatgtgaagctgagatgtggttaaacatgtgaagtgcttaccctcgtgccctgcatggagcagattctcaatagaaatttgctaatcttggtcaaattctgtccattggccaggagtcccagtcaggc

SEQ ID NO: 273582 - DNA, 329 bp, Homo sapiens
tgtaactaacctgcacaatgtgcacatgtaccctaaaacttaaagtataaaaaaaaaagatataatacccattttgtaaatgagaaaactgaggtctggagaagggacctggacatgtcatttagctgtggattcagactcagagctgcctgagtccagagcccaggcaatctgtacactctactacctccttctattatttttgtaattgagacataacatccgcataacgtacacatgtttacatgtcactatcacccaaatccagggacagaacatttccatagccctagaacccccctgtgggcttccttccaggacagccaccc

SEQ ID NO: 273583 - DNA, 422 bp, Homo sapiens
tggggaaaattgagagagaacaactgtgtcatgaaggcctccgtacagaagtcctgaacagggctaagtggtggtgagatgcttggctggaaaaccacctcctccatcctgcccaccgttctgctgtgctaggaagccagagaaccccaggtgccagggctgcctgccgctccctggaggaagtgctggctgctgcctgtatgtcacatggaaaagtcagtcacaatcagcacattcagccaaaccaccaaacgtcccttctgtccccatggtgcccgtaacaggagcccggctacctgaacctcccgacagtgaggaaagactgactatagacgccaggcgctgaaggccatggcatgtgaaatgtggccgggaggaaggaagagggacttgacatttgtaatgtacttgcacagcagtct

SEQ ID NO: 273584 - DNA, 187 bp, Homo sapiens
gggagaggactacccccaaaatttgatcatccaagagtaatccagtgtatacaaggcccagtggactttaagattccaaaggagaaatatgagagtgggcctgagtgagcctaggatggaactcgaaaagtaaattagaagtcttggccttaaaggatctccagggatcatggaaactgagtggaat

SEQ ID NO: 273585 - DNA, 435 bp, Homo sapiens
tagtctgacgtagtacatgtcacgggtggaagtcttttgggttactagaaacatttaaaaataaaatctcttactaaaattgaatattgtcatttgagataaatcctagctaccagtaaattcacttgaggaattgctggatattttgccgtgctatacctttgatttctatgtatttaaaccaaatttttagagattggctcttaagttttcctttgtgatttgtgaaggtgttaccagatatttttagaaaagcaacaaatatacaattactgtgccatactatagcgtactatactatactatactataccataccatactgtgacatatactacatacaaatgcagttagctctctgttctgcatctgtggattcagccaactgcagattgaaaatattcagggaaagaaactaaaaaataacaatactac

SEQ ID NO: 273586 - DNA, 525 bp, Homo sapiens
cagctaagcatccacaggaggtcacacacaggagacagaccctttcaatgtgatctctgtcggaagcgcttcttgcagccctcagacctccgagttcaccagcgagtccacactggcgagaggccctacatgtgtgacgtctgccaaaagcggttcgcccacgagtccaccttacagggccacaagaggatccacaccggggagaggccgtttaaatgtaaatactgcagcaaagttttcagccacaaggggaacctgaacgttcaccagcgcacccactccggagagaagccctacaaatgtcccacctgtcaaaaggccttccgtcagctggggacattcaagcgtcacctgaaaacacaccgggaaaccacctcccagtgattccagagtcaggtccacatcctccaccccaagagacagtgaatgatggtttttctccaatgttaccagatgacatatacacataaagcacttggtaggaattgcccggatgtttgaataaatatttatcctcccccatga

SEQ ID NO: 273587 - DNA, 576 bp, Homo sapiens
gtatttttagtagagacggggtttcatcatgttggccagtctggtctcgaactcctgaccttgtgatccgcccacctcagcctcccaaagtgctgggattacaggtgtgagccaccgcgcctggccagctttgtgtttttaaaaagttgtccttcattaagggagggaaattgagtaattgtcacaattctaaaagctgggcctctctctgacatgtcttcttttctcttgaaaagagatcttttgtccgatgttcagaatcagaaaagacaatatctagatcataccttagaaatgatatccttttcctaagaaccgaagaaaaaaacgataaaagccccggtgaggttttgcttctttcttttgcctttctttccaatgactttgcaaggcttaagacaaataactattaaatggaaatacatacatttgtaatttaaaaatttaaggaaaactaaacagaaaccataaaatcaagattcaggtaaaggtggaatgaggaaatgtagcttcatacagagtgccttaagtgtgaatacaggtgaataaatatgtaagaatgtatgatgtacttaa

SEQ ID NO: 273588 - DNA, 155 bp, Homo sapiens
taagggtaaaatgtgacattgtgtgtcaggagcttagcacagagctggcagaagaacccaataaatgttaacaagacaacagcagaagcagcttggctaaaatgcagatctagcatagggttattagggcaaaagccaattattatattttatcg

SEQ ID NO: 273589 - DNA, 280 bp, Homo sapiens
gataaatatttagtatcctcctatggtcaataaatttgaattatttcaacagtcattgcaaatacattagcaagtgcctaaagttgtaactccataggttagtaaaaagtttcaagggacaaagtcaatagtagaactgaagtttattcgaagccttggatcaaatatccctttaaaaacttgcattctaataaatgaaatcagtgtaaaatttctacttatgccttttcaggttcttaagttccattctgtcatacataatatccttcctagaaggtca

SEQ ID NO: 273590 - DNA, 466 bp, Homo sapiens
gcccggctctgcgggcagctgggggcggcgcggggcggcgggccggtcagtagtcgagcttgttgtataggttgtagagaggtaaggccgagaggttgcttcccgggtagtagagcggcgcgggaaaggcgagcgagcgcggcaccggcacgcgcagcagcgaactgtcccggaacaccagcggcatgctcaccagagtctgcgccgacgcgtgcgccatgttggccgcctccagctcagccgagagctgccgcttccacttgttgcggcggttctggaaccaagtctttacctgggtctccgtgagctgcaggctggaggcgaggcaggcgcgctccgagctgctcaggtagcgcttcatgtcgaaggtggactcgagctggtacacctggctgcgcgaaaagacggtgcgcgtcttcttcttggccgcgccggcctgccgctcagcgccgccgtcccgcggccg

SEQ ID NO: 273591 - DNA, 136 bp, Homo sapiens
aaaagtactttttcttttataatatgcaacaataactttctgtttagttaattagttttaaagcaagcttaaacttataatttataaagaatcatatttgctccctatcattgttttatagctggggctatactga

SEQ ID NO: 273592 - DNA, 376 bp, Homo sapiens
ggtagaatatgctaatttcctagagattctgttacttttattttcagtactaagccctggtaaggacttaactgagaagtttttttgttttggtttattgaatgctctgtaaaaatccgtcttttagtttttttttttaatcagtccctctaatgttaattgtggaattcacaaattcctgtctctgcagttttcaagacatgtctttccaaaacgtccccgtggattatttaaatcattcttattgtccctttccaggtattcttaacacatttcaggagtgaattatcttactagtttttacttgacaaattatggtttagaactatgctttccagtgtggtggatactagccctgtgtgactttaaattaatc

SEQ ID NO: 273593 - DNA, 587 bp, Homo sapiens
ttatttgatccttacaaaaattctctgaggtagacagaagaggtttcttccctgatcacagaagagaaaacaaaggctcaaggaagttaattattataactattctacagctaataagttggttatgcagtcattaagtctttattgaacatctctagcatccaggcattgggttaaggaaccgggactcaagttcaaatgaatcacacctcagtgttgtttctcttatttggagtagttctttaatgcatcagttttaaaagactgaaagttttaaacttagggtggctttcttacaacttaaaactgtttaatagagaattcttaattcacatagtataatataatatacccagcaacattctgcaacaggcgtaagccaccgtgcctggcctaagtgaatactgcatttatgagtgaattgatataaaacacatgcttcacagtccgagtaaccacaaacatcagtttttaaaaacaatttgaatagttacacagtcttcattctgtcagcttcacttccttagggttaaaagacacagatattttatgaagatcattaaaatagctggtggtgcaattcaacg

SEQ ID NO: 273594 - DNA, 583 bp, Homo sapiens
ctcaacatgctgaattgtttgataaagaccattctgggggtcagagggccctcctgatctcacagctagaaatgcaatgactatgtctgctatcaccactgttactactgagaacatgtctcgatgaaagcaattctggaaaataggggagcaaaagaccctctgtttgatactttgaggggtcttctgtggcataatcttcccaggaagatcacagatttccactgctgctctaatttaacgggattcactctttttctgtacctcctgtgtgccaggcccagagctaggcaccagggatgcagctgtgaacagactttgtcctgtcctcatggagtttataatttggtggggaagacagacaagtcgatgggaaaccacaacatggtaaaaagtgcctgatagcgaatgcacgagcccatggatgtacaaaagaaacacctaaacaaattttagaggtgaagccctggaagaaatagaagatcataccactgcatccagcctgggcaacaaagcaagatcctgtgaaagacagaaagaaagaaaagaaagaaagaaagaaagacagaaagaaagaaagaaa

SEQ ID NO: 273595 - DNA, 186 bp, Homo sapiens
aagttcacattttcatttgtttgtctttgactttcctaggcattgcatttaggatctgagtagggttttgtatgtttcagttgggccctgacactatgtatggaatatatatttcttttacagggatcaacatctgttgctgcaataatgttttaattaaataaaatttgtgggaaattatgactt

SEQ ID NO: 273596 - DNA, 404 bp, Homo sapiens
aagtgctgaaactctccctgtctcctttcctcatttgcaaacttggcttaataatgatagctacctcaaaaagttgttgtgataattaaatgaatgtcaagctcttggaacagtgcaagcgcttaagaaatattatgttggtgcaaaagtaattgtgattttgccattactttcaatggcaaaaaccacaattacttttgcaccaacccagtatttgctattactagtcctggtcagctgagcatggtggctcatgtctataatctcaacactttgggaggccgaggcaggtggatcgcctgaggtcaggagtttgagaccagcctggccaacatggtgaaaccccgtcgcaactaaaaacacaaaaatgtgctgggcatggtggtgagcgcctgtaatcccta

SEQ ID NO: 273597 - DNA, 355 bp, Homo sapiens
gctgggctggagagatcagtggaggatctgggctataatcagcctcagcaggcagaagatgaattgaggccctacaggccaccttctgcaaagtgaggactgagagtacatcccaagaagatctgcagtggggccagcaagtgcttgtcagagacttgggtaaagatgggtaggtgaattcagcagtgctgtttagggagtctcagaaattgtgcctatgctctgatgccccagcaaccagattaaacataactaaaagggactgttaaagtctagaacatcatgtcaaaaaagaagtttggtggctctttttatatgaaatggcctacttaaaaaaacaaacaaacaaaaaaca

SEQ ID NO: 273598 - DNA, 290 bp, Homo sapiens
ttttttggagaaggagtctcactctgtcgcccaggctggtgatgtacagtggcacgatctcagctcactgcctccacctcccaggttcaagcgattctctcgcctcagcttcctgagtagctgggattacaggtgcctgccaccacacccggctaatttttgtcaaataaaaaaatttgtttcaattttttctttgtatttagtttaatgctatctccatttctctctactccctatttcgttaattttctaagatttttctggcttgaagtttcattgcattaaaaacg

SEQ ID NO: 273599 - DNA, 510 bp, Homo sapiens
aatgctcccaagaagcggagagaagtcatgacgttacaagaaaaagttgtattgcttgatttgtaccatagatagaggtcttcagctgcaggtgctgccatttcacaaagaatgacttagcatatcattgtaaaacacataaaaggacagaaaaatctattcatgaagccattgctatagctacaccaacaggcacaaaaactttatactttttgctaaataccttttgcagcctttatgtgggtgcaggatttctataaggaaggcatacctgtagtatccaatgtgatttgaggaaaagaaaagtcattatatgacaacttaaaaggaaagcaaaggatatagcactggagaatttaatggcagcaaacgttagtttgaaaagtttagaaagagatttggctttaaaaatgacaagataacaggagaagtagcttttgacgatcaagaagtagcagtcaagtcaggttcccagatttcattaagaaaatcattgaggagaaaggttat

SEQ ID NO: 273600 - DNA, 466 bp, Homo sapiens
ctgacatttcattgcatttctgaagactgaaatggcattaaataaaagttgtgtgtgaatttgatttacgtgtacttaaaaacttcaaagctgcagttaaacaatccccagtgttcaaaaactattttattgttctgactatattatgaattttatgttaccatttattttattaatgttttctttaaaccattggttttttgacattaaaattttcatttattatactaagttttttatcatgtaagaccaaatccagtagttcattttacaatgtttctttctctcacaatgctgctaaagaaatggctatcattttgaatttacaacatgccaaagaagacatagaagttatatttatttttgttcttgttaaaactctgtgagcaacagttctcaagatatgttaaattactggcattctctgggtaccaaataaaaaggctgcaactttctaacattttta

SEQ ID NO: 273601 - DNA, 481 bp, Homo sapiens
attatctatacaccaaagccccaggacagacaatttacccatgtaacaaacgtgcatacctaccccttaccttcaatctaaaataaaagttggggaaaaaaaaagaatgtttgacagtttgtcagaccataaatccataaaaactgctcattctatattgtttcagttaaattattttcacattaaatttttaaaaatcatttatgaatgctacaaagaaaactattttaaggcccctcaccattcaggtttatcctcaggctgaatagctaaacattgttcttgattacccttctatgctttatttatttaagacagggtcttactctgtcacacaagaaggagtgcagtaggcctggtgcagtggctcacacctgtaatcccagcactttgggaggcagaggcgggtggatcacctgaggtcaggagtttgagaccagcctggccaacatggtgaaaccacatcgctactaaaaatacc

SEQ ID NO: 273602 - DNA, 442 bp, Homo sapiens
tggtctctgagtttccttagtatttattgatcactatctttactatctcggtgagggggatgtggcaggactatagggtaatggtggggagagggtcagcaggaaaacgtgtgagcaaaggtctctgtgtcataaataagtttaaggaaaggtgctgtgccttgatgtcatgtaggccagatttatgtttgagtttacacaaacatctcagtgtagtaaagagcaatattgccaccagcatgtctcacctccagccataaggcggttttctcctatctcagtaaatagaatgtgcgatcgggttttacaccgagacattccatttccagggacgagcagaagacagatgccttcctcttatctcaactgcaaagaggccttcctctttcattaatcctcctcagcacagagtgtgaccctttgcgggtgtcgggctggggga

SEQ ID NO: 273603 - DNA, 430 bp, Homo sapiens
ccattaagaggaataatatttccaacctggctgcctaaagtagctcctctgtaagatctttccggaataagttggttttccccagttctgaacctcaaattagccttagggaacctcgtcttgtgaactttcaaagctagcatttctccatagctttatattctgcataaatatttgttactgttttttcatttgatacactttttaggaccttgtgttcttattcagtggcacatagaaggtatttaatgcatgtttttggatgaatgaattaatgcaaggatagcatactttcgaactgcctttctctacagatttaaactaactttaagtattaacctaagcaatgttttgggaaatgacttttttgaaaacaaacaaacaaaaatactggacaattaaaacagcctgaatatctgagtacaaataa

SEQ ID NO: 273604 - DNA, 519 bp, Homo sapiens
tttttttttccctcaaagagttttatatagttttagctcttaagtctttgattcattttgaattaatttttatatatgctgtgaggtagaggtccaacttcattcttcttgcatgtggatattcagttgtgccagtacaatttgttgaaagactattctttcctccactgaattgttttagtacctttgttgacaatcagctactgatgtatgattagtagtcttttgtatttccctttttaaaactgaatttgtagtttttccttatttcttttaggatattttaatttttcatttataagaatacttaactcccacattatcatttggcttctcagatatttagaggcagcacaggtagtagttgcggtggaaactatttgttgttgtccgccaaatgttatccctttcttcctgggcacatgctgtgggactacacttcctagcctccatacctgctgtgagattgaccacgtgactaattctctctaattcagtgtgaacagaagtaacatttgc

SEQ ID NO: 273605 - DNA, 364 bp, Homo sapiens
tgcaaccatttctgacctttgatattccagaatagctgattgcttttctttggcattttcactttgctaagaggagaatgctagttaagggatagagcagaatagctctaacgacaagagctgccaccagttacccttccttgtgcggcacttagaatccttttaaataaacactgagggttagtctaaagaatattagcttaaaggggtgacaaataattaactggtccacagtacctcagtctgatcttgtttctacttcttagtttctgaaaatatattgttcgtccaggtaaaatgaaaacctcaaagtctccctctcaccatttgcttctaataaatatgaccaatttttaattattga

SEQ ID NO: 273606 - DNA, 920 bp, Homo sapiens
ccctgtctctaaaaaataaaccacagctcagcccactactcacaacatccctgagttgctattttccacaaggcttccctttgccgaggctcagccaggcagctgtgccatatctgaggaccccggggtggctgccatcagctggggtttggccgagaccacaacccctgcccatgggctctcagccctcatcggtctggccccggcttctctccatcacagtggtggccttcctctctccatcacagtggtggccttccaagaggccaggcatggacacaagcacctctccctccacatggtagcagccaaagcaaaccacaggccagcacagctccaggcaagagatgaggacaagccaccaacccggcctgctccaaacgccaagccctgctgtgacccatgtgtgcagtgtgcagtcacagccccgcaggggtgaggggacacttcagcccaggacgtctcagcagggagacagctgagttgagacattctcaactctgagctgagttctcttcttgctgagaactctcctgtctctatctgaatgtggtgctctctctctctctcaatctctctctctctctttccatcctaactttatttctggaaagctgtggtaagaaaatgagcagggccacgcacagtggctcacgcctgtaatcccagcagtttgggaggccaaggcgggcagagcacaaggtcaggagtttgagaccagcctggccaacatggtgaaaccccgtctctactaaaactacaaaaatagccgggcgtggtggcgggcacctgtaatgccagctactcaggaggctgaggcaagagaattgcttaaacccaggaggaggaggaggtcgcagtgagccgagatcatgccactgcactccagcctaggtgacagagcaagactctgtctcgga

SEQ ID NO: 273607 - DNA, 550 bp, Homo sapiens
cagatttttgtgcaggaggtgtttgatgaatggaattgagaggttgactcctctcttgagtgttgaagctccagaaaacatataaaggtgactttctctcatttgcatcaagtattctaaagataataataatattgtctcgtatttactgagtattcactatgcattgggctctcattgaagacttcttctatgtcctactcacttaatccccacaaaaaccctattgttagttaaatgctatgaatagtcttatcatacaaatgagtaaactgaggctgggcacagtggctcacacctgtaattccagcactttgggaggctgaggcaggtgaatctcctgatgccaggagttctagaccagactgaccaacatggcgaaaccccatctctactgaaattacaaaaattagccaggcatggtagtcccagctactagggaggttgaggcacgagaattgcttaaacctggcaaggggaaggttgcagtgagctgagatcgtgccactgcactccagcctgggtgacagagcaagaccctgtctcaaaa

SEQ ID NO: 273608 - DNA, 650 bp, Homo sapiens
taaactcaaatgggaggctttatacaaaagagaatatctagacaccactctggaaagctgcttctaatttcttcagcctcagaactctgcctctgtgctagactgtggaccaagccaaagctagtcagtaatgaaggcagtcatggcacaggacttgtgtcaggtttatcattaagttccttttaagccagctatccagaaataggttcatcccaaagctgggaaaacaaatgtcacacacaataggagtccatttatattcattgaggaagcatcagtcgaagttttagaacattttaaaagaagcatattttgttacttttgttatatgcagtaattttttgaattgccaattaaagtgggcttttaatacttaatacttatttgtaattggctcattattcttcattgaaagtatttgagaacatctggatcttaggtaaattcatggatttataacaacactttttcctgttccttttgtgttttttctgtctcagtgaaaaaccgttgtctttttccaaagccaaaaattcggaagccatccttgatgcgtttttctcccccgtctgccccaaactaattagtcaccaagttccaccaactcttccccagtagaggttcccacacaccccataaacaccataccc

SEQ ID NO: 273609 - DNA, 660 bp, Homo sapiens
acttatatttgcataatgacttttctcttgtttccaaacaactgctgtagagcagatttgaaggcatctttgtttggggttaggcagagccctgtaagtaagggtggaggaactgcactctatctggtatttaaattccaggtaagttaggactgatgcctggtgtagaatgctcaagtgtggcccagatcagtgtggcagtggtgtacatcagttgatgtcaaaagatgagttatacccctggacttcataagcatcagaaagctcttctcccttttgttacatggagggctatgataggaggggcacatttggaggtgactgggtgagatatgaagtttgtaaaaccgttgtgagagttcccctctctgattcaagcaaggatagggacattgcctgactttatggtgttcaccattccatgataaaatctattgaaatctcctctgaaactaagacacctgagggactatgactactgaaaaattgagttctgaaggccaacagttattctcatcactatattgccttaatgttaagataccatcaattataaaatacatcattgattttatcatagcttttcagggggagaagagaaataatacttcattaattaatttttagatcatctgatttcagaaatactgaaatgcaaaa

SEQ ID NO: 273610 - DNA, 373 bp, Homo sapiens
ccagaggaaaggtctccactgactgtcatggtgagtgaaagctgtctctttttgaccaaggatgatgtggagcttggttttaaatgtatcatagagaactagacccataggactcaagtaaaggcaaaacataagtatttcaggaacatgaagggccagtgctctgtgaagctctgcctaaagaccatgcaaggagagggcagcattgctcccctggtgaataggaggaatttccagaagaaatgcagattaggaatatatttaggtttttggtcgcatctctgaacatagatacacacacatgataccagaattgaatatttagcattcttttatcctatgctatggaagagggaaacctgtgtggagagga

SEQ ID NO: 273611 - DNA, 384 bp, Homo sapiens
gctctctgctaaagatagtagaagtccagcctctcccagagtcagactggtcattggtcatctccactcctagaagagtttcaaacatctgtactttcagactggaggaaataaggacccagtggttgtactggagaattttatccctaagccctgcctgacaatacaacgaaactgacatcaaggacgagtgaagaaacaatgaaccagacagtctataaccagcatggaacactattgtaatgcagtctccaaaagggcaggaattttcatctctcttgcttacaaccgaaactccagcatctgaagcaatgtctggggaatatcagccactccgtaaatctttgttgagtgaatgaataaatgagtacgagaaagaaggaa

SEQ ID NO: 273612 - DNA, 543 bp, Homo sapiens
tagtaaaaatggtactttataaggagaagctgaaaaaataggaaaccaaatgcatattggaaataaattatacaactaggacaatggagcaaaataagagattaaagcaaagaatcaggaactatcttgaaaataaatgatgagttcatataaataggaaaaacatttgtcaacaagtggtttgtgggaatctaaaaggttttcatacctcagagcctgagttttttttttttttttttgagaccgagtttcactcttgttgctcaggcagaggttgcagtgagtcgagatcccaccactgcactccagcctgggagacagggcaagacgccgtctcaaaaaaaaaaaaaaaaaagaaagaaagaaagtgcttctgcactccagcctggacaatagagcaagactatctaaaaaaaaaaaaattaaaaatcaatatcaaaataaatgagtattctcataagcaagacaagcctaaagaaatgtgagtactaactgtaatgtggttacatttagagacacatgaaaaaaaataaataaaagaat

SEQ ID NO: 273613 - DNA, 188 bp, Homo sapiens
aaggccatagcatgaacacagttctccacattctctcagtgtaagccactttgttcccagaggaggaaagtgctgctgctgctgcaatagatttgtcccttcagataccatggcatccactcaaatgcaagctgagtttactacatgagaagttctgacaaatattgggacaggagcaactgggaaaa

SEQ ID NO: 273614 - DNA, 565 bp, Homo sapiens
aaaattagctaggtatggtggtgtacatctgcaatcccaactactcagaaggctgtggcaggagaattgcttgaacccggaaggcagaggtagcagtgagccttgcgccgccgcactccagcctggataacagagcaagactctgactcaaaaaaaaaaaaaaaaagaaaaatccagtatccttttagacctttggctccaaggggcatccatcccctgataatgaagtatggattattacaatcctatcagtcccaacgtaacacccccatttttcctgttaataagccaaacggggaatatagatttgttcaggatcttagggcagttaatgaggcattagttccagtcacccaatagttcctaatctttatacaataataactcaagtccctgaagatgcttattggttcatagtattaaatttaaaagatgttttctttcacacacctttacacctggacacccaatacatttttgcatttgaatggactaatccagacactcatgctgcatctcagcttacctggactgtcctgtccccaaggttttaggacaatcccca

SEQ ID NO: 273615 - DNA, 482 bp, Homo sapiens
gaggttataaattagtatcctgtggttggaatctgacccatagatctcttttgtttttgccaatatgttgtttttaaaagtttgatttaattgtccaaacttaaaaaatttaaaaatccggagatgcacacaaaactctgagtatcctctttctttccttctttctctctctctcttttcttttcttttctttctttcacagggtctcactgtgttgcaatcatggctcactgcagccttgaccacctgagctcaagctatcctcccatctcaacctcctgagtagctgagactacaggtgcgtgccaccatgcctggttaatttttgtatttttagcagagatggaatttcaccctgttgcccaggctggtcttgaactcttgggctcaagcgatctgcctgctttggtctctcaaagtgctgagattcaggcatgagattactgtaatcgctctggcctgagtctccagtttcattgcaa

SEQ ID NO: 273616 - DNA, 474 bp, Homo sapiens
tacagattaggaagcagatgagtcagtcagagagataaggcagaaaagatgagagaatatggcagattcaggagtcagagagattccaaaggtgaggaggattggatgcacccatggctaacagccagcaaggaaacaggggcctcagtcctacagctacaaggacctggatacttccaacagcctagattctaccacagagcctccagatcagagcccaagccatcaacccacaccttgattttagtcttgtgagactcagagcagaggaaccagccgagctacccaacttcctacctacagaacaattagatcatacatttgcatggcttgaagccactaagcttgtggggatttctttcagaaataatagaaaatgaatacagaaacctgatcactttcacataaaatattaaatttttggcaaaataacacatacatttggtaaaaaataaaacagtacaaaaagaacta

SEQ ID NO: 273617 - DNA, 131 bp, Homo sapiens
cccgaaaaggaaaagtagacaaaatgtgtttgaacaagaatgcttttgacagacttaaaactgactgattttatatctcttactatggaaaagaccacaagaaataacctacattataaaggaatacataa

SEQ ID NO: 273618 - DNA, 205 bp, Homo sapiens
atgggatacctggacctgggggtgattagtacagggagatagtggcttgatgtatgagttccataaaagaaggttgatgggccagatgcggtggctcacgcctgtaatcccagcactttgggaggccgaggtgggtggatcacaagttcaggagtttgagaccagcctagccaacatagtgaaactctgtctctactaaaagtac

SEQ ID NO: 273619 - DNA, 613 bp, Homo sapiens
ccatcaaaaaatgaatcaccttccatactagttagaagctgaaggagcacgatttcctcatgctggttgggccctgtttttggtttagaaatgatgtttcctttgtattttccctcctccagtgacttggaagtcattccttcagactttaattctcctgggagattttatttctcccatgtgcccagctccacctcaatttcagattaagctcagctctgttgtcagaagaatgggaacccctcttctcctctgcctgaccgcggcccgttaaataaatagcaaggaaagcccatcattctgattatgttttgttgccaccactcccttgcctgtgtcccagtgccaactgctttaacaggagcctgtagctcaccctaagcaggggctaccctctccttttcttttttcattgatttttagagacaaggtcttgctttgtcacccagactggattgcagtggtgcaatcatagctcactgcagcctctaactcctgggctgaggcaggagagttgcttgaatccaggaggcggagcttgcagtgagccaaaatcacgccactgcactccagcctgggcaacagatagataccccgtctcaaaaaaaaaaaa

SEQ ID NO: 273620 - DNA, 274 bp, Homo sapiens
catgcgcacacacacagtacacattcacacaaaagtcacactcagacacacataatacacactcaaaataacacacagtacacactcgcacaaaaatcacacacaaatacacactcacacaaaaatcacacacaacacaccctcgcactcacaaatacacacgcacaaaagtcacacaatacacaaaaatcacacacacatagtacagtcttaccccaaatcacactcacacgcaaatacacaacttgcgcaaaaatcacactcacacacaata

SEQ ID NO: 273621 - DNA, 480 bp, Homo sapiens
ccctcttctcagtcaggtatacctgttatcctgaccttcaggctcagtcccctcgcccacccctagttctaaaatcagccccggccttgaatgcggcaatatgaagaattggaatcaaagtcttactattagttcctgtatctcctgccccaattctgaatctggcctctgggcatgttgggcctggcttcttggctgctgatgtccaggatgagatctgatcagttaaggaaatattttatacctggttcccagctgtgttacccaggcctccagcctggacatctgatgcccctggaatatgatccagcctcacagtgttgacttctgctactccctggttctccttgttcagaataagatctgaatgaatagatttggcctaaaccgaaactgtctacctgcccctccttgcccacgctgagacctcagaacaactttatcccccaaccctgaagagaattgtatggtgatctccac

SEQ ID NO: 273622 - DNA, 436 bp, Homo sapiens
gcgctggcttgaacgccaggaccgagcggaacttcccgcccggcgcgatcggtccgcggctctcagggaagtgcgtacgcgcgtccctcgggaaagcagagtaatttgcctgtttctggcaaatctgaagattggaatgccacacggcccagccattccttttccaggcatatgagaagccctcacacatgagcaagaaagagatgtggccaaagacattcatggagcctgttaaaaaaacaagaaaaagaaattaagaaatacccagcctgggcaacatagggagaccctgtctctactaaaaataaaaatttatacttgggaggctaaggcaggaggatcacttgagctcagaagatcgaagcttgcaatcagctgtgatcgtgtcactgcatgccagcctgggtgacagagagtgagaccctgtatcaataaa

SEQ ID NO: 273623 - DNA, 346 bp, Homo sapiens
tggttaaacctagttttggaagagaaaggatgggaaatcttgctgaaatattttttttaaagttactatataattgtctgtattagagaataaaaattgtactgagttgaagagtgtccctccaaaatccatgtccaatcagaacctaaaaatgtgttcttatctggaaatagggtagttgtagatgtaattggttaagatgaagtcatactagattagtatgggccataaatctaatgactggtgtccctataagaaggctatgcattatggaaaacagtatggagattcctcaaaaatttaaagataaagtaccatatgctccagtaatcccactgctagatat

SEQ ID NO: 273624 - DNA, 500 bp, Homo sapiens
agaggtttgagaaaatggtgggtggctaagtggtagttgaggtggaggaagagggcttcctgtcccagcccaagtccctgttgggatatatgaaatttagggatgtatgactaagcccttaatataaccgtaagaggaaagagatgtgggaacttgagtccaaccctcccaagtagggagtgcagatagttttaaaaaaacagctttctttttggccaggcgcagcttaggcctgtaatcctaaaactttgggaggttgaggcaggtggatcacctgagatcaggagttggagaccagcctggccaacaaggtgaaaccctgtctctactacaaatacaaaaattagctgggcatggtggtgcgcgcctttaatcccagctacttgggaggccgagtcaggagaatcgcgtgaacccatgaacccaggaggcggaggttgcagtgagccgagattgcgccactgcactccagcctgggtgacaaagcgagactttgtctc

SEQ ID NO: 273625 - DNA, 205 bp, Homo sapiens
tcggataccttgggtaacctattacctgaatattaaatatttttgagaactcacaccattgactataaagtgaataatagctaattcaagtctcaaattagtaatgatatgaaacagtagtaataatgcccttagtggtattttttaaaatgtggcatggaagtagggctttttcgttatcagttaaccacttaacgcaaaaaaa

SEQ ID NO: 273626 - DNA, 350 bp, Homo sapiens
aagaatgagggagagaggtctaggatgaagcttgaggagtaggtaggagctatatacatatatatatatatagagagagagaattcacataccatacaattcactcatttaaggtgtacaatgcagtggtttttagtatattcacagatatgtggagccatcatcacagtaaattacagaacattttcatcatcttagagagaaatcctgtaccctgtagctatcccccacaatctccttattccccctaggcctaagcaaccactgatctactttttgtctatagatttgcttattttggacattttatataaatggaataaaaatacaatcttttgtgcctgaaaaaa

SEQ ID NO: 273627 - DNA, 548 bp, Homo sapiens
gctaggatttcttatatggatctgccttagtattttgaatcaggacctcaaatgagatttttggatgttcatgtgtttgtggcacgatgttgaatcttgaaccttcctgtctttctaattgttagaattagattcttcaagctagacttgattgggctagtattactttaggaaatgttttaatttattatttggggaatgttttatttattatttttagtttcttatctaaggaagattaagctgtttgcagaaaatacagttttctttagctaccctgctcacaataccatctacactgtgtctgtacctgtgtgacaaggccaagcactccataactttacccggattgtttggtctttttcaaaatgtttagagtttcaaaaagaaatttgtgaagttgcttctcttaagtagctactactatgtttttaaatgtgttgcagtatttctattagttgatcttgtgtgtagtcattcatatctgtcttttgattctatttcttggtgatcttgctttttaaaatcaccatttaccttaaaaaaaa

SEQ ID NO: 273628 - DNA, 384 bp, Homo sapiens
aagaaaaaaaaagaatgctggtgcaaaacagtgttcaaattaaggtattcttagacaccattaatcgccaatgaatataggaataaattataacacataatagaagaacaatctgatggtatgtagtaaattttgtttaaataaagtactggaattttacatgtagatttaaaatctttcttcacctaaattaagactaaagacaaagaaggccgggtgcagtgtctcacctctgtaatatcagcactttgggaggccgaggtgggtgttatcacgaggtcaggagtttgggaccagcctggccaacatggtgaaatgccgtctctactaaaaatacaaaaaattagccaggcgtggtggcacgcgcctgtgatcccaactact

SEQ ID NO: 273629 - DNA, 305 bp, Homo sapiens
ttaacataactatttaatataatttatcagagcattttattgtataacattttaacaattcattgaaaagaataagccaaagcaataagttaactaatatgcaaatacctaaattactaataaatgctcgtactatattgaaaactaactctgtctgctttaaaatacatgattttatatttgtggcaaactcctctgtaataacgttgtactttagctcagaattgggcctgatagcaagacatactgtgtggtgggccacaaaaatagctttggacatagataaatatatcagcataacctga

SEQ ID NO: 273630 - DNA, 328 bp, Homo sapiens
cagtttctcgcaacttccattcattctttcctcccagaacatggaaacggagcaaggggagggacaggagctctcagtcctgccttcaggagcgcccagagacacgcttcacagaactgggtcggggtgctagggatccaggtcaggagggcctcgcagatgcccagaaggttcggaggaagcagctgcagtttccggaatgtgccaggctccctggtgcttctgagcgtctgcaagtgtggcccccctgcctgaaacacccccaccctcctgctggtctggccacctcccagtcagccttgtccagttaccttttcctgcctcactt

SEQ ID NO: 273631 - DNA, 392 bp, Homo sapiens
tcctcaaatgcgtccagctgcaccttgacccaagcatgcttcccccatagggtgctggagatgatggggtgcctcttctcacccttctcccagtgagctccagcccctgccacaatgtttgctggtgttcacctatagcctttgcatgacacccagtgacacattagcccttccagtcctttcctgtggttgtttttcactgaatacattatgactatctttctacataagtaaccattacataggaaaacattgtcttttaagaaatgactgcatagacatactagaaggtaatcaaccaatccctactgactagttgtttccaacttaggtcctttcaatttttcacaattaaaaacaatacagttggcagtaaataatgtacaaacatc

SEQ ID NO: 273632 - DNA, 360 bp, Homo sapiens
ttaaaaacataaacagggctttgattgctttgcagaacacaggggaacagaaactggattctataatttgaggtgatactcataattatctatactctggaagaaaagatgaactagaagtaaactaaaaagatgaactagaagtaaactaactttcaaaaggactgaaactcagcttaaaatcctctcattactgaattggattaatgggatcctaggttgctaatgccccagctatcatccagatgcacagataaatcctttctgaagacatggtaacattcttctaacttttaattttttctactatttttcataaccaatttcaggcacttatgcaaaaataaccaggcatatgag

SEQ ID NO: 273633 - DNA, 291 bp, Homo sapiens
ccgggattctgtgattccaacaggcctggcttgtctctggtccacgacatgtggggcctcagctgggaagacatggagtcttaagtgtgatcagtgggagggggctggaatcatttagaggcatcttcattcacaaaaccaggagctgatactggctgtcagccaggacttcaactgacctatgtagaacctgtccatgtggcccctccttgcagtctccccatttgggctggtttgggcttcatcacagtccggcagcttacttctaagggcaagcattccacgacaaca

SEQ ID NO: 273634 - DNA, 423 bp, Homo sapiens
ttggatccagttttccttaaatatcttttactgtgacttgtttgaagtacagtgccactgtcagagtaacaaccttcgttgatcatgagcctcatcatttgggaaaagcatgtgtgttgtctgggagagaagctttgggagtttacagttgacaatgagggagaactgtggggcccttctatcaacactaaagggaaatgggaggagagacatagctagattgttcttatattctttttttttctttttttttttttttttttggagatgatgtctcactctgtcacccaggctggagtgcagtgaagtatgaagtgatcacagctcactgcagcctggatctcctgggctccagtgatccttccacctcagccttgggagtagcttagactgcaggcacataccaccacaaacagctaattt

SEQ ID NO: 273635 - DNA, 477 bp, Homo sapiens
cacctcactcagcctttgttgcatattattaaggcaaactcatatgattgatatggggagaatcatctaattattataccaaaattagcattattaaataattgtattcatttattaccaagtttatttattgtaggcttttgggaaaataaatccaaagaaaattatgttcttacatccagttttttaaaaatacggaaaagtcatttcttatatattcctgaggttatggtgccaaattggtgggtaaaattggctaataccctttttttaaataaacatttttagcttgagaaatatgtgagggaaaaagggaagggaaagaaaaaggggaaattaatatttgtcgttcttgttcagaaatatcaaaactttttatgaacgttgtagactaaaaatagttatttactcttataatgttgaagggttgggataagcagatcgttttcagtttaaagttctgtgccaaaaaacaaa

SEQ ID NO: 273636 - DNA, 301 bp, Homo sapiens
gcagtgaagtcttcatacatggttactgcccaggaacctttaaaactcggcttggttttgcttctaactcatgggggacttcagtagcttctgagtgcagctgaacacttgcctcttgatttcccctgtgagctggtgcctgcccacctccatcctcaaccacctgcatcctcatctcccatttgctttagtcacacaggcctgcttctgttctttgaacacactcagtggtctcccagttcagagcctttgtggcttttttccctctttctacaatgatctttccccagatagttgtatt

SEQ ID NO: 273637 - DNA, 914 bp, Homo sapiens
gaaaaaaatacattttatcatccaaggaaatgttatcagtaaaaagaatagctctatctccaaattaaatattgatatctttattacccatcttaaagaaattttttaaaatcctgagactcagaaaattaagtcatttaaggtttcacaccttgttactgttaacctagaccatgttacaaagtagttgatttctagtctaatttaacttttgctattatatctcccccaccaaaaaccagagaggcatgctgctttcattagtgatccacagatattcttccccaccagcttccctggatcccactcatccccaaatactctgatctcacaggttagagatctgtcactgggtgcaaaagaacaagaaaaggcactgtaaggtaaacattgatgatttcttgaaactaccagtaagtagcttatattttctgactttctttgtcttactgttgtgaaatcaactgatctagttttaaatgtaatgaaaagcaaagcaatagattctcccctagagcctgcagatggaatgcagccttgttaacatcttgatttaagcttcacagacttctgatttccaaaactgtaagataataagcttctgttgttttaagccacaaaattagtaataatttgttatagcagcaataggaaacaagtacaaaatctttattagttaatactatgaatagttattcataccagctaagagatatttggaatttattatggatcactttattatggtcactgtagtaattcacctgttgttcataaaaaccttataaacatttagtattgttttatggcaattgttattttaaacaatattatcaatgtatgttagtgttatcattattaaagttattattgttaaagcattgaaattaaataaattaaggtcagtaccacaa

SEQ ID NO: 273638 - DNA, 410 bp, Homo sapiens
gaatggaatgcaagactagaggcattggatatatgtccagcctctgcagggtgctggttaagctggttagcttcagtaggaaagatccattagctaatttatttattcatttcactcactgagaaaacatttgctaggtgcttcctctggggtatccacatcagcagaggaaaagctagggaaggctatgactttgcaaactctgtagaaacctctgatggaatcacccctctactgtccactgtagtcctctttcgaggaaaagaaaaaactcagggcagctggagaaaaaacagagctcagactcgagaaaaaacagagctcagacttgagacacgggcttccctctataggggtcaaaaaccagggcggagagagataaccattgttagaacttgaacctccttaac

SEQ ID NO: 273639 - DNA, 263 bp, Homo sapiens
tctcactgaaaattatgacaaatgacaaatctgatttatgaaaataggtcctagtagtggatcataggattctgagttcccctttgtccaatcctacttcagaacactttcgggaacttgagagagagattatgagctgtgaatgaagtatcacttgaacttgagatgtgccccaaagcatctcagggtgtaaaacagtgaatcagccaaaagttcatgcttcacaaattaatcagggtgcctctaatcccctatgaattagt

SEQ ID NO: 273640 - DNA, 435 bp, Homo sapiens
  misc_feature (387)..(387): n is a, c, g, or t
ttccagaaacgttaaactctcactcatggagcctagtgcatcaagtttaggtccattgtaacagcactttaggttgtttctgattatttttttcaagacagggtctcactttgtccctcaggctagagtgcagtggcacagtcatggctcactgcaacctcaaccccctgggtgtagatgatcctctgacctcagcttcccaggtagctgagactacaggtgtgcaccgccacagccagctggagtgcagtggtgcaatcttggcttactgcaacctctgcctcccgggttcaagcgattttcctacctcaacttcccagttactcgggaggctcaggcaggagaactgcttgaagccgggagatggaggttgcattgagctgacantcgtgccactgcactccagtctgaatgatagaccgagactccatctca

SEQ ID NO: 273641 - DNA, 304 bp, Homo sapiens
tacgtggcagagtatttacaaatgcagcagcaggcagaaggtagagagagtgggggcacattccctcttatttactgaaaataagaccaaatccctgcaaaggggggcaaggatcccttgtctcttgcagtgagtcagtggcagaaaaagatgagaacttgtcaccaggtgcaaaccccaaatcttgccactggctcaagctacctctgcatggctctgaagttggtttttctggcttccttagccggacacttttgctggtcagtttccctgcagtttcttagtgtgtctggtggtcagattc

SEQ ID NO: 273642 - DNA, 389 bp, Homo sapiens
ttttctttttttgttttgagacagggtctcactctgtcgcccagactggagtgcagtggcgcgatctcagctcaatgcagcctccacctcccagattcaagcgattctcctgcctcagcctcccaagtagctgggattacaggcacatgccaccatgcctggctaatttttgtatttttagctgagacggggtttcaccatgttggccaagctggtcttgaactcctgacctcaaatgatccacctgcctcggtgtcgcaagtgctgggattacaggcatcagctattgcgcacagcctgaaagcgtttatttttgggggctgaatatcatgaaaacataggaacactgaaacccagctactatacataaaaaagaaggtgcattaagc

SEQ ID NO: 273643 - DNA, 289 bp, Homo sapiens
ggtgaaggggggattatcttggggctgacatctttccagcaggaagggggttatctcggggctggcatcttcccagctggaggggggcagctagcatgtctctggttgcagaggaatttggaatgtttctggtcggagatttttttttgtttatgatcatgctgatcttagccatttaggctgatgccctttggatttaggcagtttttgattaatgtgaattggaaaataacagtgcttgtgcaagatggtgatactcctgctctgtcatatttcagcctctcaaagc

SEQ ID NO: 273644 - DNA, 366 bp, Homo sapiens
tttttgagacagagtcttgctctgttgcccaggctggagtgcagtggcacaatctcggctcactgcaacctctgccttctgggttcaagcaattctcctgcctcagcctcccaagtagctgggattacaggtgcctgccaccatgcctggctaatttttgtatttttactagagacagggtttcaccatgttggccaggttggtcttgaacttctgaccttgtgatccacctgcctcgtcacaggccaccacacccagctatttttatttgtactttgtagagacaaggtcttgctatttcccaggccatcacatttttaaatgattggaaaatgtgaaaagaagaatgatattttatgacacata

SEQ ID NO: 273645 - DNA, 390 bp, Homo sapiens
aagctggctgcatatcagaatctccaggaaaactgatttgaaaagtggattctctggccccactatctcctgggggttctgatgactctactgcaaacagaatccaggcaccccatgattccccacaacaccccacgtgatctgaccccaattctccaacacattccccttctgtcaaccacaactgtttcttctatcagggacactctccctggatcttcccaaggctggctttttgatgtcatcctggtctcagcttaaaggtcaggggcagtggttcacacctataattccagcactttgggaagctgaggtaggtgaattgcttgaggccagaagttcaagacccagcctgggcaacatggcaaaatgccatctctactaaaaaaa

SEQ ID NO: 273646 - DNA, 526 bp, Homo sapiens
gccaggctggtctcaaactcctgacctcaagtgattgacctgcttggcctcccaaagtgctgggattacaggcgtgagccaccacacctggaccactgtcattttaaatatgcatgaggctggccatatttggagatatctgtggctcctgtggtgggctgaattgtgtctcctaaaaagaaaaattggagttttaactcctaggatatatgaatgtgacagtatttggaaattgggtgtttacaggtgtaagtagctaagatgagggcacgctggatcagggaaggccctaaatccaatgattggcatccttataagaaggtcattagacacagacatacagagaaaagaatgacatgtgaaggtggagaaagagactggagtgatctgtctacaaccaaaaacatcaggactgctggcggttaccagccacaagaaggatcacagagcagattgtccctccaaacctcaagaaggaaccagcctgctgccaccttggttcttctagcctccagaactatgagag

SEQ ID NO: 273647 - DNA, 451 bp, Homo sapiens
tttaaattctcttgttattgtctaagtcaaataatgttacaatctgagttattttactttccattttctttacaccacccctagcatggtttttccccagccccttaacctgaaaaagaaaattgggacccacacatgctcggaatgaaagtatttgagccttttaaagatactactataccttgccatgagagaatgcattggactgttatccaaaaactgtggtttgaggtgtttttttgttttttgctgtattggacaggtcaatgatgttatctgcctcactctcaatcacaaggaaagaaaaaaatgcctcccctacaatctccatggaaaaaacatgttatattccacatgacctgcctttgtcctcccacatcatagctaattgtctgcaaaagcagccagcccttgggctaacctatggagtggccagacataaaaaaaaaaa

SEQ ID NO: 273648 - DNA, 480 bp, Homo sapiens
aggtcattctcaggttttatatatatatactttcagaaatcaaagacaaaattctgagacctcccaaccatctgaaaggacacctcctctaggccaaaggcattccaaagttaagctgaaaaactgtttcaggctgtgatggaagtgggggtcagacatgcctcattatgccctcctcttttttggaattcaggaagagccgaccggcactaacatcaacacagacctaaggcctgataagaaacatttaccatatctttcctgttcctcaccctgatcacgcttcatttactgatggcagctccaccaggcctaatcgccacacaccagcaaaggcaggctatgctatagtacaagccactagcccgcctttcagaacctctcatttcctttccatcatggaaatctatcctcaaggaaataatttctcagtgttccatctgctattctactattcctcagggattattcaggccccct

SEQ ID NO: 273649 - DNA, 477 bp, Homo sapiens
caggctgacaacgcaagcctcagtaccaacgggctcggcagcagcccgggcagtgccgggcacatgaacggattaagccacagcccggggaacccgtcgaccattcccatgaaggaccacgatgccatcaagctgttcattgggcagatcccccgcaacctggatgagaaggacctcaagcccctcttcgaggagtttggcaaaatctacgagcttacggttctgaaggacaggttcacaggcatgcacaaagatgcaaggaggctggtactatcatcatcctcattttacagatgaggacaccgaggcacagagcacctgagcgacttgcccagtaaatccccaatttgagaccctggttcttaatcctttagtacccacctccacctgggtcatcctaccctagagcctccatcctctgggaaagtagcaatttggggtaaaaaaataataataaaggaatgagctaagagtaga

SEQ ID NO: 273650 - DNA, 369 bp, Homo sapiens
gagacagggtctcactctgttgcccaggctggagtgcagtggcatggtcagctcactgcaacctccacctcccaggttcaaacacttctcatgcctcagttttctgactagctgggattacaggcgtgcaccaccatgcctggctaatttttgtatttttagtagagacaaggtttcaccatgttggccaggctggtcttgaactcctgacctcaagtgatccgcccacctcagcctcccaatgtgttggaattacaggcatgagccaccatgcctggccctcttgttcttttcaatagcaacacacttgatacatttatagaaactactacttctaagttttgtttcactccatgaaaaaataagaat

SEQ ID NO: 273651 - DNA, 425 bp, Homo sapiens
ggttctgttcagaccggtggttatagaagttcttttttatgccctcaaaaattatgttttttaattaaagttatattgtcaggaaaacatcagcatactgtggttaagttatgagggtcggctgggtgctgtggctcacgtctgtaatcccgacacattgggaggcttaggcaggaggattgcttgagcccaggagtttcagcccagccagggcaacatagcaagaccccatctctacaaagaatgaacttttaaaaattagccaggcatgatggtacacgcctgtagttctcccagctacttagaaggctgaggcagaggatcgtttgagcccaggagttggaggctgcagtgagccatgattgtaccactgtactccagcctgggcaacagagtgagaccttgtctccaattaaaaaaaaaaa

SEQ ID NO: 273652 - DNA, 423 bp, Homo sapiens
actgcacttcagcctggatgatagagcaagactgtgtctcaaaaaaaaataattctagatatttgaaaaataagatagggtgatgaatgtttatcaccggatattagggtgtactcaatggtaagtataaagggaaaccagcaatgggtaggctagttcaaaagatgtattatatttccagatattctgataacagtgataaagacttgatggtgaataggtatgtcgatagcagtactgcagatgctcagtttgagtaagtcacccacactaccaaaagatgaatattctttttgagaacagaagaattctagtaatcatgagctaaggatgctggaaattcattcctgaaaatgtatatgtaccaagtagttgttttctgttctcccattcttcattaaacctgtccttatcaagaacaaa

SEQ ID NO: 273653 - DNA, 848 bp, Homo sapiens
aaaccccatctcagccaaacatgcaaaaatcagccgggtgtggtggcacatgcctgtgatcccagctactcaggaggctgaggcaggagaatcacttgaaccagaggcagaggttacagtgagccaagattgcacccctgtattccagcccaggtgactgagcgagagtcctataagctacacagctctggcagcctcatgtcataccctctcctgtcctacctacaagaggggagggaattcagagcacatatcctgataggcaaaatgcagtgattcccacccctgtcacccctgaagcagcgagggtgtgcatttgaaatgcttgcaggtgaggactctggcatctcaccccccagctgggagccagccaagctacattccctgcagacagtcctgctgtctccctgggagcagagcgatccttggggctgggcttattgtccccgaaggtgggctgtccagatgaacgtggagacgatgcccaccaccttgggtatttccgaatgtgggagcccatgagagcagcaggcaccaaactagtaaggaggcaggcagggtggcaggcctggggcgagaacgccctgggtggggcctgcagaaactggagctctctccttcgaactcatttagaggtgcaggcaggggtcagggagtagaccaggggccgaggtgcccggaggccagccatgtagggccgtgaggctggtgaggtttgagagtcagggaccctgaccttcacgccctttctcagggccctgggagggaccccagaaatgtacttgcagagtcatgtgacataatttacataccttaaataaatacacatatctctacatttctctcca

SEQ ID NO: 273654 - DNA, 410 bp, Homo sapiens
aacaaagatgatagttcaatagaataaaatagagagttgagaagtagaccattcatgtgtgggtttgttgattttcaaccaagtaacaagtcaattcaatgaaaaatttagtattttctacaaatgatgcagcaattggatattcaaatgagaaaaacatgaaacttagcttctgccttatgctgtactccaaaaagttttgaaaacaagtcatagacctaaatataaaagctaaaattacaaaacttttagaagagtgggattacaggcgtagtgagccaccacacccagccagggttttcatatagattaggtaaggtagtagatgtgacaaacattttataaaattttaatgctatacaaatgctatttttagctattacacttaaggtgggtgctgaaaatgtaaa

SEQ ID NO: 273655 - DNA, 228 bp, Homo sapiens
ctgccaccgaataagtgaaacagctgaaaatgagagccagggctgatccctgtggcttgccaaactttgatgtccatggaattggcagcttcccccagtctcccagctgaaaataggtcagtgattaagagggtagaacttcagggtagaacttcaggaattgtaagatggattgatgggagcatttggaaaacttgatttatcccaaatcaccaaccctacctaatc

SEQ ID NO: 273656 - DNA, 355 bp, Homo sapiens
gccaaatgtggcaagggatgagctgggagtcctggcttctcagacaaaggggacagggataaacgccacacagatccctgccaacaggctcaggatggacagtggagtttgtgtctactcatcttgtctactggtgggtagaggccacggatgctgctgaacatcatacggtgcagctagagagtgttacagggtcttaccagcaaccagcgtatttccagcccctctttactctcattgaatgatgctgtggaagtgagggaagcctccacacatggtgtaaatacaacgaaacccacccacccagaacctcccacccaggctaggaagctggggacgcgcacgggttgtaacc

SEQ ID NO: 273657 - DNA, 368 bp, Homo sapiens
ccataggtgaactgggaggaaccagaggttaactgactcttactaaaattagaacgcagcccagacccagctcaatgcctgactagattgagatgataagtgtttcaccctttgtaaagagagcaagggcacccctgtctggtgccctttatcttctggagcttctacctttcttttatacataatgtccagtatacaaacaaacaaaatactagttatgcaaaaaggcaggaagatgtgactgacagtcaaaagaaaaaatacataaatataacaataacagcagacccacagatgacctaaatattgaagttaactgaaaaggactttacaataactataattaatatattaaatagaaaaaaaga

SEQ ID NO: 273658 - DNA, 466 bp, Homo sapiens
aaaatattgccatgtccatagggatatatatgcccagtgataaatctctaaagaagacacgaagaaataagagaagggcaagatgagagacaagacaccaactcccaaagaaaattgccgagtttctcaacccttcaagggccatttgagagcaacttggtgttgtgcaagtcactgtatgcagtatgcagagcagacagaatttgctgcgggatatgaagctcaccaagcgaccaagggatctaactggaaccggcagagaagagccctttagaagtagaagtgagagaatgttcctaactgattcacagacacagcacttcccagcactcccggtgagagccagaaaacccgggggtccaaacctaaaagacaggggacatcaacaaggctgagatgatccattttgcccaaagatttgtaatctctttatgtgggctacccatacaatgtctgaaacgtgttt

SEQ ID NO: 273659 - DNA, 427 bp, Homo sapiens
ccacatggctggggaagcctcacaatcatggtggaaggcaaaggaggagcaaagatacgccttaggtggcagcaggcaagagaatgtgtgcaggggaactgccctttataaaaccatcagatttcgtgagacttattcattgtcatgagaacagcacaggaaaaacctgcccctgtgattcaattacctcccactgggtccctcccacaacacggaattatgggagctacaattcaagataagacttgggtggggacacagccaaaccgcatcaatgaattagattgaaccataggaaattgccattattagactgtttttgacctgcaaccaatggaaatgacagtggaatgacaaccacatccatttggttccacctaatatttgcttgaagatgcataaaatctctctgaaattgtacactata

SEQ ID NO: 273660 - DNA, 523 bp, Homo sapiens
ttctttttttcatgagtcaaaaagcatctctcactttagttacacctgtattaggagagttatgatcaattacagcagttgtagtttctgagaacttggataaatacaaacctgaattacacagaatttatgtaaatccagatattcaaaaatgagaaataatgtaatatatgaccaaagtaatatcaagacaacatacaattaaatcactcaacaattactgggaatatgtatcaaggcaagaattgtaaaattctacctggtacttctgaaatgaacaaggcaatgagaaataacagtttatcttgtctattactgagtatcaatgaaagcaataaggtgaacggaaaagtccatgaaaactccattttcagaataatgaggagacagatttaattcacagatccaaatgtttctcaccggctgacaaaactgtgttaagtcagggtgaagcatggcggaggaacagggaggaagtgcagagtgagaaaacataaagaagtcaggaagtgccagaggagta

SEQ ID NO: 273661 - DNA, 459 bp, Homo sapiens
ccctcaaactagaacagcagcaccagctgcttcctggacttccagctcaatgactctcacacttcaatggcagcaatggctccacccccaggctccagctccaacaccctcagatctgagcagcggcagcaccagctcctttctgggtcttctgtttcacgatccttaaattagaacagcagcaccatcttctccctgggtctccagctccacgaaactcaagctagaatagcagcaccggctcctctgggatcttcagctccacgaccctaagacatcagtggcagcaccggctcctcccctgggctccagctccaggaccctcaaacttgaacagaaacaccagctcctccccaggcctccagctccttgaccctcataaacaatcccttcttatgaaatgtagcagtcaggaaaactgtagaggaagtaaataaataaatggtttcctttcaaatt

SEQ ID NO: 273662 - DNA, 791 bp, Homo sapiens
ctaccggacccttgaattacaacaaaattgctcctccctgggtctgcagctccacgaccttcacaccagaacaagacctctcctccctgggtcgccagcttccggaccctccaattacaacaacattgctcctccctggttcggcagctccacgaccctcaaactagaacaagacctctcctccctgggtctccagcttccagaccctcgaattacaacaaaattgctcctccatgggtctgcagctccacgaccctcaaactagaacaagacctctcctccctgggtcgccagcttcctgaccctcgaactgcaacaaaattgctcctccctggtcggcagctccacgagcctcaaactcgaacaagacttctcctccccaggttgccagctaccacaccctcgaattacaacaacattgctcctccctgggtctgcagctccatgaccctcagaccagaacaagacctctcctccactgggtcgccagcttcctgatcctcgaattacaacaaaattgctcctccctgggtctccagctccacgaaactcaagctagaatagcagcaccggctcctctgggatcttcagctccacgaccctaagacatcagtggcagcaccggctcctcccctgggctccagctccaggaccctcaaacttgaacagaaacaccagctcctccccaggcctccagctccttgaccctcataaacaatcccttcttatgaaatgtagcagtcaggaaaactgtagaggaagtaaataaataaatggtttcctttcaaatt

SEQ ID NO: 273663 - DNA, 378 bp, Homo sapiens
accccagagtgccagtacccacctggtcccctccctccccaccacacccacagacagatgcacaagcagacacattggttgcaagccgggagcacctttatggcaaagcatggctcagctctaggggcccaggaaagcagagcccttactaaggctacgggaggcacccaggaggaagggcaggcggataatatggaaacacccagggcagagtgtgcattttccagcttagccagaggaggcaaatggagatttggagagagaggtctcttgagccccgatgaaggggtcaggtctgggagggaggaataaaatgggccgacagctcttggattcccaggctggggatcccagaatgcagtcacagcgggtgggggt

SEQ ID NO: 273664 - DNA, 536 bp, Homo sapiens
cacctggtttcagctagtgcattagttttatcttgttttttaccgctgggcaaaccttgctggaacaacaactgacttcatgatttgcacatttggagggcttaacgtctttgcaaatgaaaaatccactgtacaataacaagctcaaaggaactcggagcctttttagaagaaatcgtgctgaattataatgtggcttactgcaataatgtttctttgatcaggatggaaaggaaaatactgagtttagcagaaaacgatgtctaaatgtatttgtaatgatacaattgtttataaatgttttactattaggttgaaccataagaaattgccagtgtacaatttcatctacaaaatgactggcttaacctaaattctgcattttatactccaagaataagctcttcgtggcagctttctaagtgtgaaatgatggaactttctatttgccagaatgacctacacttctctaatagtttatctcatattgttagccaaacgctgattaaaatgcaaatttcaaactaaagagtttt

SEQ ID NO: 273665 - DNA, 458 bp, Homo sapiens
tcattaaaatagcccagatacaactaaaggacagttagacagtgattaaatatctcattagaaattttgtaagtcaaacctcttttgtctactgtgaaatttttgttttttaatttgtatggtagccttaaaaatcattgcaaggactgcttgctgagacagagttttgtacaaaaatcatttaaactgatcaccctgattgttcctgacagcttcatcatgagtttagatttttatggcgtgtctttattcagagaaaactgcaaacctattaaatacattgaaccagcaccagctataaggtaaccttcctattaacagctttgagagagcagcactcttaaccaatagcttttggctctgcatgcttataatatttttgatacaattaaatgctggctacactgaaattctgtacatatgcttttgttgacaacgatggaccggccgaatatatt

SEQ ID NO: 273666 - DNA, 666 bp, Homo sapiens
tcattaaaatagcccagatacaactaaaggacagttagacagtgattaaatatctcattagaaattttgtaagtcaaacctcttttgtctactgtgaaatttttgttttttaatttgtatggtagccttaaaaatcattgcaaggactgcttgctgagacagagttttgtacaaaaatcatttaaactgatcaccctgattgttcctgacagcttcatcatgagtttagatttttatggcgtgtctttattcagagaaaactgcaaacctattaaatacattgaaccagcaccagctataaggtaaccttcctattaacagctttgagagagcagcactcttaaccaatagcttttggctctgcatgcttataatatttttgatacaattaaatgctggctacaacctataatcccagcactttgggaggccaaagttggaggatcacttgagctcaggagttcaagaccaggctgggcaacatggtgagaccttgtctccacaaaaaagtacaaaattagccaagcgtggtggcacgggcctgtggtcccagctgctcgggaagctgaggtgggagaatcgcttgagtctgggaggtcgaggctgcagtgagccgagattgtaccactgcacttagcctaggcgacagagtgagaccctgtctca

SEQ ID NO: 273667 - DNA, 418 bp, Homo sapiens
agctctgggcaaatttttcagtataattacgtaaatgcaagtttttatctattcatatatgtgtatatgtatacacacacacacctctgtgtgggtgtatatataaaaaccaaaataaaacttaaaagttagttggggccaggtgtggtggctaacacctataatcccagcactttgggaggccaaagttggaggatcacttgagctcaggagttcaagaccaggctgggcaacatggtgagaccttgtctccacaaaaaagtacaaaattagccaagcgtggtggcacgggcctgtggtcccagctgctcgggaagctgaggtgggagaatcgcttgagtctgggaggtcgaggctgcagtgagccgagattgtaccactgcacttagcctaggcgacagagtgagaccctgtctca

SEQ ID NO: 273668 - DNA, 423 bp, Homo sapiens
acgaaactctgtttcaaaaaaaaaaaaaagaaaagaaaagaaaaagaaagaaagaacaagtattctctttttatcgagtacttacctgtgccaggacaattataagtagattatggctctcatttaatcttcgtaacaacatttttaagttggttatattcttcattccattttacaaagggggaaattgaggcttggctaaagtcactagccaccaggttgcacagtggataggtgggtggtagagctgagattaaacctccctagggagcctaacaccagagcctgagctcctaacctctttgtagtactgcttcacagtgtttgcaaactgaaaccttaacaggcaggagtctgacccaagcaaaagattattaattactgtacttctcagcccaaattaccttacctttcagttcaact

SEQ ID NO: 273669 - DNA, 187 bp, Homo sapiens
aaatctccctcttcttaggaggacaccagtcatattggacttaaggcctacgctaatccagtatgacctctgcatacctctgcaaaggcccaaaaaggttccaaataaggtcatattcccagggttccaggtggatataaatttgggggaacattattcaactcaatacaccatgtgtaatcttctt

SEQ ID NO: 273670 - DNA, 444 bp, Homo sapiens
aacatcaggaccagaaagagaactcaggtgtgtctgacccaaaagccctgtctcctgaccacaatgccttattgtttctcgtgctatgaggcctaaataaagcaacagccccctcacagtggtgaaaatagctgccacaaaacttatgcttgtgtcctagtaggcagacactcatgtttgaggcaggcaaggcagagcacagagagatgaggatttggagtatgcagccctgagttaggctccaggatctgcccttgccagcctcagttttctcatctccaaaatggggataatagctcctgtttcaaatacagggtctaactctgatgaggtaatgcaggcatcacgggatcatgaagatcccgtgagctctgtgtgtgaatggtaaggttctgaattcacactagttattatcctgaataaataatgcctaagctcaaaaag

SEQ ID NO: 273671 - DNA, 446 bp, Homo sapiens
agcctcccgagtagtcgggattacaggcgcccaccactaggcccagccaatttttgtatttttactagatacggggtttcacgatgttggccaggctggtctcaaactcctgaccttgtgattcacctgtctcggcctcccgcctcagtcccccaagtagctgggactacaagcgcgggtcaccacacccagctaatttttgtatattttgtagagagaggggtttgccatgttgcctgtgctggtctcaaactcctgacctcgggcagtcctcctgcctggcctcccaaagtcctggggttacaggcatgagccattgggcctggcctaccctgattcttaagaaagcattttctttctttcatattataaagtagttatgtgtaggtttatttagttaggaattccagctgttcagagatggcaaaacaaaaaaaaaaagcaag

SEQ ID NO: 273672 - DNA, 410 bp, Homo sapiens
tacaggtgtgggcagagactctgaggcctgagagacctggcctggattcccagctctaccacccagtggtcaaatgacctggggcaaattgcttcacctctccagtcttcggcttccttgcctctaaacagtaatagtaataaaccaccctccagagttgtgagcattcagtgagattacatgcataaataatttgctcatggtaaggagttggagttcctggaaaacatgacaaaggcaccttcacagctgaggtggccgtctgagtcaatgactccaattctgagtccattgcttctggcctgtgctgtcggggtgctttttctctgcaggagcagtttatttctgaaccaaggtcataaattagttcattttgcagttcttgaactgaaaatttttattcaatatct

SEQ ID NO: 273673 - DNA, 486 bp, Homo sapiens
ctccctaggtcctgccttattttagcacaaactttggtggtggtttgtcattggtaaatcagtgcctactgaggacctgacatattgaaggtactgagcagactcatactgaacttctctgggaagaatttactaccacacttaagatctggttataatatttttgaactcataacacagtcctatggcatggaccttgaggatactgcaacagtgggtctcaagaacaactgtatttttaaaataaccaaattaagaggagtatggcaatggtcaatggtggctcgaggattttttgctttctataaagttcatgacaaccaggaaaagacttgccattatatcttatacacagacactgaagattaggctgtttctataggtttatattatatctatatctgttattttgtataaaaggtgtgttaaaccagaagaaaaaaggacaattgtcatagtatttaggaagatcctaaaaagaaaaaa

SEQ ID NO: 273674 - DNA, 355 bp, Homo sapiens
ttttttttcttttctgacttctcccaaagcttttcaattcccactacttcgagccctgggatgtttgctgatacagagtagcaagcatttccaaaaaaaaaaaaaaaacgagataacatataaatacctgtagaattctagggaataaaacatgtaatgtacattttaagtatgtgttaatagttttcatgtctgcaaagcaattgatatttctgcctttttaggctgggattaatatacttttttttttttttgacggagtttcactgttgtcgcccaggctggagtgcaatggcgcaatctcggctctctgcaacctccgactcctgggttcaagtgattctcctgcctcagt

SEQ ID NO: 273675 - DNA, 280 bp, Homo sapiens
ctttatggaagacccgagtcttccttctgcaggatccacacttgaactgtgcaaagcaccaacatatcattgcctcccaaatcctggagatcagaccttccccactcaccccatctcctgccccaccatctgtcgggagctcctcacctttaaccttccccactccatgcgagtgtcccacatcctggggacacaaatcaagctttcaggcagtctccttgaagcctccctcacttgactttaggagtggagattcaccctctctgctccccatggctag

SEQ ID NO: 273676 - DNA, 448 bp, Homo sapiens
tttatagggataaattaattgctactatacttttaatggttttaaagttacttaggccacttctagaaatatgtaaaattgtatgatcctaacttaatgtttcatttctccctcagtttttatgtgatttgataatataatgaagggaactataaaaatttgatattgttggggcctttttagaaaattgagatacatttttctttgtatcattgttgctaaaagaggttaaatattgctacttattacctaggagaaagaacagcattttgtggcaaaataagtaggttataccgaatttgacagacttctctcctgaccgattttggagcacatatcttcatgtgccttgtaaaactagagatgcattcagttttcaatgttcccagatatattttaccactctatttttcccatatagcatctcaataaactgctgtttcataaa

SEQ ID NO: 273677 - DNA, 815 bp, Homo sapiens
  misc_feature (655)..(655): n is a, c, g, or t
  misc_feature (662)..(663): n is a, c, g, or t
cctacacaacttggggcccctctcctctccagcccttctcctgtgtgcctgcctcctgctgcccccaccatgaccaccaccatccgccagttcacctcctccagctccatcaagggctcctccggcctggggggcggctcgtcccgcacctcctgccggctgtctggcggcctgggtgccggctcctgcaggctgggatctgctggcggcctgggcagcaccctcgggggtagcagctactccagctgctacagctttggctctggtggtggctatggcagcagctttgggggtgttgatgggctgctggctggaggtgagaaggccaccatgcagaacctcaatgaccgcctggcctcctacctggacaaggtgcgtgccctggaggaggccaacactgagctggaggtgaagatccgtgactggtaccagaggcaggccccggggcccgcccgtgactacagccagtactacaggacaattgaggagctgcagaacaagatcctcacagccaccgtggacaatgccaacatcctgctacagattgacaatgcccgtctggctgctggatgacttccgcaccaagtttgagacagagcagggcctgcgcctgagtgtggaggccgacatcaatggcctgcgccagggtgccggnaagatgnncctggcagaagcgggaccgggagatgcgaaatgggagaacccaaggggagccggctacggaagaaaaccccgggggggataaaccctgaagccagggggcggggacaccgcgggatggcccccccaagggggcggagccaaccagatagggg

SEQ ID NO: 273678 - DNA, 401 bp, Homo sapiens
ccctgtctcaaaaaataaaataaaaaataaagctagaaatgccttaccatttggatattgtgccagtgggagtttatattcatgcatgtccctggtcaaacttttaaagaacatatctgagtaggaaaagatttcctgagttataaaaatgttttactgagaaggtagctcttttattctctttttttttttttttttttttaaagagacaaagtcttgctctgttgcccaggctggagtgcagtggcacaatcatagctcactataacctcaaactcctggcctcaggtgatcctcccacctccacctcccaaagttctgggattacaggcttgagccaccatgctctgccaattttttctctttttaaagtttggcatgtagcttaaatgttgctcaat

SEQ ID NO: 273679 - DNA, 452 bp, Homo sapiens
gacatttcatataaatgcagtcatatactatgtggcctttggtatctgatgcttttcacttcagagaatgtttctaaggttcagccccttgcagcctgtatcagtacttcattcctttttttttttttaagtacttcgttcctttttatggctgcataatattctattatgtggatataccacattctatccatttgtcagctgatggatgtttgggttgtttctaacttttgactattatgaataatactgctatgaacattcatgtacaggtctttggacatacattttcagttctctcaggtatatttctaggagtggaatgattgggtcgtaaggtaactttaggtttcacctttaaatatttttttaatttattttattatttatttattttgtagagataggggtcccactatgttgcccaggctggtcttgaactcctggtctca

SEQ ID NO: 273680 - DNA, 367 bp, Homo sapiens
aaacatacctccttttagaagagaggagtcagttgagacactgcatttttgtatgtgatgaaaacagttttctaagggtttgggaaactttatatggttggggataagaattgaatgcaaattaatgaactagatttgcatttatggagttacctcatcatggagttaccttggtctgtcccacgtcaattaatcttgattccttattttcatagaccatcctctagaacagtgttttcacactgtgtatcgtgatcctataatgcaggggtgtccaagcttttgtcttcccttggctacactggtagaagaattgtcttgggccacacataaaatatactaacactaatgatagctgataagctaa

SEQ ID NO: 273681 - DNA, 1051 bp, Homo sapiens
gagagatagagtcttgctatgataatcaagctggtcttgcattcctgggctcaagcaatcctctcgccttggcctcccaaagtgtttggattacaggcgtgagcttctgtgctggccaaaacagaatgttggagacacacactgaatttacttggaaggctgattgttttcccacgccctccctaggagggtgagctgggtgttgggaccttaactctgcccataagatgttcaggccaggagagatgccctttaccccttgggttacaagggtttccactccctttctgcttgattgaggcttgccctcagttctttgtatccctgctctgctctgcttgtttcaaacaacacatttttgcactgtgtcatgaacagctcatcttcagagagtctgtttttgctggtgttttccgggatctgcatgtgcctcttcccatgtaactttggtaggccttgtgcaggtcttggagtttccagtgtctttttgtcttctagtttcgttgaatatgggatttctgcctcattcccccgctcaccaccatatctccctatcactttgcataatttctaggaggaggaaggggacaattcagtcaaatattgccacagttcttatactataatcatatcgctttgtaatataaatttctcccactttttccattataagattaaaaatagctcacaccaaaatcccatcgcttgaacccagaaggcagagattgtagtgtgttgagattgcaccacggaactccagcctggacagagacagagccagaccctgtcccaaaaaaataaaaataaataagtaaataaatgaataatgtttccttttttatatagatatatagacatagatatataaccatatatcatacctggatatagacacacatagagatttctttgttcaaaaatggctcaaacgatatatacgttcttcaacttcctttattcatgtgaacatatcatgggcatatttccatggtatgacttattttgaatgccaatgtttatattaaatcacatttcaaactgtgttcactgt

SEQ ID NO: 273682 - DNA, 450 bp, Homo sapiens
ctcagagctaagctagggatagctttgctgtaagttacattgacagcatctgttaccatgtaattggtgcctgagctgaagcatctttcaggcattactggccatttgtacctttgcctgacgttatctcttgaaatgtctacactggcctcgctttacccgtgggaaaccagaagcccagaggagcagtgccttgcccaaggtcacacgatgaccatgaaagcagagtggagatcactctccactccttaaagggaatgggatcaagaggattgaaatgctgtatccactgagcagggcggcacatgcctgtagtcccagctactcgggaggctgaggcaagaggattgcttgaacacaggaggcgggggttgcagtgagctgggatcacaccactgcactccagcctgggtgacagagtgagatgctgtctctcaaaaaaaaaaagtc

SEQ ID NO: 273683 - DNA, 291 bp, Homo sapiens
ctccctgggagttcactcattcagtctggaatgccaaagtagcacctacaggacttatacctgctgactgactttattgatgcaggtatctgcctgctctgacatccatgtcttacctaacccagattctccatcactgagctgtttctgccagccagagtgctgagcacctgttcctgttcctcttcctcactgcagcagtttgcccggaagctgagctcagactgtcttaactttgaaaagaataatcacctgccatattaagctcccttttcagcacctggaactggg

SEQ ID NO: 273684 - DNA, 421 bp, Homo sapiens
tccctctatagcagaaagctgaattcttcactggcatggaggccagaaactgtggttcatgaaaggaatgctgatggacttaggcccttatacaaacttacttcaactatttacattaatgatgatgatataataatatttgacattttgctatcacattttggtcatcagaagctattttgtcctttcaccattactttttatattcttgaaaacatttgtcctgaatttcccagcactaagaaataaagacggctgtcttccaaggaactagaggttacaatctagggatgggcgtgctcatgagattggtggtgggcaaaagtgctgctgccactgctgctgtcaggccacttgtgtattatttaacatgagtttatatatatttttctaataaaaaggataaatcagactttctaag

SEQ ID NO: 273685 - DNA, 246 bp, Homo sapiens
gtccccgaggaggtcacagactctgacctgggaggcagcgtcgtagcactgcctagtcagtttaagaaataaaaaggtacatcccatttaaaatgttcatcagactgcagtggaaaaggcgactgcgttttacagtgatgtccactggggatgatatgagggaaagcttcgttacatagtgtcgtaggcttccctcatgaggcaggttaatttccacgggacactcattccccgcactgtgggagg

SEQ ID NO: 273686 - DNA, 327 bp, Homo sapiens
gggctgatacatagatgacacgacgctggctttacacaccacatcacggtgagactgactccagcaagcttacatcactcagacggcaaatatttcaaagaaaaaatccatagtgtttagtaagccacagaagaacattttaaagtaaggagtaacaaatctgtatggaagaatttccaaaattcacaaagcgtagaaagaagattgttaaaaagtatgtccagtgattgacttggagtgggtacggaggcatgggcagtggccctggactgctgcctctgctggcaccagctcttattaccaccgcttgaagaacatggtacattt

SEQ ID NO: 273687 - DNA, 182 bp, Homo sapiens
cagaaattggagaagtgttaaagggtcaggttgaatgaggactgtctaacctggagctggcatcagaaacaactaccagaaatccctgtaacctgcttctcctttggggtctgtgaaccgcaggactaagacactcccacattctgaccctggcaccagcaacagactacttgccatcggat

SEQ ID NO: 273688 - DNA, 292 bp, Homo sapiens
cccacagtacattaatgttcatcatgacatgatgcctggagaacattaaggctcctattaacacatgaggggccctgaagacccacctcctgagctaacgtccaacaagagttcaaaagacacacctcatgcagaactcttattcaacagaatttgaagaactattttgaagaattatttttgtaactcattcaaaaaaagtgatcagaggcaaaagcagcatgcagggtcaggcacttctattagtgaatgtatctatttgatataatccacagggccagtatttgcttca

SEQ ID NO: 273689 - DNA, 276 bp, Homo sapiens
attgactttaggactgatcctcaaatgtgaagttgactgcatttggaacagactaataaaccgtgtgtaaaaacttgactcagaacaatggcagtggctcacatctgtaatcccagcactttgggaggctaaggcaggaggatcacttgatcccaggggttcgagaccagcctgggccacatacagagactccatctttacaaaaataataaaaataatattagccaggcatggtggtatgcacctgtgggcctacctagggaggctgaggtgggg

SEQ ID NO: 273690 - DNA, 571 bp, Homo sapiens
aggaaaaccctgaggcagttgttaaaattttgtccaacatcagtgagtttatattgaagaaaaacctgcaaatataataaatttggaaaaacattttttcaaaaactacaaattataaaacaccaaagagtttatactaaaatatatttttgcaggtgcagtaaatatgaaagatatttaatccaaaattgtctatgtaaatatcagaataatccacagtagaaatatctagggccactcaatgtttagacactactgtaaatcagagtgctgcgtataaaaaacaatacaaaactaaagatagcataaacattatttgtatataactttaaaagaagtagaatattttttggagagttataattacattcaaattatactttttatgaaaatacaggtttttttcgaagtgaataataatgaagttaaactcttaaattacttcatgctcttccatcattcctggtttattcaaatgtgaaagcatgtgactaattgttgctggacaaaatatatgagagattcttgtttattaggtaagcattacttatgaccttttctatggaaaggt

SEQ ID NO: 273691 - DNA, 343 bp, Homo sapiens
gctgccactactgtcactgtgatgcttatttcactataaaatccctcaaactgcaggcatcaacaatggtagaagggaatcccagtgagggtgatggccctcttgaacacctgtgacacaaggattgggaggtcccacagaagggttaggacacatttgacttgcaacacttggatgtgcttctgcaggactgtgctttagtagatttcaataatctatggcaaaagagttggacaatccaaccagaagtatcttgaggtcaatgatctttgtataaggagaatgatatgctaggcttctgctgaagaattgcagaccaagcaaggtatcagaaagtgtagtg

SEQ ID NO: 273692 - DNA, 252 bp, Homo sapiens
caaagcactaagcacctgaatttattgccaggtcctagctcagactggcccacagaataccccttccaagactgtttgaaatgtggaaagagaaatgttctaggaattggaaaaaataaattttggcttcagcactgcaattatttagcgattatttggcctctgcactgtgaattgctccctggttcccttttctgtgtggtgaatatgatgatacttaataaactcagaagattgttgtgaggtatggta

SEQ ID NO: 273693 - DNA, 318 bp, Homo sapiens
tctcagattctttgctactttcttcctgtctctccctctctcctaacggaaaacaaacacttcagccaggcattgttttaagcactttatacatattaactcaaccctaactcaacacaaaccaaccagtatatgtcagagaatatgaactcaagatcttacctgaggcatctctgctttgtctttttcacccctcaaacactgagctatccttaagataacaagagagtttctatagggacaaacccaaggcatttagtttttgtagggacaagcccaggattatttgcgagaaggccaaaaaaaacccacacaaga

SEQ ID NO: 273694 - DNA, 239 bp, Homo sapiens
gtgcctgtaatcccagctactcgggaggctgaggcaggagaatcgcttgaatccggcaggtggaggttgcagtgagccgagatcatgcccctgcactccagcctgggtgacagagcgagactccatctcaaaaaaaaaaaaaaaagaaactcatgaatggcttctccaatctcctctcccaccttccttacttcctaaaaaccattagtgtcctcacaaagagaaccacagtagaagta

SEQ ID NO: 273695 - DNA, 456 bp, Homo sapiens
gagacctacctggcagacccaacttgctgtgaccaggacctcagaggcagggatgctgcagctgagctgggtgccaggaggaaagacagcccctgtctcatgccagcacactggaaataaataaatacatgtgcagggaagggaaaactgactaaaccactaaatggaaaggggagaaaaggagaggccatcagaagaactgaaagacagaaacaaagctgcctgagccaggggcctctgaagactgtccctggccctgccagcctgctctctcctcctgggtgaatggtggcagggacagctgtccctattgtgaccagagatgctgcacagaggagagctctctcatccttttactcgccattggccacttttgctttattttcctctaagattttgctttcccttatatgtattttttctatttttctccaataaaggattggaataatagga

SEQ ID NO: 273696 - DNA, 403 bp, Homo sapiens
tgttgaggtacgggggtgtttctttttgtttttatttccaaaaaaaaattaaatctaaaactatcattaggtcattaatgtgtcataattcagacagatggcagtgtgtaaattcatgcttcgagaacttaaaaacagcagactcacagaaaaatctcatatttctttttataattctcagttatgtccagacacaatctattgctgctttcaagtagttttcaaaaatgtaataatgtaatagaagtcattttacatttccaaatactacattcgagtcagtgtttttaaggcgtaagtcattttaaagcagtacacaaaaatgattaggtaccacctatttttagtacctaaaaattattgaatagctcaattttcaagctttagatgatatttgggtgat

SEQ ID NO: 273697 - DNA, 237 bp, Homo sapiens
ggaggagcagcagccatgcctggcagccctcgctgaccttcacagcctactggctgcctcccctctgctactttccaagtcttttctctgcagcccactgccaatggcgggagatgggaattttgggaaatgtagttatagcttaactaagttaccacactttaaaatcacaatgaggaacagaaaaggggccagtgtggccagattgcagtgagtgtgggggaaagtatatagcaa

SEQ ID NO: 273698 - DNA, 396 bp, Homo sapiens
gatgaaaggtcacaaattaaatttaatgtgaactatgctaatatagttcatattaagaatataatttaagcatattacatcatgtcatcacttcatattgcttttggagccatcttggagtagaggggcaatgtttgctgttccttataacagaggctttaatgatttattaaaaacaaataattactaggttatgtacattgtaaaagtacatttcccatggtgtggataaagagaaacgaataaaaatagggcagaatagaaaagccaagataaggtgcttgtcactgctactagaattccctctctccaaaaaattttctaaatattttccaaacattttgactttacaccattcatacagtttcttctatattagtgaaactctactagtaa

SEQ ID NO: 273699 - DNA, 530 bp, Homo sapiens
atccatgaacatgaaatatctttccattcacttgtgtcttcttcaatttctttcatcaatgttttatagttttcattgtgcagatctttcacttacctggttaaatttattcctacaatttcattctttttgatattagggtaaattgaattattttcttgatttctataaattatttattatcatactcatacttgtcaggcctctgggcccaagcctgcatgtatacatccagatggcctgaaataactgaagaatcacaaaagaagtgaaaatggccagttcctgccttaactggtgacattaccttgtgaaattccttctcctggctcagaagctcccccgctgagcaccttgtgacccccgtccctgcccaccagagaacaaccccctttgactgtaattgtccactacccacccaaatcctataaaacagccccacccctgtctcccttcactgactcctttttcagactcagcctgcctgcacccaggtgaaataaacagccttgttgctcacaaaaaacctg

SEQ ID NO: 273700 - DNA, 399 bp, Homo sapiens
ctgggtgatttggaggtggtcaggatttgattcaagcacagacttcactctatgttcaaagctgtctgggctgtgaccaactttgtctgtgtgggctataagagtagggggttcttggctggacatggtggcttacgcctgtaatcccagcattttgggaggctgaggtgggcggatcacgaggtcaagagatcgagaccatccttggccaacatggtgaaaccccatctctactgaaaatacaaaaactagccaggcgtagtggtgggcacttgtaatcccagctacttgggaggctgaggcagggagaatcgcttgaacccgggaggcggaggttgcagtgagccgagatcatgccactgcactccagcgtgggcaacagagcgagactccatctca

SEQ ID NO: 273701 - DNA, 108 bp, Homo sapiens
cccccacatctaatacagtaggctgtcttgttgggtctatctaatgtctacgggtctcctaaatctgacttctcactttttccatgctatcactctagtctgggttgc

SEQ ID NO: 273702 - DNA, 617 bp, Homo sapiens
tgagatggagtctcactgtcgcccaggctggagtgcagtggtgcgatctcggctcactgcaacttctgtctcccatgttcaagcgattctcctgcctcagctccccgagtagccgggattacaggcgtgtgccaccatgccccgctaattttgtatttttagtagagatggggtttcgccatgttggccaggctggtctccaacccctgacctcaggtgatccacccacctcagcctcccaaagtgctgggattacaagtgtgagccaccgtgcccggccccatttctgtctttgcgagcaagagacaaggctgcatctcctcctccagggccgccatgcccagcacagggcttggtacgaggtctgtaatcagtgtgaccttaatgaatgtgctgtagaatgattcccatttcacagacgggaaaaccgaagcttagttgggttaaaggagttagctgcctggggtctgccgagccggggctgaactgcctctatgggttgggggctttctgaaggcaggggggacttgtagcatacgccccatgactcagcatttccattctgagacatccaccctttacagatatgtaacgggagacacagacaagaggatccg

SEQ ID NO: 273703 - DNA, 394 bp, Homo sapiens
actgcaaggaccaccttgatttttgtgaccagcagacttcacgaacaacgtcagtgaggactgtacattaccacacctacagtaagcctatgagaagctatgcattggaatattaaattagcactaaaatatatttaaagaactatttttaaaaatgagatcctcaagaacagctattatcaatatttcaaaaagccaactagatttcatacacatacccatgtacttgcacaaggtaattaaatcacctttgcttttggctcaatttatataaaatcatttgatttaaatgttcatctagtgcacttcaaaaaatgataactgccaggtacatgttgtctattagtaaaagtaaaaaaaaaattgcaatgttttattatgcaaagtagttatg

SEQ ID NO: 273704 - DNA, 163 bp, Homo sapiens
aaagttcttttcctccttttttcttcttttaggcagaaaccactaatactagcctcttgcaggtgcaactggaatgcagtttacataataaagtgtgtcagcaattaaaggtaaaataaaatgtgtagtgttttctctctgctttcctcctgcctctttgctt

SEQ ID NO: 273705 - DNA, 385 bp, Homo sapiens
cctctccaggagcccacacggggtagggcccatcataggctttcaggaaatgctaaagctaaatgcagaggcgagagtaaatcacttaaactgaatggcagctgctgttagcaaaagagagtgacttgctagagtcctccaggatagcactggatgaaagtgccagctgtgcctgggcctctgttgtgatcgtcagaccgtagaccagaggcacgtcgacctactcctgggcacaaatggtttccatctgtttagaacctttgtcaattaaacgaaggtacataggatcatgaccaggggcatctgcctgtgcaaaatgattttaaaatctgtgtgtattaaatagaaagataaagttgatatttttatatcttttcttcaaatg

SEQ ID NO: 273706 - DNA, 448 bp, Homo sapiens
acgcgtgggcaaaacaaggcccaacactctttaaaagacaagaagcgtgagtcaccgcacccggccatgaattactcctgctttctaacagcacccagtccagagcaaaactactttctttcaccctctcccaaaatacccaaaacaaacgctactacaagcccctcctaacaccctcttactgagacattccgtggttcccaatggtgtgtggtttctgaagtctccctttttacaacaagtcattaaacctagctttgaactatagatgtgtttctgatggtctttggctgatgaacatcaacaagtgtttattaaagctaagtactttttaaacactatcttatttaaatcttgtaatggttttatgtggcagatgttataatcagccctgttttacagatgagaaaacaggcttagagaagttaaatgtgtcatgatcaagatc

SEQ ID NO: 273707 - DNA, 336 bp, Homo sapiens
ccagcagaaaaatgtatttccggcctttcttcctcaccctctgccactgttttaggattgctcagtttcatcaaggtttgaaggataggcaggctctcactaagagagaggtagggagaggggaggtagagacctatgaatgggctcagaggctggactgccagagtctgaaccccagcatctcttctcattagcttgtcatcttggacaaggtactttacttctctgtgccctagttcccccagctgtaaaaatgagacaaaaatgatattgaccacatgcagtcttgttgtaatgattaaaggaggtaatttttataaagcacttcaaacagcg

SEQ ID NO: 273708 - DNA, 998 bp, Homo sapiens
ttgatatatttgttattaatttgttttttctatgaattacttgcttctatactttgccatttatagaatgggtttctgacttttacttacagatttgcagaagtttcctatatattctaattatgaattctttgtcagtttgagatgttgaaagtatcttctccctctcaactttgactatggattcctttgttgaatagaaacctgtaatattaatgaaatcaaatctacatatttttttaccttgtggtttatgatttttaggtcttgtttaagaaaatttccacctttaggtcacaaatattttcctacatttttagtttcactgtttatgtatagattcttactcttgctgaagttcattgtatattatatcaggtaaggatgcagttttatttttctccatattatgggagcttttccccactataacctactaaacagtcagttttttcctgtttcttcgtaattcccttatattcatgagtctctgagctctttttggttctgttggtctgttggtctactcttgagccaataccatgattaaaaaaatttccatggctttatagtgtaacttaatatttgatgggaccagtctcacttctttgtccttctttctgaaaaatgatttcaccatttgtgaacccatttttcatatgttttagaataaattcattaacccctaaaaaattctggttgggattttgattgggattggaattataaaaaacatttgaggaggatggatatctttacaatgttaagccatactatcaaagagcacggtttttttatttatttattcatatatttcattacattatggtctcagaacatggtctgtatgctttcaattctttagaatttgagacttcttttaaaatcattatttggtcagtttatgtgaatgttatatgtacacaatatacacatgcattctttggtttgtggagggttatatacaaatatgagtttattaaatgtcttatttagat

SEQ ID NO: 273709 - DNA, 298 bp, Homo sapiens
taaaaaagctgggcatgatggtgcatacctgtagtcctagctactcaggaggatgaggcaggaggatcacttgaacccaggagttaagaggctgcagtgagccatgattgcaccaccgcacctccaacctgggtgacagagcaagacactgtctctttaaaaaaaaaaaaaaaaaaggtgttcttgagagcaagaggccagaaggaagcaggagcaagcaatggagaaatggtgagaaggtaagcttccactgagcccaggagaacaggagctgaaacagccattcacacttgtccag

SEQ ID NO: 273710 - DNA, 402 bp, Homo sapiens
ggagatgagagcttaggggatcatgtgtgctctgctatgtctccatttgtgagatttttcccaataaaacctattctgtgtgtaacatggtgctcacaagtagtatgtgcatgagactcctttattctcaattgtctcctagaacttctgcactcaaatgtttttttttctcctaccatgatggcactcccttaatgattttgtccagatctcataggttccatctgtaggctagacctctctattgactatgagagggcataaatgaagctactgggatgctgaagatgttctaaatccagatctagatgatggctaaaaggcatgtaagaacaaattgaattatacacatttgctcacatatctctatgtatgttatccttcaataaaaccttacccaaa

SEQ ID NO: 273711 - DNA, 390 bp, Homo sapiens
acgccccagctggtccatagggcagtgagacttgaatcacagagacgcttctctggtgtccagaaaaatccggctctttctagtggcgcttccaagggggaagagattggagagctctccagcaaacccaggcctgagctttgcagaggtctgagctgaggactgagtgtccaaggggctgaggatgtggactgtctttgtgaggtggggtacagccagtgaaggagccagtgttaatttcctgaagctgctgtaacacgggccacacagacttcgtgccttaaagcaacagaaatttcaggccgagtgcggtggctcatgcctgtaatcccagcactttggaaggctaaagtgggcagatcatgaggtcaggagttcaagaccattctg

SEQ ID NO: 273712 - DNA, 445 bp, Homo sapiens
catgtaatgagcagtgagggcaaccagagcttgctttcatcaccatcttggttttagctggctttgcttggtttctttaatgcatcctattttgattggtggagttgtgaccaatactcagaaaacaagtcctgctgattgcctccctcacctggaagggtccaaatctgctcaggtaattgttcagtttggtagtatctattatagagacagcatagcaacatggtgaagcatgcagacatacattgggttcaaatccttgttctactacttaatctccatgtaatcttcagcagattccttaatctgtcttgcctcggtttccatatttttattaaaaatacttaacctccctatgtcagacagtttccctgtctgtaaaatggagaaataacagcctacctcacattcataagacagctaagtacatacgtaagtgctacat

SEQ ID NO: 273713 - DNA, 535 bp, Homo sapiens
acaagttatttggataagaaaatgggcattaagaaaatagcagacttgagatttaggttcactaggaccacttagtgtaagtgtattactggcaaattcaatagccttagagaggtcatcatggttagccttcttcaatccctctgcctagaatactgcaaggtatcaataaatgcttacttaatgaaggaatgccacatttgacatttggctttcccttcacttagcttccgtgaaacttttctgactgcctcgaaaatcacaggctatcacttggaattcagttatctgctattcttaaacaaatgtggacttttttattccttctgtggttcaactcagacactgcaactttgaactgaaataaatgattcactctctagtctaaatgtattcaactggttactgagaaaatttcagatttatactgcttcttccaacttgattacagtactttaatacctgcattccaaatgttaaactacctctaatcctttacatttgtaataaaaacaaatactttacatatttaaaa

SEQ ID NO: 273714 - DNA, 176 bp, Homo sapiens
ttttttttttttttttacaattgcttgaagccctttactttccccttctccacgtctttggctgactttcattcattcttcaggctttgtcacgtctatcacttattttctgactacttccctgaccccaatcctggattagttgccccttctgtcgtcttctatccatccattta

SEQ ID NO: 273715 - DNA, 104 bp, Homo sapiens
tcatttggaaatgaccactcagtctgcatgttactgaggtgtgggataaaatacaaccgtaaatttcaaattgagtgtgatgaacgaggtgagagtgggtgaac

SEQ ID NO: 273716 - DNA, 385 bp, Homo sapiens
tgagacggagtctcaacctgtcacccaggctggagtgcagtggcacaatctcggctcactgcaacctccacctcctgcgttcaagagattctcctgcctcagcctcctgagtagctgggattacaggtgcgcaccatcacgcccggctaatttttgtatttttagtaagacagggtttcaccatgttggtcaggctggtctcgaactcctgacctcgtgatctgtccgcctcggcctcccaaagtgctggaattacaggcgtgagccacccaccgtgcccggccttcccttctttatttacaaccatttcctttcttttggaattaaaaaatgattttgaatgaaaaccacgccaaggctgcccctgacaaactgcctgctattt

SEQ ID NO: 273717 - DNA, 254 bp, Homo sapiens
gcaagcctctgcgtcctgggctcaagccatcctcccacctcagcctcccaagtagctgggactacaggtgtgcgccaccacagcaggctgatttttgtatgcacaaaaaatgtttcataccgatgcagttactaactagcaaagaactggaaacaacctgtcctacagcggggtgatacttagtaaatgagctgtgatacctcaggaggatggaacattatgcatctgctacaaatagtaactgactgctgggg

SEQ ID NO: 273718 - DNA, 449 bp, Homo sapiens
gaatgagcaaacccttcatgatatatggggcagtgtaaagcaactgaatattcaaatcatcagtgtccccaagggtgaagagagaatgaaagattagaaatcctatttaatgaaatattagatcaaaacttcccaaatataacaacaaacctagacatccagatgcaggaggcccaaaggtccccaaacagatacaatgcaaaatcatcttctccacagcacgttataatcaaaccacttaaagtcaaagcaaaagcaaatatactaaaaagagcaaaagaaaatcttctaattacccataaaggaaccaccattagactaacagtggatttctcagcagacaccttacaggccaggagagaaggggatgacattttcaaagtgctgaaagaaaaatactgccacccaaggagaccatgtccagcaaaactattcttcataaaaaaaaa

SEQ ID NO: 273719 - DNA, 365 bp, Homo sapiens
aatgttataaaatgccatcatcaagcagatctgtgctcagccctgtgctgggctttgaggaagatctagagctggtaccaggccagagagggaatgctctttatcaagttcttactatgctttacccacctgatatcaaggtagaggagcatattcccttttcactgctgacaacacttaatgaaattcagagtgtctgaggtcaccaagctcatgaatcactcaacacacacatttgttggccaggcacggtggctcacgcctgtaatccctacactttgggaggctgaggtgggtggatcatgaggtcaggagatcgagaccatcctggccaacatggtgaaaccccgtctctgctaaaaaaa

SEQ ID NO: 273720 - DNA, 279 bp, Homo sapiens
ccacatgcccttctgcagcaccggccacagataagtgtcatccatgctggtggtgatttgactcatgtctcacctgccacacaacagaggcccaggaggcacagcagcctgtggtctctgctcatgattgaaggagcccctaaaacagggccggaaggcccaaaatagccactcaacaaacatctgtcgcataaatggaagtcacgtgcctcattccaagtctttgctgttcttcaaaaaataatggtactccaaaaaataatgatactccagattaca

SEQ ID NO: 273721 - DNA, 551 bp, Homo sapiens
gcccaccaagctgagtttggcattttttctcataatatttacattgggattaggattttagggaacacaccctggaagtgcaggaccctgtgacatcaatgtctaggcactggttatcacttatcacttgattagtgtcatctgtgttggctttctctactgtttttccctttccctactattttcttgggaaacatccagcacatactcaaggtgggagggcagtaagcttgatggtggctagatgtttctgaagacaagagtagggtggccaggtgtggtggctcaagtgtacaataccagcactttgggaggcagaggcaggaggatcccttgggcccaggagttcaaggccagcctgggcaacatagtgagaccctgtctcttaaaaaataacaaaattagcagagtgtggtggactgtggtcccagctacttgggaggctgaggcaggaggattgcttgagagcctgggaggttgagactgcagtgagctatgatcacgcaattgcattccagcctgggtgacagaggaagaccctgtctctaaaa

SEQ ID NO: 273722 - DNA, 622 bp, Homo sapiens
acattgagacaggcagaaaaagtgagagagaaggttgccttcactgagcaagatgagcctcaaagcagcagtgacgagaacataaggtgagggtcacagaagaacggcccaggagctgctctggaaagtacaggggcccactagtcatccctacatcccctcgctgcaggccaaaaaccccaccagtttagaaggtgagtcactgttagggattgggaatcgtgtccccccaaaaatccagatgtcaaaatcctaacctacagtgtctcagaatgtggccctatttggacctacggtcatcggcatatggacttagttaagatgaggttgcggccgggcgcggtggctcacacctgtaatcccagcgcttcgggaggctgaggtgggtggatcacaaggtcaagagatcgagaccatcctggctaacacggtgaagccccatctctactaaaaatacaaaaaattagccagaagtgatggcacacccctgtagtcccagctactcaggaggctgtggcaggagaatcaggagactcacttgaacccgggaggcggaggttgcagtgagccaagatcgcgccactgcactccagcctgggtgacagagtgagactccatctca

SEQ ID NO: 273723 - DNA, 483 bp, Homo sapiens
aaccacaaacaatttttagcaaaagtgtgtcccaaatattaaaagaatgggacagacagtactgaaacattatttgtgatttatctgaaattccagtttaactgggcatcctgcatttcatctagtagccctctcagttttaggcaattagttggtcctggttagtagaaagtttttgtgtcacagaggaactggtcaagtttagcaaagaacaggataaccaaccaccaagagccagaagtgaacgatacccattcaaataccacacagagggaagagccttggcaatgcagatgtaagcattatggtgtccttggagaggctgtcactcagttgggaagaaatgcttctcagtatggtaactaattgtcattagtttgattcccacgtaccaagtcccatgtacatggcacgtgggtctctgctgatacgaacatttctgtctgcttgacctctataaaattgttattctgtattatgtga

SEQ ID NO: 273724 - DNA, 458 bp, Homo sapiens
atctctagtgctcttttcctgattcattttcatcactaccacgtgacatcctatatacatcagaggtccccagttcctgatactggtccgtggcctgttaggaatggggctgcacagcgggaggtgagcagcggggcgagcattacggcctgagcccctcctcctgtcagatcagcagtggtgttagattcccatagaagcacggaccctactgtgaactgcgtcagtgagggatataggttgtgagctccttatgagaatctaatgcctgatgacctgtcactgtctcccatcacccccagatgggaccatccagttgcaggaaaacaagctcagggctgccactgattctacattatgctcatgagaattcgtccagctttgctctcagctatcaacctggggcctagagactggcacattataggagctcaataaatatttgctgagtgaacaaa

SEQ ID NO: 273725 - DNA, 448 bp, Homo sapiens
tagagatgatttaaaacatatgggaggatgtgtgtaggttacatgcaaatacaatttgttttatattagagtgttgagcatccatggattttggtatcttggcaggagggtggtcctggaattagccgccaccatgcccagctaataccccatggatactgagggatttctgtccttgtaccatatacatgagaatctcatttttaaaaatgtctacatgtgattctgttaaactttttacccaatttctgattggtggacatacatgtttttctagtgttctccctcataacaattgaacattatttatacgtaaatcattgcccacatttgccactatttctgggtatacacatttatgtgtctgaattggtctccaaaaaattgaattaattttgcatcaccctttatttgaatcgaagcaagcagtgctttaaaacctgaaaga

SEQ ID NO: 273726 - DNA, 431 bp, Homo sapiens
  misc_feature (138)..(138): n is a, c, g, or t
gtagttcatcagtttttggattgtcaacagatcaacacctctggctgttcaaataattgcctggcccaagaggctgaataaattagaaaagttaaaaagaagtaaaaagtaacgctgacaagttcctgcaaacaaaantacgtttcaggcttactgatatgacaaactgagcctatgaagagcagcaaaattaaaaatcaaactgcagatttaaaacagaatattttgttttaaaagtctccacaataagctttttagaaaagataactttagagttataaaagagttgcaaaaatagcacagacttcccttctgccctttatgcagttttcccttatgttaatatcgtacataataataaaataataatattttacatattgtacataataataaaataaacgaaggaattatccttggtatgatactcc

SEQ ID NO: 273727 - DNA, 136 bp, Homo sapiens
gggtttgtggggagaggaaggccgagggaggagaggaagagattggatccggcgccctgctatgggtgtctccatctgggctgctgctagaaggggcagttgttctcttttttttcttttttagacggagtttttt

SEQ ID NO: 273728 - DNA, 491 bp, Homo sapiens
tttttttaacataattcagtttcttccccaaaaccacaggctttagaatacaacaaatctagattcaaattctgatagcaccacttaatactagttatttactccttctgaccctcagttcccttatctgtaatatagggtgaataccacttacctagcaagctattctgatgattaaatggctcaatatatgtatagcccccactgcagtatctggtaaatggtaggtggccaaccaaagcttattttcctcctgagttctgcatcactcttggtctccccagttggacagtaaagttgtctaggacagagactgtgtgccacgctactttttattccccacacagtgctttgtcagaagcaacagctcaataagtacactacttgttcatttgatctttgcagagagcactaagcttcacgcggtgataaactagaaattgttgtggattgagttgtgtctgtcaaaaagatattttgtagtcctaaac

SEQ ID NO: 273729 - DNA, 351 bp, Homo sapiens
cttttcttctcccatttaccacaatattgtggtgacttgattacttttctcatactggaatagtaaaattaatcccttatctctgaagcaacaacttgtaataattaagagtaattccggttagtgatagcataaaggcggaagcctctagaaatgatcctgttgtgtgctctttgctaagaatattggattacagttttaaggggagtgtgcctaaagatgagtcaattagtttaggattaggcatttaaaatttaactttgacagagagaaggtcatcattaattttaataggagcaaatttcaacaaagtagtaggggcaaaaatcaggttacaggaagaaaggaata

SEQ ID NO: 273730 - DNA, 199 bp, Homo sapiens
tgagagagacagagagagagacccacccgctgagtggccaaggagtcctcatgaagccaaatctgaggccacagccacccacagctgctcagtgagtttcgttatttttctcaaattgtgataagacatacataacaaaatttaccatcttagccatttttaagtgtacagtgctgtagcatcaagtacattcactttt

SEQ ID NO: 273731 - DNA, 346 bp, Homo sapiens
ggggagataagtaagacaaatagtgacgttgcaaagatctgaaacagctctgctacagggccatttgaacaaaagaatgaacacattctagcctgactctgccttgctactctgaaatggttggaagtggagagagaagtgctttgagatttcatcgtagaaagatcgttggtgaatagaccagacatttaggttagctatgcatttcttatgctgttgaatttattttctatggtgagaatctctttgtctgatggcacccatagcctaagataattgatgcacaatacacatgcaggttctgagttcatttggatagtatagtgggaaggaataaaatatttat

SEQ ID NO: 273732 - DNA, 258 bp, Homo sapiens
ctcacagctggactacatctcctaggctgtgtttcagccaatggactatggccaaaagcagggaatgccccttccaggcctggcctataaaaatcccccatgtgctcctctgttctctctttgtccacctgccagctggacattgatgctcaaggcaaccttggaggtcatgtgttgaagatggcagtgtctttgccaaccccactgccagtggactttatgtgaacacaaaataaacttctatgatgtgaatccact

SEQ ID NO: 273733 - DNA, 433 bp, Homo sapiens
ttaaagacggagtctcgctctgttgcccaggctggagtgcagtggcacaatcttggctctcttggctcactgcaagctctgcctcccgggttcacgccattctcctgcctcagcctcccgagtagctgagactacaggcgcttgccaccacgcccagctaattttttgtatttttagtagagacggggtttcaccgtgttagccaggatggtctcgatctcctgacctcgtgatccgcccgcctcggcctcccaaagtgctaggattacaggcatgagctgtactatgcctggctcatttctatacttttaaatcatatcctagaagaagaaccaaacagaaacacagcaacatgactgtcatagtcacagaaattccctcaacctgtttaaaagaaaatactctttcaatctgaatttcatatattcagctt

SEQ ID NO: 273734 - DNA, 155 bp, Homo sapiens
acaatgtgatgcaccaccagaaacatccacatttatcatttgcctgtcttaaattatttttggaatatgctaaattaatacaatgcataggccaggcgcagtggctcacacctgtaatcccagtactttgggagggcgaggcgggcggatcactt

SEQ ID NO: 273735 - DNA, 407 bp, Homo sapiens
tttttttttttgagatggagtcttgctggagtatagtggcactatctcagctcactgcaaactctgcctcctgggttcaagcaattctcctgcctcagcctcccaaatagctgggactacaggcatgcaccaccacgcccagctaatttttgtatttttagtagagacggagttttaccacgttgggcaggatggtctctgtcttgacctcgtgttccgcctggctcggcctcccaaaatgctgggcttacaggcatgagccactgtgcccggccaggacaaatattcctacaagaggcttgattggaatagggttattaagaactaatttcattttttcagtattgtccttcaaaaaagcatgcttctctccatgataggttaataatgtatattggggattaatt

SEQ ID NO: 273736 - DNA, 182 bp, Homo sapiens
ccctccccaggccctgtcctccagaaggatttggatggggtcatcggagagagagagctcgtcctacatggcagcaagtggctcttttcacaaactgtccctgcccctagctgggcatagtggcacgcacctgtagtcccagctactggggaggctgagatgggaggatcacttgagcccag

SEQ ID NO: 273737 - DNA, 532 bp, Homo sapiens
cagacgctcctgtccgggtcgcagtgggacgccatggagcgctccctgcaccgcgtctccctcgggagccggcgtgcccacccggacttgtccttctacctcaccacctttggtcagctgaggctgtccattgatgcccaggaccgggttctgctgcttcacattatagaaggtaaaggcctgatcagcaaacagcctggcacctgtgatccgtatgtgaagatttctttgatccctgaagatagtagactacgccaccagaagacgcagaccgttccagactgcagagacccggctttccacgagcacttcttctttcctgtccaagaggaggatgatcagaagcgtctcttggttactgtgtggaacagggccagccagtccagacagagtggactcattggctgcatgagctttggggtgaagtctctcctgactccagacaaggagatcagtggttggtactacctcctaggggagcacctgggccggaccaagcacttgaaggtggccaggcggcgactgcggccgc

SEQ ID NO: 273738 - DNA, 430 bp, Homo sapiens
cgtggctgcctttttggtaccacccaccatgaggccctgtcctggcatctgcctccaatgtctcttgccctgggctccttgttcccttgcagcatctgacaggggactctattctgtcctctgcagaggctgacttgaaggaccctgggaagcctttaacttggagatgtgcagagtcagctgctgggcttaggtgggccatgagatccgctaatcatgcttccttttttccaattcaagatttctttgatccctgaagatagtagactacgccaccagaagacgcagaccgttccagactgcagagacccggctttccacgagcacttcttcttgtaagagtctggtgcagctgggccctagaaaggagagggaaggagtgtttatctggaaacagctctgtttgccaaatctagaactagatctatgc

SEQ ID NO: 273739 - DNA, 390 bp, Homo sapiens
gagatccgctaatcatgcttccttttttccaattcaagatttctttgatccctgaagatagtagactacgccaccagaagacgcagaccgttccagactgcagagacccggctttccacgagcacttcttcttgtaagagtctggtgcagctgggccctagaaaggagagggaaggagtgtttatctggaaacagctctgtttgccaaatctagaactagatctatgcaaaaaaaaaaaaaaaaaaaaaaccaaaacaaaaaaaaccagtgccttctaaaggatgtctttgttttctcactcacttgtgtccttgcatccctggcaccaggcccagcagcgaggtccacagtgataaggtatcacttggctagctctcataactaaaatg

SEQ ID NO: 273740 - DNA, 487 bp, Homo sapiens
gactcccgatgtggtgggcggggctgaaccctgtggcttctgaggtccctgccagccagagacttgtgtcagctgaggctgtccattgatgcccaggaccgggttctgctgcttcacattatagaaggtaaaggcctgatcagcaaacagcctggcacctgtgatccgtatgtgaagatttctttgatccctgaagatagtagactacgccaccagaagacgcagaccgttccagactgcagagacccggctttccacgagcacttcttctttcctgtccaagaggaggatgatcagaagcgtctcttggttactgtgtggaacagggccagccagtccagacagagtggactcattggctgcatgagctttggggtgaagtctctcctgactccagacaaggagatcagtggttggtactacctcctaggggagcacctgggccggaccaagcacttgaaggtggccaggcggcgactgcggccgc

SEQ ID NO: 273741 - DNA, 449 bp, Homo sapiens
ttgaaagtgctgaaaattgctgcgagtctgggcccctcttacagtggcagcctgttgctctttgatgccctgagagggcatttctgctgtattcggctgcggagctgcaggctcgactgtgcagcttgcgggaaatggcccactgtgactcatctgctggactatgaagccttctgtggctcctcagccaccgataaatgccgctccctgcagttactgggcccagaggatcgtgtttctgtcactgactataagcgacttctggattctggggcaccccatctgttgctggacatcaggcctaagatggaggttatgaagagaagatggctatctgcaaacctgggagcaggctctaaccagacactacatcttccagtgccttgaacttggacttccctccccacagaactgtgagaaataaatatttgttgtttaaaccacccaat

SEQ ID NO: 273742 - DNA, 287 bp, Homo sapiens
gcccttctgtaaatagcagtgtctgctgccctcggagaaggggaaggagcagctggtgcccgcccccgccccactccaccgcttagtcccagcagagcccactaattttgctgctggcagagggcagcgttcctgcagggtcactgggcccttcccctcctttgtgtcatgcaaaggtgggggcatttgtgggtattcaggagtcattcccatgggagggcagctcctaccatgctaagaacttggttgagtttcccaaatgtgtctggtcccaggagacaggctcc

SEQ ID NO: 273743 - DNA, 526 bp, Homo sapiens
ttaagaaaagctactgtatttcattcatgatagccctccacaaaccagcacagcttggtgcaataaagaaaaaatgcccaaaacacagcttctgtcttgggagagagaaagaaaggggaacacacatccaatgttctggcttttcatggggctgcctgaggaattggtttctgtctcacctgactcagagcagtgatggagatatagcatactttggatgcctaggggtcactaagaacaaaggagagctctggagtttgtggaagcaccagagaaaccacagtaccacagataggtgctagaagaagcaagttattacaagattctgaaaaaggaccaaacatacatctctaattggaaatttatatgcacaattccagagaaaatgcatgcccccaaaaagtttgaaaggtacccagaataattagctgggatgataggtgaaagtcttctcttgtatgaaaccagtccatgaagactgggagagatggctactttatcaaatacccaaatctcagaaaaaaaa

SEQ ID NO: 273744 - DNA, 421 bp, Homo sapiens
ggctatgaagttggagcgtggcatgttctagaagcagaaagaaggctggtgaggtagggacacagcaggtagggagtagagtgaggccaagccccaggtcagggctggacctcagggcctaggtccaggtgaaagcactgggcatgatgctgagggcagtagatgctgtgggaggattttaagcagggtgacaagatcaggcttgtactagatgagaacgttggctgtgtaaagatagattgacagtaagcaagagtgaatccagaaaaaaataatctagaaacctgttgcagtgatacaggtgagggatactttgcctttattggatttgaaagtataaaaaaaaaatgaacatctgttgtttagagtaaaagccctgtaaggtatggtataaaatgaaacattttcaaaaatgcccatg

SEQ ID NO: 273745 - DNA, 609 bp, Homo sapiens
ctgggttaagatggcacggtctcggctcaatgaacccatcagcagccaggttctaggacttctccggctttagtgttccaagtagctgggattacagacgcctgccatcacgcccagctcaaatcattttatgaatgcatatttccatctgggtgaaaaaaaaatcacaagcctctctctcttcctactgagcacctgtgaacagtgacctgcagtttgtggctgcagccagtcctcttgcagcctggtgttcttacatttcattctgaggctcacattctcagtcaccatgcagaagaacacccgccccatcctgggtcattacagagtgggtcaatccatctgctgcatctgaagagctgggtccagcttctacagtgaatccatatatttctgtatttcctggataaggaagagcaaaggagctgagctggtggaggaagaagaactaatattaactgactccttattttgtgctagtactgtgctagttacatattttatctcatgtaattcttaccaaactgtaagggggtttcggagtgatggagacaatattgatgttatctccattttagggtgagaaaataaaggctcagaaatgttata

SEQ ID NO: 273746 - DNA, 899 bp, Homo sapiens
ccttggtggcccccacgctgccccacacttgatgtagtgtaaacacctgacttggggcattactttttgtgaatatgttggccaggcttccagaggccagagtgaggggccaggtacccttcgtggtggtccaaacacatccccagccctttcttcagaggccccagcaccatgtggctcatccagggctcacctactccagtaccagggcaaggtgtacagccccaggacccaaaatgcctcccttaaagctgattggttgatttctttattcttatcacatggtagcccacgatcagatctgactctcctgtcctttctttgtgggtctgaaaaataagaactgctgtaatcaaatgtgatctggaggcatcagaacagagcaatctgatgcttcttttcttgcccaggctggagtgcagggcgtgatctcggctcactgcaacctctgcctcccaggttcaagcgattctcctgcctcagactgccgagtggctgggattacaggcatgtgccaccatgcccagcgagtttttttgtatttttagtagagatgggatttcagcatattggccaggctggtcttgagctcctgatcttgtgatctgcctgtcttggccttccaaagtgctgggattgcaggtgtgagtcaccgcgcccggccagagcaacctaatatttcaaaaaaaaaaaaaaaaaaaaacaaaaaagaagcgcgcggagaaaaagggcgggcggcggcctctcgggggaagagccacccacgtcccacttgggggagcggcgcgcgggggggggggagagaggagagcagccggggaacaccggagagacatgtgcaggggggcacacgggtggggggggaaggggtaacccaggaggccaggctggtgtgctgc

SEQ ID NO: 273747 - DNA, 158 bp, Homo sapiens
tggatcatgcttttggtatttcaaccccctaacctcaaaaaaatctctggataatctttgatccttaatttcttagttcacgccttctccacatcttatgagttgtgaagcctaacctcaagatgtctctccaatctatccccttctttctgttccac

SEQ ID NO: 273748 - DNA, 442 bp, Homo sapiens
tgagacggagtctcgctgtgtcacccaggctggagtgcagtagcgcgatctcggctcactgcaagctccgcctcccaggttcacgcccttttcctgcctcagcctcccgagcagctgggactacaggcacccgccacaacgcccggctaattttttgtatttttagtaaagacagggtttcaccgtgttagccaggatggtctcaatctcctgatctcgtgatccacccgacctggcctcccaaagtgctgggattacaggaatgagccaccatacccagcctctagtgtacttaaagttccatcatttaagcttgattttgtttgatccttctggtttgtactcctgccatatcataagctccacaagaatcaggtaatcagacaagaatcatacagtacagactaaaaatatttggcaattaccaaataagtatagtcag

SEQ ID NO: 273749 - DNA, 360 bp, Homo sapiens
ttcctcctgggactgaaataccctcacaaagagaagcaaatcagtgactgaaggtcaatagagaccatcaaggtatgaaaaggaaggaatcggattttccatactggaaacggtggagaaagtgcaaatagtgcctctgtagatcctggatgcggcgatgccctgtgctcttcctcctctcacagtcctacagggtcttgaaatcggaaatggaatagcattctgcccagttttcacatcgtctacccttttggaaaagtatgcaggtgtcatatctttgaaggagctacatttttattactcatctaagatgttgtttaattgttcctatttataataaatatttgtgaaatattaaaa

SEQ ID NO: 273750 - DNA, 418 bp, Homo sapiens
aaagtttgcggcatggaaaggcaattacccaaatgactttttaaaagtatgagaatttgcctggctgaacgttttttaattaatgccgtgagttaacattaataactattcatagcttagtgagctgggcttgaggtgggtttaggaaacatttggtatctctggcagggacagatgttgacctggccggtcggcagcttttacaaacctaaggacttcagggtccggttgcgcatgaggaccggggaggacagagctgtttgcaataggtgtgggcttttatagcattgtgagcatttcacgttagcgtaagtgttgctgctgtgcaggtggtctctggggcttacaatcttccccaatgttcttccccacccctcccaccattctggtgaacaagcctcttgggattctttgaaaa

SEQ ID NO: 273751 - DNA, 275 bp, Homo sapiens
gactaagaagggctggaatgtgtcttcctcacgcagacaggtaaagcacacacaacaataaaagcatggagagaaggaagcaagggcgatgggtgagcgcaaagcgaggaggcaaaacaaaaggcatcctccccggctcctcaggacagttgcagaagagactggataatcctccaggttacagaatgggggtgaaggcacgtgctgtgctgcgccaactccagagctgtgtgcaaccgtgagcatccgtaaacctccctgctgactgtgaccct

SEQ ID NO: 273752 - DNA, 329 bp, Homo sapiens
tcacgcctataatcccagcactttgggaggccgaggtgggcagatcacctgaggtcaggactcacaaattgctaagattacaggtgtgagccactgcacccggccttaaacataacttatatatgcactgggaaaccaaaaaccttgtgtgattcactttgttgcaatattcactttactgaagtggtctagaactgaacctgcaatatttccaaggtatgcctgtagttgtgagatgtcagtgttttacttgaagtgttaaaacattgattttaagttgactgttaaaattaggtatgtgtattattatccctagatcaacagctaaa

SEQ ID NO: 273753 - DNA, 459 bp, Homo sapiens
aacgtgacaaacgggaaccatcctgaatggaaaagctccaaggtgacagaaggcatctctgcccctgcttctcccccagcccctttctgttagaagtcaccaccaggagaagagggacccctgctgcatgaactccaggctgttctgctggaaggaaaggtcaggagaaaggactgtcacctgccagacctcagcatcagagaagggagtcatggactcctctctgttcgtacttcactgaaccgttgaacctcagggttgaagaaaatgacctagtccaactacccatctgatgtaagaatcacatgttcattcattcatgaattcactcattcatttatccatcagttttttgtttgattgattggcttattcattctttcaacatctaatgagtagctactctggcccaggcaatgcacagaagttgaataaaaggcacagaaccttatcacttga

SEQ ID NO: 273754 - DNA, 236 bp, Homo sapiens
aaagactggtaatatgtatgctagctggagaagccacctttcagtcccatctctgcgtatagttgatcgtcgaggaactcgatggtgcagggggaaaggcgtagctttgcagtcagaccttagctaacttcttggccctgctgcttgcttgctgtgtgactttaggctagctaccttgcctctctgttcctctgcttgctcatttggacaacaggaccagacctaggaagattagg

SEQ ID NO: 273755 - DNA, 370 bp, Homo sapiens
aatttttttgtagagaaaaggtctcactccattgctagggctggtctcaaactcctgggctcaaacaatcctcccaccttggcctccagaagtgctaggattaaggcatgagccacagtgccagcaaacgctccatcatcttcagagtttatttaatttttatttttttaaagaaagttgctctgtcgcccaggctggagtgcagtggcacgatctcggctcattgcaagctccgcctcccaggttcacgccattctcctgaacctgggagacagaggttgaggtgaaccaaaatcacaccactgcactccagcctgggcaatggagtgagacttcatctcaaaaaagaaaaaagaaaagaaaagagaat

SEQ ID NO: 273756 - DNA, 293 bp, Homo sapiens
tcccaatggaggacgtggaggaaggagagcaagttcaagagcttattttatttgcttcattgttctatttgtttttgtgcttatttaatcagccaaggtgttgtgattgtatgtatatatgtatgtatgcatgtaagtatatctgcattaacaatatgtttgagactgaggatggtgtataggcagtctggtggttgcatgtgtgtgtgtgtgtgtgtttcacacctacttgcacacttgtgtcccctcatgtcttcaggtctgtcatggaagtgaggaggggagaaagggag

SEQ ID NO: 273757 - DNA, 192 bp, Homo sapiens
ttttttttttggtgtttccataataatctcattttacctacaaaccatgaacacatgatagcaggctcatgcatttcaattgtctgtcatttgtagtataaataattacgtgctataggtaagattttctctgtgttgatgtgaaatagttaatgtcctttatgtggctagaatgagttatcaactagtatt

SEQ ID NO: 273758 - DNA, 414 bp, Homo sapiens
ttcctttaaagtctcaaatatctatcagtgtagaagagtgggaagacaccaaagactccaaagaacaagggcaccaccgcagcaaccaccgcaactcaacatccagtgatcagtcggaccatcccttgctgcggagaaaaagcatgcagtgggcccgaagactgagcagaaaaggcccaaaacactctggtaaaacagctgaaaaaataacccagcagcgactgaacctctacaggaggtcagaaagacaagagcttgctgaacttgtgaaaaatagaatgaaacacttgggtctttctacagtgggatatggtatgctctttaaaaactactgtatatatggactcgtgatttcttgccattagtagtaatatagttggttctaatttaataaagaattgaatttttgcttca

SEQ ID NO: 273759 - DNA, 821 bp, Homo sapiens
tctagtggggccaaaagagctgtttggataagctctttgccgaagaataacgtgagaaggaattatgtctctgaatactttcttaccccatcaaatatgagcaggtaacctgtgctgctgcagccagagggattgctctaaaagcaacctttcaagcaagatgttgttcacgtaaaccttcaatgctcagacactgaagaacatctcctagcactaacaccatccaggaaaacatgacctcacctcaccaattgaactaaataaggcatcaaggaccaattctggaaaaacagagatatgtgaactttcagacagagaattcaaattagtggttttgaaaaaactcagagaaattcaagacaatgcagagaaggaatttagaattttgtcagataaatttaaaaaagattacaataataaaaaagaatcaggtagaaattctggagctaaaaaatgcaattggcatactgaagaatgcattagagtcttttaatagcagaattgatcaagcagaatgaattagtgagcttgaagacaggctatttgaaagtacacagtcagaggagacaaaagaaaaaacaataaaaagcaataaagtacacctacaggagctggaaaatagcctcaaaagggcaaatctaacaattactggcctcaaagaggaggtaaagaaagagataggagtagatagtttattccaaggaataataacacagaacttcccaagagaaagatgccaatatccaggtacaagaaggttattaaacaccaagcagattaacccaaagaaaagtacctcaaggactttaataattaaactc

SEQ ID NO: 273760 - DNA, 263 bp, Homo sapiens
tctagtggggccaaaagagctgtttggataagctctttgccgaagaataacgtgagaaggaattatgtctctgaatactttcttaccccatcaaatatgagcagattgggatttataccaccagctttcctggttctccaccttgcagaaagaagatcctgggacttctagctcagcttctataaccataactaccaacacttttcaaatttaaatcctacaaacaagctgaatttgattaagtattcttcaggtggctctat

SEQ ID NO: 273761 - DNA, 472 bp, Homo sapiens
ggcagcagctgttcctcgttcttaatttctccaatgcctagcatgtgccagactctagaaaaacacttcaaggatgagtaatcatcagttctgttctagaagcacatgtggaacactaaacaagaaatgattgtaaatattagactatctttgccatttttatttgactattatgcttctgctctgatgacttccatgactagactgatcaggccagtggcaggtgtgcaaatcacaacttggcctcccaaactaaggtacaaagttgtgagtcacacgtctgccactggactgatgcgaaggctcagttaagctcatgcactttgcctgaattagcatgtctgatatttctttaaataaacgttgccttccttccttttgcaaaatgaatttccctttctttgggggaagtcatttttcactgaggcctgacttatcaaagctgatggcagagtcgcctggaaggcaacag

SEQ ID NO: 273762 - DNA, 705 bp, Homo sapiens
gcccagtgggcccagagcaaaactcaggcaaaggtgccactagactggccaggaaagcgacaccctaaagatcccataatgctgatatgttaattctattctataagcaccacacagaagtgatagcttttatttcttattttgtctagcctggagacagagctaaggattccttgaactgcaaagtcttttccagttcttagtttatacaatccatactcaccttctgcctaactaagcattgtcatttttgtgccaaatgaagagtaggactcctacgattgtcctcagactctcttggctcaatcctcctgctttaacctttcctacttcaaaaactcctgaagttttgcttccccttctatagaatggaaatatatgtcgcaatacttactgcaaagaaaattatatattttaaaaatagactaaagagatgttgtgagacatcagacatcaatcagatgttgtgagaactgatttctgcatcagaatatctccttgactttacagctatcctttaatcctggctcaaagttccagaagaaagatgatccaatataatactcctatttggactttgagtcatacacattccttcttctgagaaaacgtgcttctgcatgaatcctcccttcattattttcagctcatctattattgaatctgaaaccccaggttaactgactgatcactctcatcagtggc

SEQ ID NO: 273763 - DNA, 521 bp, Homo sapiens
attgaggatgatccactagtgtcgataaacactttatacttgcaagtttgagctcaagcaccattaattcaggagaagaaggccaggcagctgcatcaatatcagcttggctggttttacatgcaagggccccaacatctatagcccctacacaaccagaaaagaagacaatgtgggacacagaagaatgagacttcaatgagaagggcactgacttattttctcccctcttcccaataaatggcaagttgtctctgtttcttctttaatttatccttttatttgatgacttagacctgcattgtccaatcagtacatgtggctactgagcacttgaaatgtgctgaaaaaagtctgaactgagatgtgctgtaagtgtaaaatacacattggagtttgaacagttagtaaaaagaaagaatgtaaaaatatctcattcatccatatatttatattcattacatgttgaaatgataacattttggatgtactgtggtaaaaaaaatatattattaaaagta

SEQ ID NO: 273764 - DNA, 141 bp, Homo sapiens
cctggttgtctataacaaatatgtaatttttaaattagcaacagcgttagactacttcggggaaacctggctctgtgtgccacgaagcagggaagggcttgttcccaggcgcagcagcacttgggcatcccgtggtgaagt

SEQ ID NO: 273765 - DNA, 443 bp, Homo sapiens
gttttgcatggctcggggatgaggtggcgggagcgaaggccagaggccagatcaggagttgtattctgaaggttgtagggagcccttgaggatttgactaagaagatcattattggttctgtttcaagacattcatggcaacagtgaaaaatggacgagaaaacgcatggtagagacaggagaaccatgaagacattgaactgttacacatgagaaataatgagaactgcaagatgggctccaggcagcagggaggtgtgaggaggagacagggcagatgccctgatctgttggctctggaatctgtagggtttgttgttgttgttgttggtttttttaatgtacagttcaaggttgggtgcagtggctcaggcctgtaatcccagcactttctggaggccgagtcaggcggatcacttgaggccaggagttcgagaccaccc

SEQ ID NO: 273766 - DNA, 346 bp, Homo sapiens
agagcctagagcagacctccccattgtcagacgcaaaaggcaagacacctgggtgtttatttgccatctccacaatagtagagagctaagggggcattgacttcctggcctgccccacgcatgaggagctgttgcactcctcaccaacaaagaccctcaggcagagagctacaggagcagtaggaagccatagggtctgtgtgcacctgaaggcaagtgctaaggggaaatgggtggagtacaggcaacacgtttttcaaagaccctacatgatctgacttccctcctaccccaggcacccctgcgacctcaccttctgcaactccccagcccctcacactccagc

SEQ ID NO: 273767 - DNA, 261 bp, Homo sapiens
atttctgatacgactttctatttcacaagactgggtttgggagaaggcatctgtgtgtcaccactggctggcgttcctccctctggtaaaatggctgtctgccaccttgagcccagaacaatgtattgaagtcatgaaataatttgtcagtgttccttttaacactgtagtcatgtattccatgattattaaacttgtacatacctgattagcaaactccaaccaaaaaaagataagcaaacaaaacaaaacaaatacaaa

SEQ ID NO: 273768 - DNA, 400 bp, Homo sapiens
gggccccacgaaccccaaccaccacctgcctggactcagcctgcctctgctgctcaaatcctcacctgcctcagcaccccaagacagacacctcgggccccgcatgggttggagacatttattggcagtcctcatgcacttctctgaccttggagggctcttttggtttaagactgaagcccaggacggagcaaaaggagatggagctgagaaaatgggatcatcctgtgtctatcctgggattctgggcttttctgtccattaattcaccgaaggaggaaacttagctccctgatcattcaaaacacttgtgccttttcccctcaactcctcattttcttttcctgaccaacctccagtcgtctgataaataaatcagtgtgacttgtcaatagcgaaa

SEQ ID NO: 273769 - DNA, 971 bp, Homo sapiens
ttccttacccattcaagttttatcttgagccatgctctcactgcagcactccagtctgggcaacacagcaggatcctatctcaaaaacaaaacttgggtcactttcctggtcattcatggacaaacatatgctcaagagtggcaaaaatttgagttgcccacctggcacattcccagctgagttgaaacaaggtgacaacgctgccttcttgtttcaactctcccactgcaaacaaatgttctttacaaaatctatttagtgccacattgttcctattttgtgcgtttgggtggtgattttgcctgtgaaatggcccccaagcatggtgcttgaagggcgatctagtgtttcaagtacaagaaagttgcaatgtgccttacagagaaaatatgtgtgtgagataagcttcatttgggtgtgagagtgctgttggccaggagttcatgaatgaacaacatatattaaccaagatgtctttaaacagaactacctgtaaaacaagagttaatgaatgaacaacatgtattaaataagtgtctttaaacagaaccacacataagacaaggctacgtattgatcagtttacaaaaatattgggacagaggctctcaggattctaaccctgtatttctcctgtgagcaaattcagtgatcacagtgaccttatgaaacacgactactggccaggtgccatgactcacacctgtaatcccagcactttgggaggccgagatgggcggatcacctgaggtcaggagttcgagaccagcctggccaacatggtgaaacctcgtctcaactaaaaatacaaaaatttgccaggcgtcgtggtggcacatgcctgtaatcccagctactcaggaggctgaggcaggagaattgcttgagcccgggaggcgggggatgcactgagccgagatcatgccactgtactccagcctgggtgacagattgagacactgtctcaaaa

SEQ ID NO: 273770 - DNA, 146 bp, Homo sapiens
aaaaaacccaacaaaagtcagcatctttatccacctgtcccggttccacaaagtgctttgttttacttcattattcgggagcctctggctgctccctgcagacggggtttcccctgctggacctcacagcctgtcatgggagccca

SEQ ID NO: 273771 - DNA, 541 bp, Homo sapiens
gaggacagggaggtggaagaaagaaagggagaagtgtgaggggcgttttgtctgccctgagctctctcatacccacagcccagggcaggcagggctgggcttggagggtggaatggtctgggcagaggtcagtccgaaacttcagccctggagggagctggagctggggctttatcttgctctctttccttattttaacttaatcttgtctttattagttttatagagatagggtctcactatgttgcccaggctggtcttgaactcctgggctcaggaaatcctttcacctcagcctcacaaagtgctgtgattacaggtatgagccactgcacccagctctttcctccttttaaaaacaagaaacctggccaggcacggtggctcatgcctataatctcaataccttgggaagctgaggcaggctgatcacttgaggccaggagttcgagaccagcctggccaacatggtgaaaccctgtctctactaaaaattcaaaaattagctgggcatagtggcacatgcctgtaatcacagcta

SEQ ID NO: 273772 - DNA, 428 bp, Homo sapiens
tctttttgtagttaattgtgtatatattctgggattcttcagtggtataaaagtatactgttgcttttctagatggttttatttttatatagctaccaactacaaatgagcacatcattttttcagtgtggttgaccaaatccttcccatttccatcaccttctccaatataatttatattcttcttctttacccaaatgttcatctattctaactcttcttcacagtccttccgaatacgactttttccaagaatgtggggaaagtatgattttaatgcaaaatgaagaagaacccaatattccctgtctattagagttagtgtaatttttgcccttaaacaaaaaagagtattgtcttattggagagacttaagtagaataaacatacttttctgtcattaataaataatctgatcatcttgtaaa

SEQ ID NO: 273773 - DNA, 478 bp, Homo sapiens
tttctctttttaaactttgggaaagtcaattcttaaatctgaagataaaagccttaaggtccactaacccccttctcccccctggcaatttatatttaaaaagacttcagatcacacataggttggctcatatttagatgcagagaatggctcatatttagaggttgagaaacactcaaagtgaaacaacccacaatcatatcattgttcccttgcacggcggggagagtttagagaaatcaagtcctctctagcaggttgtaacaaaaagaatgttacaagtctcagttaaatttaaaacatttctttggacagaagtttctctttacaggaacattgaattgtcttttcccccttttatgtctctagaatattttgtccactttggtaatcttccattctggttgtttgcgtttacctgtggggaagtcagaaggactagtattttgcaaaccacttaaaactgccgtttaaatgg

SEQ ID NO: 273774 - DNA, 337 bp, Homo sapiens
gatagtaacctaaagaatgccagggtggctatactgagacaaaagagactttaagtcaaaaattgttacaagagcaaaacattacatattgattaaaaaaaaaaaaggtcagtctacaaaggagacatagtaacagaaatagaaataaatcatcctgaagttaacatggaatttcaaggtatctcaactagccaaaatgatcttgaaaacccatgcatgtatggtaaaatgattttcaacaaagttgtcaagaacagtcaataaggaaaggacaatttttctaacagatagtgttggaaaaactggatagccacatgaaaaacaaaactaaaaaaaa

SEQ ID NO: 273775 - DNA, 1067 bp, Homo sapiens
cactagactttcttggttccttctccagaaattccagtctagcctgctcgggtggctctgtccttttcttctcagttgactctctttgtgtctcctctggagtctctggtttggtcatctttggtggctgaagatctgtctcttcaagtgattctcctagtttctcacttggaaaatcttgtttggtctgctctggaggctctagacctgtctcttcatgttgcactctaagtgattcctctggaacccccggttcagtctcctcctctagtaattctaaatttctctctctgactgtggcccccgaaacctcagacatggtttccgttggtggcactggatctggatctgtttccatagctgactctaggaacacatcctctgtaacatttggtttagcctcctctggtggctctaggtctgactctttatgcgtttcatccataggggcctccaaatctttgaaaaactctcccatctctctggatgtttccgactttacctcttggtgtatccctggttcagtttcgcttggtacgtctctcttggactccttggcaattccttcctgggacgtcccgccaggtttcagctgcacgttcttagcactgtctggctccccctctttgaagtcctcttcctcggtctctggctgtggctcttggtaaatctctgctggtagcttcgagtctgcctttgccatggtgtctggttcggcattttcatacaatttatgaagtccaggcagttcaggcctctcaggctccagctctccatcttcatctgggccggaatcataatcctccgggacttcagccatttgcagcttagcagacgcgccgcggcttcctagcaaccccaacttccgatagcgtctctatggataccacgatttccggcagtgtcttcctgactcttccccaggttttgtttgttctttcaagccctgactttaaaaatcgtctgtcacaagcacgcagtaaccctccctgcggcctcatcgccagcctcagcgggccagagctcctgtggccgcccctgggtcagctagcttttcaagcggccgc

SEQ ID NO: 273776 - DNA, 324 bp, Homo sapiens
tttttgtgtttttagtagagatggggtttcaccatgttggccaggctggtctcaaactcctgacctcaggggatctacctgccttggcctcccaaagtgctggtattacaggcctgcgccactgcgcctggcagatatagaacatttctgttaccacagaaagttctgttggacaacactgtcgtaaatcccagggtgctgaggattagaattctgtctctggcccactgaggaaagcaggtctcaggcctagctcctgatgaacccctggatgaaccactgtgaagtgtgtggaataagtctactctgctgaaacagtgggac

SEQ ID NO: 273777 - DNA, 464 bp, Homo sapiens
tacaatacttaaattacttaaaaaatttttttttctcacttcaaattttattattagtatgacaaacatgggctaggatcaaaaactttgtttattccttattatcagagaactctagatcttgaattcattgctaaggttatttgcaagtaaataatctgctgttgtgttctttgattggtggtaagctgcacagcacctaaaactgtcgtataataatttggccaggtgcagtggcaaatgattttaatgccagtgctttgggaggcccaggcaggatcacttgaggccaagagtttgaggccaagaaacatttttatttttttgtttccatgaaaaatagaaataaaaactcatctgggcatggtggcgtgcacctgtagtcctagctacaaggaaggctgaggcgggagtttgaggctgctgagctatgatcgcactactgctctgcagcctgtctctaa

SEQ ID NO: 273778 - DNA, 415 bp, Homo sapiens
actgaagtaaaatgacaaaggatttttttttttaattatactttaagttttagggtacaaatgcacaacgtgcaggtttgttacatacgtatgcatgtgccatgttggtgtgctgcacccattaactcgtcatttagacaaaggatgttaaacaaactggaccctagtgtgcccccaacagtccttcaatcattcacaccaactacacccagccctctgccggcacttttcctgcaatatggctaatatggaaccacttctagtcccacataaacctgatcccactcaagcagttcctctcacagaatgccaccccaccaacccagtttctaaagcgagaaaactagaaaccattactcattctcattcttgccactcccactcagtatcaccccatcccatcaatctagtctgc

SEQ ID NO: 273779 - DNA, 569 bp, Homo sapiens
tgctgcaagatctccgacagaccataccctggaggttgcaagggtttcatttggcctattttggcagcatgttgagcatctaaagtttggattctttagttcttctcaaatatgaacttaccattattatggttatgatcctggtagctaattttttttaacccttcatacctactgttaatcattgttttttcctggaataaattttaaaatatattcaggtaaactatattcatgcataagatgactgtggtgagtatttagtgtaaaagacattttcttttgaaactgcagtattttggataaattacatgtgaacctcaagtcgcctgtgacccaagtgagattgttagtgttctgaatactagtatcatttttagcctttgtgtatctttttatatgaagtgtctacttctcaagctgattataggatgaatgtgcttaaggttgtgtgcatcagtatgcttaacaaatatcattttagtctctggaagaaagcttgctaaatgtaaaggtgaatctcaagtatataaatttttgcattatagtgtatttaaaaatatatgcca

SEQ ID NO: 273780 - DNA, 230 bp, Homo sapiens
ggatgcagcctgtcaccagctggcccaggtggtgacctctgagactgaggcaggcaagccctctccagtaggatctctcaccacgttcccccaccccaacatcttatttacatccagcatctcatgctgtcatattcacttaggcgtcagctgacaatgggacacaccacttgtttttttggaagaaccaccacctcgacccagcacagtggctcatgtctgtaatccca

SEQ ID NO: 273781 - DNA, 402 bp, Homo sapiens
ggcatttttctacttaatcctttacaggcaagtgggagattcccacgtgcctgtctctatcttgctgctgaagaagtggaaggccagagaggaggaagccacgcgcccgaggccgtctggctgttgagaagaccagaggagagcctgaggaggccaggttcgagctcgtgtgtctcagcccagagcctgcagaattttgtgtctgtcgcgacggggtctgaaaacctattctggccgggcaggctggaacccgggcttgttgtgggccgcagaccagctcagtgcagctcgcagccctgccagacggaaagggggaactaggcgcgcagaaagggtacgtgcggaaaaaactcttgcctctgcgctagaacgtccggcagggcccttctgtgaacaagcggc

SEQ ID NO: 273782 - DNA, 494 bp, Homo sapiens
tggatgccggctatagctgcagcccccaaagtcgaagctaccagaacaggttggatgaggatggcccaaagattatggagttgctggccccaaagcaagtcagacactatgggaagtttgcatgaatcatgcccttggatagacaacctaaatcatacctcatcgagcatggatcctggtcagcataccaagtcaaggcaagtaaagactgaagaaatatcacctggtctgcagctccccccagaacgaagtctgctactgatggcagaagcatagatagaccaagggtatcactatgtaatgatggaagaaggaaaaaccccatgcattcactcatgtcttgaatcacctagagaagagagggaatctgccaaagtggacacaatagaaattcagttctaaatttggaggaaatgagacccactctcagataagatgaaaagtaaaagccctaggatccaatggggtattaaacaaatatttaaaagtaaaaa

SEQ ID NO: 273783 - DNA, 204 bp, Homo sapiens
gttacagatggggtctcactatattgcccagggttgtctcgaaattgtgggctcaagcgatgcccccatcttggcctcacaaagtgctgagactacaagcacaaaccactgcacctggccgtcttggtaattgaaatatttagcccttttatatttacataatattgatataattaggtttgaatcatctttttcttcttttaa

SEQ ID NO: 273784 - DNA, 490 bp, Homo sapiens
gctaggagaaagagatggagatgggagtgcctcctacagtagcagcggtgcaaaggacctaaaggcaaatcagaaagtcattctgtgatgtactaaaggtcaaactaagagaaaaataatgtgaatatggcttaagcaaaacgaagcgagccaagaggtaacgcttggttatactgaaatcaaaaaggcatagaattaaaaaacaggtcaaaagtgataaagtggaggaacagtacggccaacttctgtaaatgtaaagccagcatctttatgtgatcttataaatgcctctgatatacgtgggtccatggtttggggccaaagacatagctgtcattcaattgatagctaaaaacttcctgtcactggaaatcaagtcccttctgaggatctttttccatatttatcaagtttctgaaatggtgtggattaaatgtcctcatcagccatttgattttctataaacttaagcctctttgccaatatcatt

SEQ ID NO: 273785 - DNA, 419 bp, Homo sapiens
tgcttttttcccctaataaaaattgtgaacatcattatgactaaattggtcacttataacttgtcaaggaaaaattttctgaaatacatcatcctcaattggctccttcttcgggaatatgacttgttatcatggtatgggtaaaggatggtagagaatcaagaactacaaataatgtacaaatgtgagatctctatctctatcaattgcacttatttaattggccagagaaaatcatagtccgtgtgtatgttcgagtgtgaaagtgtaaccttcccttaagcctgaaagtagagggaaactgggtactagtgaacaatataagaactattacatggtccagaaagaaaagaaagaaggaaagaaagaaaaaaagaaagaaagaaagaaagaaagaaagaaagatagaaagaaagaaa

SEQ ID NO: 273786 - DNA, 429 bp, Homo sapiens
agtctgttccttttctgaacccccttctctatgatttaggtaactacagttgtgcctcacttggcagggatatgttctgaaaaatccattgttaggcaattttgtcattgtgcaaacatcttaagagtgtacttacacaaacctaaatggtatagcctatgtaatatatatatatatatacacacacctaggctatagagtatatatacctaggctatagagtatatatacctaggctatagggtatatatacctaggctatagagtatatatacctaggctatagagtgtatatacctaggctatagagtatatatacctaggctatagagtatagcctgccgctcctaggcaacgaacctgcacaggatgttactgtactgaatgctgtaggcaagtgcaacataatggtaagtatttgtgcaacta

SEQ ID NO: 273787 - DNA, 204 bp, Homo sapiens
ggagacttcaggaggttaggactactgcagcgactatggtcctttggtcaaggaacccaaggatgacattgagatagagataccaaccagatcagcagttctcaaatgagagaggcaacctcacatcaccctcaaccccaatagacttctcctatccctgctgttagccaagtcttcccttctgcccagagagctctcagcctt

SEQ ID NO: 273788 - DNA, 232 bp, Homo sapiens
ttttttttttgcttacgattgctttggctattcagcttcttctttggttgcatatggcttttagaatgttttttttctaattctgtgaaaaataacaatgaatatataaacatttatatattgaatagcatttaatctataaattgctttgggcaatatggccattttaagaacattgaatcttcttatccatgagcatggaatgtttttccatttgtttatgtcatctccg

SEQ ID NO: 273789 - DNA, 149 bp, Homo sapiens
actttatcttaagtctaattcccctggtaacccaacattgctggttttagaatttaatagtcttcagaaattttttaagataaatttgctattttctttattatcttttaattacttttataacatggggtttttgttgtgtgtatata

SEQ ID NO: 273790 - DNA, 512 bp, Homo sapiens
cccagggcccacattaaggctggtgtttctctcatggacggtggagggttgcccccaggcctcagtgtctaggggcttccaagggagaaatttgttgctatatgagcacaatttgttgctgtaaggatggctgctcagagaaaggccattgataatctcactgaaatggacgtggagaaatgttttttaatgatcaactttaaaagttagatttgttagaactaattcagttcaatggagaaaacacaggcctgggtgctggagacctggatggagtttcggctctgattctacctgtgtaacttgaaaaagtctcttgacctgtgagatgccgggcttactatgtcacacagagtatcttccagctctaaacacttgacagtctttcccagctcacgatgctggaattctatgactattctttctaaaatcttgtcaaacgtgcttcttaatatctactctgatttgttacctctaagcactcattaaaagctgaatccaaaccctgacct

SEQ ID NO: 273791 - DNA, 543 bp, Homo sapiens
tgagcgctcctactgcagagccagccgcgccaaataatgtctctatgatactcgagaactttcatttttttccaggctcgttcggatttggggtggtttttggttttgttcccctccccaactcttaccctcaccttttttttttttaaatttttttactggtgttatatctttgattctccttcagccctccccgttctcatttttcttgatcaacatcttttcttgcttctgtccccttctctcaccatatctcttagctcccctccaacctggggggcagtggtgtggagaagctgcaggcctgagattccatctgctctccttcctggagcccagagtggggcaggagaagggggtggcatcttcagctcctcagcactgaggaagaatggggctcttctcatttcacccctccctttctcccctgcccccaggactgggccacttctgggtggggcagtgggtaacagatcggctcacactgaaaatgtaagaactacaaacaaaatttctattaaatcaagttttgtgtctccagaa

SEQ ID NO: 273792 - DNA, 265 bp, Homo sapiens
aactggaatctcagaatgtaactttatttggcataagaatctttgtagatgtaattaaggttagcatcttaatttgaggtcatgctggattgagataagcacgaaatccaccaatgagtgtccttataagagacagaaaaggagaatacaaagaaacgtagggaataatgacatatgaagacaaaagtagagactggagttgaacatatctttggggagccactgttgaacctactatgcctaacagctcaggcctgtcccaagg

SEQ ID NO: 273793 - DNA, 405 bp, Homo sapiens
agcttactcggaataaagttctttgcagatgtaatcagggtaataatctcaacatgagattatcctggattaaattgggccttaaatccaatgactagtatccttataagagccagaaagaaaaaggcaaagagacacacagaaaaggccacatgaagatgaaggcagggattagaatggtgttgtcacaagcccagagaacctggagtctgcagagctggaaagggaaaggaagatcccccaaccagtgtctttggagggggtgcagccctgcccacaccttgatgttgaacttctggcacccaggactgtggaacatacatttctagtgttttaagccaccaagctcgtggtaatttgttatggcagccatgggaaacgaatacaggtctcgatgaagtaaca

SEQ ID NO: 273794 - DNA, 397 bp, Homo sapiens
tacttgggaggctgaggcaggagcattgcttgaacctgggaagcagaggttgcagtgggccgggatcatgccactgcactccagtctaggcaataaagtgagaccctgtctcaaaaaaaaaaaaataggattatgtagagaaaaatatatttgcattcttaacatcacctacaagagtggactttaggtccatgctgtccacagcagcagccacccagccatgtgtggctactgagatgtagccaaaccaagtgtgtcatgactctgaaacaccaggtatgaagcatggaagaggacaacaactttaaataccttaatttttatattgattatgtgttgaaataatattttagatatattgggtttcaaaagtatcattaaagtgaatttcaactat

SEQ ID NO: 273795 - DNA, 328 bp, Homo sapiens
gggaggcagggcgagccccactcctttcctctgccccaggagaggggcagacggggttggggcggagtggagaaactcgatgtccttgggcgggggcgctggcatagctgagaggggaagatgccctgcagaggaaactcacagtggctgagggagcccctggccgcctttgctttcctaacttaggtcgtgaggttcctaccggtccttttgacatctggaaaatgtccccattcactactaacggaggaagggctagaagagaagggtggggaaagggttcccaaaacttggaatgctaactaaagtgctgggaaattgaatagtt

SEQ ID NO: 273796 - DNA, 210 bp, Homo sapiens
caaccaaaaatggtatagaaaaggacaaatggggctgcagcacagcggaacagcgcatcttggggggccgtgtctgggggttcatgctattgttcctgcttctatgtaaaaattaaaataaaacacgatggtacatgttcctttcctttagaaaacttataaaagggccgggtgcggtggctcatatctcctgcaatcccagccttttgg

SEQ ID NO: 273797 - DNA, 533 bp, Homo sapiens
gcaccaagttttgacggttcttgaactttctataaatggaatcatattgtatatactcttgtgtctggcttccttcactgcacattagctgtgagatacatctttgttgctgcatatcatcataatttattcattatcattgtataattttttgttttgttaatatacccagtttattcttctgaagatgagtatttggatagtttccagtttttagctgtctgaataatgccactatgtacactttttaaatgccttttggtgaacaaatatatgcatttcttctggatatatacatacaagtagacttgttttatcagaggatagatacatactcacttttggtagatagtgccaaagaggtttctagagtcattgtaccaattacattcctagcagcagagtatgtgcgttctagttgttccacatgcttgtcaacacttaatattgcttgttttcattttagccatccttttgaggtgtgtgatgtcttttattttttaagaaataaaaatattacatattcagttaaa

SEQ ID NO: 273798 - DNA, 513 bp, Homo sapiens
cttttgctcatattccattggccaagacttagtcacatagatagacacacctggctgtaagtaactctgggaaaaagtctccagctgagaggccatatgccttcttaaaactcagttttggggaaagctttctactactgaaaggaaaacctggatattgggatcaactagtatctgctttaagggaagtcatgttggtctcagacatgactgaacaggtttacagaggccaggtgaggtggctcatgcctaaaatcctagcactttgggaggcagaagcctgcggatcgcttgaggccagaagtttgagaccagcttgggcaacatagcgagaccctaatgaaaatcatcagctgggtgtggtagtgcatgcctgtagtcctagctacttggaagactgatgtgggaggatcccttgcccaggagctcggggctgcagtgagctatgattgtgccactgtgctctgggctgggtgaaagagcaagaccctgtctctatttaaaaaaaaaaaa

SEQ ID NO: 273799 - DNA, 2191 bp, Homo sapiens
agcggaggcggttacctggcaaccgagagatgcggagcgcaaccacctagcggtcggaaagtgcatttttcagagccctaggaatccgagctgacggatccctgacaggggcgactgactcctagttatccccctaacccctaggggccttcagccccaaccccatcatgacatctcctctgtgcagggcggcctccgccaacgccctgcctcctcaggaccaggcttcgacgccctcttccagggtcaagggcagggaggcttcgggcaaacccagccacctccgaggcaagggcacagcccaggcgtggaccccaggccgttccaagggaggatccttccacagaggtgcagggaagccctctgtgcactctcaggtggctgagttacataaaaagatacaactgttagagggtgaccggaaggctttttttgagagctctcagtggaacatcaagaagaaccaggagaccatcagtcagctccgcaaggagactaaggcactggaactaaagctgctggacctgctcaagggagatgagaaagtggtccaggcagtgattcgcgaatggaagtgggagaagccatacctgaagaacaggacaggacaggccctggagcacctagaccaccggctgagggagaaggtgaagcagcagaacgccctgcggcaccaggtggtgttgcggcagaggcggctggaggagctccagctgcagcacagcctgcgccttctggagatggcggaggcgcaaaacagacacacggaggtggccaagaccatgcggaacctggagaaccgcctggagaaggcccagatgaaggcgcaggaggccgagcacattaccagcgtgtacctgcagctcaaggcctatctaatggacgagagcctcaacttggagaaccggctggactccatggaggctgaggtggtgaggaccaaacatgagctggaggcactgcacgtggtgaaccaagaggccctcaatgcccgggacattgccaagaaccagctgcagtacctagaggagaccttggttcgagagcgcaagaagcgggaacgctacataagtgagtgcaagaagcgcgccgaggagaagaaactggagaacgagcgcatggagcgcaagacccaccgcgagcacctgctgctacagtccgacgacaccatccaggacagcctgcatgccaaggaggaggagctgcggcagcgctggagcatgtaccagatggaggtgatctttggcaaggtcaaggacgccactggcactgacgagacgcactcgttggtgcggcggttcctggcccagggcgacaccttcgcgcagttggagacgctcaagagcgagaacgagcagacgttggtgaggctgaagcaggagaagcaacaactgcagcgggagctggaagacctcaagtactcgggggaggccacgctggtgagccagcagaaactgcaagccgaggcgcaggagcgtctcaagaaggaggagcggcggcacgccgaggccaaggaccagctggagcgcgccttgcgggcgatgcaagtggccaaggacagcctggagcacctggccagcaagctgatccacatcactgtggaggacggccgcttcgcgggaaaggagctggatccccaggcagataactatgtgccaaacctgctgggcctcgtggaggaaaagctgctgaaactgcaggcgcagctccagggccacgacgtgcaggagatgctgtgccacatcgctaaccgcgagttcctcgccagcttagagggaaggctgcccgaatacaacacccgcatcgccctgccccttgccacttccaaggacaagttttttgacgaagagagtgaggaggaggacaacgaggtagtgacccgcgcatcactcaagatccgttcccagaaattaatcgaaagtcacaagaagcaccgtcgctctcggaggtcctagactcgtcctgacacccaccaggcggcccccttcggagcccccgatccctccgggtctagcgcaggccccacggggccccttcaggggctgaacgcggcccggaccgggaacggaggcggccagcggcgcccggaggggaggaaggggccgggccagacgttcccacagtaaatctccccagctgggtccgccccggcctcagagttgcgcaataaatgttaccgaccatgaaaaaa

SEQ ID NO: 273800 - DNA, 2463 bp, Homo sapiens
agcggaggcggttacctggcaaccgagagatgcggagcgcaaccacctagcggtcggaaagtgcatttttcagagccctaggaatccgagctgacggatccctgacaggggcgactgactcctagttatccccctaacccctaggggccttcagccccaaccccatcatgacatctcctctgtgcagggcggcctccgccaacgccctgcctcctcaggaccaggcttcgacgccctcttccagggtcaagggcagggaggcttcgggcaaacccagccacctccgaggcaagggcacagcccaggcgtggaccccaggccgttccaagggaggatccttccacagaggtgcagggaagccctctgtgcactctcaggtggctgagttacataaaaagatacaactgttagaatctcgctctgttgccaggtgggagtgcagtggagcgatttcggctcactgcagcctccgcctcccgagaatctcttgaacccgggaggcggaggctgtggtgagccgagattgcaccattgcactgcagcctgggcaacaagagtgaaactccatctcaaaaaacaaaaaaaacgttggatgatggcaaacaagggtctttcctctggggatgttgcacccatgcacccacccagtaactgtgtgtctgtccacctcacctgcctgccagagggtgaccggaaggctttttttgagagctctcagtggaacatcaagaagaaccaggagaccatcagtcagctccgcaaggagactaaggcactggaactaaagctgctggacctgctcaagggagatgagaaagtggtccaggcagtgattcgcgaatggaagtgggagaagccatacctgaagaacaggacaggacaggccctggagcacctagaccaccggctgagggagaaggtgaagcagcagaacgccctgcggcaccaggtggtgttgcggcagaggcggctggaggagctccagctgcagcacagcctgcgccttctggagatggcggaggcgcaaaacagacacacggaggtggccaagaccatgcggaacctggagaaccgcctggagaaggcccagatgaaggcgcaggaggccgagcacattaccagcgtgtacctgcagctcaaggcctatctaatggacgagagcctcaacttggagaaccggctggactccatggaggctgaggtggtgaggaccaaacatgagctggaggcactgcacgtggtgaaccaagaggccctcaatgcccgggacattgccaagaaccagctgcagtacctagaggagaccttggttcgagagcgcaagaagcgggaacgctacataagtgagtgcaagaagcgcgccgaggagaagaaactggagaacgagcgcatggagcgcaagacccaccgcgagcacctgctgctacagtccgacgacaccatccaggacagcctgcatgccaaggaggaggagctgcggcagcgctggagcatgtaccagatggaggtgatctttggcaaggtcaaggacgccactggcactgacgagacgcactcgttggtgcggcggttcctggcccagggcgacaccttcgcgcagttggagacgctcaagagcgagaacgagcagacgttggtgaggctgaagcaggagaagcaacaactgcagcgggagctggaagacctcaagtactcgggggaggccacgctggtgagccagcagaaactgcaagccgaggcgcaggagcgtctcaagaaggaggagcggcggcacgccgaggccaaggaccagctggagcgcgccttgcgggcgatgcaagtggccaaggacagcctggagcacctggccagcaagctgatccacatcactgtggaggacggccgcttcgcgggaaaggagctggatccccaggcagataactatgtgccaaacctgctgggcctcgtggaggaaaagctgctgaaactgcaggcgcagctccagggccacgacgtgcaggagatgctgtgccacatcgctaaccgcgagttcctcgccagcttagagggaaggctgcccgaatacaacacccgcatcgccctgccccttgccacttccaaggacaagttttttgacgaagagagtgaggaggaggacaacgaggtagtgacccgcgcatcactcaagatccgttcccagaaattaatcgaaagtcacaagaagcaccgtcgctctcggaggtcctagactcgtcctgacacccaccaggcggcccccttcggagcccccgatccctccgggtctagcgcaggccccacggggccccttcaggggctgaacgcggcccggaccgggaacggaggcggccagcggcgcccggaggggaggaaggggccgggccagacgttcccacagtaaatctccccagctgggtccgccccggcctcagagttgcgcaataaatgttaccgaccatgaaaaaa

SEQ ID NO: 273801 - DNA, 754 bp, Homo sapiens
agcggaggcggttacctggcaaccgagagatgcggagcgcaaccacctagcggtcggaaagtgcatttttcagagccctaggaatccgagctgacggatccctgacaggggcgactgactcctagttatccccctaacccctaggggccttcagccccaaccccatcatgacatctcctctgtgcagggcggcctccgccaacgccctgcctcctcaggaccaggcttcgacgccctcttccagggtcaagggcagggaggcttcgggcaaacccagccacctccgaggcaagggcacagcccaggcgtggaccccaggccgttccaagggaggatccttccacagaggtgcagggaagccctctgtgcactctcaggtggctgagttacataaaaagatacaactgttagagggtgaccggaaggctttttttgagagctctcagtggaacatcaagaagaaccaggagaccatcagtcagctccgcaaggagactaaggcactggaactaaagctgctggacctgctcaagggagatgagaaagtggtccaggcagtgattcgcgaatggaagtgggagaagccatacctgaagaacaggacaggacaggtttgcccaccctcgccccacctcctccttcatttccagcctgggtcccctcaccactggactccaggctcaccctctccaatccttcctgcacactagctgccattcatgtgctcattcaattaaatctttattactcactt

SEQ ID NO: 273802 - DNA, 550 bp, Homo sapiens
caggagatatggtttgcaaatattttctccaagcctgcagctttgtctttccattctctcttaacaagagtcttacacagaacaaataaggcccaatttatcaatctttccttctatggatcatgctttcagtgtcaagtctaagaactgattgcctagccctagatcctaaagattttaacctatttttttctaaaagttgtatactttcatattttgtatttaagccaatgatccattttgagctaatttttgtagaaggtatgaggtttaggtcaaggttcattattttacctgtgaatgtccagtttctccagcatcatttgttgaaatttctaaccttcctccattgaactatttggctcctttgtcaaaaattaagttggccacatctgtgtaggctatttctgtgtttcatatactatgccattgatctatgtgtctatccctccaccaataacacattgtcttgaatactatagctatacagtaggtcttatcaaaatggtttttaaatgtaaattacgccatgtcagtttcatgctttaaa

SEQ ID NO: 273803 - DNA, 423 bp, Homo sapiens
ttttctggaaacagagtcttgctctgtcacccaggctggagtgcagtggcgcgatctcggctaactgcaaggtccacctccccagttcaagccattctcctgcctcagcctcccgagtagctgggactacaggcgcccgccaccacacctggctgattttttgtatttttagtagagatggggtttcaccattttagccaggatggtcttgatctcctgacctcgtgatccgcccaactcagcctcccagagggctgggattacaggcgtgagccaccatgcccagccagtacctggttttaacttcatgtcactgaaagaagcactgaggagggcttgaatcactgacaccacctttccaccccccaatagtggctgtgcagtgtggaaagtctgtgtacttggggaagagagagcacagtg

SEQ ID NO: 273804 - DNA, 1208 bp, Homo sapiens
gtgatctctcagcagaatagatttattatttgtattgcttgcagaataaagcctatccttgaaagctctgaatcatgggcagtgagctcagtggtatctgaaggacagggcactggccactgcagtcaccatcttctgccaggaagcctgcacctcaggggtgaattctttgccgaaatggattgccaaaacggtcaccagcacatttcccaggagcttgaagttctcaggatccacatgcagcttgtcacagtgcagttcactcagctgggcaaaggtgcccttgagatcatccaggtgctttgtggcatctcccaaggaagtcagcaccttcttgccatgtgccttgactttggggttgcccatgatggcagaggcagaggacaggttgccaaagctgtcaaagaacctctgggtccatgggtagacaaccaggagccttcccagggtttctcctccagcatcttccacattcaccttgccccacaggcttgtgatagtagccttgtcctcctctgtgaaatgacccatggcgtctggactaggagcttattgataacctcagacgttccagaagcgagtgtaacacagattctcctctgcgctatgtggacattgccatcccatgcaacaacaagggagctcactcagtgggtttgatgtggtggatgctggctcgggaagttctgcgcatgcgtggcaccatttcccgtgaacacccatgggaggtcatgcctgatctgtacttctacagagatcctgaagagattgaaaaagaagagcaggctgctgctgagaaggcagtgaccaaggaggaatttcagggtgaatggactgctcccgctcctgagttcactgctactcagcctgaggttgcagactggtctgaaggtgtacaggtgccctctgtgcctattcagcaattccctactgaagactggagcgctcagcctgccacggaagactggtctgcagctcccactgctcaggccactgaatgggtaggagcaaccactgactggtcttaagctgttcttgcataggctcttaagcagcatggaaaaatggttgatggaaaataaacatcagtttctaaaagttgtcttcatttagtttgctttttactccagatcagaatacctgggattgcatatcaaagcataataataaatacatgtctcgacatgagttgtacttctaaaacccac

SEQ ID NO: 273805 - DNA, 787 bp, Homo sapiens
tgtcttttccgtgctacctgcagaggggtccatacggcgttgttctggattcccgtcgtaacttaaagggaaattttcacaatgtccggagcccttgatgtcctgcaaatgaaggaggaggatgtccttaagttccttgcagcaggaacccacttaggtggcaccaatcttgacttccagatggaacagtacatctataaaaggaaaagtgatggcatctatatcataaatctcaagaggacctgggagaagcttctgctggcagctcgtgcaattgttgccattgaaaaccctgctgatgtcagtgttatatcctccaggaatactggccagagggctgtgctgaagtttgctgctgccactggagccactccaattgctggccgcttcactcctggaaccttcactaaccagatccaggcagccttccgggagccacggcttcttgtggttactgaccccagggctgaccaccagcctctcacggaggcatcttatgttaacctacctaccattgcgctgtgtaacacagattctcctctgcgctatgtggacattgccatcccatgcaacaacaaggtaatgattttaggatctagagtttgtgaatgcgtgctctagaaaaaacattcctgtgcacattgttagagcttggagttgaggctactgactggccgatgaactcgcaagtgtaggtagtgtgctacatgaggggcaagttttcgctaacaccacaagggtctctggcccaatgagtggagtttgatagtaattcttgctacaagta

SEQ ID NO: 273806 - DNA, 826 bp, Homo sapiens
tactaggaccacatagtttgtacacagtagaaaaaagcagttagttattgctgtagaatgaactgagtgacagttcttgcttgcttgagaaaaatatactgagcatctagattgggccaggtagtgttgctaggtgctcgggatatatagtagaaaaacaagcctgtcttttttaatgtatgcaggaaatctctggagaagtaagagaggttaaggaaagctgggtatgtgcctgctttacatggagtagtagtgattaagttggccagtgcccagaagtgcttactgggtgccaggattgttgctgtggaatatcgagtaccactaacttttaaattcttcaaagagggctgtgctgaagtttgctgctgccactggagccactccaattgctggccgcttcactcctggaaccttcactaaccagatccaggcagccttccgggagccacggcttcttgtggttactgaccccagggctgaccaccagcctctcacggaggcatcttatgttaacctacctaccattgcgctgtgtaacacagattctcctctgcgctatgtggacattgccatcccatgcaacaacaagggagctcactcagtgggtttgatgtggtggatgctggctcgggaagttctgcgcatgcgtggcaccatttcccgtgaacacccatgggaggtcatgcctgatctgtacttctacagagatcctgaagagagattgaaaaaaaaaaccggttttttgttgaaaagggctttccccaagggaggaatttggggggaaggggctgtgcccccctccccggattcacgtgttctcacc

SEQ ID NO: 273807 - DNA, 1166 bp, Homo sapiens
  misc_feature (21)..(21): n is a, c, g, or t
tggcaggatgagccgggtgtnaatcggcacgaggctgcagaggggtccatacggcgttgttctggattcccgtcgtaacttaaagggaaattttcacaatgtccggagcccttgatgtcctgcaaatgaaggaggaggatgtccttaagttccttgcagcaggaacccacttaggtggcaccaatcttgacttccagatggaacagtacatctataaaaggaaaagtgatggcatctatatcataaatctcaagaggacctgggagaagcttctgctggcagctcgtgcaattgttgccattgaaaaccctgctgatgtcagtgttatatcctccaggaatactggccagagggctgtgctgaagtttgctgctgccactggagccactccaattgctggccgcttcactcctggaaccttcactaaccagatccaggcagccttccgggagccacggcttcttgtggttactgaccccagggctgaccaccagcctctcacggaggcatcttatgttaacctacctaccattgcgctgtgtaacacagattctcctctgcgctatgtggacattgccatcccatgcaacaacaagggagctcactcagtgggtttgatgtggtggatgctggctcgggaagttctgcgcatgcgtggcaccatttcccgtgaacacccatgggaggtcatgcctgatctgtacttctacagagatcctgaagagattgaaaaagaagagcaggctgctgctgagaaggcagtgaccaaggaggaatttcagggtgaatggactgctcccgctcctgagttcactgctactcagcctgaggttgcagactggtctgaaggtgtacaggtgccctctgtgcctattcagcaattccctactgaagactggagcgctcagcctgccacggaagactggtctgcagctcccactgctcaggccactgaatgggtaggagcaaccactgactggtcttaagctgttcttgcataggctcttaagcagcatggaaaaatggttgatggaaaataaacatcagtttctaaaagttgtcttcatttagtttgctttttactccagatcagaatacctgggattgcatatcaaagcataataataaatacatgtctcgacatgagttgtacttctaaaacccac

SEQ ID NO: 273808 - DNA, 1179 bp, Homo sapiens
  misc_feature (16)..(16): n is a, c, g, or t
caggctggtacccccnggagtattggatatcgtcgaccaggcgctcgctgcagaggggtccatacggcgttgttctggattcccgtcgtaacttaaagggaaattttcacaatgtccggagcccttgatgtcctgcaaatgaaggaggaggatgtccttaagttccttgcagcaggaacccacttaggtggcaccaatcttgacttccagatggaacagtacatctataaaaggaaaagtgatggcatctatatcataaatctcaagaggacctgggagaagcttctgctggcagctcgtgcaattgttgccattgaaaaccctgctgatgtcagtgttatatcctccaggaatactggccagagggctgtgctgaagtttgctgctgccactggagccactccaattgctggccgcttcactcctggaaccttcactaaccagatccaggcagccttccgggagccacggcttcttgtggttactgaccccagggctgaccaccagcctctcacggaggcatcttatgttaacctacctaccattgcgctgtgtaacacagattctcctctgcgctatgtggacattgccatcccatgcaacaacaagggagctcactcagtgggtttgatgtggtggatgctggctcgggaagttctgcgcatgcgtggcaccatttcccgtgaacacccatgggaggtcatgcctgatctgtacttctacagagatcctgaagagattgaaaaagaagagcaggctgctgctgagaaggcagtgaccaaggaggaatttcagggtgaatggactgctcccgctcctgagttcactgctactcagcctgaggttgcagactggtctgaaggtgtacaggtgccctctgtgcctattcagcaattccctactgaagactggagcgctcagcctgccacggaagactggtctgcagctcccactgctcaggccactgaatgggtaggagcaaccactgactggtcttaagctgttcttgcataggctcttaagcagcatggaaaaatggttgatggaaaataaacatcagtttctaaaagttgtcttcatttagtttgctttttactccagatcagaatacctgggattgcatatcaaagcataataataaatacatgtctcgacatgagttgtacttctaaaacccac

SEQ ID NO: 273809 - DNA, 1161 bp, Homo sapiens
aaatatacgctaggtagcgaggctgggtggcgcagaggggtccatacggcgttgttctggattcccgtcgtaacttaaagggaaattttcacaatgtccggagcccttgatgtcctgcaaatgaaggaggaggatgtccttaagttccttgcagcaggaacccacttaggtggcaccaatcttgacttccagatggaacagtacatctataaaaggaaaagtgatggcatctatatcataaatctcaagaggacctgggagaagcttctgctggcagctcgtgcaattgttgccattgaaaaccctgctgatgtcagtgttatatcctccaggaatactggccagagggctgtgctgaagtttgctgctgccactggagccactccaattgctggccgcttcactcctggaaccttcactaaccagatccaggcagccttccgggagccacggcttcttgtggttactgaccccagggctgaccaccagcctctcacggaggcatcttatgttaacctacctaccattgcgctgtgtaacacagattctcctctgcgctatgtggacattgccatcccatgcaacaacaagggagctcactcagtgggtttgatgtggtggatgctggctcgggaagttctgcgcatgcgtggcaccatttcccgtgaacacccatgggaggtcatgcctgatctgtacttctacagagatcctgaagagattgaaaaagaagagcaggctgctgctgagaaggcagtgaccaaggaggaatttcagggtgaatggactgctcccgctcctgagttcactgctactcagcctgaggttgcagactggtctgaaggtgtacaggtgccctctgtgcctattcagcaattccctactgaagactggagcgctcagcctgccacggaagactggtctgcagctcccactgctcaggccactgaatgggtaggagcaaccactgactggtcttaagctgttcttgcataggctcttaagcagcatggaaaaatggttgatggaaaataaacatcagtttctaaaagttgtcttcatttagtttgctttttactccagatcagaatacctgggattgcatatcaaagcataataataaatacatgtctcgacatgagttgtacttctaaaacccac

SEQ ID NO: 273810 - DNA, 1154 bp, Homo sapiens
ccacgcgtcgccacgcgtcgccacgcagaggggtccatacggcgttgttctggattcccgtcgtaacttaaagggaaattttcacaatgtccggagcccttgatgtcctgcaaatgaaggaggaggatgtccttaagttccttgcagcaggaacccacttaggtggcaccaatcttgacttccagatggaacagtacatctataaaaggaaaagtgatggcatctatatcataaatctcaagaggacctgggagaagcttctgctggcagctcgtgcaattgttgccattgaaaaccctgctgatgtcagtgttatatcctccaggaatactggccagagggctgtgctgaagtttgctgctgccactggagccactccaattgctggccgcttcactcctggaaccttcactaaccagatccaggcagccttccgggagccacggcttcttgtggttactgaccccagggctgaccaccagcctctcacggaggcatcttatgttaacctacctaccattgcgctgtgtaacacagattctcctctgcgctatgtggacattgccatcccatgcaacaacaagggagctcactcagtgggtttgatgtggtggatgctggctcgggaagttctgcgcatgcgtggcaccatttcccgtgaacacccatgggaggtcatgcctgatctgtacttctacagagatcctgaagagattgaaaaagaagagcaggctgctgctgagaaggcagtgaccaaggaggaatttcagggtgaatggactgctcccgctcctgagttcactgctactcagcctgaggttgcagactggtctgaaggtgtacaggtgccctctgtgcctattcagcaattccctactgaagactggagcgctcagcctgccacggaagactggtctgcagctcccactgctcaggccactgaatgggtaggagcaaccactgactggtcttaagctgttcttgcataggctcttaagcagcatggaaaaatggttgatggaaaataaacatcagtttctaaaagttgtcttcatttagtttgctttttactccagatcagaatacctgggattgcatatcaaagcataataataaatacatgtctcgacatgagttgtacttctaaaacccac

SEQ ID NO: 273811 - DNA, 1188 bp, Homo sapiens
gagagagagagagagagagagagagagagagagagagagagagagagagagagagagagcagaggggtccatacggcgttgttctggattcccgtcgtaacttaaagggaaattttcacaatgtccggagcccttgatgtcctgcaaatgaaggaggaggatgtccttaagttccttgcagcaggaacccacttaggtggcaccaatcttgacttccagatggaacagtacatctataaaaggaaaagtgatggcatctatatcataaatctcaagaggacctgggagaagcttctgctggcagctcgtgcaattgttgccattgaaaaccctgctgatgtcagtgttatatcctccaggaatactggccagagggctgtgctgaagtttgctgctgccactggagccactccaattgctggccgcttcactcctggaaccttcactaaccagatccaggcagccttccgggagccacggcttcttgtggttactgaccccagggctgaccaccagcctctcacggaggcatcttatgttaacctacctaccattgcgctgtgtaacacagattctcctctgcgctatgtggacattgccatcccatgcaacaacaagggagctcactcagtgggtttgatgtggtggatgctggctcgggaagttctgcgcatgcgtggcaccatttcccgtgaacacccatgggaggtcatgcctgatctgtacttctacagagatcctgaagagattgaaaaagaagagcaggctgctgctgagaaggcagtgaccaaggaggaatttcagggtgaatggactgctcccgctcctgagttcactgctactcagcctgaggttgcagactggtctgaaggtgtacaggtgccctctgtgcctattcagcaattccctactgaagactggagcgctcagcctgccacggaagactggtctgcagctcccactgctcaggccactgaatgggtaggagcaaccactgactggtcttaagctgttcttgcataggctcttaagcagcatggaaaaatggttgatggaaaataaacatcagtttctaaaagttgtcttcatttagtttgctttttactccagatcagaatacctgggattgcatatcaaagcataataataaatacatgtctcgacatgagttgtacttctaaaacccac

SEQ ID NO: 273812 - DNA, 1080 bp, Homo sapiens
  misc_feature (21)..(21): n is a, c, g, or t
tggcaggatgagccgggtgtnaatcggcacgaggctgcagaggggtccatacggcgttgttctggattcccgtcgtaacttaaagggaaattttcacaatgtccggagcccttgatgtcctgcaaatgaaggaggaggatgtccttaagttccttgcagcaggaacccacttaggtggcaccaatcttgacttccagatggaacagtacatctataaaaggaaaagtgatggcatctatatcataaatctcaagaggacctgggagaagcttctgctggcagctcgtgcaattgttgccattgaaaaccctgctgatgtcagtgttatatcctccaggaatactggccagagggctgtgctgaagtttgctgctgccactggagccactccaattgctggccgcttcactcctggaaccttcactaaccagatccaggcagccttccgggagccacggcttcttgtggttactgaccccagggctgaccaccagcctctcacggaggcatcttatgttaacctacctaccattgcgctgtgtaacacagattctcctctgcgctatgtggacattgccatcccatgcaacaacaagggagctcactcagtgggtttgatgtggtggatgctggctcgggaagttctgcgcatgcgtggcaccatttcccgtgaacacccatgggaggtcatgcctgatctgtacttctacagagatcctgaagagattgaaaaagaagagcaggctgctgctgagaaggcagtgaccaaggaggaatttcagggtgaatggactgctcccgctcctgagttcactgctactcagcctgaggttgcagactggtctgaaggtgtacaggtgccctctgtgcctattcagcaattccctactgaagactggagcgctcagcctgccacggaagactggtctgcagctcccactgctcaggccactgaatgggtaggagcaaccactgactggtcttaagctgttcttgcataggctcttaagcagcatggaaaaatggttgatggaaaataaacatcacaccacacccaaccccacaacccattctcgggca

SEQ ID NO: 273813 - DNA, 1164 bp, Homo sapiens
  misc_feature (21)..(21): n is a, c, g, or t
tggcaggatgagccgggtgtnaatcggcacgaggctgcagaggggtccatacggcgttgttctggattcccgtcgtaacttaaagggaaattttcacaatgtccggagcccttgatgtcctgcaaatgaaggaggaggatgtccttaagttccttgcagcaggaacccacttaggtggcaccaatcttgacttccagatggaacagtacatctataaaaggaaaagtgatggcatctatatcataaatctcaagaggacctgggagaagcttctgctggcagctcgtgcaattgttgccattgaaaaccctgctgatgtcagtgttatatcctccaggaatactggccagagggctgtgctgaagtttgctgctgccactggagccactccaattgctggccgcttcactcctggaaccttcactaaccagatccaggcagccttccgggagccacggcttcttgtggttactgaccccagggctgaccaccagcctctcacggaggcatcttatgttaacctacctaccattgcgctgtgtaacacagattctcctctgcgctatgtggacattgccatcccatgcaacaacaagggagctcactcagtgggtttgatgtggtggatgctggctcgggaagttctgcgcatgcgtggcaccatttcccgtgaacacccatgggaggtcatgcctgatctgtacttctacagagatcctgaagagattgaaaaagaagagcaggctgctgctgagaaggcagtgaccaaggaggaatttcagggtgaatggactgctcccgctcctgagttcactgctactcagcctgaggttgcagactggtctgaaggtgtacaggtgccctctgtgcctattcagcaattccctactgaagactggagcgctcagcctgccacggaagactggtctgcagctcccactgctcaggccactgaatgggtaggagcaaccactgactggtcttaagctgttcttgcataggctcttaagcagcatggaaaaatggttgatggaaaataaacatcacagatgacatcaacagtggatgcatgatggaatgccacagccagttaagcacaaaaggaaaacatttcaataaaggatcatttgaacaagcgtggtgcacaccaaatatataccccgg

SEQ ID NO: 273814 - DNA, 1378 bp, Homo sapiens
  misc_feature (21)..(21): n is a, c, g, or t
tggcaggatgagccgggtgtnaatcggcacgaggctgcagaggggtccatacggcgttgttctggattcccgtcgtaacttaaagggaaattttcacaatgtccggagcccttgatgtcctgcaaatgaaggaggaggatgtccttaagttccttgcagcaggaacccacttaggtggcaccaatcttgacttccagatggaacagtacatctataaaaggaaaagtgatggcatctatatcataaatctcaagaggacctgggagaagcttctgctggcagctcgtgcaattgttgccattgaaaaccctgctgatgtcagtgttatatcctccaggaatactggccagagggctgtgctgaagtttgctgctgccactggagccactccaattgctggccgcttcactcctggaaccttcactaaccagatccaggcagccttccgggagccacggcttcttgtggttactgaccccagggctgaccaccagcctctcacggaggcatcttatgttaacctacctaccattgcgctgtgtaacacagattctcctctgcgctatgtggacattgccatcccatgcaacaacaagggagctcactcagtgggtttgatgtggtggatgctggctcgggaagttctgcgcatgcgtggcaccatttcccgtgaacacccatgggaggtcatgcctgatctgtacttctacagagatcctgaagagattgaaaaagaagagcaggctgctgctgagaaggcagtgaccaaggaggaatttcagggtgaatggactgctcccgctcctgagttcactgctactcagcctgaggttgcagactggtctgaaggtgtacaggtgccctctgtgcctattcagcaattccctactggtatgtatcaggatagaggtgaatcaagctgatattttgcaacttctcagttttattctaactttaatgatctctgtgacttttatactagctttaagaggttttcattccagtgtgctacagcatctgatagactgctgttgggagtggggtaaggaaaaatactacattgaggacagagctgatggctttttttggtattctcttaacagaagactggagcgctcagcctgccacggaagactggtctgcagctcccactgctcaggccactgaatgggtaggagcaaccactgactggtcttaagctgttcttgcataggctcttaagcagcatggaaaaatggttgatggaaaataaacatcagtttctaaaagttgtcttcatttagtttgctttttactccagatcagaatacctgggattgcatatcaaagcataataataaatacatgtctcgacatgagttgtacttctaaaacccac

SEQ ID NO: 273815 - DNA, 1331 bp, Homo sapiens
ggttcactgctactcagcctgaggttgcagactggtctgaaggtgtacaggtgccctctgtgcctattcagcaattccctactgaagactggagcgctcagcctgccacggaagactggtctgcagctcccactgctcaggccactgaatgggtaggagcaaccactgactgggtcttaagaggctatggcaatctgctcagtgggtccactaatgcggcgttgttctggattcccgtcgtaacttaaagggaaattttcacaatgtccggagcccttgatgtcctgcaaatgaaggaggaggatgtccttaagttccttgcagcaggaacccacttaggtggcaccaatcttgacttccagatggaacagtacatctataaaaggaaaagtgatggcatctatatcataaatctcaagaggacctgggagaagcttctgctggcagctcgtgcaattgttgccattgaaaaccctgctgatgtcagtgttatatcctccaggaatactggccagagggctgtgctgaagtttgctgctgccactggagccactccaattgctggccgcttcactcctggaaccttcactaaccagatccaggcagccttccgggagccacggcttcttgtggttactgaccccagggctgaccaccagcctctcacggaggcatcttatgttaacctacctaccattgcgctgtgtaacacagattctcctctgcgctatgtggacattgccatcccatgcaacaacaagggagctcactcagtgggtttgatgtggtggatgctggctcgggaagttctgcgcatgcgtggcaccatttcccgtgaacacccatgggaggtcatgcctgatctgtacttctacagagatcctgaagagattgaaaaagaagagcaggctgctgctgagaaggcagtgaccaaggaggaatttcagggtgaatggactgctcccgctcctgagttcactgctactcagcctgaggttgcagactggtctgaaggtgtacaggtgccctctgtgcctattcagcaattccctactgaagactggagcgctcagcctgccacggaagactggtctgcagctcccactgctcaggccactgaatgggtaggagcaaccactgactggtcttaagctgttcttgcataggctcttaagcagcatggaaaaatggttgatggaaaataaacatcagtttctaaaagttgtcttcatttagtttgctttttactccagatcagaatacctgggattgcatatcaaagcataataataaatacatgtctcgacatgagttgtacttctaaaacccac

SEQ ID NO: 273816 - DNA, 1399 bp, Homo sapiens
ctggcgccttccagggctagaaaaatgagcttttcctgctcaaatgaagggtgagaagactagtgatgaaagccggtcagactggatctgtctcccgcccggcgcgccccaccttaggcctgcggcccgcacgtggccaggctcgggctggcgggttcccagagtgccccgggagcgggtggaggccgccctccagcggaggctccgagctggggttcggaccaggccgcgggtgggcgggagtgcagaaagcgggctaacatcctgtgttgctatcccttcggagtcccacacggcgattcccgtcgtaacttaaagggaaattttcacaatgtccggagcccttgatgtcctgcaaatgaaggaggaggatgtccttaagttccttgcagcaggaacccacttaggtggcaccaatcttgacttccagatggaacagtacatctataaaaggaaaagtgatggcatctatatcataaatctcaagaggacctgggagaagcttctgctggcagctcgtgcaattgttgccattgaaaaccctgctgatgtcagtgttatatcctccaggaatactggccagagggctgtgctgaagtttgctgctgccactggagccactccaattgctggccgcttcactcctggaaccttcactaaccagatccaggcagccttccgggagccacggcttcttgtggttactgaccccagggctgaccaccagcctctcacggaggcatcttatgttaacctacctaccattgcgctgtgtaacacagattctcctctgcgctatgtggacattgccatcccatgcaacaacaagggagctcactcagtgggtttgatgtggtggatgctggctcgggaagttctgcgcatgcgtggcaccatttcccgtgaacacccatgggaggtcatgcctgatctgtacttctacagagatcctgaagagattgaaaaagaagagcaggctgctgctgagaaggcagtgaccaaggaggaatttcagggtgaatggactgctcccgctcctgagttcactgctactcagcctgaggttgcagactggtctgaaggtgtacaggtgccctctgtgcctattcagcaattccctactgaagactggagcgctcagcctgccacggaagactggtctgcagctcccactgctcaggccactgaatgggtaggagcaaccactgactggtcttaagctgttcttgcataggctcttaagcagcatggaaaaatggttgatggaaaataaacatcagtttctaaaagttgtcttcatttagtttgctttttactccagatcagaatacctgggattgcatatcaaagcataataataaatacatgtctcgacatgagttgtacttctaaaacccac

SEQ ID NO: 273817 - DNA, 1149 bp, Homo sapiens
tgtcttttccgtgctacctgcagaggggtccatacggcgttgttctggattcccgtcgtaacttaaagggaaattttcacaatgtccggagcccttgatgtcctgcaaatgaaggaggaggatgtccttaagttccttgcagcaggaacccacttaggtggcaccaatcttgacttccagatggaacagtacatctataaaaggaaaagtgatggcatctatatcataaatctcaagaggacctgggagaagcttctgctggcagctcgtgcaattgttgccattgaaaaccctgctgatgtcagtgttatatcctccaggaatactggccagagggctgtgctgaagtttgctgctgccactggagccactccaattgctggccgcttcactcctggaaccttcactaaccagatccaggcagccttccgggagccacggcttcttgtggttactgaccccagggctgaccaccagcctctcacggaggcatcttatgttaacctacctaccattgcgctgtgtaacacagattctcctctgcgctatgtggacattgccatcccatgcaacaacaagggagctcactcagtgggtttgatgtggtggatgctggctcgggaagttctgcgcatgcgtggcaccatttcccgtgaacacccatgggaggtcatgcctgatctgtacttctacagagatcctgaagagattgaaaaagaagagcaggctgctgctgagaaggcagtgaccaaggaggaatttcagggtgaatggactgctcccgctcctgagttcactgctactcagcctgaggttgcagactggtctgaaggtgtacaggtgccctctgtgcctattcagcaattccctactgaagactggagcgctcagcctgccacggaagactggtctgcagctcccactgctcaggccactgaatgggtaggagcaaccactgactggtcttaagctgttcttgcataggctcttaagcagcatggaaaaatggttgatggaaaataaacatcagtttctaaaagttgtcttcatttagtttgctttttactccagatcagaatacctgggattgcatatcaaagcataataataaatacatgtctcgacatgagttgtacttctaaaacccac

SEQ ID NO: 273818 - DNA, 1157 bp, Homo sapiens
ggcgttttcacgtgctgaccatgcaagcagtgggtccatacgtgcgtcgttcatggattcccgtcgtaacttaaagggaaattttcacaatgtccggagcccttgatgtcctgcaaatgaaggaggaggatgtccttaagttccttgcagcaggaacccacttaggtggcaccaatcttgacttccagatggaacagtacatctataaaaggaaaagtgatggcatctatatcataaatctcaagaggacctgggagaagcttctgctggcagctcgtgcaattgttgccattgaaaaccctgctgatgtcagtgttatatcctccaggaatactggccagagggctgtgctgaagtttgctgctgccactggagccactccaattgctggccgcttcactcctggaaccttcactaaccagatccaggcagccttccgggagccacggcttcttgtggttactgaccccagggctgaccaccagcctctcacggaggcatcttatgttaacctacctaccattgcgctgtgtaacacagattctcctctgcgctatgtggacattgccatcccatgcaacaacaagggagctcactcagtgggtttgatgtggtggatgctggctcgggaagttctgcgcatgcgtggcaccatttcccgtgaacacccatgggaggtcatgcctgatctgtacttctacagagatcctgaagagattgaaaaagaagagcaggctgctgctgagaaggcagtgaccaaggaggaatttcagggtgaatggactgctcccgctcctgagttcactgctactcagcctgaggttgcagactggtctgaaggtgtacaggtgccctctgtgcctattcagcaattccctactgaagactggagcgctcagcctgccacggaagactggtctgcagctcccactgctcaggccactgaatgggtaggagcaaccactgactggtcttaagctgttcttgcataggctcttaagcagcatggaaaaatggttgatggaaaataaacatcagtttctaaaagttgtcttcatttagtttgctttttactccagatcagaatacctgggattgcatatcaaagcataataataaatacatgtctcgacatgagttgtacttctaaaacccac

SEQ ID NO: 273819 - DNA, 1151 bp, Homo sapiens
ctggcgccttccagggctagaaaaatgagcttttcctgctcaaatgaaggattcccgtcgtaacttaaagggaaattttcacaatgtccggagcccttgatgtcctgcaaatgaaggaggaggatgtccttaagttccttgcagcaggaacccacttaggtggcaccaatcttgacttccagatggaacagtacatctataaaaggaaaagtgatggcatctatatcataaatctcaagaggacctgggagaagcttctgctggcagctcgtgcaattgttgccattgaaaaccctgctgatgtcagtgttatatcctccaggaatactggccagagggctgtgctgaagtttgctgctgccactggagccactccaattgctggccgcttcactcctggaaccttcactaaccagatccaggcagccttccgggagccacggcttcttgtggttactgaccccagggctgaccaccagcctctcacggaggcatcttatgttaacctacctaccattgcgctgtgtaacacagattctcctctgcgctatgtggacattgccatcccatgcaacaacaagggagctcactcagtgggtttgatgtggtggatgctggctcgggaagttctgcgcatgcgtggcaccatttcccgtgaacacccatgggaggtcatgcctgatctgtacttctacagagatcctgaagagattgaaaaagaagagcaggctgctgctgagaaggcagtgaccaaggaggaatttcagggtgaatggactgctcccgctcctgagttcactgctactcagcctgaggttgcagactggtctgaaggtgtacaggtgccctctgtgcctattcagcaattccctactgaagactggagcgctcagcctgccacggaagactggtctgcagctcccactgctcaggccactgaatgggtaggagcaaccactgactggtcttaagctgttcttgcataggctcttaagcagcatggaaaaatggttgatggaaaataaacatcagtttctaaaagttgtcttcatttagtttgctttttactccagatcagaatacctgggattgcatatcaaagcataataataaatacatgtctcgacatgagttgtacttctaaaacccac

SEQ ID NO: 273820 - DNA, 1969 bp, Homo sapiens
tgtcttttccgtgctacctgcagaggggtccatacggcgttgttctggattcccgtcgtaacttaaagggaaattttcacaatgtccggagcccttgatgtcctgcaaatgaaggaggaggatgtccttaagttccttgcagcaggaacccacttaggtggcaccaatcttgacttccagatggaacagtacatctataaaaggaaaagtgatgggttagtcattgctttaattttttgttactccagctgtaagtacaaattttgagcttgctattctcgtggttagttctgggtaatttctttctatcttccttaaatgaagccagacccctacgttgaaaacatactttaaataaatgttcttgttattgagagaaaagatttctgctccaggggaggaatatgtcagttgtctgagttacgggacttgggttgggtcatgaacatgagaaagttcattggctgagtttctaatagctcgcatagtgccttcaacttcataggtacttacacaggctattgaactgaattttgagtggaaagtggggtaagaggtgggaatgaacaatatggtttggaagaaccagaggatggaaggcattaagttggctaaggcacttacttattttagagataaagctaccaaggacttgggagtgacatgctgtaaaggagttttaggatgaatcttgcatcagtgcagattataaaagggaaagagtggcagaaagccaggaagtggattcttaagaaccaatgatggaataagtacagggaaagagaaaggaaagatggatttagccaactgaatctaggctgcacactattaaagctcagggtggaggccagtcttggctcatgaacttctgagtgtcggaagtgtgctatatcaatggcaggattttcgctaacaccagtagagcttgcctctatgactggagtttggtagtactcgctgccacatagagtaaacttgagaagaatgtttgcacagccaggtcaagtgttacaaatccttctgccctcacttaggcatctatatcataaatctcaagaggacctgggagaagcttctgctggcagctcgtgcaattgttgccattgaaaaccctgctgatgtcagtgttatatcctccaggaatactggccagagggctgtgctgaagtttgctgctgccactggagccactccaattgctggccgcttcactcctggaaccttcactaaccagatccaggcagccttccgggagccacggcttcttgtggttactgaccccagggctgaccaccagcctctcacggaggcatcttatgttaacctacctaccattgcgctgtgtaacacagattctcctctgcgctatgtggacattgccatcccatgcaacaacaagggagctcactcagtgggtttgatgtggtggatgctggctcgggaagttctgcgcatgcgtggcaccatttcccgtgaacacccatgggaggtcatgcctgatctgtacttctacagagatcctgaagagattgaaaaagaagagcaggctgctgctgagaaggcagtgaccaaggaggaatttcagggtgaatggactgctcccgctcctgagttcactgctactcagcctgaggttgcagactggtctgaaggtgtacaggtgccctctgtgcctattcagcaattccctactgaagactggagcgctcagcctgccacggaagactggtctgcagctcccactgctcaggccactgaatgggtaggagcaaccactgactggtcttaagctgttcttgcataggctcttaagcagcatggaaaaatggttgatggaaaataaacatcagtttctaaaagttgtcttcatttagtttgctttttactccagatcagaatacctgggattgcatatcaaagcataataataaatacatgtctcgacatgagttgtacttctaaaacccac

SEQ ID NO: 273821 - DNA, 1185 bp, Homo sapiens
tgtcttttccgtgctacctgcagaggggtccatacggcgttgttctggattcccgtcgtaacttaaagggaaattttcacaatgtccggagcccttgatgtcctgcaaatgaaggaggaggatgtccttaagttccttgcagcaggaacccacttaggtggcaccaatcttgacttccagatggaacagtacatctataaaaggaaaagtgatgggttagtcattgctttaattttttgttactccagctgcatctatatcataaatctcaagaggacctgggagaagcttctgctggcagctcgtgcaattgttgccattgaaaaccctgctgatgtcagtgttatatcctccaggaatactggccagagggctgtgctgaagtttgctgctgccactggagccactccaattgctggccgcttcactcctggaaccttcactaaccagatccaggcagccttccgggagccacggcttcttgtggttactgaccccagggctgaccaccagcctctcacggaggcatcttatgttaacctacctaccattgcgctgtgtaacacagattctcctctgcgctatgtggacattgccatcccatgcaacaacaagggagctcactcagtgggtttgatgtggtggatgctggctcgggaagttctgcgcatgcgtggcaccatttcccgtgaacacccatgggaggtcatgcctgatctgtacttctacagagatcctgaagagattgaaaaagaagagcaggctgctgctgagaaggcagtgaccaaggaggaatttcagggtgaatggactgctcccgctcctgagttcactgctactcagcctgaggttgcagactggtctgaaggtgtacaggtgccctctgtgcctattcagcaattccctactgaagactggagcgctcagcctgccacggaagactggtctgcagctcccactgctcaggccactgaatgggtaggagcaaccactgactggtcttaagctgttcttgcataggctcttaagcagcatggaaaaatggttgatggaaaataaacatcagtttctaaaagttgtcttcatttagtttgctttttactccagatcagaatacctgggattgcatatcaaagcataataataaatacatgtctcgacatgagttgtacttctaaaacccac

SEQ ID NO: 273822 - DNA, 1856 bp, Homo sapiens
agagtatgaggtccttttagctctcgtgacgagaaccggcggatgtggcaccaatcttgacttccagatggaacagtacatctataaaaggaaaagtgatgggttagtcattgctttaattttttgttactccagctgtaagtacaaattttgagcttgctattctcgtggttagttctgggtaatttctttctatcttccttaaatgaagccagacccctacgttgaaaacatactttaaataaatgttcttgttattgagagaaaagatttctgctccaggggaggaatatgtcagttgtctgagttacgggacttgggttgggtcatgaacatgagaaagttcattggctgagtttctaatagctcgcatagtgccttcaacttcataggtacttacacaggctattgaactgaattttgagtggaaagtggggtaagaggtgggaatgaacaatatggtttggaagaaccagaggatggaaggcattaagttggctaaggcacttacttattttagagataaagctaccaaggacttgggagtgacatgctgtaaaggagttttaggatgaatcttgcatcagtgcagattataaaagggaaagagtggcagaaagccaggaagtggattcttaagaaccaatgatggaataagtacagggaaagagaaaggaaagatggatttagccaactgaatctaggctgcacactattaaagctcagggtggaggccagtcttggctcatgaacttctgagtgtcggaagtgtgctatatcaatggcaggattttcgctaacaccagtagagcttgcctctatgactggagtttggtagtactcgctgccacatagagtaaacttgagaagaatgtttgcacagccaggtcaagtgttacaaatccttctgccctcacttaggcatctatatcataaatctcaagaggacctgggagaagcttctgctggcagctcgtgcaattgttgccattgaaaaccctgctgatgtcagtgttatatcctccaggaatactggccagagggctgtgctgaagtttgctgctgccactggagccactccaattgctggccgcttcactcctggaaccttcactaaccagatccaggcagccttccgggagccacggcttcttgtggttactgaccccagggctgaccaccagcctctcacggaggcatcttatgttaacctacctaccattgcgctgtgtaacacagattctcctctgcgctatgtggacattgccatcccatgcaacaacaagggagctcactcagtgggtttgatgtggtggatgctggctcgggaagttctgcgcatgcgtggcaccatttcccgtgaacacccatgggaggtcatgcctgatctgtacttctacagagatcctgaagagattgaaaaagaagagcaggctgctgctgagaaggcagtgaccaaggaggaatttcagggtgaatggactgctcccgctcctgagttcactgctactcagcctgaggttgcagactggtctgaaggtgtacaggtgccctctgtgcctattcagcaattccctactgaagactggagcgctcagcctgccacggaagactggtctgcagctcccactgctcaggccactgaatgggtaggagcaaccactgactggtcttaagctgttcttgcataggctcttaagcagcatggaaaaatggttgatggaaaataaacatcagtttctaaaagttgtcttcatttagtttgctttttactccagatcagaatacctgggattgcatatcaaagcataataataaatacatgtctcgacatgagttgtacttctaaaacccac

SEQ ID NO: 273823 - DNA, 1066 bp, Homo sapiens
tgtcttttccgtgctacctgcagaggggtccatacggcgttgttctggattcccgtcgtaacttaaagggaaattttcacaatgtccggagcccttgatgtcctgcaaatgaaggaggaggatgtccttaagcatctatatcataaatctcaagaggacctgggagaagcttctgctggcagctcgtgcaattgttgccattgaaaaccctgctgatgtcagtgttatatcctccaggaatactggccagagggctgtgctgaagtttgctgctgccactggagccactccaattgctggccgcttcactcctggaaccttcactaaccagatccaggcagccttccgggagccacggcttcttgtggttactgaccccagggctgaccaccagcctctcacggaggcatcttatgttaacctacctaccattgcgctgtgtaacacagattctcctctgcgctatgtggacattgccatcccatgcaacaacaagggagctcactcagtgggtttgatgtggtggatgctggctcgggaagttctgcgcatgcgtggcaccatttcccgtgaacacccatgggaggtcatgcctgatctgtacttctacagagatcctgaagagattgaaaaagaagagcaggctgctgctgagaaggcagtgaccaaggaggaatttcagggtgaatggactgctcccgctcctgagttcactgctactcagcctgaggttgcagactggtctgaaggtgtacaggtgccctctgtgcctattcagcaattccctactgaagactggagcgctcagcctgccacggaagactggtctgcagctcccactgctcaggccactgaatgggtaggagcaaccactgactggtcttaagctgttcttgcataggctcttaagcagcatggaaaaatggttgatggaaaataaacatcagtttctaaaagttgtcttcatttagtttgctttttactccagatcagaatacctgggattgcatatcaaagcataataataaatacatgtctcgacatgagttgtacttctaaaacccac

SEQ ID NO: 273824 - DNA, 1162 bp, Homo sapiens
tactaggaccacatagtttgtacacagtagaaaaaagcagttagttattgctgtagaatgaactgagtgacagttcttgcttgcttgagaaaaatatactgagcatctagattgggccaggtagtgttgctaggtgctcgggatatatagtagaaaaacaagcctgtcttttttaatgtatgcaggaaatctctggagaagtaagagaggttaaggaaagctgggtatgtgcctgctttacatggagtagtagtgattaagttggccagtgcccagaagtgcttactgggtgccaggattgttgctgtggaatatcgagtaccactaacttttaaattcttcaaagagggctgtgctgaagtttgctgctgccactggagccactccaattgctggccgcttcactcctggaaccttcactaaccagatccaggcagccttccgggagccacggcttcttgtggttactgaccccagggctgaccaccagcctctcacggaggcatcttatgttaacctacctaccattgcgctgtgtaacacagattctcctctgcgctatgtggacattgccatcccatgcaacaacaagggagctcactcagtgggtttgatgtggtggatgctggctcgggaagttctgcgcatgcgtggcaccatttcccgtgaacacccatgggaggtcatgcctgatctgtacttctacagagatcctgaagagattgaaaaagaagagcaggctgctgctgagaaggcagtgaccaaggaggaatttcagggtgaatggactgctcccgctcctgagttcactgctactcagcctgaggttgcagactggtctgaaggtgtacaggtgccctctgtgcctattcagcaattccctactgaagactggagcgctcagcctgccacggaagactggtctgcagctcccactgctcaggccactgaatgggtaggagcaaccactgactggtcttaagctgttcttgcataggctcttaagcagcatggaaaaatggttgatggaaaataaacatcagtttctaaaagttgtcttcatttagtttgctttttactccagatcagaatacctgggattgcatatcaaagcataataataaatacatgtctcgacatgagttgtacttctaaaacccac

SEQ ID NO: 273825 - DNA, 804 bp, Homo sapiens
  misc_feature (21)..(21): n is a, c, g, or t
tggcaggatgagccgggtgtnaatcggcacgaggctgcagaggggtccatacggcgttgttctggattcccgtcgtaacttaaagggaaattttcacaatgtccggagcccttgatgtcctgcaaatgaaggaggaggatgtccttaagttccttgcagcaggaacccacttaggtggcaccaatcttgacttccagatggaacagtacatctataaaaggaaaagtgatggcatctatatcataaatctcaagaggacctgggagaagcttctgctggcagctcgtgcaattgttgccattgaaaaccctgctgatgtcagtgttatatcctccaggaatactggccagagggctgtgctgaagtttgctgctgccactggagccactccaattgctggccgcttcactcctggaaccttcactaaccagatccaggcagccttccgggagccacggcttcttgtggttactgaccccagggctgaccaccagcctctcacggaggcatcttatgttaacctacctaccattgcgctgtgtaacacagattctcctctgcgctatgtggacattgccatcccatgcaacaacaaggtaatgattttaggatctagagtttgtgaatgcgtgctctagaaaaaacattcctgtgcacattgttagagcttggagttgaggctactgactggccgatgaactcgcaagtgtaggtagtgtgctacatgaggggcaagttttcgctaacaccacaagggtctctggcccaatgagtggagtttgatagtaattcttgctacaagta

SEQ ID NO: 273826 - DNA, 531 bp, Homo sapiens
catgccctgtcccccgtcctgatggccatgccccgtcctggcccatgggaggtcatgcctgatctgtacttctacagagatcctgaagagattgaaaaagaagagcaggctgctgctgagaaggcagtgaccaaggaggaatttcagggtgaatggactgctcccgctcctgagttcactgctactcagcctgaggttgcagactggtctgaaggtgtacaggtgccctctgtgcctattcagcaattccctactgaagactggagcgctcagcctgccacggaagactggtctgcagctcccactgctcaggccactgaatgggtaggagcaaccactgactggtcttaagctgttcttgcataggctcttaagcagcatggaaaaatggttgatggaaaataaacatcagtttctaaaagttgtcttcatttagtttgctttttactccagatcagaatacctgggattgcatatcaaagcataataataaatacatgtctcgacatgagttgtacttctaaaacccac

SEQ ID NO: 273827 - DNA, 1215 bp, Homo sapiens
tgtcttttccgtgctacctgcagaggggtccatacggcgttgttctggattcccgtcgtaacttaaagggaaattttcacaatgtccggagcccttgatgtcctgcaaatgaaggaggaggatgtccttaagttccttgcagcaggaacccacttaggtggcaccaatcttgacttccagatggaacagtacatctataaaaggaaaagtgatgggttagtcattgctttaattttttgttactccagctgtaagtacaaattttgagcttgctattctcgtggttagttctgggtaatttctttctatcttccttaaatgaagccagacccctacgttgaaaacatactttaaataaatgttcttgttattgagagaaaagatttctgctccaggggaggaatatgtcagttgtctgagttacgggacttgggttgggtcatgaacatgagaaagttcattggctgagtttctaatagctcgcatagtgccttcaacttcataggtacttacacaggctattgaactgaattttgagtggaaagtggggtaagaggtgggaatgaacaatatggtttggaagaaccagaggatggaaggcattaagttggctaaggcacttacttattttagagataaagctaccaaggacttgggagtgacatgctgtaaaggagttttaggatgaatcttgcatcagtgcagattataaaagggaaagagtggcagaaagccaggaagtggattcttaagaaccaatgatggaataagtacagggaaagagaaaggaaagatggatttagccaactgaatctaggctgcacactattaaagctcagggtggaggccagtcttggctcatgaacttctgagtgtcggaagtgtgctatatcaatggcaggattttcgctaacaccagtagagcttgcctctatgactggagtttggtagtactcgctgccacatagagtaaacttgagaagaatgtttgcacagccaggtcaagtgttacaaatccttctgccctcacttaggcatctatatcataaatctcaagaggacctgggagaagcttctgctggcagctcgtgcaattgttgccattgaaaaccctgctgatgtcagtgttatatcctccaggaatactggccagtttgtggaacagtggttagtttttatattatagaaataaagcttacagacattgtgagacat

SEQ ID NO: 273828 - DNA, 369 bp, Homo sapiens
gagagagagagagagagagagagagagagagagagagagagagagagagagagagagagcagaggggtccatacggcgttgttctggattcccgtcgtaacttaaagggaaattttcacaatgtccggagcccttgatgtcctgcaaatgaaggaggaggatgtccttaagttccttgcagcaggaacccacttaggtggcaccaatcttgacttccagatggaacagtacatctataaaaggaaaagtgatggcatctatatcataaatctcaagaggacctgggagaagcttctgctggcagctcgtgcagattcacgcgctggtgagagacatccgcaccagcggcgtatctctggacagcttgca

SEQ ID NO: 273829 - DNA, 292 bp, Homo sapiens
ctccagcggaggctccgagctggggttcggaccaggccgcgggtgggcgggagtgcagaaagcgggctaacatcctgtgttgctatcccttcggagtcccacacggcggtgagtctaggcccaggcgctgatttacaccagctacttgggctggtcgggttttcccttcgcgccgtgcgggtcaggagttaaggttctcgggtttttagacaaacaagtggtgacagcacagcgaagtaattccaaagcatccgcctacaatctgcttgaaaatgtctgaaaacaattcatg

SEQ ID NO: 273830 - DNA, 298 bp, Homo sapiens
tgtcttttccgtgctacctgcagaggggtccatacggcgttgttctggattcccgtcgtaacttaaagggaaattttcacaatgtccggagcccttgatgtcctgcaaatgaaggaggaggatgtccttaagttccttgcagcaggaacccacttaggtggcaccaatcttgacttccagatggaacagtacatctataaaaggaaaagtgatgggtattgcatatctatatcatatatctaaggaggccctggagagaggtttttcctgcacagctgcgcacatttttcacataaaa

SEQ ID NO: 273831 - DNA, 659 bp, Homo sapiens
gctcaatcttgataaaatccagcagcaatcgcccatacatgtcataccatctgcgctagctgaacagtgcgatcagacgcaacaacctggaaccgcactcaacacacgtgcagtggtggatgctggctcgggaagttctgcgcatgcgtggcaccatttcccgtgaacacccatgggaggtcatgcctgatctgtacttctacagagatcctgaagagattgaaaaagaagagcaggctgctgctgagaaggcagtgaccaaggaggaatttcagggtgaatggactgctcccgctcctgagttcactgctactcagcctgaggttgcagactggtctgaaggtgtacaggtgccctctgtgcctattcagcaattccctactgaagactggagcgctcagcctgccacggaagactggtctgcagctcccactgctcaggccactgaatgggtaggagcaaccactgactggtcttaagctgttcttgcataggctcttaagcagcatggaaaaatggttgatggaaaataaacatcagtttctaaaagttgtcttcatttagtttgctttttactccagatcagaatacctgggattgcatatcaaagcataataataaatacatgtctcgacatgagttgtacttctaaaacccac

SEQ ID NO: 273832 - DNA, 240 bp, Homo sapiens
gattaatacctctgcttgaagaaagggataattttctgatgacatcattcattacaacatgcagggtataaagagaggacacttcagtcattagccatgccctatgaaatgcagagacaactgcttgcctcatttgctcatcatcaagttttggcctttaaagatgttcaaaactgactacttaaggcatttaaaattaaacacttagcctcgacccccctcagttggcttaaaatctta

SEQ ID NO: 273833 - DNA, 206 bp, Homo sapiens
gattaaataaaaattgtgaagtgactggcccataatagacaatcaataaatcacagttatttttatgaacattatcattatatttattactagttgattgtaactagttggttattactgaattctaatgtcccagtagaaaaagaaggaaagtgaaaattggtatgggcccagtctaagaatgctggctggcgaaaatgatacga

SEQ ID NO: 273834 - DNA, 213 bp, Homo sapiens
gtttttggtagagatggggttttgccatgttgcccaggctggcctcgaactcctgagctcaagtgatccacctgcctcagcctccaaaagtgctgggattacaggcaggagccactgtgccgggcccttgtctattaaattctgtgtgtagttcttgaaagtgtatctcacctcattggtctgcaaggctcatgagtacagggactgtgtctg

SEQ ID NO: 273835 - DNA, 449 bp, Homo sapiens
tttacctcctttcttatggttcataaatccccctttcaatgtgtgtatgtgtagatttgaaactgtgtatctgaacacaaccatgtgtaaggatgtatggaaatgctgtgcaatgttttccatcaattcaagagctgaatttatgaatcctccactgcttatgtaccagacactttcaatgccgtatttataccctcagatgagtgttgcttctttcaaagtagccacactcggaagtggaggaattatcccacaaatgcaagcctgggttggattgccaaggatatttatcttccatctcattgggcttaggtgggctactaaactctgctcaactttttggacctcgattttctaatctgaaaaatgctcctgattaaacctacttcttgggctgttatgcaaattttatgagaaaatgttcataaagaatttatctgtgcctggca

SEQ ID NO: 273836 - DNA, 583 bp, Homo sapiens
tggcccctgtggtggctgaggctactatgttgccaaaacatcaaatcaaggtggctaaggcatgtgaaagttgccagtaccagaatggagtcacttatgtcaaaaccctaacaaagtggagtcaggaggccctaaaaaagttctcaccgcacatgcctataatataccttatcacaagaaattcctgcaggtcccacatgccccacttctgcactcaccctgcaacagagcttatcacaggaatttttcaggcctgcagtatttcagacaagctgccagcaccaggacagttactcagcaacagccatctccaccaatgaataaacgccaactcctgcactgagcttctgtgacccgtgagctttatttcaagctttatttcatggatttctctttgtctttaaaagctttccctttccccaactcccctggatacattaatggcccgtcatagcttgcataccctgcaattgcaatccctctgctattcctagataaacttgtttgttctaaagagcctgtctttctgagtttctttttaggttgacaggcagttccagtagcagcagtagttatggcagtg

SEQ ID NO: 273837 - DNA, 509 bp, Homo sapiens
tcaataatgtcctatttatcatatgaatagtatttttatgtatctttttatgaatagtatttttatgtatctttttaaagaaatctttgactactgcaaagtcacaaattatcctaatttttagaagcttatgcttttacttttcacattagctctcttattcattttaaattaaatttctgtgtatgaaataagccaagtctaaggctcattattttcaaataaatactgatcaacaatatttatcaacaagactagccttctatttcattatactggagcccttgttaaaactcaggtgtgtttgcgagtctgttcctgaaccattttgttccactggtttatctctccttgtacacaccccacatttaattactgcagctatacaaaatcttgaaatctgacacattaattcctccaaatttgtttttctacttcaagattatcttggctactttcagtccctttcactgtctatataaattgaagaatcatatcatcaaatctac

SEQ ID NO: 273838 - DNA, 412 bp, Homo sapiens
caagaactatttaatccttccaataagcccatgaggtaagttctcttaccatccctagtttacaggtgaggaaactgaggcacagaggggcgagcaacttgtccaaggtcaccccactactgagtgtcacagctggactctacacctggccgcctggctctagagactgggctgttggcctctttcctagaatgccttgacagaaggaatctgagaaagcatttcatctggttttcaagctgtgctcttagagtcttcatcaagtcctcaggggcccagggatgagggctctggtgggacccagtgtgggggtggtacacaggcacaaccagagaagcaccaactctgtctgctttatgtgctggcttttaagggcagctcctctcaaagaaaggattccatggctttaaaa

SEQ ID NO: 273839 - DNA, 350 bp, Homo sapiens
cagagtctcatttgaggcgtgcaaactctgagcaatctcttagatttcccagaagggtgtcaattaggcagttggaaatatgactggagttccaaagggagatctggcctggaggtataagtttgtgaatcaagagtgcacagatggaattaaaagctataagattagaaagaatcatcaaataatatgagtgtggaaagaggagaggtccaaggacagagtcctaaagagcctagatggtagaaaaagagtagaatccagcaaaggagattgagaagagcagccagagaggtaggaggacaaccaggcatttcttcatatttacaataaatgggttgcactacaccacc

SEQ ID NO: 273840 - DNA, 335 bp, Homo sapiens
ggggattcaggctgaatgttagtctggaatgcatttggcctgaagcagcaagtgctgggtgatacagttccctggtaaacagccgagagctggccgctagtttggcccaacctgcaacggaagaaggccttaagtacaggagaaaaagatctttgccaattggataatcatggaaatttagaagaagtacagctcgaactagacgtaaaggacagaatgtgtctgtctagctgaccagccaaccatcggtccatcactttcatcctccaaactagtgatttgttgatgaattggtttcaatactttgttttaaaatgttgaataaaaagtaaatg

SEQ ID NO: 273841 - DNA, 237 bp, Homo sapiens
tgacagagcgagacactgtctcaaacaaaaaacaccagattgacttttgatcatctttccttatggaatattacaaagatagtgtcaaaagatggaaaagacaagaactagagagaaagcagattccatttcagatgaagggagacctgggctaagccttcagcttcagagagcctggggtggatgaagaggagcaagcacttgggatggtttgggttttccagctgaaatatgtta

SEQ ID NO: 273842 - DNA, 169 bp, Homo sapiens
aggtctaggctcctgatgcatactccagaagacccacgaaccagcccccagcattagctgcccaaggcccagggtccagttccctagcaatgacccagaagagcccagggcccagccccgagcacttgctcaggcctaccgggcagcccttgggaaccaggatcagact

SEQ ID NO: 273843 - DNA, 340 bp, Homo sapiens
gatctttctaattctttcttaactaacttattcaaggggctagcatcagaatcttttttctgtactgaccaatttatgtctaaatgggagaatttggcatcagtctgcatttgaaaaacaatatcacacagaaaagattgataatgaatagactgttcatttatttttcaagaatagttttctttaaagtaatgtaattttgagataagttttgtattatgtataagtcacatattagtttttagatgtaacttaatttttaaaacttcttcaaaccacttaaattttgaattgtgtatgtacaaattaattttatattgacctatgtatttttcaggat

SEQ ID NO: 273844 - DNA, 513 bp, Homo sapiens
cttcagtgtcggaggatgaacatcttctgcaggtggatgataggagcaggtgcatgacagtgtgaagaaggtacttaatgccactgaactgcacccctaaaaatggttattacagtaagctgtacggtaagtcaattggaccacacacacacacaagtgaagaaagcgttcaacaccacagcaagtaaacaggtcagtttgggacaccagtgtgactgggggcagctttctctccatggccctgtgtgcaggaaagaacaccctctcgtgtgtggaatcactctgtgacacagtattgtacaacagaggtcacacactttttccataaaagaccaaagtaaatatcttaggccttatagggggccatacagtctctgccgcaactactcaactttgccgtcatgggcctgaagacaaccgcagaaacaacctgtacataaatgggtttgactgtgttccaagaaaactttactgacaaatacagctggccaagcagtcatatgctgaccactg

SEQ ID NO: 273845 - DNA, 364 bp, Homo sapiens
tttttttttgaaaatctgacattaggaaattaaacctcttctgcaagatccagttttctccagaataaaagttttaaagattttttttctttttgtaatttaaaataattcaggtttacaatattttgagaatgtagacatataggggaaaagtgggtattcttccacaaggctaacactttgtaatgcatctttccagcctcttctctgcaaaagatttcttaaagaaaaactggacactttatatactgtctcataatttgtgtttttacctaacactcccatgtatttccaggtttatagatggctaccttttagatactttttataacatcattttatagatcattataattaagaggtc

SEQ ID NO: 273846 - DNA, 504 bp, Homo sapiens
agttctcacagcccgaggaagatgctgcggcgattcccactttacggctaatgccaggcccaggtatgccataccgctgtcagggctctcaccaccccaccttgggtgactcacacccagcaagatggggagcgtgggacctgactcagaagctggtgctcacctgagtccctctcctgcgggtttaactggcaccttctcctggggagaagcaaagccagaggtcctgggccgtctcctccagacatgtgtgcagacgaagggacaggaagcgacgatgagtggaactgatgattggacttcatcctgaccaagaggcacacacagccagtgactgcagaagtgaccacgtccccccgcaggggtcctgagaacagagctcgtggcctggcctgcgttagcttcacaccagcctagatgactgcaagaaattcaaagagaaggcagatggaacgtgctgtgagaggttctcaaaggcaaagagctaattaaaaagtctgtttc

SEQ ID NO: 273847 - DNA, 434 bp, Homo sapiens
ttctgcttttccatttccccattattgtcaataatgtcatccttttgttctcatggcataatatgcatggagctgctctatgtgccctgacagtgcagcgactccactccatgttaagctcaagagacacttgagccataaaggacaaagttgtggccttagccaacagagcccttgctccccaaacagtacaatctatgacataatccaccaggaagtcccaagccattagttaaaatgtggaacttcagagaaagggagtgtttgttttcacaaagaaatcttgatgattcttcctgacttcagcctgtcctctgtccctttactttctcagtacctccactctggccagagtttgcccccatctgcctgcctgcctcctgcttctttcagctgccacaattccataccgtactttgcccactgggactttc

SEQ ID NO: 273848 - DNA, 432 bp, Homo sapiens
tcagcacgaccaagagggaagaagaagagaggagtgaaatttctcaattaaactgtgggtaactttgggaaggaaggggctttgaaagcctcattcattctgtgttcctttcagaacagaagcttgcatctgcacttgccatttttgccaagacgatctgtggagggctctggaggtagtgctattgcattcaaactacttctttgacaacatgaagcttcaagtccacagaactgtccccaaatatacattttggtggaggagcggaataagtgcttcctaaaaagtctttctctaaggctcactgattccacacattaccttgtgaaaaaggacaccatggcctcgatctccatggccaaataaataaaggaaatggaatttcacaatgcatattagcacattagagaggccgagaggtcctgcagggga

SEQ ID NO: 273849 - DNA, 262 bp, Homo sapiens
gcaaaaataggacttgaacccaggacctccaggtgtttctgggtgttctttgagttcctccatcctgaatcaatagtcaagtatcatgtataaatggagccacagtcctcaaggataaacactaactgcttgtaggccactgcaggccattcagtacagtgttttattgtgctgaaaagtcacctgtttccagaagtgcttccccaatgcaggctttctaaagtcatcatgtagagtaaattattttcccctaacaaactat

SEQ ID NO: 273850 - DNA, 569 bp, Homo sapiens
aagatccccttttggcaaactgaaaggcctttcagctctggcatgtgtacatcaaccatggcattcaagccacaatatcaaaaccaatcactgatttggcaattacccaacaaagtatccacattattggggaaaatatatttttagaaagctgttatccctactctcataaaaattacacaaataatttgaaatagagtgtggtgggggtagacaactaaatgaacaagaacccaaaggatcataaactgaaatagttactggggtcaggaagataatattaatgagagaagcaaggttggcctattataacaaggagtgggtttcgctgcggcaaagttacaacaaccttcatcatttaagtaaaacagccactaattgaatagctttagctggcttttgccaattgggaaaggggatgcactattattaaatggtctatgttcttcaaacaagccagaaatccaatatttatgtgaaatttcctgaaatacaaataacagcaactaggcaaatttggtggagcaaacaaaaccttcatgggatggatttggcaagtgggccactac

SEQ ID NO: 273851 - DNA, 303 bp, Homo sapiens
gtgtgggattacaggtgtgagccaccacacttggcttaattgagcattttctatgattccactttctttcttttcttagcttctcagttaattgttaatttttttttttaattttagtttttttagtttggcttttagttcccccagagtttgcagtctacagctaatccaagcccactttcaaataacaccatgccactttacaggtagtggaagtaccttataataacgcagtaatcctattttctctctctagtctcttacatcattgctgctattctttttacttatatataagcatac

SEQ ID NO: 273852 - DNA, 294 bp, Homo sapiens
aggggtctggtgtgtcctcttggggtcggcttcctgctggccatctgaaggtttgcatttggggcgggggtgacactggcatgcagagaagaatgtcagaaaactccaagtcacacagtatatgcactgtctgaatccgttttcagctctagttttcctacctgggaaatggatgaagcaggggattccttcatgtcaaggggcctgtacagtggagctgagggacatgctttaggagtacctgaggcctcttggaatgaaacatctaagccactacccctgcctctcaggtcg

SEQ ID NO: 273853 - DNA, 211 bp, Homo sapiens
gggggtggtgtgagtgctgccagggaaccgccggggcaatgttcctggccctccattcccagggctgccctaagcctcggtttcctcatcaggaaaatggaaaagtgaatcgctactgggctcaggtttagggagagagtgtgcttctggaaggtctgccagtaatgtcgctctacttggtggaggagtgaggtgcagccctgatgggcgg

SEQ ID NO: 273854 - DNA, 183 bp, Homo sapiens
ggttttaccgtgttggccaggctggtctcaaactcctgacctcaaagtgctgggattacaggtgtgagccactgcacccggccctgacagcacttcttaacaaattaccagatgccctttctctctcctgcgacggcgggatgcagtcaactccaggccacactcactgggcacctaccctgt

SEQ ID NO: 273855 - DNA, 1936 bp, Homo sapiens
aggggaaaatggggagtgactgttaatgagtatcaggtttcctttggggatgatgaaaatgctctggaataaagtagtggtgatgttcaactttgtgactaaattgaaaactgctggattgtacactttaaatgggcgaatttatggccatggaagcaggtctctcagaggtaaaaagtgagttacagtcacgtgatgatctcttgagaattatagaaatggaacgattgcaattacacagagaattattaaaaataggagagtgccaaaatgctcaaggaaataaaacaagacttgaatcatcttatttgccttctattaaagaaccagaaaggaaaataaaagagctgttttcagtgatgcaagatcaaccaaatcatgaaaaagaattgaacaagataagaagccaactccaacaggtggaagagtaccataactctgagcaggaaagaatgaggaatgaaatctctgacctaacagaagagcttcatcagaaggagatcactatagcaactgtcacaaagaaagctgcccttctggaaaaacagttaaaaatggaattagaaataaaagaaaaaatgttagcaaaacaaaaggtctcagatatgaaatataaagctgtcagaactgaaaacacacatctaaaaggaatgatgggagatttagaccccggagaatacatgagtatggacttcactaacagggaacagtcaaggcatacatctattaataaactgcaatatgagaatgaaaggctccgaaatgatcttgcaaaacttcatgtcaatggaaaatcaacctggactaatcaaaacacctatgaagaaacaggaagatatgcctatcaaagccaaataaaagtggaacaaaatgaagagagacttagtcatgactgtgagccaaacagaagtacaatgcctcccttgccaccttcgacatttcaagccaaagaaatgacaagtcctttggttagtgatgatgatgtattcccactgtctcccccagatatgtccttcccagcatctttggctgcacagcatttccttctggaagaagagaaacgagcaaaagaacttgaaaaacttctaaatacacatattgatgaactgcaaagacacacagaatttactcttaataaatactccaagctaaaacaaaatagacacatatgagcttttaaacttttttatttgcttcccccccccacccccgccaagaaaaaaagctctggcaaaatatttacaaagctgattaatgaaaccaagaaattctgttctgtttccttgagtaaataatttccgtaaggcagctagaaaatagtaagtattttgttctataaagctgttcacatttctgcattaacatgctaaattgtcctgctgtagagttactataaaataaacatgactattccaaaagagatttttttccagtctaaggaatattttggaatcaaatatgcagttttttttccccacttgaatcatgtatactgaaaacccatttcctcagcaactacacaaaataagagaaagggaagtgctatattccagatacaaatgactcaaaggcagctcagttgtactggttttgaaaactcaaggattttataaataaaaatatttaagtatttccagttatgtaaacactctaaaattctataattttttggaaaaaaaaagctatagctttattgtttttacattcacctttataatgtctgtctgtttcaacacaatgaaggtatatggaatgtgcaatttacaaacctaaaatatatgtgccaaaaattaacgcttttttgttagtactaattacttcatggacacaaacaagataaaggaaatataaagcattactgttgctacattttcctttgtaatcacttctgtttttaatacaataaaggaatgtaaaattcaatggacttgaagca

SEQ ID NO: 273856 - DNA, 258 bp, Homo sapiens
agtgtgagttgtcagattatatccagaagtggggataaggatacaagagttaatttttaagtgactgaccttaagagttgtagtctaagaatgtgattaattagaaagaatgagtatttctatcagaataatctgaataattcttagaatcattataatcaaaaccagtttcaattgtttaatgtcctagtttgccacaagttgtcaaataaagtcataataagcttaacaacaaaataaaatatcattaaaggaaga

SEQ ID NO: 273857 - DNA, 380 bp, Homo sapiens
cttctccatggctcactaggaactgtaacctcagaggaagagtaagcaaggccgtgacagggaacactcagctggccccaggcaggacatgccagcatctgtacttcccgcacgtccgtctatccatgcggtgtcagtttatcccatactgacatgtataccaagagaatattttcttcttttcagcatgacatgtactccttacccccagggtcttcctctacccctgagtgtgctttgccttctaaagacacccagcataggccgggcacagtggctcaggcctataatcccagcactttggaaggctgaggtgggcggatcacgagatcagaagatcgagaccatcctggctaacacagtgaaaccccatctctact

SEQ ID NO: 273858 - DNA, 436 bp, Homo sapiens
aatgtgaggtcctgttccagccaattgaaactggacacggcagtagggtggacatgtcaggttataaatgaccctgtctcgtttgttcagtgtactctcgtggctaagctgctggcgagtgtaccctttctgcagaaaatagaaaaatggccttgctgagaaaattaaatttatgttcaagtgccatttctttacggcaccagggaacaaggctttcaaacaagtcttagggttttactatctcaaaataattgttttttatggttgcggtagggatcaaagttcgtttttcccccatgttgttaaccagttagtccaccaccattatttacacatatattaaaaaataattgcaaaattattgaataggaacttacctttttttacagaagcaattcacatttattatagaaaaaatgaaaataaatataatgta

SEQ ID NO: 273859 - DNA, 816 bp, Homo sapiens
ggagcttcccggctgctttgtttacctaatcaagcccgggcaatggcgggcgcccctcccccagcctcgctgccgccttgcagtttgatctcagactgctgtgctagcaatcagcgagactccgtgggcgtaggaccctccgagccagtctatttttcaggagcattgaactgaccagttatatttatatctgggagaactacaggctgttcaatttgccttgggattctccatggacttggtattcagccttcttaggagttgactttggctactactggttccatcgtatggctcatgaatttcctactctcccctggccctcttcatacccccttcagtatatgctgttcatcttcaattcaatcttctttaccaatttgtgatccatacagaggtcatcaataacctgtggtccttgtggaaactgattcttaatactcctagccatcatagggttccatcatggcagaaatcgttatttgcatagacaaaaattatgctggtgtcttattattggactaacatcttgggaccattggcagcagacaatgaacaaagtgtatatgggtttaacacatcccatttaatacctttggaccaatcaagtgcagtccatcacttatttttcatatggactcacattctgggcacaccgattcttcaataagtttctggcatattagggcgggtgggcccggtaacacgacttggcccggaaaatccgaaggccgggaaaagtcctcttatcacttattcagatagatataagcgacggcgggtggtataagctcgaagggggggacccgcggggac

SEQ ID NO: 273860 - DNA, 1091 bp, Homo sapiens
ctacacagaatcggctgttgagtgtgctctcagtggagctttggttttagctgttctctgacaaagagcttgttctgagctgcacatctcgtcctctttgttcagcctcaggcttcaagcattgaatcctaaatattctccagctgggaatcagacaagggcagaaatgaagaacccagaagcccagcaggatgtttcagtttcccagggatttcgcatgttgttttacacgatgaaacccagtgaaacttcattccaaacattagaagaggtgcctgattatgtaaaaaaggcaactccatttttcatttctttgatgctgcttgaacttgttgtcagctggattctcaaaggaaagccaccaggtcgcctggatgatgctttaacgtcaatctcagctggtgttctgtctcgacttccaagtctatttttcaggagcattgaactgaccagttatatttatatctgggagaactacaggctgttcaatttgccttgggattctccatggacttggtattcagccttcttaggagttgactttggctactactggttccatcgtatggctcatgaatttcctactctcccctggccctcttcatacccccttcagtatatgctgttcatcttcaattcaatcttctttaccaatttgtgatccatacagaggtcatcaataacctgtggtccttgtggaaactgattcttaatactcctagccatcatagggttccatcatggcagaaatcgttatttgcatagacaaaaattatgctggtgtcttattattggactaacatcttgggaccattggcagcagacaatgaacaaagtgtatatgggtttaacacatcccatttaatacctttggaccaatcaagtgcagtccatcacttatttttcatatggactcacattctgggcacaccgattcttcaataagtttctggcatattagggcgggtgggcccggtaacacgacttggcccggaaaatccgaaggccgggaaaagtcctcttatcacttattcagatagatataagcgacggcgggtggtataagctcgaagggggggacccgcggggac

SEQ ID NO: 273861 - DNA, 549 bp, Homo sapiens
tagttgaaaggagagttcagaggagcctcattagagtttagtcaaggagagaatctttgtcattaatgaggtgcatctttctttttaatctatgtatttctatgagatgtcttttttttttttgctcttatagctattgaaattaatattgaaatatttttatgagaaaaaagtttttatgctatttataaaatgaaataattaaaatagtaagaaaagcatgtcttaccattgaattgaacattttattatatagagattctcttttactttgatagtgatttttatcttaaagtctattttgtctggtatctactatataggtgtacaagctttcttttggttagtatttgtctaatatatactttttctttttttcactttcattttatttttttattttatttttgtgttttgagacagtcttgccctgttgcccaggctggagcgcagtggcacgatctcagctcactgcaatctctgcctccagggtttaagagattctcctgcctcagtctcccaagtagctagaattacaggagtgcacca

SEQ ID NO: 273862 - DNA, 297 bp, Homo sapiens
gcctggtaaaatgaaagaagtcaggaagggagttgggtgcaacccaagaagagggctcttctacagagtttcagtttctgttgtacctctttaaatagcagctgccccataaacttcatggtagaaggtttagaaagccaaagactcaacctccattctccactataggtcccaaacatagactctgcccaggcctgaatactacatctcgaaagtgtttaaaaatttcctttgttttccaattagcagcagacttcatactaatccctgcttttcttacctgctttttttcctcct

SEQ ID NO: 273863 - DNA, 343 bp, Homo sapiens
ttttttaagtttcaaggggagggccatctacacccagtatatctctcaggatattcacagtgttgcttttctccactctctccttgtttccagcttccacactcgatttctcaccgagatttgaatcccagtcactgaactcccttgtatctctttctcatgactttccttttaccatttggactttaacttttctacctgattattgacttagtttaaaccccaggattccaggccctcggactcccaccttccactcaaagtcagactggtccagcccttcttcttatattacaggaatctagataaaaatacagtaaacccaagagaacagtactaaaca

SEQ ID NO: 273864 - DNA, 1639 bp, Homo sapiens
  misc_feature (1)..(1): n is a, c, g, or t
  misc_feature (44)..(44): n is a, c, g, or t
  misc_feature (759)..(759): n is a, c, g, or t
  misc_feature (1115)..(1115): n is a, c, g, or t
  misc_feature (1478)..(1478): n is a, c, g, or t
  misc_feature (1552)..(1552): n is a, c, g, or t
nttttttggagataaaaatgacaaaggagaacctcctgaacagnatccagtttgcttttagctttagccatctctctgacctcagtgctgctggactcagttccaagatctaactgtcaaatgctttaggggaaacgggaagagaagtccctggagtaacccatgtgcgcagcctggcactgttttcacttgcctttggaaatgaaggtgcagaaaccatgggaggaacctgatgaaatgcctggtctaacaggaggatgcagagaaagttatgaagagaggatcctgaggaatttgctcctgggccatgaagatgggaagctgagtcagagtgcagttcttcacccaatcccacagccacacgtgcctgcttgctcacgggatcttcccactctcctcgggaaggcttccgagctgcttcctcaggatgtcctgtgatagcagcctgacctgtcaaagccatgcgaataccatctgttcagttatataacttgagatctgggaagaattctcaataggcaaggtttcactacattgaccaggctggtcttcaacttctgacctcagtggcttctagaagagtgagtctggaaaatactgcccctactttcaaatgggagaaagcctcccttgtactaagtttgcaatcattagaaaactgttgatatacagcaaaagaaactaccatcagagtgaacaggcaacctacagaatgggagaaaatttttgcaatctactcatctgacaaagggctaatanccagaatctacaaagaactcaaacaaatttacaagaaaaaacaaacaaccccatcaaaaagtgggcaaaggatatgaacagacacttctcaaaagaagacatttatgcagccaacagacacatgaaaaaatgctcatcatcactggccatcagagaaatgcaaatcaaaatcacaatgagataccatctcacaccagttagaaaggcagtcattaaaaagtcaggaaacaacaggtgctggagaggatgtggagaaataggaacacttttacactattagtgggactgtaaactggttcaaccattgtggaagacagtgtggcgattcctcaaggatccagaactagaaataccanttgacccagccatcccattactgggtatatacccaaaggattataaatcatgctgctataaagacacatgcacacgtatgtttattgtggcactattcacaatagcaaagacttggaaccaacccaaatgtccatcagtgatagactagattaagaaaatgtggcacatatacaccatggaatactatgcagccataaaaaaggatgagttcatgtcctttgtagggacatggatgaagctggaaaccatcattctcagcaaactatcgcaaggacaaaaaaccaaatactgcatgttctcactcataggtgggaattgaacaatgagaacacttggacacaggaaggggaacatcacacacnggggcctgttgtggggtggggggaggggagagggatagcattaggagatatacctaatgtaaatgacgagttantgggtgcagcacaccaacatggcacatgtatacatgtgtaacaaacctgcatgttgtgtacatgtaccctagaacttaaagtataat

SEQ ID NO: 273865 - DNA, 573 bp, Homo sapiens
ctcatttctaggggaagaagcataggaataagaatcaaaagattcacattctaatcttggcccagcctccaaacagcagtgtgacgtggtccaagaagtggcgctgccctaaacactcattacatcttcacagcatgaacaggaacctgatgaaatgcctggtctaacaggaggatgcagagaaagttatgaagagaggatcctgaggaatttgctcctgggccatgaagatgggaagctgagtcagagtgcagttcttcacccaatcccacagccacacgtgcctgcttgctcacgggatcttcccactctcctcgggaaggcttccgagctgcttcctcaggatgtcctgtgatagcagcctgacctgtcaaagccatgcgaataccatctgttcagttatataacttgagatctgggaagaattctcaatgtaggatttgctgcccaaatcaaatcattttcagaaaggagattaagcattctttgctgggaaaaggagaaattaccagaaaaattatcatttcactgagtataaacaaacctttgtccaaaatacacaaatgaaaatga

SEQ ID NO: 273866 - DNA, 407 bp, Homo sapiens
tagctgggattacaggtggccaccaccacacctggctaattttttgtatgttttgcagaggcaaggtttcactacattgaccaggctggtcttcaacttctgacctcaggtaatccacccacctcagcctcccaaagtgctgggattacaggcctgagccaccacgcccagctctcagttgtttcttaatttgcctgccagtttgttttttatatgatactaattgaaatggaggtccttcttaaatgaacttctttcacaaacaaaaacattagttttggcagtgatggcttacaagagtgtgttctataatacctactttgcagatgcaatttgaattcttcaatatgagttatttggatttcttttttctgaaattctttctaatgagatttttgtggattttt

SEQ ID NO: 273867 - DNA, 307 bp, Homo sapiens
aaggttacctttgaggttctttcagctctaatgattgtagcatatcccctgatgttctctgttatcactgtagtgggctgaaatgtccccccccaccaaattcatgtccacctggagtcttatttagtgacctaattattttaaaatagcattttttttttagctgggcatggtggtgggcacctgtaattccagctactcgggaggccgaggcacaaaaattgcttgaacctgggaggcagagtttgcagtcagctgagatcgcaccattgcactccaccctgggcgacagagcaagactcttctc

SEQ ID NO: 273868 - DNA, 633 bp, Homo sapiens
gttacgggaagacacatcggtgcagtggttgcccacctggcttcaactagaatctccacaggggcttaaaagctgtttctgatgaaaatgtaaacaaaatttgagaaacgatgcagtgaactattttgacctatcattctaacataccaatccaaccacattgcaccctctttagaactctcagataatttttcatcaatgatagaagaaattccacactccaggtgtgctgtgaggggcttccccgacctaactcccatccctattcaggctgtttagcatcctgagtgtgtgcatgtacacacacacacacataaacgcacacacataaacacacacaacatgcatgcacacacatataaccacacagacacacccacatacataaacacacatataacacacacataaacacacaacacacacatgcacatacatacacagagaatgcagcacacacatgcacacaagcttgcacacacaaacacacaacacacatgtaacacacatgaacacacttaacacacataagcacacatacacagagaacacagcacacacatgcacacatacttgcacacacaaacacacacaacatacacatgcatgcacataaacagacacataacacac

SEQ ID NO: 273869 - DNA, 310 bp, Homo sapiens
tgaacttagcccattcatatactgttagtttgttggctcatttatatgtaaactcctggctcatcaactccagtgaccactcagcttcacattggaagagtatttaggactcggggctccctatataaatgtaccactgcctcccattaaagtcattctggggttcatcccagaataactgaattagaatctcatgtgggcctaagtgtttgaattttaaaaagctcctccggaagctctgctaggtttgagacccactggtttaggtaatttcatgacaggtttaggcagctaatataaggaattctca

SEQ ID NO: 273870 - DNA, 380 bp, Homo sapiens
agttataatgttgaaaaatgaaatatcaaattgtcaaaaatataaatagaaggaaaaatactgaagacaattaactagctttctaaaaattatttttgaattagtgatttttgagtgagatgggggtctcacttcatcacctaggctggtctcaaaccactgggctcaactgatttttccacctcagcttcccatagttctcggactatagaggtgagcaaccattcctggcggagaaagcatttcttatttctgaacagacatttatgtgctccatggtagtaaatgcatagattttatttatcctcacaacaacaataaaaggagcaagaacagttatggaaaattttagccagaaaatatatctcaaaatcttctag

SEQ ID NO: 273871 - DNA, 344 bp, Homo sapiens
actatcaaatatatttatctcatgtcccctatgttctatagacacaatgaagggaaaacactaatgtgtttatctgaacaatgcctaggggatgatgaagcagacttggaaggaacccgggccgttgagtgcccatttagtagtggggctgctctacaaccccagaccatttacattagcaccattaggttagagagatttaaaagatcttttttctttgattgattgattgattgattgattggagacagagcctcactctgtcacccaaactgaggttgcagtgagccgagatcacgccactgaactccagcctgggtgacagaacaagactccatctcaaa

SEQ ID NO: 273872 - DNA, 181 bp, Homo sapiens
agcaagagactcctcagagagccaggactctaactaacttagcaagttctcatcctttcagaaccagcagggagaagcatttcccccaggtcttccttctggactaagggattcagtcagaaggaaaagcaggaactctggattctgccccccagcttggcttggcaagatggtgggagtt

SEQ ID NO: 273873 - DNA, 308 bp, Homo sapiens
accgagagatgttccggattctgagtctgttccgtcttgtggttgaaaatggactgcccaggagcacacgagccacgcggtgcccccttggctgccccacgaggtgcaggggacgtgggcactcgcggcctgtgctgggcgagggagcaagggacgggtcttcgctgaggatttagagcatgcagggaacgagggctgctggcagtgctggagggactgtgaggctgcagagagctcagattttacaagttgatgggtttcatggatagaggcccctattttgattaaaaaatgcactcttcccactg

SEQ ID NO: 273874 - DNA, 842 bp, Homo sapiens
ttccagagacctaaagagatcccaagggcgcctgggacaccccttcctccccttagctccagacgtcctggaaatctgtgatgtctgctggcctctgtagagggaacaccagccgcagccacctccacgtcagtcaccgcagagaaaggaagatttgtggaaggaatacagcaaatcaacgcctcctcgcaaagcactttccctggatgttgaaacagtgactgcaaactcagaggcccttcaggggcttaagccaggattcgttcagcccatcctacggctgctgcacgtgaggcccgaggcccttgctgcatctgcactgcacccacgccgctgagaggatctcacttgtctgacccgtcagtggctatcttactgtccgtgtctgtggctcaggcagcaaagctctggaccacataacctgcccagggtcgcccagcgggtgagagatgctcttaggatcagatgacagattccacctctagatgcctgtctggggctgctgtaacagaacacccatgagctgggaggcttaaaaccgtggggatttgctggtttacagttctggaggcaggcatctgagatgagggcgctggtggggtggcactgcagcccaaggttctaggggatgatcctcctgccgcttccagcttctggtggctcctggcacttccttgccttgtggccaagtcactccaagctctgcctccgtcttctcttggcccctcgctgtgtctgtctcttgtaaggatatttattggagttggtatccatccagatagtccaggatggtttcatctcaagatccttaacttaattaaatctgcaaacaacctttttct

SEQ ID NO: 273875 - DNA, 536 bp, Homo sapiens
gcttcctgcccttgaatatcaaactccagattcttcaccctttggactctcagacctacaccagtggtttgccattggctctcaggccttcagccacagactgaaggctacactgtcagcttccctaccttagaggctttgggacttgaactgagccactactggtttcattgctcctcagcttatagatggccaactgtgggattttcacttgtgatcatgtgagtcaattctccttaataaactccttttcatatacacataatcctattagttctgtccctctggagaaccctaatacagtctcctagtgtttagatagctgaagtggtcacaggctcaggaaacacaatactcagttggcttagaattcttggaaggtctctaaagaaggacaggcacaaacaaaggaagactgtgaagagtaaaataaatacttaatccctcaatgcacagacagcctgcaatttcacaagcatcaagaagattctgggtaatatgatctcaacaaatggacatgaggcaccagaggccaa

SEQ ID NO: 273876 - DNA, 306 bp, Homo sapiens
ggtagatgtcatgatcttatatctagaaaaacttaaaaactccacaaaaaactctaagtttaatacagtttttgattaaaaaccaacaaataaaaatccataacatttccatacactaataatgaattaagtgaaaaagaaatcgagaaggcaatttcatctacaatagctacaaaaataaaatatttagggaatacacttgatctataaggtgaaatacatctacttcaaaaatacaacaaaactttgatgaaagaaaatgtagaggacacaaacaaatggaaagacatctcatcttcatggaat

SEQ ID NO: 273877 - DNA, 652 bp, Homo sapiens
ctgaaatggagccacaaaaaagttttcagtaagacagtgacatgatttaattttcctttaaagtcattattctggagctatgcagaaaatagattggaggtagacaagaatggaagcagggagaccagtagggaagctattgtaatagtctaggtgagagaagatggtggcttgcaccaggggcaagctcagataggaagtttaggagatgggtttgcaatacattttggaagtagaattgttgggattcagagatggattggatgtgggtggggtgtgaaggaaaaaggaagtcccaagtatcattgcctggtttcaggttttagtaaataggcagatagtgatgccattttttgaggtaaagaaacttgaggaagaggcacctatgtagggataatcattaaatccattttttaaaaagtcagtttatggaggtataattttcactcagcaaaattaacagtacaatttaacattttgagaaatattgtttttgtgaaactatcatgccaatcatcttaaaaagtttcctgatgccctttgtagttagtcctctccccctctacatctacagacaaccactgatgttttctgtccctataattttgcctgttttcagaatgtcatatacattaaaatataaaatatgaaa

SEQ ID NO: 273878 - DNA, 295 bp, Homo sapiens
ctccttcatgtgtgcccaatgtttacagagccctctctcactccttcatgtgtggccaatgtttacagagccctccctcactacatcatgtgtggccgatgtttacagagccctctctcattacatcttctgtgcccgatgtttacagagccctctctgactccatcatgtgtgcccgatgtctacagagccctctctcactccatcatgcgtgcccgatgtcgacagagccctctctcactccatcacgtgtgcccgatgtttacagagccctctctgactccatcatgtgtgc

SEQ ID NO: 273879 - DNA, 400 bp, Homo sapiens
caacattggggattacaattcaacatgagatttaggcagggtcaagtatctaaactatatcactgtctgtgattgggcgctatttttacatttttttcaatatttaaaatgtaagtgaaattaaaagcagatgtcaaaacagttaaagttatcttttattttgatattgatatttagtaggacaaagtacttaatttttaagtagatatttgtgatcacttacttatacttatgtaacgtgttttatcttcaaattatatatgagcctttggaaactaagggcttttagacatctttgtatcctccatggtacctgatatattgcttttcaagtgtttgttaaattgaattattgccatgtaaaatagaacagaaatataagtaaatatgtaaccagtga

SEQ ID NO: 273880 - DNA, 432 bp, Homo sapiens
acagaatgtataattttttgcaatattttattatcactaagcatgtatctaattactttgcttgcgttttccttttaattctgatattaattcaatgtagtaaaaattaacaccagtattttcatgagtaatgtgaggctaagttaagtaagataccagtgaaaacatagctagtaaatgatacagccaagatgaaacccaagcctaactcatttcaacagcatttatttgcagtctaccacactatcatgaatagtttatcttagtggtttatggcaggttctagaaactattttagagataaatatcaagtcatagttttatagacaaatgagcaacagttcatcgtgtttcaaatattccttcctctcatcttaatgtcatatctttctccccaaccccaaatttcactcagcttttccactcaaagac

SEQ ID NO: 273881 - DNA, 292 bp, Homo sapiens
tataaatgtaagaggctgtcttattttttgacccaaatcattgtggtctcttctactccattcggctcaatttcctcactgttcccagcacaactgttccattctcatggaagagcctttgctcatgcagttcctccacctgaaatgccttccttcctccccagcacccatccaaatctcatccattcttcaagatcaactcaaatgccaccccatccaggaagtctccaatgcacccacccaagcacatccattcctccattgactcctcctataattacagatgggctac

SEQ ID NO: 273882 - DNA, 485 bp, Homo sapiens
aaaataggcataatagctacagtaataatatggtattttacaggattcatgggaggctcaaatgagataatctgtgaaaagcacttaaataatttcctagagtatagcaagcattaaagagcactctttactgatatgcttcctattattagagaaagaaaaagaagaatgttgaaaatcatgatgtctgttacaatgcacatgtgccaagtttggaaatgagcatcaagttatttctactttctctaataatattacttcaagcccatgcttatgcttacattcatacacacacagcatttacataatgatttatcattttcaaagtgttctcaaactcattattttatctgttcatgggttagtgacttacacgtagtatatgtgattctacatatgatggaagacttacgattttttttccagaaccctgactcttacggcatgtagaagggcaccctttcacatgtgacccaggagcaaaa

SEQ ID NO: 273883 - DNA, 516 bp, Homo sapiens
tctggcaagctcctttcacaaatcttgcgaaacttggcctttagacaatccgagctcttgactgagctagatttttgtttttgttttctttccccttagagtttccacaatatcccttttgagcagttagggttagaggactatgaatgaactggactgttcgctacaaaattaaattcgaggacattttaattaagtttggttatgagtacgtcatagtttttatccctgggacatacaagagccttaagacatcttgtgtctaaaacactgcattcttagcaaaaagcccaccaaggagcctgagggaaggaccttataaggtccttatgtcattaaaaggagaatacctcaggaaccattagtaatggccaggtttgggacattcagcacccagtatgccggaacctcagagaagggattcagtacagtgccaacatgtccttcatatatcctttggttaaattctgagatgagccccagacatagagctttggattactatcagagcggccc

SEQ ID NO: 273884 - DNA, 296 bp, Homo sapiens
caattatttgtcaatttaaaaaattgttaaagagacaaataagtgttggcaagaatatggtgaaattggaaccttcatacactggtggtaggaatgtaaaatggtgtagctactgtggaaaacattttagcagttcctcaaaatgttaaatacagagttatcatatgacccagtaattctactcgtaggtatatactcaaggggaatgaaaacacacacacacacacacacacccatcaagtcatacacaaacgctcatagcagttttattcataatagtatcaattgatgaatag

SEQ ID NO: 273885 - DNA, 271 bp, Homo sapiens
aatactgactctttattagctgatgaaggcaatgactttgaagacagcttgaatcacagtgtgaagaagaaagcagcaaaacgaccaccaaaagcaacaccggtgagtcagccagttttcttttgtttttgaatcttgtgggggaagcagcccagctacttgggaggctgaggcaggacaatagcatgaacccagggggcagagctggcagtgagccgagatcacgccactgaactccagcctgggtgatagagcgacactccgtctcaaa

SEQ ID NO: 273886 - DNA, 390 bp, Homo sapiens
accgcgcctggccagcttttaatatttaacttaatcactcagtcagtgctgaaagttgttatgggggcctgcctgttcagctgctagtgaaacctgacctgctacaacagcgcggagccacacctgccctaactccatctcctctttcatcagccaggaaaacgatgctgcccacaggtgcacacctgcagaggccgcgacccatgtagaacataagtgtcccaggagagaggccgaagcctggttccaggagtggcccagaggatggacattcatgaccctggtgagcagggtgtgcttagtggttggcctggccgggggatccagcccagggccgctctgcatacagcaccctggggccctcccatctgggatccacttgcttgaccc

SEQ ID NO: 273887 - DNA, 455 bp, Homo sapiens
tagtgggatggtgcctggtcagcattgctctgacttgctgtaataagcaatagatttacatttgtcatttcatttcagatatcaagtggtggtatcctcatcctcaacaatacctaaggagagaataatggagtaacagccaacaaggaccaacaaacttattagaaagtagttttcttcacaggtgttctttattagacagactcctgctgagaccggatctttctgctcatcccaatttcagctcacaggggagatgggttgagaaactcccagtcgaatttcaacactttggaagaaagagggcagagagatgagaagaaagagagtcataagataatggattacaagaaatcctacgggccaccctctttaattattttaactttatttcttaacctgagaactgacatggccttcttttgtctataaaacaatagcagtaatttacagaa

SEQ ID NO: 273888 - DNA, 402 bp, Homo sapiens
caatcttcactatggtaatagtttcacatgggccataactcaaactgtacactttaaatgtgtgcagtttattgtacattaattatacctcaataaatctgtttattaaaagtcaaggccaggcgtggtggctcacgcctgtaatcccagcactttgggaggccgaggcgggtggatcacaaggtcaggagatcgagccatcctggctaacatggtgaaacctcgtctctactgaaaaaaaaaatacaaaaaaattagctgggcgtggtggcgggcacctgtaatcccagctactcgggagggtgaggcagaagaatggcatgaacctgggaggcagcgcttgcagtgagccgagaccatgccaccgcactccagcctgggcgacagagtgagactgtctca

SEQ ID NO: 273889 - DNA, 434 bp, Homo sapiens
aattgcaggtcataaaatcctcatttcagaggggtcttgccccattccctggaggaaggactgctgcacggagaggctaagaagaatctgaacagacaggccttgctgggtttccccactcagtctattagtattagattataccctttttgtctaatcacatttctacacagttgtccttataccaatcatgtctatccgatgaagtctccataaaaggcctaagaggaggggtttggggagtttctggacagctgaactcataggaacatgaacaagaactcatccacgtgcccagagggtgttgtaccccaactcataagaatggaagctcctgttctcaggatacttccagacctcgcctgtataatcccatcatctggctatttatttgtattatttaaataaagatattacattaattaattacttca

SEQ ID NO: 273890 - DNA, 350 bp, Homo sapiens
ctatattgataatgatgccatttgctacgttagaaaggggaaaaaagcaacttagagtgggaacattgagatgataacttttattttagatgtttagggtttaaagtacctgtagaaccttttaggggaagtgtctagtaggcaattgaaagtatgggtctggagcttagtaattcttaatttgggtgtcagtagttttaggagagtagctaaaatcatgatatacatgagttgcctaggacaggtatataaagtaaaaggagaaagccgggcacaactcttaaatagcacccttgtttatgggacagcataaagggagagggccatgcataaaggagaaggatactgat

SEQ ID NO: 273891 - DNA, 212 bp, Homo sapiens
ggcctatcaatacagaccctgacataagctactattccacctggagtgagttttttcagtaggagtaacgggttgtactgctgtagcagacattgttagttgtcgaccctggcagcttgtcatccttcattctctgttattagaaaacatcaactttgttcaggtaggaaagtgacatgtgtccaggccaggagataaccaagtggtctaat

SEQ ID NO: 273892 - DNA, 421 bp, Homo sapiens
catcttataagcattccttttcttcccagtcagcttcttctttaaaacctacatgtatctgtaatctgagtttcaattttacattataagaaatgaacctaatcctaattcactacctaaaaggaaatatgcataccaatctttattcatttgtatatgccctagatatcagaagaatgaaaacttattcagattttaactcatttaaaaatgcatttgattctttttttagtttttgttttgttttgttttgtttgagacagagtctcgctatgtcccccagcctggagtgcagtagcactatcttggttcaccacaacctccacctcctgagttcaagcgagtctcctgggaggcaggggttacagtgagccgagattgcaccaaaacacttccgcctggcgacagagcgagactccgt

SEQ ID NO: 273893 - DNA, 305 bp, Homo sapiens
gcttcttggatagagcatcttctgactgtttttagcctgaggactcatccttaaagtagaacgttggtcacggcatgtcctggttcaaaagaaaagctgctgcacatcaatcttcacagcagcgttgtcacaacaggacaaaggtggaagctacccaagtgtctatcagaagatgaatggataagcaacaaactatggtggatggatgcacagtgggatattacttagcctcaaaaagtgaggaaattctggccaggcgctgtggctcacgcctgtaatcccagcactttgggaggccgaggcgg

SEQ ID NO: 273894 - DNA, 561 bp, Homo sapiens
gatgattttgtaaaatgaaatacagcattcttcactaacactaaatctatcaaatattaataagaatcacttgaggaaattcacaactgtgtgcccacccaacaagcaatacacaaaacccttacttccctctatgaatgacttttaataacacttcaaattagaatttaagttagaaccagtgcgtatacgtgatatttttacaaatttaaataatgctttattacattacaaaaaattaagagttgttgtttaagccaaaacaacttatttgtaaccaacatctcaaaagactgcagtgcgctaaaataaacctatgatgaaaactcagttttacattattgattcaactctatgaagtaggcctactgttacctcattttagacataatgaaactgaggcacaaagctgttgaataacttagtcaaggtcatatggatagtaagtggctgagctaacctatacgattctactgaaatggagttcacaaaatttttgacgttcacgagatactttcattcttcaaaaattccaacatatctccatgtcccagacagcca

SEQ ID NO: 273895 - DNA, 476 bp, Homo sapiens
ttggcttctttgcttttgtgtaacctcctgttcacctcctggtgaatagaatcctcagatgaggcttattgaatgattgattcctcctcaaaagtatacttgaaagcagtggtgtgctgaagccagctcatgcccactcacaagggacaactgtgagaatttcttcctaactctgcactcagtgaccttgcgttggtagccatgagctacttcatgagccctcatgttgaaattggccatagtgggagtatttacaccacagaaattcacagatgctataaagcacagctttcgctttttttttttttagagagagctggtttaccaatttcactgcttgaaagtatcacaaaaatctggggatccttttgaaaatataaatgccatcatattgtgatataatttatacaatataatataattgtgtaaaatcatgattataataatgtttcaataaacatttcttaaattcccaa

SEQ ID NO: 273896 - DNA, 427 bp, Homo sapiens
ttatgctgggctcggggtgtggaaaatggaatcgaagctggtctctgctcctgagaggcttacagccccttttagggtatgtgctggatctggaaagctgggatagaagaaattgggtgactgtgtattgtctttgtgcttttgtgtttttttagaggcttctatgatcagaatatttttggactaatgatgtgagttccttagataatttgaaaatgtgcccctatattctctactgtttagagtggtataatgttggcatgacctcatcttcctttcaagattacatattaaaagaaaatttgactttatattaaacgaagtcaaagctgggttcagtggtgagcacctgttgtcccagctgctagggaggctcaggcagaaggatcacttgagcccaggagttcgagtccagcctgggcaacat

SEQ ID NO: 273897 - DNA, 431 bp, Homo sapiens
caatttataatctcaggaaattagtccattagtgagaccacagagggcaatgagtgtttaaataataaaagataaagcagaagaacaattttaattaggtttgatctggcctagacaaaaaaagggatgaaatctagcctaccaagagacaggtatatcatcctggctatctggaaatagatttaatacagtacttaaaatgaatactttgcataaactttgtatgaggttataataccaaacaaactattctcttagagaaaagccatacttttttttttttttttgaggacaggaaataaaagataactctttcaatggctcctaaatatccacaacaaacatttttctggagaagcagacaagagatcacagtatcttgtaccagccaagtacatactgtttttttgtttttgtttgtttgttttgac

SEQ ID NO: 273898 - DNA, 490 bp, Homo sapiens
cccacattgtggctctgcatccttttctagaggatctgcgtgctatttaaaatgctttgtcataaagcagaactcttccctcctttctgtcactctgtaggaggggagaggagtccctccctccattttgactctgaagttttctgacttgcactatgccagcctttctacccaattgcccaagcatttctcagctaaagtgatccttagtagcttgaattcttgtcacaatgtgttcaggctgctataacaaaataccataggctgggtggtttataaacaaaggaaatttatttcttagagttctggaggctgttcggaagtctaaggtcaggaatgcagtaggttcggtgtctggtgagtgtctgcttcgtggttcatagatggctgtcttcttgctgcacagtcacttggcagaaagggtgaggggttctctctctggggccactaatccctttcatgagggctccctccccctcatgacttcatt

SEQ ID NO: 273899 - DNA, 524 bp, Homo sapiens
gtagattatatttaaggacaaatctttattccatgtttaatttatttagcttcccctgtagctaatatttcatgctgaacacattttaaatgctgtaaatgtagataatgtaatttatgtatcattaatgcctctttagtagtttagagaaaacgtcaaaagaaatggccccagaataagcttcttgatttgtaaaattctatgtcattggctcaaatttgtatagtatctcaaaatataaatatatagacatctcagataatatatttgaaatagcaaattcctgttagaaaataatagtacttaactagatgagaataacaggtcgccattatttgaattgtctcctattcgtttttcatttgttgtgttactcatgttttacttatgggggatatatataacttccgctgttttcagaattattgtatgcagtcagtatgagaatgcaatttaagtttccttgatgctttttcacacttctattactagaaataagaatacagtaatattggcaaagaaaa

SEQ ID NO: 273900 - DNA, 287 bp, Homo sapiens
tctgggggtaatttgttaatgcagactcatcaagtactgagttttctttatgtatctttttctttaaatattttctcattatagagattaggacttaaaaaaatcttttctggaaatagctcacttgaaaggaagggaatcttttggtgttttccattgttttaaaaatgcacagatgagaaaactcaaggaaaatgtaatagaatagtttgcatatttacttttgtactttgctagaagaatggaaagtcagtggtggaataaagatggtcttgaaagtaacatgt

SEQ ID NO: 273901 - DNA, 502 bp, Homo sapiens
aaccactactctagagtgtcacgctctataagtacacacattctatttagtcattccattctagaccgatagcttttatttttagtttggaactattacaaattgtgctgctctggacattctcgaacatgggttttgggacacacatgtacacttttctgttgcttatacctaggaataagattgttggattataggtgatgcacatactcagttttaagatatgttgtcagacatttttccaaagcaattgtgccaatgcccgtgcctaccagtaatgtgtgaatattccatttccttcacatcttcagcaacacttaatgatgccagtcagaatttgcatttccctgatagctaacgaggttgggcatttttacatgcttgctagctgttaggatatctttctttatgtaatatcccttcagatgtttgcatattgattaatccgactgtctttttccagttaatttttcctttgttgaataaatatgttgcaaatata

SEQ ID NO: 273902 - DNA, 255 bp, Homo sapiens
ttttttttttttagctcatcagttatcgttagtgttagtgtattttatgtgtggcccaagataattcttaattcttccaatgtggcccagggaagccaaaagattggacacccctgtacatgctcatatactttatctttaatctttatagcccttatctgtaagtgttcttgcatttgctttaaaagatctttataaaaacttgtccccaaattgtgagcacttgcaaatcccttctgtcgtcttctcgcattt

SEQ ID NO: 273903 - DNA, 93 bp, Homo sapiens
tctggtctgtagtttttattagattctcagggaatcctgatcctatcatgaagaccttctattctagattgggttcctttcacatccccttct

SEQ ID NO: 273904 - DNA, 1265 bp, Homo sapiens
gttttaaagaagtctaggagttcataaaagtcaaagagcaggaaatacagaaagagcaaatacaagagaattctaatagccttacttccccaggtggtttgaatgagaacctgcacacactttcagtgtacctgcagatacagcagattgtaaaggattgtgacttgacaagttaagtattttctcagtctaatagagcaacttggaatcaggtaatctgaccctgggcccaagtggaatggatgaggtgttaggcggggctaacctccatcagctctgcacacaggtgcaaactgatgccaacaactcaatgactcctttatttgcagcaggctttttcctgttgactcatccctgaacacatttctttaatatagtctaattagagtagcattccaaaacagcctgagagaattatgtgttagaagtttgaggtcccaatcacttactctccatcactgcaagctctaataaagataaataaggaggaggagctaaatgaggtcaaatgattcaccttcttggtggaggctcagtaactcctagctggactaaagaacctagctaagagctgaggccaaagtggagaatctccttatcttttttcaagcagagataacgggtcaccaacggaagttggcctgacttaccacttgcaggtgaaaaatctggagtagttggtctcccagaggtgtcacagcctagtgtgcacaccctgtgggagtggacataggggttcaagaacacagcaaatacagaatgggaaatggatgaacctaaccacatcaaaattccctcatacattgttaaggaatgtttgttaacttagtggacatagaaaagatggacttttgaaaaggcacaaatgattgaatggtagcaggctaccaaatgaactcttatccaagtgccttcaagcctgcctactcccccagattcccctctggactaccaattacctccacccctatcccaaagacacagctgagacatttgtgagcactcgctcagccatatgttcagacatttgtcagatgttgacctccaagagacacaactggcatgaaactgccaattagcacttcagaaataatgttctctcaccagtgatgctaaaagggaaacttcatataaaggagaatatatttgtgaaacgcatataaaggattgtatccagactatataaaggtctcttaaaactttaataaaataataaaacaattcagttttaaaacaggcaatatccaggcgaggtagaaaaaaga

SEQ ID NO: 273905 - DNA, 271 bp, Homo sapiens
tgattcccacccctaccctattccccagaaccttcagcagtgcctagcgcagctaggactcaatcatcgcttgtccacttaatgaatgactcttggcacaaatttcctcgtccttttctgccccagacagacaccccacaaacatgaagttacccttgatttttccactttcttcctcctgcctgcaaattcctcaatcacaggtggtgcaaatcctacctctaaatggtactgaatctgcctactttcggggcaacctcccttacctgga

SEQ ID NO: 273906 - DNA, 577 bp, Homo sapiens
ggaaaatgcagaaaaagtgtagcctgaagcatgattttctcatgtggcacttctgtgtgcaggagatcacagcgcgggttttgttggctgctcatggaccccttctccaatgaggctcatacctgactgaatgaaggacccttgggagggaggcccagtctcctctgagaaaagcctaaccaacaccttatgaaaataagcaaataaatacttgttaaataattggctgggaagggatagggacatcttctcttgtctataaccaaggtagattgctcccatgcacacagatgatcacagggtaggtgtctacaaaagtctccttgccaggaaaaacttttgactatttagaaattgtgttttgcgttatactaccaaatatttcactaatatttaaaaagagttaggaaaaaagtgttcaatgaaatggattccttggagtgaaataaatacaaggtttacaaagtaagagtcacaaattctcagaaattttttcagaagacttggagtattcttgaaatgtagttattttggaaaaataaacttggatatacaggaaggattttaaatgtttcaa

SEQ ID NO: 273907 - DNA, 1482 bp, Homo sapiens
ctgagattacaagcgtcaacgactgtacccggccccaaattccttattgaggatcctagaatacatgagaccagacttggaaatgaaagtgtaacatgtttattgttcaaaaagaaaaactcaaaggtgtgtagtgattttaaaatttagggaaattcctcaatatagtgaaagaagaaaaacaagaaagaaatttaggaaagaaacacacttaaaccataaaaaatagaaaatggaccaataaagataaaagctaaacttaacaaggtaggaaaaagaaaaagaataaattaaaaaattctttgaaagcaccaataaaatagataaaacctcctgagcctgataaaaggggaaaggagccaaaaaaattaacaaaattaggcatgagaaattagacataaccatatatattgaggaattgagaagaagaatagaactctatggcaacaaatttgaaatcagaggaaatggataatttcccagcaaacactgatcctagaaatagtttgaataggccagttggttacccaagaagaaactggaaaggtggttaaaattttatcctttttgagcaccataagatggtgaaaaataaataaaattttatccttgtaaaagattgatggccaggcatggtggtggcccacacctgtaatcctagcactttggaaggccaaggcaggcagatcacttgagccccggagtctgagaccagcctgggcaacatggcaagaccccacctctactaaaaataccaaaattagccaggcatgatggtgcttgcctgtagtcaacagctacttgggaggctgaggtggggaagatggtttaagcccaggaggcagaggttgcagtgagccaagactgtgctgctgcactccagcctgggtgacagagcgagaccatgtcccaaaaataaaaaattgtttttaattaaactttttaattgaaaaatataggggaaattgtacaaatcacaagtatgcagctcagtgaatgattacaaagtaaacacactcctatagccatcactcaacccccaaaatagatgagttttaactattattgtactcaaacctgataaagtgccagaaagaatgctatagcctaatctcacctatggccatagatgcaaaaatcccaaataaaatcaagttgaattgcacactctgattacataaggtttattttagcaatgcaaggctcagtgtcaggaaatttattaatttattacatcaagaacttaaatgttatttaaatgtctagagagtgctagtgttgttaaattttctcattttgataattatactatgattacagaagagaacgtccttgttttcagaaaatgtaagtatttagaggttaaaggtaaacctctaatttggtttgccagtatttcagataactacacacacacacacacacacacacacacacacaggaatgataaagcaaaaagtaaggtgttggcaaggcatggtg

SEQ ID NO: 273908 - DNA, 1271 bp, Homo sapiens
  misc_feature (220)..(222): n is a, c, g, or t
  misc_feature (275)..(275): n is a, c, g, or t
  misc_feature (868)..(868): n is a, c, g, or t
  misc_feature (1269)..(1271): n is a, c, g, or t
tgagacagggtcttgctcagtcactcaggctggagtggagtggtgcaatcacaatcacagctcactgtagcctccaactcctgggctcaagtgatcttcccacctcagcctccgaagtaactgggaccacaggcatgtaccaccacacaaagccaattttttattttttgcagagatagtgtcttcctatgttgctcaggctggtcttgaactcctggcnnnaactgatcctcccacctcagcgtcccaatgtgcttggattacaggtgtgaacnaccatgactgaccctagatgtttatctttaatagaaaaaaaaataggttaaaaaaagtcatgcccaatattaggggaacaattaagcaagaagccctcccttactccaccaatcaccaatcagatttaataccttcctttgtgggtggttagtgcttacatcttagcatttcgactgagttgtactatacatagtcatacccaagtctgtttcccttgctggactgtaaactctctgagtataaatttgagatcctattcagatctgtattatatcccttaccatcttttgggtcttttaggcccctcctccctaccctcagcatccagcacaatatttcactaacagcaggatatgaaaaaatcttaaggtgaaccactataaaaagcaattaatcaatgactttagagataaaataattttatatagaaaaagacatataaacactttagaggtatgaacaaacactaaatttagaactgccttaattcaaccataatttagaataagctcaaattccatgagaatgcaggaatgagtattagatcaaaggagtcagagtaagcagtcatgtccctttacgttttctccgncttcctgcctcaaacatacatgagaagcctagagatgcaacgggtatcttgaaaccgtgaatcaagccacaagtttatgactgtagcaccaaaggcaaaagcctgatcctcaattatgtcaatgagccaactgcctcactctggacttgtgacgtgaggagaaagaaatcccacgtgttaaacccactgttaatgatgttttctgttattgtgacttacagaattttctgacagatactaacagaatttctcatagttagtaaaagggttttcctttacttgttctgacttgtacccatctacttggttacagtgactacaccgtaagtggacacttcaatcaagaaaggcctatcagagtcttcctctagactaacctatggtctgagggaaaaaaaaannn

SEQ ID NO: 273909 - DNA, 294 bp, Homo sapiens
agtggacgccaggctctgcatttctcgggaaccaagtggggtgggccttccctgggtccctccctcccggacgggataaataagccggggctacttggaaacgatttgcgcaatgccgggttcgggcgtccgtttggggaactcagatgcctgcggcagctgatctactctgtgctatgctgagccagacaccaccacgctttgcctccaggagcaagtcttaactagagagagatcaaagaaaaagacaactagggacgactgccaagagtgcaataaatataaagttcagcc

SEQ ID NO: 273910 - DNA, 100 bp, Homo sapiens
tgagacagggtctcactctgtcgcccaggctggagtgcagtggcgcgatctcagtgttacaaggtgtcatttttctggccgcaaatgtttgaggccagtg

SEQ ID NO: 273911 - DNA, 133 bp, Homo sapiens
gccagttgaaggattttatagtgctgtaggtttgttttatctaatgaagtttgaaagcagggggagtatcatgattaggccattgggcacaattaacattcgtagtttacatggatggcaaccttctctagtg

SEQ ID NO: 273912 - DNA, 521 bp, Homo sapiens
aggagcaggcatgtttatgcatctgccttgaggctgggcttggatgctgcagggggaaaaatagttgaaggccttggaaggtaaaagagggaatcacacacacacacacacacacacacacacacacactcactctctctctctctctctctctctctctctctctctctctctctgtctgtctctctctctctctctctgtctctctcacttggattttccctatgccaggtaagggtttgacattgtgagccccggtgggtgcttgcattagggttttgttgttgttgtttaaggagcctgagccgaggggagtgtgagtgccagctagctgctgtaacttaagtctcatttgcccaccattgtgactgttaaaaaggaatgataaagttgttactggttggtttttcgcggtttggggcggtggtggctctccctcactgcaaaatgaatgaatacttttcgggtcaaggttagcgtgaaaatgacagcccccttaggctgccccctttggcactgag

SEQ ID NO: 273913 - DNA, 481 bp, Homo sapiens
aggagcaggcatgtttatgcatctgccttgaggctgggcttggatgctgcagggggaaaaatagttgaaggccttggaaggtaaaagagggaatcacacacacacacacacacacacacacacacacactcactctctctctctctctctctctctctctctctctctcacttggattttccctatgccaggtaagggtttgacattgtgagccccggtgggtgcttgcattagggttttgttgttgttgtttaaggagcctgagccgaggggagtgtgagtgccagctagctgctgtaacttaagtctcatttgcccaccattgtgactgttaaaaaggaatgataaagttgttactggttggtttttcgcggtttggggcggtggtggctctccctcactgcaaaatgaatgaatacttttcgggtcaaggttagcgtgaaaatgacagcccccttaggctgccccctttggcactgag

SEQ ID NO: 273914 - DNA, 282 bp, Homo sapiens
aatgtagcatttaattttatgttgtcttttccccattgagaacaattctgtgaagtaaaatttgttggcttttgaatttcatatcatgctttggaagaactctcctgtcccaagatcttgcaaatatattcctatattttcttctagatttaaattttttaaatatttagatcttcacctgtaatttaccttcttgttcttcaatgtaagattacaaatgctattatcttttatagctgttttctcattaatacatgtcttttaagtcactaatatactgat

SEQ ID NO: 273915 - DNA, 457 bp, Homo sapiens
gtacgtgcctgcattcacatgtacatctgcatgtgtgtatacttgcttttgtgtgtggctgtatgtgcattcatgtgtacatgtgcacacatatgtgcgtgtgtgtgtgcatgtgcccatgcttttgagtgcactgtgtgcaagtgtgtgtgcgtgtgtgtagacagccacaggcaggctggaagggctccttctgaacagctaacccactgctgcaggcagggcacacgggaccccgacctggccagccaggactttgtcttccaggccatattgattcactcaggggtgggcacatgatcctggccaggccaaggagcttcaatctggacttttgctagcaaacctgggaaggaggtaccttctgctgggactgccacactagtggccaggagcccggggcgtggctgggaacactcaaatgccacacacaacaggctgtcaggccccgcacctg

SEQ ID NO: 273916 - DNA, 111 bp, Homo sapiens
atcgatgccacccagaccgtgttatcgatgccacactagtggccaggagcccggggcgtggctgggaacactcaaatgccacacacaacaggctgtcaggccccgcacctg

SEQ ID NO: 273917 - DNA, 503 bp, Homo sapiens
gtctttgctttcttgaggttatatttacatttttgtgctttaaattttgggaggtaaaatacagttttactccccacccttatcgtatgtgtcaaatacttcaactgattttttggagaataaacattttctttcaaacagatctctagctgtgcttggccagcagcatgttagttgccatgcacaataccaggatttgatatctgtttgagaatattcttggtcttgatctggataaaatgactcatagagaaatgctcttgtgctacttttatagcattccctgtatatacagaaatatgtgtttatattggcttctctcagagttttagtcagcctttctctgctctcctgccccacctctgccccatagaaaaagagtaacatgttgtatcaagatcttggtgggaaaataagggagaaatagcgctttgggcactgtccctgcacacattggaatgggggaggggtgggcataggagcctaatgattgataccaaaaa

SEQ ID NO: 273918 - DNA, 279 bp, Homo sapiens
cacacctggccgggattgtgctgaatatgtagatcaattcgaggagcactgcccatccatccttgaacatgggccccgtctccatttacttaagcctcttttaatttgtctcaacaatattttgtctttttcagcatataagccttgcactttttttgttacatttattcctaagtattttgttattctttatgctattgtgaatgaaattgttctcttatttctattttcagaatgtttgttgccagtatatataaaataaaacactatttatttatt

SEQ ID NO: 273919 - DNA, 480 bp, Homo sapiens
gaaaaagaatggatgttgaaatttgtcaaatgcagccgggcgtggtggctcacgcctgtaataccagcactttgggaggccgaggtgggtggatcacgaggtcaagagatcgagaccatcctggctaacacagtgaaaccccatctctactaaagaaatacaaaaaattagccaggcgtggtggcgggctcctgtaatcccagctactcgggaggctgaggcaggagaatggcatcaacccgggaggcagagcttgcagtgagtcaagatcgcgccactgcactccagcctgggtgacagagcgagactccatctcaaaaaaaaaaaaaaaaagaaatttgtcaaatgccacttctgcatttattaagatattcatatgatctttctgttttaatctgttactgtagaaaattatattgcttttacatatattgtttttaaagtttgttttaaataaaagtcatccaagtgagacttatt

SEQ ID NO: 273920 - DNA, 515 bp, Homo sapiens
tagagaggattccagaagcaaggactcaagaggttaaaggtcccagatatagaaaaagcagaaactgctgattgttcctttttttgttgactgattatacaatgtgtccttttaaaaatggttctctgttctctttgcagttcttgtattggttcctagttcctactaatttctcacacttagttaactagtcagtcttactgaaaagtaaactaaccagggatccctggtttctgtatctttcaaacctatagggttacaaaccaaagtgagatgcctatctggtttctgcacagttgtcctgaattatgttggcagatattttatacctagaaattcaccttgaaaaataaattgaaaccataccaagtatttagagctaggggtctaaagtctgcaaaagccctgggaggttgcgttgtctcaagagccagtattcaatggaccactccacatcatagtaaataaaatttgaacacagcattttgaagccaatagtatgggtctctgtgtgt

SEQ ID NO: 273921 - DNA, 348 bp, Homo sapiens
tgccgtttcccaaaaacagtcaagttggaaaagactggaaggatcatttagtgtagtgctgtacccctacctccagtctggtgactgtgcccctcttctctaacagtctcaacagatgattctctagctcaggggtcagcaaactgcagcccgcgtgggccagcaggcctgtttctataaatttttattggaacacagccatggtcattcattaacatatctgtccatggctgctttcacactacaatggcagagttgagtagttgcgacagggaccatatggcctgcagaaactaaaatatttacaatctggccctctaagtaaaagattgcagacccctgctctac

SEQ ID NO: 273922 - DNA, 95 bp, Homo sapiens
aggatgtacaggctacaggtgccccggcgggaaggaggtatcaggcatgcaacacaagttactgcaaagaccctgacgtgggagcccgattggcc

SEQ ID NO: 273923 - DNA, 498 bp, Homo sapiens
tgctttgtaggaaatgcgagctgggccgtgaggcgtgtagtcacactttccagcacagccgaggtagaggacctgactcctcttgaggctgaaagataccctctgccttggttgcacttccctcaccccattctgattttctccattcatgagagaatttccacatagtcagtggtctccttgccttcattcccaccttagtctaatataggagttggtaaatgatggtcctcaggacagatccatacctcctggctttgtaaatacatgtgcattagaacacagccgggttctttcttaaatgaaatacttaaatgtattgtcttatggctgctttcacactacagcagcagagttgagaagttgtaacaaagactgtgtggtccacaaggccacaaatatttaccctttggcctgctgaccccttaatccatccaactggctgcctgtgagtgatctcttaaacctcagatcgaaccacaccactcttctgcttac

SEQ ID NO: 273924 - DNA, 646 bp, Homo sapiens
atttaaaaataaatcagtattctgtgtttacattattataactctgaaagattcatttactatcaagccaaatagtgtagtgtgatttaatctattttcttctaaagctttttgtttttcctggagctgacaattgcattattttttcatttgcttagttttctggtattaatcactaattctttccaagccttttgagaaactataaaaccctacaattcttgcttgaacccgggaggcggaggctgcagtgagccgagatcgcaccattgcaccccagcctgggcgacagagcaagaccccatctcaaaaaacaaacaaacaaaaaacccctacagttctgtttttcacatggtcaaatgtatcagctgcactattttttttttttgagacctaaaactagggattgcctaagcctttcctttttaaaaagtcaggtttatataggtataacttgcatacagtaaaattaaccttttttaggtgtaagagttctgagaggtttgatagaatatatcaaggtatagggccagcgccgatggctcacacctgtagtcccaacaatttgggaggccaaggcgggaggatcacttaggcccaggagtttgagaccagcttgggcaacatagtgagaccctgtctctac

SEQ ID NO: 273925 - DNA, 425 bp, Homo sapiens
agccaacttactttccatttcagctcattgtcttgccatttcgtctttgacttttcatgagagaatccatagttttcctgattttcattgggaacgcaaatagggtagagttccttacgacctgctggcagcatttagtgacttcattccaatgggatgttcttcttctctattaaaggctcatacttcttaatttttttggtcacaaaatcttttcactgtttctaagttactttctgtccattttctcactcctgcaatggtaaattagaatttaatctaggatgatacatccttgtaattctggtgttttcccatgaacaaggtttaatatttcgtttcattccactcatgttcaacttggctgctcgaagaattttccttcgtgtagtgagggctggtcggggtgtgtcccttggttggcc

SEQ ID NO: 273926 - DNA, 452 bp, Homo sapiens
ccttaactatcgaggaatggcaggaaattctgtctgcccagcacctggtgaccctggagctcctcagtttcctggggagttgagttttggagcagtctcttccagagaggctgggagtgcatcactttccccctggaggtggcggaggctgctgggcccaactagctcattgccaggcaatccagagagagttccagacaccagatactgaacaacctacttgtctccacacctagtaaagcttggatccaatgctgccaacttttctgcctctccagttttggagcccttaatgtgaaggtgcaacccagaagcctgcaggctgttcgtagcctgtagatgtgttttcttcccagtagctggagtacacagtgtttttgtattatttttcaaataagcaatacatttgtgtggttcaaaaattaaagcgctatagaaaggtaaaaaagaaa

SEQ ID NO: 273927 - DNA, 330 bp, Homo sapiens
actccatccttcctttgctcaggccaacccccttgtagccaccctagacacctcactgcctcccacatttcacatctaagcaggcatcaagttatgttggctcctccttccaagtgtacccaggatggaactgcctctccctactcccacgtctctcaccctgctccaggccaccttcagctcgctctgaaggatcatggtcgcatccaactggtttccctgctcctccccagcccccttcagtctatttccctcctctgctcaccactgggcagtggccactgctctcaagctcaggaaaagcccaagtcctggcctggcgcagtggct

SEQ ID NO: 273928 - DNA, 467 bp, Homo sapiens
tgtgtctgcaggtagaatgctgtcatgggccacagtcatctcaaggctccactgaggctggagcatccccttctggaactctcatggctataaaatgaagaagtcacttggttgctgttaccttgctgtgtgaacctctccacaaggttatttgagtgtcctcactaatggcatctggctttccccagagtgggcaaactctcaatagaggacaagtgaaggggaagctttttatggcttagtccctgtagtcaccccgccgttccttacacgtattcattggaatcaagccactacgtcccaccgatgttcaagggaaagggacttaggctctaattcttcaaggagaaggtgtcaaggaatttgtgaacatatttacaaatctttacaataactttttgcatacatccatgcactggtataacctagcatttatgctaataaagtgttatgtgcatgcttttggt

SEQ ID NO: 273929 - DNA, 1382 bp, Homo sapiens
atgaaaataagacatgatgtaccaagactcaaggaatgcagctagcacacttcttagagggaaatttgtagctataaatgcctatgtaataaagaagaaagatctcaaatcattaacctttccaccttaagacactagaaagagaacaaactatacctaaagcacacagaaaaaagaaaataacaaaaagcagggcagtgatatggtttggatctgtgtctccaccaattctatattaaactgtaatccccagtgtcggaggtgggtccttgtgggaggtgattggatcatggggttggatttccccctttggtgctgttctcgggacagaggtctcacaagatctggttgtttaaaagtatgcaccatttccccctcgctctctgttcctcctgctctggcatgtgaagtgctgcctcctagtttgccttctgccgtgattgtaagtttcctgaggcttccccagaagccaagcagatgctgccacgcttcctgtacagcttgtgaaaccatgagccaattcagtatcttttctttataaattacccaatctcaggcatttctttatagccatgtgagagcggactattacaagcagaaatggaagaaatagagaacaataaagaaatagagaaaatcagtgaaaccaaaagctgattcttggaaaatatcaagaaaattaacatgcatttaagtaagtaattaaccaagaaaaaaagagaaaggactcaaatttctagggtcaaaaaaaaggacattactgccaatcttatataaataaaaaggattataaaggaatacaatcgtgaataaatgtatgtcaagaaattagatggctatttttctaatagaagtgaaatgaataaattcctggaaagacacaaactgctaaaactaaatcagaaacagaccattttaatagatagacttataattagtaaaaaggttgaattagttatcaaaaacctatacataatgaaaagtccaagtccagatagtttcaccactgaattctaccaaacatttaaaaaattccagtgctctcaaaaaaaaaaaaaaaaaaaaaagaagaggggtgaatatttctcatctcattttatgatggcagtattaccttgatgcaaaaccaaagacatcacaagaaaactacagaccaatgtttttataaatatggatgaaaaaaatctcaaaaaataccaccaaactgaattcggcaacttataaaaagaattatcaccatgaagctgggcatggtggtgtgcaactgtagttgcagctcctcaggaggctaagcagggggaatcccttgagtccaggaattgaaggatgcagtgagctttgatcacaccactgtacttcagcctgggtgaagatttatctaa

SEQ ID NO: 273930 - DNA, 926 bp, Homo sapiens
actcacaatagcaaagactaggaaccaacccaaatgtccaacaatgatagactggattaagaaaatgtggcgcatatacaccatggaatactatgcagccatggtattgagtggccatgtgagagcggactattacaagcagaaatggaagaaatagagaacaataaagaaatagagaaaatcagtgaaaccaaaagctgattcttggaaaatatcaagaaaattaacatgcatttaagtaagtaattaaccaagaaaaaaagagaaaggactcaaatttctagggtcaaaaaaaaggacattactgccaatcttatataaataaaaaggattataaaggaatacaatcgtgaataaatgtatgtcaagaaattagatggctatttttctaatagaagtgaaatgaataaattcctggaaagacacaaactgctaaaactaaatcagaaacagaccattttaatagatagacttataattagtaaaaaggttgaattagttatcaaaaacctatacataatgaaaagtccaagtccagatagtttcaccactgaattctaccaaacatttaaaaaattccagtgctctcaaaaaaaaaaaaaaaaaaaaaagaagaggggtgaatatttctcatctcattttatgatggcagtattaccttgatgcaaaaccaaagacatcacaagaaaactacagaccaatgtttttataaatatggatgaaaaaaatctcaaaaaataccaccaaactgaattcggcaacttataaaaagaattatcaccatgaagctgggcatggtggtgtgcaactgtagttgcagctcctcaggaggctaagcagggggaatcccttgagtccaggaattgaaggatgcagtgagctttgatcacaccactgtacttcagcctgggtgaagatttatctaa

SEQ ID NO: 273931 - DNA, 1717 bp, Homo sapiens
gtaatcctactttatacattttaaacattattctgagaagtagtccacatggttcacttattaagaagttcacggcacacacaaaaacaaacaaaaaagaattagaaactcctgctcttataaataaaccttacaagggttaaattcagagtgattaacagtgaccagacaaccaactgactcatcaaaatcccatgtcacagctaacaagaactaagtttgcaatgaattaaatgaaaattaccttttccctatttgcaggctgctccatgtcatgtatctcattataggctgataataagtttgatgaaaccagcttattacaccaaatcaaagccaagattgaaagaaaatataacaaaagagagaattacttattttgtcaacctccaaaccagattcctattctaaaaaatcacaaataaagcaaacctaccatttgcagcaaactctaaaccaagaaaaatgatcacctttgttgcttatttcagaaagccaagataaaaagagcagaatgtgcagaaaaatatgtgctgcactagacctctggtccaaccctcacaatcatcagtactgtctgagacttccagctggttctcaaggcctccgggactcaattttcaaaggcatctgtacctccttgtcctcttgtacactcgtcttctactctcttcagcctaggactacaccacagtcattcccagctccatacctctgctctgacctgcaacaaaatgtattccacctgtccttcaagtcagttgcatgcaacctttgtcctcattgagccctccccttgtctgataagattcagaacccattaatttagcacttagttccccaaatattccactactgtttcattcagaacccaaggttcctagaaggacacaacagtcaacagttaactgaataataagagtaagagaatgcctcaaactgctgctaaactcacactaaccacaaaaaaaacaaactataataattaagtaattcctgctttaaagtgtcttctcatttcctataggcaacacagcataagactcacaacaccatctcttcaacctctctagttatttttcttcaacctaaccaccaaccagactgactacttctacattatctactgaacacatatctgttttactatttcctccactagaattctcattttcttcgtatataaaaaagtctttcaaggcacagctaaagaactacctcttctggctgggcgcagtggctcatgcctgtaatcccagcactttgggtttgttttggggggtgggagttgatcctcccacccagtctgcccctggtctctgcccatccaatcagagcccaccctcctggaagagacccccgtgttcagagtgctggcagccctgcacgtgtccagggacactgcatttcaaagaaccactgagtgggtgagctaccttgggcaaaccccccactcctgactctgactgccacgtgggtggcccgacctctgacctgctgtcatcatagaggtagaaagcaaacaatctggggctcagcacacctgggggtgctcccactcattcagtgtgtggggcccctgagcagaggctgggcattgccactagaacctgagctcctagagagcaaggacctgggtggcctcgcttactgttccagcccaggccgagcacagggcctggctcgtggcaaaccttgaataaatatttgttggctg

SEQ ID NO: 273932 - DNA, 372 bp, Homo sapiens
ttacttcatgaattttaatgtaaaaaaagaaaaagaagccacagatcctctagacccttatgcaatatagggaaatattccttaaccccaatcgtgctttaatccttcttctactgaaacaaatacagctaatgaattagagatgctcttttgttctcctgttaactatctgaccttaaggaagtcactcaaccaattggttctcagtattctctttccacactgagggaagtggacagataatctatggttgcttctagctccaaaattcagtgaccctttaagcttaacttctttcaccagaatacctgtcatttctaggtaaatagtgttctcagtcctttctgttaaagaggttaagtaaataaaaag

SEQ ID NO: 273933 - DNA, 290 bp, Homo sapiens
gggatggggtggaggcgcatggccacctgagaacttgcgagactcatgccagcccctcctagggtgcccccaccaccagcctttttggtccccagtgagtctttcatccaagtgggtcactgccaggggtgaggacttgtaaatctatgtgagatttcaacaaatgaggcttctagctgatggtcttaaacacttccacggacatctccattttcttttagacaaatgggaaaataccagttatagtcattcactaacatccttttagtccacaccgggggcaaggcact

SEQ ID NO: 273934 - DNA, 183 bp, Homo sapiens
aaacccatcaaaaaattaacactttgcaagtgccttctttgttttaaaccaaatcaatttaagaatatgctcagattttgagattaaactctccccccagggaagctaaaacacagctttcctaaagatagaaaattctagtttcaaagatattagaataaagatgaatgagctcattactgg

SEQ ID NO: 273935 - DNA, 426 bp, Homo sapiens
tggggggaatttgggactgagtataaataatcagtgtgagtttatgaagccttggggatttacttatggggtcatttcttagaaaagaatgtttaaggatgctgatcaccctgaaatcaacagaagaagccagtctgcaaagcaattgaacaaatatggggccacagatgaggactgtgatgagagagatgtcattcacttctctcagtgattttgagtgcttcctggttcagtatacaagcaggatccttttggataaggctttcctgaagaaggtgatagtgtattttcttaagagactgttatgggccgggtgcggtggctcacgcctgtaattccagcactttgggaggctgaggtgggaggatcacttgaggttgggagtttaaggccaacctgggcaacatagcgagaccccatctctac

SEQ ID NO: 273936 - DNA, 313 bp, Homo sapiens
gaacaaaagcctcactgaaggaggagaaaggatgagccataatgacagcttgaaggaagaccattcaggcgaagggaacaagtgcaaaggccctgaggcagaatgaatgcctgaagagaactgaggcggggaacaagcacagaattaggaagacctagacatggtggtgcaggcctgtagtcccagctacttgggaggctgaggtggtaggatcccttgagcccaggagtctgaggctgcagtgaactatgatcctgctactgtactccagcctgggcaagagaatgagaaatctgtctattaaaaaaaacaa

SEQ ID NO: 273937 - DNA, 383 bp, Homo sapiens
gagttcaagaccagcttggccaacatggcaaaacccctatctctactaaaaatacaaaaattaggccaggcacagtaaacttctgatgattcacgtgcaggtggttcacacctgtaatcccagcactttggcaggccgaggcaggtggatcatgaggtcaggagttcaagaccagcctggccaatatggtgaaatcctgtctctactaaaaatacaaaaattagctgggcgtggtggtgcgcacctgtagttccagctactcgggaggctgaggcaggagaatcccttgaacctgggaggcagaggttgcagtgagccgagatcatgccattgcactccagcctgggcgacagggcgagactccatctctaaataaataaata

SEQ ID NO: 273938 - DNA, 334 bp, Homo sapiens
aatttttatgaagccagcccagaattcccagaattcagtcgggtgcactttgcaaaccctaaaatgctgtcaccatagaaggtttcattgcttgcacctgctataacatttgaggcatttgagaggcagtgaaacacatttgcttttcattttatctgactttggaaacctttgaagtgtttaatagtagagcccaggaaagatctccgcctcttaatcatttactcgtaaggcacattctcggctggtagcctgtcaagcagaaactgaactgagcccagttttattaagtgtcacatgcccagtcactgttcattaaaggtgttttaaggtt

SEQ ID NO: 273939 - DNA, 390 bp, Homo sapiens
tgtagacataagactttacctttttaatttttttagaaacagagtcttatgctgtcaccgaggctggagtttagtgataacattcatagctcgttgcaacctctaactgctgggcagaagcgattctccaacctcagcttcctgagtagcttaggactacaggtgtatgccatcacgcctggctatgttgcctaggatgttttcaaactcctcagctcaagcgatcctcccgcctctgcctcccaaagcactgggattacaggtgtgagccactgcccctagccagactctaccattttttacagttgtgctagaagttaattaactatgacattaactctcagagaggagatcttagaattataataaattggctttttgatgcttatt

SEQ ID NO: 273940 - DNA, 470 bp, Homo sapiens
tctccctttgtcccttgtataattgctgtcattcattttattaatttataagcatgcatacagacatgatatgtacataagcatacacaatccaatgcattattactgttttgggggaagatttacctctgtttaattttatgttgaacattctttcatttcaacatttatttattgaatgtctacaccatgaagtcatagtgccttgaatagggttgtattaagatgaatgagggtttgagctgggaatgttatgatcagcactaaaatatggaagctatgacaagcccaggtggatgtgatgagattctgaactaagttgagggaagggagaatggaaaggagaaacaagtccatactattttgcccagactcagagaacaggtatgtaaatgttatttaaagatctgccatgcacgctcataccagatactcaaaatttttttgaatacaacaggcctcaaatctga

SEQ ID NO: 273941 - DNA, 714 bp, Homo sapiens
gagttctggtgaaatctgctcatttaaaagtgtgtggtacctccctccccaactctcactccatatcttggccatgtaagatgtgcctgttttcattctgacttctgccatgattgtaagtttcctaaggccttcccagaagcagaagccactatgcttcctgtacagcctgcagaactgtgagccaattaaacctcttttctttataaattaccgagtctcaggtatttctttatagaaattcaagaatggactaacacagaaaattagtaccaagaaaaggggcattgctatgatacctgaaaatgtggaagcagctttgaaactggataacaggcagaggttggaacagtttggagggctcagaagaaaacaggaagatgagggaaaagtttggaacttcctagagacttgaattgttgtgaccaaaatgctgatagtgatatggacaatgaagtccaagctgaggaggtctcaggtgaatacgggaaagttaccgagaattggagtaaagctatgctttagcaaacagcctggctgcaatgtgtccttgctctatggatctgtggaactttgaacttcaaagtgatgatttagggtatctgatggaagaaatttctaagcagtgaagtattcaagacatggcctggctgctcacatgtgtaagcaaagaaatgacctgtaatttgaacttttttataaaagaaaagcaga

SEQ ID NO: 273942 - DNA, 122 bp, Homo sapiens
ccagctcctgtcccaggacgtcatctccaggcccaaaacttcctcaagtcagcctctctagtcccaactgctgcctcctggtggcctatgaaggcccaaaatctcctcaagttgacctctcc

SEQ ID NO: 273943 - DNA, 365 bp, Homo sapiens
tgagcaggagccacggcccacctgtgggcaccgaccccaaggccagggcaggtctctgaggttggagagggcggttgagaggccacccaagatgagcaggggcctgatgggaaccggaactaagcagtctttcctgtcgctgggcctgacacagctgccttctgtgcccagggaatcccgggggctgggaactgggccttctcctgcagctcccacattgcccgggcaccaggctgttgtcttccttcctggcttgaaaaaaagtccaggtccccgccagaagcctttggcctgctgagggagcaatgtacttgttttttctaaattccttccttgggattttatttttttattccccctgccaa

SEQ ID NO: 273944 - DNA, 404 bp, Homo sapiens
ttatctccaaaccttaccctcatgttactgtagccacttttactcctacttcacttagagaaacacagacttccattaccagcaaagtgcaatctatatctgaaaaacttccaatgaaacaacaaaaaattgctggataaaaataacaaacctacttttaaatgcatagctgagcttgcaagagagtaaggaaatccccagaggtcaaacgtgaagacaaaactaaaaactagatctcaaaatgtgaattggtgctggacttgtcttagggtagggcaaaggatgtgttttcattcacatagatatacagggaggtaaagctcggatgaggcaaggtagaggcttagaactgaggccctctacaaaaagatggactcactagaatccagtgaaagttgtgaagt

SEQ ID NO: 273945 - DNA, 427 bp, Homo sapiens
gacccagtttattgactccatattcttataacagcaaaataaaaattcttttaagttaaaaaaaactttatcataggaatttccaagcatatgttaaaataggatatctccagcttcaacactaatggcattttgcagattgagaggataataaaatgtagctgtagtttggatacatgtatccagatatattacatgtatttcagatatgtcctctgaaaatacctgcaagtttatagagaatgttgtatatgtcctttgactttatccatgcttagttccatagtgtataattcagtttatggctgggtacagtggttcatacctgtaatcccaacactgggaggtcgagctgggaggattacttgagcccaggagttcgagaccagcctgggtaacatagggagaacctgtctcttaaaaaaaa

SEQ ID NO: 273946 - DNA, 464 bp, Homo sapiens
tgttctttctaattcactgggctttagacatactgaccatttgtgtgtcctcaaatatgtaaggcatttctttgtctcatagcctttgtagatgttgtttcctcagcttgcaataattttctccaaagcatgtttttttggtcccgtatttattcagctcaatgccacctccttagagaaacttcacttagtctcttcttgtcactctttacttccttatcctgaatacttattgttctccatggtgcttaacgttctttacttgtttattgtcgaatgccttttccagaatgtgagcttcatgagaacgtctgctgtatcctctggaatatggtcagcaccggggtgagttagaattgacgagttaaggggtgcagcacaccagcatggcacatgtatacatatgtaactaaactgcacattgtgcacatgtaccctaaaacttaaagtgtaataataattta

SEQ ID NO: 273947 - DNA, 408 bp, Homo sapiens
atatttatttatttaattcaaattgatgtgcattgatcattattttcataggaggaataaatgctataactatgtaagcttacaattaaattttatttaaagctgccaaaaattaaatttatttaatttttaatttagaggcatataaaatttgtgtcattgttttctgattttttagctggaagagacaaaaaaagtgaggtgagattattttcttactactttctgttgaagaatttgatctcaaaattgacatggtaatataagttcatgactaaaatctggacacatcaaggtgttaatattcaaattaaaacagttataagcttttctgataaaccaaaatattagtgagtgatattgatgactatgaatattcaattgagatttttttttctaagtgatcac

SEQ ID NO: 273948 - DNA, 624 bp, Homo sapiens
tctggggccttcttgcctctcaagaagggccccaaggagcccattcctgaggagcaggagctggacttccaagggttggaggaggaggaggaaccttccgaagggctagaggaggaagggcctgaggcaggtgggaaagagctgaccccactgcctcctcaggaggagaagtccagctccccatccccactgcccaccctgggcccactctgggggacaaacggggatggggacgaaactgcagagaaagagcccccagcggccgaagatgatattcgggggatccagctgagtcccggggtgggctcctctgctggcccacccggagatctggaggatgatgaaggcttgaagcacctgcagcaggaggcggagaagctggtggcctccctgcaggacagctccttggaggaggagcagttcacggctgccatgcagacccagggcctgcgccactctgcagccgccactgccctcccgctcagccatggggctgcccggaagtggttctacaaggacccacagggcgagatccaaggccccttcacgacacaggagatggcagagtggttccaggccggctacttttccatgtcactgctggtgaagcggggctgcgatgag

SEQ ID NO: 273949 - DNA, 923 bp, Homo sapiens
gtggaaaatttagacaatacagaaaagtataacaattaattgcctatgattctgtcaccagaaaaaatcacttgatatttttgcatcttccttgccattgtctttgctacttctgcatatttttacttagtttcatcattctcagtgtaatttatatcttggggtttttccccgcaacctacaggcattattccatgtcattaaaactgtgtcaactattattaattttatggtactccattgttatggatgtgccatgtttcatataacctttacttattttgaacagtttagattatatctcataatgccacaatgaatgtctttgtgtataaattattttcttaggataaaatactggaggtggaatttctagtcaagggtatatgaacacttttgtagttcttgattcataccacttttccacatgggtatgttaatttatactgcagctagatggtatgggaagggtggtctagccatattttccaagaacatgcaacgttttatctttatgcaggcatctgcactaagaccctctgcctttctgactctatggaacggggttaactgatatggagatcattggcagagattttcccaagctttcttagttttaaatatatctgacatgggccgggtatggaggctcacgcctgtaatcccagcactttgggaggccaaggcgggcagataatctgaagtcaggagttggagaccagcctggctaacatggaacatggtgaaaccccatctctagcaaaaacataaattaggtgggtgtgatggcaggcgcctgtagtcccagctacttgggagaccgaggcaggagaatcgcttgaacccaggaggcggaggatttgcagtgatccgagattgtgccactgcactccagcctgggtaacaaagcaagactctctaaa

SEQ ID NO: 273950 - DNA, 417 bp, Homo sapiens
tgacagagtaagactgtctggaaaaaaaaaaaagaatcttgaacatctagtttaatggatttcaagttctactcaaaggagtatgcacctgtgcaggggatgaaggagcagggggtggggtggcaggaggtgggaggagtcagatgggagaatatctgaccccctgctcctggcttcaatcagagcagcattttgtgttcatatttatttgacttccatgtgaattttatttaatggttttgctgctgattgaaagagcagaaacccttgccccagcaccctgttttccttaacctctgtcattctcattaaccatggtcatgacttttgccatatctatgtaccacctgtattgttaatttagttatgtactatttttgattaaatgcattcactctctgaaaacctcaaaaaaaa

SEQ ID NO: 273951 - DNA, 875 bp, Homo sapiens
tttctagcaactgctcttaagtcataggttcctcattttttctttgctggtagtgggagaaaatagttgatctgtgatttttgttttcatctccccaaactatgttataaaggcagtaatttgatgctgaagattatgattagaaatcctcagatgggttatatattggggctttatcttttaatattaaaaagaatgtctttcctggactactttattcagtagtaagcactattcattctatgtatattccttattcagccttgcagactcctgtgggatctgatctcttcctgcttcaactcagtaccatactcaccaaggcttagtatgtcttcacccactctcccttctcttgcattcctcaaacatgctgagtttattccagccttaagcctttgatctacgcatcagaaatgttgggccccacttcagatcttctctgccctgccttctactccagtcactgctgtggtaactaattccatgaagtctttgaccaggttctcagagaatatgatagtacctctctttggattctagctgtatacctttcacttcagcctccctgacgtggaatgtctgcagaacttgtttggtactcccaattgcacagcccaaaggtgcaggggagttaggtgcccatggggccatccttgacctaggtggaaagttgctagtggataactgattactcttttcatcacctgggcagacagttctgaaatgcatttcgtaagtctcctcaaaagaggaggagacttctgtggcgggtttggcaataaccatccttatattggctttcctcttttgtttcactcctgtgcatctctcttgcatcctgggatcgcttctcaaataaatgactttcattc

SEQ ID NO: 273952 - DNA, 539 bp, Homo sapiens
gattccaaaaaaaagaaaaagaaaaagaaaagaaggctttttctaattagaaaggtcaggttagtggcattgtggaagacggattggacaggggcaaaagtagacccagggagactagtcagtctagccagtcagccaacaagtgttttgtaagttctgtagtaggttaaatagttgcttcccccactccaaaagttatgcccatgtcccagaacccgtgaatgtgaccttatttggaaaacagaactttaaagatgtaatcaagttaaggatctcaggatccttgattatctgatgggccttaaatccaatggcaaatgtccttaaaagaaacaaatgcaagagaaggccactgaagacagaggcagagattgcagtgatgcagccataagccaaggaatgcccggaaatgtcagaagcagaaagagcagattctcccttcaagccttcagagggagtgtggccctgctgacatcttgacatcaaacctctagcctccagaacaatgagaataaatttatgttgccttatgccaccaa

SEQ ID NO: 273953 - DNA, 262 bp, Homo sapiens
attttcattgttgctacaaagtacaactatattactaaatacatattgatattattgttggtggtacgtattacttaagagtttatgtgttttacttccacagaagtgaatttttagtacattatcaagtaggtgagaatagagttaaaattttataaaaatgttcattattgttaaaccatggtattaaaaacttttaatgcttagaaattaagttctggtagataaaatatggtttctaaaatcatttaatctcaattat

SEQ ID NO: 273954 - DNA, 174 bp, Homo sapiens
aatcatacacttaatgatatacaattggctcaaatttttattttacataaaaataaaagatagacaagctaatagaaaaaagtgttatcagtgacaaattagtatcagtccttcctgtaatgttagtttacccacctaatattggatttatagactgctaagtgtgtttgtttt

SEQ ID NO: 273955 - DNA, 351 bp, Homo sapiens
ggtggtgcatacctgtagtcccagctacttgggaggctgaggcaggagaatcgcttgaacccgggaggcggaggttgcagtgagccaaggtcacagcattgcactccagcctgggcaacaagagcaaaacaagagaatatataaagaactctcaaatcacaatcttttttaaaaacaacagtaaacaacagttcatttagaaaatgtgcaaaagacacaaaaagatattttgccaaaaaggatttagggtaggaggatctacttaagcctgggaggtcaaggctgcagtgagccgtgatcgtgccactgtactccagcctgggcaacagagccagaccctatctttaaaaa

SEQ ID NO: 273956 - DNA, 259 bp, Homo sapiens
cctgtgaagacaggggtggagactggagtgatgcggccacaagcccaggaatgcaaaacaaccagaaggtggaagaggcaaggaatgcattctcccctagatcgccctggagggagcgcagccctgttggatttcaaccttctggcttccaaaactaagagggaataaatttctgctgtttattttatcttgagatggagtcttgctttgttgtccaggcaagagtgcagtggtacgattgtggctcactgcaacctct

SEQ ID NO: 273957 - DNA, 505 bp, Homo sapiens
aaaatgcaggagtcttggctgagtcccctttctctgtctgggtctcagtttcctggtctgagagcattggaggagtagcacaacctacttaatatttggggctggaattgaatactagaagcttcactcaggtatttctacaagtccagagcagggaggttagacatttctctgtgagagcaacatgtgaggaaaatatggggggtgagtgtcttagagccctttgtgcttacacaaactggaccagctgagtgagcagggcaaggcagccaccctccaggtcatactgtggaacagaggcaggacccctcccaagaagccgtgctctcagctccctactcagggctctgggcagcttcccgattctagtgctggcagcagcctgatgtctatccttctgtcctgcgagaagctcccacttaccggggaggcttctgcttatctgtccccttttgcaattttgaactcttcaccctccagccctggcaggggctgaggaacatct

SEQ ID NO: 273958 - DNA, 402 bp, Homo sapiens
ctgcgttcagtgctcagtggtgagttcccacgcaagagcctggggagtcaaccagaaagacccgaacgcggggcgggcccagcgacctcgggcgccatctgctgattaccagacgccactacctgagaaaggcccctccagtcccctcattgcccagctgcggaccctaagcggagccataaccgtcctaccaacccacgtcagcagaagagcccagtgggagggcgtgtgttcacttctgctcctctgggcaaagacgcccaggtcagaaacacccacccgaccctcccactacccagagacagccccacctgcacagctcagagcaggaccactgaccctctggctctccggtcatatttgctattgaagaccagaataaagtatttttatcaggattga

SEQ ID NO: 273959 - DNA, 1604 bp, Homo sapiens
gtaatgtgtcagttgaaagccatctttctaggttcagctcatgtaagcctctctgaatgtcacaagtgtatattgttctatatttatcttaaaactgctaagaagttaggggaaatggaaatgcctgcacagatagtcaaaatagaaatggacacggaccaaaaatgctggtggctttacaagggatgctttctcaaaaatttaaaacgtggggagggaagaacatggttaggaaaacagatgactgtctattccacatcactctgcggcctttaaaataggcttttaaaatttttccagccttgggaacttggataaaaaggggcagataaagcagaaacaactctcagcttgttgctgccattgctcaccactaggtggcgacagagtgcagctgcattacaaatctctgcttaagcgacttgccatttgagttacatcaccaaggggaaagggcgaaagacagtctccccagataatctatttacatcaccttataggacatttgcacctacctcagcgtcaaaattaagatgctgattttagccaaggtaggccaagtagtccatcatagtaatctttcatgcaatagcgtgcacatcgaaattaccattttgtttctttttctgtttgttttttacctatttgtcgtattaagaaattatccagtatctttgggttttggtttaccattctgcaaaatggagttgaattgtaaccattatttttttttacgtgaccgagacacatgagaattaaccaatcaatgtcagtgtcccagctctctgtgtaaaactgatgacggacacctttacacagcagaggaaatacatctgtggaaatgtgtatccttcatggaatccctgaggggacccgattaaccctcatcttgtccaactcattgatttcagagatagggaagctgaggcatccccaaggttatatggtgcttaacgcccaaaacagaaagacgcagatgagccgtcttagataactgttcttgctactcattccctactagtcaaatgcctttaaaataaactatttcaactactgtaattagtcagctttcctcaaaactgtctcctagttatccacattaacatggaggtgattcttgttaaaggtaagctttgaaaagttctaaaactcgccattataagacacacacaacttctctgctacgaaaagtcttgattgattctggcctcaggatgtgaacagtatagaaaactgatgatttgtgtgtaaaaagaggggcagggtttgaaagatatgaaggaagggaaaagagaaattgggaaacaggtaaaagcaaggacgggggccgggcgcagtgactcacgcctgtaatcccagcactttaggaggccaaggcgggaagatcacaaggtcaggagatcgagaccatcctggctaacatggtgaaaccctgtctctactaaaaatacaaaaattagctgggcacggtggtgcgtgcctgtagtcccagctactcgggaggctgaggcaggagaatcgcttgaacccgggaggcagaggttgcagtgagccaagatcacaccactgacctctagcctggtggcagagtgagactccatctc

SEQ ID NO: 273960 - DNA, 1861 bp, Homo sapiens
gggatggcagtatggaaacagaataaaatgaggcagatttatcataaagcagtgctagaacaacccatgtatatcttcttctagtagcatctctgaaagggggtaccaggaagcaccagttccatgaattgtctagagcagggattagcaaacctttctgtaatgggcagatagtaaatatcttaggctttgagggccagactacctctgtagccactctgcaactctcctgttgtgctaaagcagctacagacaatacgatgaatgggcacaactgtgttccaataaactttatttacaaaaaaaaagtggtgggatagatgaggcctatgagccataatttgtcagcccctggcctagggggaagaagaatctacagataagcttaggaaacactgcctggtctatctcccccttggagattcactgagcacacagaacattacacactctgaaattctgaaaggaagtcacttgcctttgcgtagcccatcagttcccaaatttatttggtttcatctccttattctcatgtaacttctattaacatcctgaagaactaatgttctgtggaacatactttgagaaacattgactatagactggattttagaggaacaaaggaagaatattctatttgacttaatgccaaacgccatattccacacctaacccttggggaggtgcattctccactgtggttggcagatccaactccaggggcccctgttgcactcccctcccctctcgctttggcttagagtatggagacagggtgagaatgaggttgctgcctggccagaagggggtcccttctccctgcggtagcagctgttgctgctgccaactacttctttgcatgaatttatttacagggctcctttaaaacctcttggacaaaaacacaataaaaatagttaattataatagtttaggcagatgaacatgacattaataaattatgcattttttaaggagtttaaaacagtatgtctcagattccagttccactgaggcaggttagctttacaaaggtcccactggtcccatctgagtccaggtactcgtcacacttatcacctgggccactgcaaagacttcactgggtctttttccagccttcagttctagtgcactctgatccaccctgcacaccactgagaaattaatctggtaaagcaccatctaatcaaaatgctttttctcaaagcccttcactggctccccaaagcctatggcacacaacacaatccctcagccagttaaaggtcttccatcctctggctccaatttacctctgcaacataactgggttagttcgcccatatggaacctgctccaggcatataggtattccccaaatcttcaagcacatcagaagtttctccctaacttaattatgtttgttctagaccctctagcccagtggctcccaaatataaccagagcaggataattatctggggaactttttataaattcagatttgtagatgctattccagacttccctcatcagaatcccttagggatggggcattagaaacttatattttaacaagcaccctaagtgatttttatgtagccagcccagatcaactgggaaccactgatggtccaaactcttcatttaagagatgagaaaaccaagtctccaaggccctagtctgggcaaggccacaggtgctcttgcaaaactaactaggcttcttaattgttttctcatccattcatcatagagggaatgggggtatatgccacatggttctatagataaatatttgcagctgggcaaaatcttcagcagtaagattttgtttaaaagtcaaatttgcaaccaaaaaaaaagtcaaatcccactt

SEQ ID NO: 273961 - DNA, 528 bp, Homo sapiens
aggatgttagtacaaactatagcgcctcatgttcttaacagaccccaccacttcggatgccagttacagtgtaattgtaggctatgttcttcattaagaattgatggatctgctgtctgcagaacaagcattttggaataaatagccccatttgaacaataggccaaaagcaaagccaactagtccataagagatttaaacagcctgatatttttttcccctacaaattgtgctttattcagtgagggttcacatttggaagttcatatttgtaaacattaattttcaaagccaggctttccctatagttactgcaggacaaccccctcataaagcattttatcacattgaggtcaaaatacatttcctcatgaatgctgtggtctgtggccttgctgtccaagctctgttactggtctgccaggagttaagttccaaaattgcaagtatacactcaaactttcatggcaatttgacggagtaatttatgtttgtgggaatccaataaaaaactctggatttgtaaat

SEQ ID NO: 273962 - DNA, 350 bp, Homo sapiens
tcaggtatcagcactttgcttatttccggccgaagcccaggaaggggagaattaaagttgcagatggaagttgtcataggggccctcataagtggaagaagaaggtcagtgttagagagacacatgtgaggatgctacgctgctggcactgcagttggaagaagggaccacaagccgaggaatgcaggtagcctttagaagctggaagaggcaaggaaacagggactcccctaaagcctccagaaaggaatgcagccctgatgacaatatgattttagcccagtgagacccatttcagacttctgggtgctgaaactatactacaataaatttgtattgttttaagtaac

SEQ ID NO: 273963 - DNA, 119 bp, Homo sapiens
tgtacttatcttaatatcgttaagagatggcagccaagggtaaaactgagtcttcttgggctgactatgatgaaaatgccaagtgtaatctgagcacagccctgaacttgggctggtag

SEQ ID NO: 273964 - DNA, 419 bp, Homo sapiens
acacgattcttccaatcctcactccggtaccagtttccctctgggtgtgcagagcgggagcctggcaaggtataccagtttcacaccttgggtggcttcttagaacccctgactctggataggttcaaatagcagaatctggatatcgctggttgtagtttctgatacctacaacagcggaatactgtgactcttctcataaagctaaaatcaggaataacatttgcttgaaaccatctgctctcccaaacaaaagttcaaatacgtttcactgaaagtcacatttaccacatatttaacttattattattattttttttgagatggagtcttgctgttgcccaggctggagtgcagtggcgtggtctcagctcaccacaacctccgcctcccaggttccagtgattctcctgcctcag

SEQ ID NO: 273965 - DNA, 578 bp, Homo sapiens
gacatctccactgttgcagaaggctctgttacacagtgccgcacttggttcagttacatctgtcgttaaatgcagtgactttccacaggagagagatgggagaagcgataactcccagggaggacatcgtgaaatttctgtgattggatggagagcttgcatcttcattcccttcccacttgaagttctgatgcttttctcggaagacatgtcttccagctgtctgttgagaattagtgttccatagtaagttaattgtgggaaagaaaattggtgccaatagcttttcagggttggactattactgataattggtgaggtccatacatagttaaacagcacctatatataacggtaaatgctgctgttcaatttcggctccagagcgtttagtaacattagttacagcaagtgctgatgattacattgaagctttgtaaaatgataaaaaattagaatattggaaatgcattctgtattgtgtgcaaaacagcatgtatttatgccaccttttatggttaggaaatacgtaatctagaaagattcacaagaaacagaatactttgctctgggaatgg

SEQ ID NO: 273966 - DNA, 442 bp, Homo sapiens
ggctggtctcctgacctcaaatgatccacctgcctcagcctcccatagtgctggagttacaggcatgagccactgcgccccaccgcctcccattctattcaaagtcacccctctgctcactgacataaatacatatctgattgcctactttagagaggccaatcagaaactcaaaagaatgcaaccatttgtctcttatctacctatgacctggaagctcccttcctacttccagttgtcttgcctttgtttcaagttgtcccacctttccagaccaaaaccaatgttcatcttacgtatattgattgatgtgtcatatctccctaaaatgtataaaaccaagctgcgctcagaccaccttgggcacgtgtcatcagaacttcctgaggctgtgtcgcaggcgcacgtccttaactttggcaaaataaacttactaaattga

SEQ ID NO: 273967 - DNA, 254 bp, Homo sapiens
ctcgtgggaggtgtttgggtcatgagggcatatccctcataaataaattaatgcgctcccacaggggtgagctgtcattggcaggaatggattagttcccactacagtgggttgtgaaacagtctgacttctttggtctctctcttgcctcctctgtcaccatgtgatctctacacacacctgctgcccttccattttctgccatgagtttaagcagcttgaagccctcactagacacagctgcccaatcttga

SEQ ID NO: 273968 - DNA, 281 bp, Homo sapiens
tttactgggatgcttatctactatgtactatccaccataccaagaacttatatctgttcttgtttaatcttcatttacccagtgaaagtaattgccacacttgtctccatttcacagatgaaggcacttagcttaggcaggcaaataacttgcccaaggtcacacactagaaagtaacagagccagcctttccatccagccttcaaaccctgagtccgatgttttcatcactaacaggaatgcccgctgtgtctactcttcatagagtaaatggtggaggc

SEQ ID NO: 273969 - DNA, 603 bp, Homo sapiens
acattttgcccatccattcatcggccgacggacacttgggttgcttctacctttttcctcttgtgagtaatgctgctgtgaacatgggtgtgcaagtacctcttcaagaccctgctttcagttattttgggtatagacccaggagtggaattgttggacctcacattacttttcaagaccatcagtctctgcactctgaatctgtcatgttctcagttttttctttagcttattaagaagtgtagccatgtgaattccctaattgttgacatgactttgtttataaattaccaaatattcttgatgtagtgttcaaattaatacattattttgcaaaaatgtaaagtgctaactcttaactgtctatttttctttaaaaatgtttatattaacatataatgactcttgtttttaaatgaattaaaatacacacacacacatgtacttcagagacaaagtctcactctgtcacctacactggagtgcagtgatgtgatcatagctcattatagtcttgaacccaggaggtggaaattgcagtgggcagagatcgcgccactgcactccagcctgggtgacagagcaagactccatctcaaaaaa

SEQ ID NO: 273970 - DNA, 271 bp, Homo sapiens
tcgcctgggcccccgttccctaaaaaaaaaaaaaaaaaaaaaaaaaaaaaaaaaaaatgcatttaatacatctgacctacaggacatcataacagcctagccttccttatactttctcagaatacttagattagcctacagttgggcaaaatcatctaacacaaagcctatttttatctcatgtaagagtattttactgcatattgctagcccaggaaaatctcaaaatttaaaatttgaagtacattttctactaaatatttatcacttt

SEQ ID NO: 273971 - DNA, 683 bp, Homo sapiens
acatacacacacacgcacatacatacacacatgtacacacacatacacatacacacaatacacacacatacatgtacatgtacatactcacacatatgctcttcaacttaatgatggggttagttccaataaacctaagataaattgaaaatattgttaagtcaaaaatgcatttaaggccaggcacggtggctcacacttataatctgagcactttgggaggccgaggcgagcagatcatttgaggtcaggagttcgtaacagcctggccaacatggtgaaaccccgtctctactgaaaacacaaaaattcggggcgtggtggtggacctctgtaatcccagctactcgggaggctgaggcaggagaatcgcttgaacctggcaggcggaggttgcagtaagctgtgatcgcaccactgcactgcagcctaagcgacagagcaagactccatctcaaaaaaaaaaaaatgcatttaatacatctgacctacaggacatcataacagcctagccttccttatactttctcagaatacttagattagcctacagttgggcaaaatcatctaacacaaagcctatttttatctcatgtaagagtattttactgcatattgctagcccaggaaaatctcaaaatttaaaatttgaagtacattttctactaaatatttatcacttt

SEQ ID NO: 273972 - DNA, 645 bp, Homo sapiens
taattctgcaacagacagctccctgacattctcactgggcccctccacagcctgtgctagaggtgtgccctggaatgctgtggcatgcaggtagttaaagaccacatctcccgccgccatgatgaggaggtcggcgcggctgtgctgcgggcaggcagcggagagggctcgcggcgagggctccagcttaccccgccgccgcgtcgcgtgcacggagcgcttcagaggtttggagggggccggaacctcaaaagcaactggatgagcacaacgcggacgccccggagaagcggcgcaagcgggcccaaaatggttgctgatcagacgagtggcatctctcgcccccctaccgcgggaattgggacctccagactgtgcctgggggatcggcaagtggttcccctctggttttttcggcgctgccttcccggtggtatcctcactctctctctttgaaatgacctctgctttcctatctctaactcttcccagatatttgaaagcaagtttttgtacaaagcaacatatgaatgtattcagccattcgatcgttcggcgaacatttctaggtgtctcgtgctgtgccagatattgttctgagtgcgctgaagatgcacctgttagcaagacaaagtcctggctccc

SEQ ID NO: 273973 - DNA, 317 bp, Homo sapiens
ccatgctagatattttcagatctttctgttcattcaaccaatagtgaattgagtgttgccaggcactgcatatgaacaagacacagtcacagaccttaaaaactcagactgctagaccaacctggctaacacggtgaaaccctctctccactaaaaaatacaaaaaaattagccgggcatggtggcgggtgcctgtaggcccagctactttggaggctgaggcaggagaatggcgtgaacccaggaggtggagcttgcagtgagccgagattgcgccactgcactccagcccgggcgatagagtgagactccatctc

SEQ ID NO: 273974 - DNA, 383 bp, Homo sapiens
tttttttttaagagatggtatcacactctgttacccaggctagagtgtcatgtggtatgatcatggctcactgagctcaagtgattctcccacctcagcctcccaagtgtggctgggatcacaggcacatgccaccatgcctggctaatttatttttaaattattttttgtagtgatgggatcttgctatgttgtccagtctggtcttgaactcctgggctcaagcgatcctcctacctcagcttcctgagtagctgggactacagatgcacaccaccacacttggctaatttttgtattttttgtagagatagggtttcaccatgttgcccatgctgggctcaagcaatcctcctgcctcagtcttccaaagggctgggatt

SEQ ID NO: 273975 - DNA, 246 bp, Homo sapiens
gaggtgaggaaggaagagggagggcccagagctgcccacctcacttgcaggtgtggcctggaagagtgccggggtctctaatgaagaatcaagttcaagggatgaagaggagttggcgaaggggcacaaaaatacagctagatagaaggaatgtgttatagtattcattagtataatagggaaattagagttaacaatttattgtgtatttcaaaataactagaagaattgtactgttcctaacac

SEQ ID NO: 273976 - DNA, 428 bp, Homo sapiens
actctggaggcagaggcatgagcatggcttgaactcaggaggcggaggttgcagtgagcagagatcacaccactgcactccagcctgggtaacacggggagactctgtctcaaacaaacaaacaaacagaaatacactcctgggtggagatctaagatgctaacgagacatgcaacatatgaacaagcatgtatagtcactgcgtatgtgcacccagaatatcactcagaacatgcttataagcaactcctcttccctccaccttattaataataatgtaaaactcccgtaagggggtttctccagcgacagtccacgctgtctcactcttacgagcagcccgccctggagtatctctctcagggtgtactgtaatctgcacttaactttcaagtattttcttttccaataaattatgctgtactttt

SEQ ID NO: 273977 - DNA, 255 bp, Homo sapiens
gggagtggggggtactgagacccctgggggcacagcagacctacccatgctcttggatcagaacgctgggaatattagaggtagtattgaagatgttaggagggcggggtgcgttgggaggctgacactggaagtcaggagttcaagaccagcctgggcaccacagagagacctcatgtctacaaaacattttaaaaacatttgctgggcatggtggtgaatgcctttagtaccagctacttggggtctcacgag

SEQ ID NO: 273978 - DNA, 501 bp, Homo sapiens
tcagtaatgatttgagtcaggttaaataaagacaagcgctgtgaactgggggttttcagggaattcccagacagctcagataatgacaattctttggtaacggagttttggggaagctcaaacatgttcttccctctccagtggatgcaaggctactagttttcacagctactctgacggtgatgctgttgattttcaaagctcctgaaaagctggggaaaagggcataggaatagggtgggtttgaatgtcacaaagctcactgtccttacatatgtttaaccatttttcttagatagacacttagtgttacttagtttgttgaaagcccatatcaatttacagctttcttaaaaagttgattttgacaatatctgccagtacttttgttgattttatgaagaagtggggttttggaggttttcacttaacctttttcactgatgtcactcacttgcattattttttattcagctttatttaaatataatttatattcca

SEQ ID NO: 273979 - DNA, 694 bp, Homo sapiens
ccatacagggtcattctcagaaaccttattgttcttgtttcaagttttcttattatctcaagaagtaccccctaaaatcccagtgcactaagcacattaacatcatatttctactaataatgcacaacttcccttcaatatatagtgataacagactctcttgcctgtaaaaggaaaacattactgaagaaagtaagaatatttactaaagaacatatatattctttaaaaaattattttacattaaaattcctagtttttaatttttttagttgggcaattgagttggagtaatagttatgttctcttgggaactcaaatgttgaatgatactaggcataataatatagatggtcagatttaattatagtgcaatattgattttaagcacctgacttcttattaaatatcttttactaacttgttagatatgcacatcatttatactagatagaaatgtgtgagtcaaaggttaacatacttttcaacaaatattaataatgatttaaaaatgtaagatacttaaatagccattttttcaaattattaggtaatttggtgaattaatttccataattacatctgaaataaattcacccttaaatattattttgtaaaaatccattctggatttaatatattatgtaaaataatataaaatatgcatttggaaagatacaggaaatgttttccc

SEQ ID NO: 273980 - DNA, 282 bp, Homo sapiens
tttttttttttttaatggcttatggtatttattgccaaatcaccatagaaagttggtgttgatttttcacttcctccaatagtgaatgggagtggccatttcctgacctcttgacaatacctggcacaatattcaccattcagaaaaatcttttccagttatttgtttgagcacgttcaaatgttggagcctttttgtgttctttgtctagttttctttggtgatgcttttttaaatttatttgtagtatcacagcccttttccccttctgtcgtcttctcg

SEQ ID NO: 273981 - DNA, 1208 bp, Homo sapiens
caaggacctgctgtcagggctcattaaaccccgaagtatggcaccttggcatgcggactactctgacccagaggagactggaaggcctcagaagccaggtctttgtccttccctcctggttcctgcctccttttctcccccaaattgagtcccagaaaccagaattccttttcctcaaagcaggtcttagaaactagaattcctttctctcaaacccagccataaaacctagctaggtcactctctcccttctccctggaagatcctcattcccgagggggatacccaggggaaggggaattgtacagagcggctttgctgggtttcccgactctgtccatcaccgttaggccagatcctttgtgtccaatcacatttctgcgtggatgttcattcatcaaacctaaatacaaaaataaacgtttttatggccaggacaaaaaaaaattaacaggagtttggaagaagttgcttccaaccctcatggatgactttaggggtataagactttggtggaggaactaattccagacgtggtagaaattgcaagagaagtagaattagaaaatggaacatgaagatgtgactgaattgctgcaacctcatgataaaacttggacagatgaggagttgcttcttacggatgagcaaagagtggtttttcttgaggtggggtctgttcctgttgaagatgctgtgaacatagttgaaatgaagacaaaggatttagaatattacataagcctgttaataaagtagtagcagggttggcaaggattgacaacaattttgaaagaaattctactgtgagcaaaatgctataacaacattgcatgctacagagaaatcttccgtgaaaggaagagtcagtctatgtggcaaacttaattgtcttattttaagagattgccagttggtcaggtgcagtagatcatgcctgtaatcccagcactttgggagactgagacaggtggatcacttgagcccaggagtttgagaacagcctgggcaacatggcaaaactccatctctacaaaaaatacaaaaattaactgggcatggtggtgtgcacctgtagtcccagctactcgggaggcttaggcaggaggattgcttgagcccaagagttcgaggctgcagtgagctatgatcatgccactgcaactccagcctgggtgacagagcaagaccccatgtctttaaaaaaa

SEQ ID NO: 273982 - DNA, 534 bp, Homo sapiens
tccttaggaatcctgggtagaaggaattttctggatattcgagtctatcctctagctccaggtcattgtcagtggcccctgaaacatattattattatatgttaatgaatatttctccagtagtaaaaagtgagagctgcacttattgaattcacattatacatcatactttggattaaagttttacctatggtaaatttcatttattcttcaatatatgcctattgggtattatcaacttcattttacaaacgaagaaattgaagttcagcaacattaaatatcatgccccaagtcacacagctattgagccgcttgtctgagaattctatccaggcgtgtttatgaggtatgaaccacagtccctgccttctggatgtgtgccatattttgcctactagtgaagggactcatttttacatgctccttggtccaaagagtagaaaatggcctaatttcagcaagcaataatgaactgcagtttgtgttaatcatttgaagctgctgataaaattggggattagcaactcaact

SEQ ID NO: 273983 - DNA, 759 bp, Homo sapiens
aacatgtctcagctcttcctgaggacaagattttggctgggatccttgctgttgtcactgcaatactcggaatggctgtgtgactttggctgtgtgactttacagcaatgacacagaaacgaccaggacagatgaaaaaaatccagggaaaagctatttaggggataatattgagactattaagactttcataatgtttttctctgaacacagacatttttagcattattagcaatgcaagaccatcctgggaaaggctaccaccaatattctgtgaggcccatggttgcttatgttagagcattgcgcccagcctaaccaggcctccacgcctgccccatccagtgcctcatgctaatgaagcagcaatgccaaaaatccagtattattcaatttactccatatcatcacgcttttatggcctatacaagtaatctaaaaatctgtgatagaatctggttcttgatatctgagtccccttccaaagccactgtcataaatttagccaggaatgagtcaagctgttcattaggtacaagtgcaagttgacatccaaattatcagggaccctctcttaacaccattttggttggatacagctttaaattagctgtaactgtaacttggcaaagattttcaataataacaaagggtaaaaattgccatcatattttgccatttaatcagcacatgttccaaggagccaaggaataaaatcaaagacaaaagggcaaggtgtcgtcttgccttatcttttta

SEQ ID NO: 273984 - DNA, 443 bp, Homo sapiens
tatacctgtacagaaaaagttgtagaaaggcttaaaaggaaaaacaaaagagtgactgaataatgtaccttgattccttgatttttctcagttactatgatgatttttgtcatctgttgaaaaaggtttctgctaaatttaattatcagatcatcatctcaaatcttcaaagttcctttttttgtctttctctattaacagacaaattaaaagggaaggatcaagtatatgaaatgaaattgtgatgctccaggaacagttttaggtcttacgtttctcattggaagaaaagtcctctgtcaaaaagaaaattttgaaaagtttaaattatctaaaaatatacagtgcccctaaacttaacatatataatgagtgtatggcctggaaatccaatctcttcataggctatttgcacatgcaatatcaggaccatacttacagtt

SEQ ID NO: 273985 - DNA, 376 bp, Homo sapiens
cttttagttcaaattctcactcacagggatctcactgactcctggctaaaggaggaggagaaatcacaagcacatcaattgctccctcctgatccaatcagtttgtgtcttgattgtggcttcctatggcctcttaagcaagatcttcaacacagcaatgtcatgagggctggcagacactccaactgtgtctacgcaaagatgagtaaaccatgttagagtttaaaaaatcttattttcaggcagtgtgagataatttgccctcaatcaacatggactacctttacatagagaaataaattttagaaatcatctggcgtattaaatcaatggaaaataggatctgataacaaagcattgtctattccagctgaaa

SEQ ID NO: 273986 - DNA, 665 bp, Homo sapiens
aaaggaatggtctgcacattttgttagttttgtttctgttgattttctaatcgaaggaaggaaatgagcccgtaatgatctactccttaaagcttgaacacagataaaacgacatccgatcccatcttaatgtggctttgaaataccctttcctaatacttcctgagccctcttcagatgcctttacatcatcagagcctttagttgccatttttgcttgtggttgcattatggcttttcaagcagctgctgtggtttttgaattgtttcagtatttttgttataaattaatatctgcattttgaaatgcagatccactcacccccaaactaatttttgatttttgcttatcatattgatagtaatgaaaaaaaagaaaaagaaaatgaagtgccttagaaagcgtcagtgtgaattgctttcacaaaatgacactttgatgtggttatagacttatttttattcttgtttcattttaactagtgtattttgaaaatcttgtctgttgatggcatttgggatggtagtgttttcgctgttcgtgggatttttctttgtattcatatcttaagtggcacggtctgtttggcctgcagagctggaactatggggagggccgcgctgagcgttgagtggagacatggagcctgcatccccacagagca

SEQ ID NO: 273987 - DNA, 465 bp, Homo sapiens
caaagtatacaaaaatgtagctctgctcaccaaatactaggaagaaagtaaagggtttggttagttatagtgaaaatgttgtcacacagtatgggaatttgattacatattttttatgttttccttctacatatgcacatggattatgtctttgttcactgttaaatctttagtgcctcacctatagcaggtgttcaaaagatactcagttcaagagaaccatgctgaaagaaagcaaagaaatagataaaccatgggataaccagcagctaaattggacttaacacttgcttttgtaaaaaaaaagtttcattggaactcagctagtctacttttaccttttctctatggttgctgccttcatactgcaaggcagattggagtatttgtaacagagaccctctcaaagcctaaaatatttactatttgaaagtccttttcaaaaacagccaacctttgttataa

SEQ ID NO: 273988 - DNA, 364 bp, Homo sapiens
gccttgctggcactgcctacatggattccagctttgggtgccgaggtgcctggttctacatcaccttgtgcctgctacctagaatagacctcccgtgcctgcctctttgcagacaaactgccccagccttgtccactgtcttgctgttgggtggagggggttctgtatggggacaaaagacagacgggcaggctgtggctggagctgtgtgcagactccattgcagcctctgggtcctgctctgtaaagggtcctgtgctgagggaccatcctcttccggggtctagagaggcctctggcctgggtgtaggatgtcagacctgagggccaccccagaagccactccacggaggccatgccccta

SEQ ID NO: 273989 - DNA, 427 bp, Homo sapiens
caagttgagaaccactgagttagatcagagaggtggcatttaagatgagaaaaaggaattcaaatcaggaaatactcaatctacatatttctttgtgttttataaccacctaagaattgtgtgcttcgggccaggcatggtggtgcatgcctgtaatcccaaatcccagcactttgggaggccgaggcgggtggattgcttgaggtcaggagttcgagaccagcctggccagcatggtgaaacaccttctctactaaaaatacaaaaaaaaaattagcctgacatggtggcagatgcctgtaatcagtcccaactactcgggaggctggggcaggagacttgcttgaacctgggaggcggagtttgcagtgagctgatagcataccactgcactccagcctaggtgacagaacaagactgcatctca

SEQ ID NO: 273990 - DNA, 892 bp, Homo sapiens
ggacacacaaccagaagcaaagacagcagctgacctgtagctgatgacggagtttcgctcttgttgcccaagctggactgcagtggcgcgagcctggctcactgcaaactctgccttccggtttcaagcgattctcctgcctcagcctccggagtagctgggactacaggcacacaccacgcccagagaaaaacagatcttcaacagttttttgatggaaataaacaatttcaagttgagacaacacatcagcttcatgcattccttcagcttgaagtcaactgggcctgggttgaatctggttctgttttgttgttgtttcattttgttttttagcatttgactatgtacagtctctatttctaagtcttgatttcctcatttataaaacaaagcaactaaatgatatcaaatacccttgttttgaaaatcaaagaataagcacggcacccaagacaactttttgtatcacaggcacacatgaatgcttttttccttttccttttcttatcataaaaacctatattttatgacttttacatttattcctagatgctctcatatgcattatctcatttttacaataacattataaatataaacactgttatgctattttacagatgagagacttgaagcacagaagggtaaaactacctttaacttctaaagaaattttgtgagaagcatctgagactcttgacagttaaaatccctatcatttcagaaagtgcaactggggatcacctgtttttaaataattctagttgagaatagtcaaaggtcgcatttatgaaggaagattggcatttttaaggttcccaatgatttcatcaaggttatttagtactcctaagcctcagtttcttcacttgcaaaataagaataccaa

SEQ ID NO: 273991 - DNA, 555 bp, Homo sapiens
agatgggagatatgaagtaggagactgatgtttagcaggccacttaacatacttgagactcagttccatgattcgttaagtaggaaccaataagctgagtatcactggctccccatgaatataaaaggatgtatgttatactactatttccaagaactttcctacaaagtgtctgtgacggattgaattatttttctcaacttgttactcccttctttccatacgaggattacatatccctttcccattggcattggtgacttattttggccgatgaaatgggagtgtatgtgatacactcctcatacataggtacctaatggcagaacttgtaaaacgtaggaagtctgtgcccgtgttcttcttcatgtcccctctaccgtgtcccagccaatggctattcctgcagcctaattctcagaataaaaagtgaggggaagcaaatcctaaccggacacacaaccagaagcaaagacagcagctgacctgtagctgatggtatctgtaaacaatttatttatgtgaataataaatagttgttgtaaacactcagta

SEQ ID NO: 273992 - DNA, 1009 bp, Homo sapiens
ccaagaactttcctacaaagtgtctgtgacggattgaattatttttctcaacttgttactcccttctttccatacgaggattacatatccctttcccattggcattggtgacttattttggccgatgaaatgggagtgtatgtgatacactcctcatacatagacggagtttcgctcttgttgcccaagctggactgcagtggcgcgagcctggctcactgcaaactctgccttccggtttcaagcgattctcctgcctcagcctccggagtagctgggactacaggcacacaccacgcccagagaaaaacagatcttcaacagttttttgatggaaataaacaatttcaagttgagacaacacatcagcttcatgcattccttcagcttgaagtcaactgggcctgggttgaatctggttctgttttgttgttgtttcattttgttttttagcatttgactatgtacagtctctatttctaagtcttgatttcctcatttataaaacaaagcaactaaatgatatcaaatacccttgttttgaaaatcaaagaataagcacggcacccaagacaactttttgtatcacaggcacacatgaatgcttttttccttttccttttcttatcataaaaacctatattttatgacttttacatttattcctagatgctctcatatgcattatctcatttttacaataacattataaatataaacactgttatgctattttacagatgagagacttgaagcacagaagggtaaaactacctttaacttctaaagaaattttgtgagaagcatctgagactcttgacagttaaaatccctatcatttcagaaagtgcaactggggatcacctgtttttaaataattctagttgagaatagtcaaaggtcgcatttatgaaggaagattggcatttttaaggttcccaatgatttcatcaaggttatttagtactcctaagcctcagtttcttcacttgcaaaataagaataccaa

SEQ ID NO: 273993 - DNA, 161 bp, Homo sapiens
agccaccagcctgtcactgactgcaggtggccacctagagcaatctggggactggatgagccttgaggacatcacgctaagagaaacagaccagccaaaaaaggagagctaccccttacttctctttcatgaggtctctagagcagtcactcattgaggga

SEQ ID NO: 273994 - DNA, 207 bp, Homo sapiens
tcgaccactaactttgctgtttaaatcaccgctttgaaaatatcttggttaacgttaaatattttgtgcttagaggtataataaacactgtagttagtggggataatgccatgaatattagcaagctgaattaagctactaatccatttaaagaaagatgggttacggaagaagcaagcctctgaagcatttgctttaaatctaaat

SEQ ID NO: 273995 - DNA, 421 bp, Homo sapiens
agttatcaaactacttggactttaaaatagctgtgatcagccggatgcagtggctcacgcttgtaatcccagcactttggaaggccaagatgggcagatcacttgaggccaggaattcaaccagcctggccaacatggtgaaaccctgtatctaccaaaaatacaaaaactagctgggtgtggtggtgtgtgcctgtagttccagctacttgggaggctgaggtggaaggatcgcttgagcccaggagttggaggttgcagtgagctgagattgtgccgttgccctccagcctgggtgacaaagtgagaccctttcccccctcccaaaaaagaaaaatagctatgatcaatgattaatatgttcaagaaataaataacagaataatttcaccagggtatgtaaaaaatgaatcaaacggaa

SEQ ID NO: 273996 - DNA, 483 bp, Homo sapiens
gttcccctgaagggagcactctttctgctgcaggcagctcccagttatccgaaacaccgtcaaacccaaggcctagcagctcatttctggtttcgagctatgcttgggggaccactttcttgattccaaagtgtatcccgtggcctcaagaagaagacaaatagaatcaattgcttttgtccctttgatggaagcatttaaatgtgaggtcctgactgtggcatgagagaaagttggacgccctgtcccactaacggttgtttctgatgattctacaccccactctgtctcctcctgacaaccacagccatctgagcacctggggttcatgtaagaacagaagtgcaagcctcattcatttaaatgctcttcaaggatatgccctatgtaaataagaaatgagtgtgcaatgaattaagacagtatacattcaattacaaaaccacgagttgtgaaaaataaattatgaatatgcaaaggaaa

SEQ ID NO: 273997 - DNA, 583 bp, Homo sapiens
tccttaatattggaatccctgactttcagatggtcacagcctgcccaaaatgaaggctacatttcccagtctcccttgcatgtgtgaccaggtgcgaccatgtgattaagttctccgcaatggttgaagagtagaagttatgcacgcaactccagaatcatgcccctcaagggaatgagcacatcctccaatattttccactttatcttttccacctccacctgacaatgaaacctggagcagccatccagtctatgatgttaagaatccgggtacctaatgccgtccagccaccatgcttaccctggacatagtctgaacctagtttaacttttacatgagaaagaaatttaagttgcttgggttactttattttggcctttctgttaccatagcctgaactgcatcggtgatactatgacataataagaaatatatatttggtctctgaccgtgcacacaacttctaaaacccttggaatttctggagtgttaagaatgtttttttgaggccaggcatggtggctcatgcctataatccaaacactttgagaggctgaggtgggaggattgcttgaggcca

SEQ ID NO: 273998 - DNA, 328 bp, Homo sapiens
tgtctgtagaatcaccctaaaatgctttaagcttctctacagaaaataacttcctggctgggcgcggtggctcacatccgtaatcccagcactttgagaggccaaggcgggcagatcacctgaggtcaggagtttaagaccagcctgaccaacatggagaaaccctgtctctactaaaaatacaaaattagctgggcgtggtggtgcatgcctgtaatcccagctactcaggaggctgaggcaggagaattgcttgaacctgggaggcggaggttgtggtgagccgaggttgcaccgttgcactccagcctgggtgacaagagagaaa

SEQ ID NO: 273999 - DNA, 350 bp, Homo sapiens
aacaaaacacaggactctaaggttattgtcacataggctgtgtggctgacgtctgctacaatagaaccataactcttctcaggatggtagggttttgatgtaacctatacttcccgcacatgtaccctcaaacttaaaataaaagttggaaaaaagaaaagaaaaagaaagaaaagaaactctgcttgaggcgccaggctgctgtcctgtggaattcaaactcgaggctgcaacatcaacttttaccgtatctccagcctgccggcctgctctccaaattccaaaactgccagcctctgcaatcctgagagccaattactgaaaataatttgctccccatcccccgcccc

SEQ ID NO: 274000 - DNA, 429 bp, Homo sapiens
agttagaggagcaagagtggaatcaaacaaagcgtcttaatgcctgggtctcaaaactcagaacaaaattgctttcaccatattctatcacctaaaggaaatcacaagccagtccatctttaatgatcagagaattagattccactttgggatgtgagtagatgcagaaaattgtggccatttatgtaaatcctaatctggcctcaaatccttttctgtgatggaatgagaaagcctcaaaatctttgtgagttcagccctccaagcagccactcccaacttttagacaagacacaaatttgtcatccatggtgcaagacaataactagtgttagtctgctcatttatgagtagaataatcacagatatgattgctataacctaataaaatgatatatcctaataaaatgatatattctaatatggtaa

SEQ ID NO: 274001 - DNA, 402 bp, Homo sapiens
cttctgaaaatgatttctattacaggtattcagagaaagccaatgaagacacgaagagtgggtgcagaacctcccgagagaaagagatcccactgtcctgagctcacgggcacccacctagccccgtcctgagatggaccctgcccacctgtgatgctgacatcccccctctcagctgacttagagcccccgtggcgggtaggatgctccctgctgcactgccctgcaggccacccagaaccatccagaaccacccagaaccatccagaaccatccagaaggtccattctcctcctcccgccttgctgccctttcctctgccaggaacatccttccctaactgtccaggcacaagactcctagatctccaaaacttaggttaagtaggagcccccttgggtg

SEQ ID NO: 274002 - DNA, 266 bp, Homo sapiens
gaaaatgttgagtataaatttcactgatgattaagatctggattcaacatttgttatgaaattgtcattactaataggatatcacatgatgatttagtcattgtaacctttgagtcatgaacactattcctttgacaaacagcatatgtttgtgatagtacacagatgtaaaatttcattttttcttcccctcaacaccataactaaagtaaaggaaatctgccttaaaagagacattatccagtgacataaatctgactaaatga

SEQ ID NO: 274003 - DNA, 435 bp, Homo sapiens
caataacagttttccaaaagataaaaacacaaagaatgagagaagaatagtttcttctaatttcccctatcttaacctttttcccattaaaaaaaaaagtgcagcttgccaccagtactcacttaattttacataaacatgcttttcgaggctgaagcaaatctgattgattttcaatgtgaaagtaaaacataaaaattgttcttggagttatttctaaacagaactaacatcagaatcatctgaatcatcagaattgtctatttcggaaaaattggattcatcaaatgaatctctggccaacaactgttggagaccaatgttaacaccatgtgtaggaatgctgtgttttccaggatttgacattttcagcgatcaagaattactatattttgtaaataaaaataccactactaaaagcagaatgctctaaat

SEQ ID NO: 274004 - DNA, 429 bp, Homo sapiens
tgtttacgatgtgatacatgaaatgaagggcacaggcaagacggggcaggaggacagaggactaacgggtctctccgagttaggagtccaggaaagcttcctagaaaaagtgcgccttgttctgggctataaaagtcttgggtgaggagggctgggcacggtggctcacgcctgtaatcccagcactttgggaggccgaagcgggtggatcacgaggtcaagagattgagaccatcctggccaacatggtgaaaccccatctctagtaaaaatacaaaagttagctgggcgtgatggtgggcgcctgtagtcccagctactcgggaggcagaggcaggagaacggcttggacccgggaggtggaggttgcagtgagctgagatctctccactgcactccagcctgccaacagagcaagactctgtctca

SEQ ID NO: 274005 - DNA, 2627 bp, Homo sapiens
  misc_feature (2107)..(2107): n is a, c, g, or t
tatatatagagcacctggcacagtgcccggcagagggtgggtttgtagattccctctgtaacttctcagccttgtttgcacactggcttttttgtcctgctggcttcctggcctctgcttcgtggccttgcgacttcatgcttaagcacggagcagggttggaaggaagaaacatggagtagtggcccctgactggaagcttcttcggacaggtgtacaacccttccagagcccctgtagttgctgccactgtcactgctgctgctgcaacctcaagataaggatcacactgcccaagttcagcctgctgtctgggtgtcagcctggagcccaggcagcacggtggccattcattgctgcttgtcagagaagaatgcagctatcttctttcctgcgtgtgctggcagccgtctgggtggcattagtaacccagccaccccgtgggccttctccacttcagctcaggtctttgctgagagcctgagttgtagacggaggctgtgaatgcgggcttggtgaagtgggctgagcacgccagcagatgggtgggcgatgggcttcagcagtgtcccactgctgactgtcagtctgggagtggtggcgtccccttcttccctctgcctcacagaagttgcctcctgaagttgccgccttagtctgaaactggggggtgcaggggtgtaggggtagcgggcagctttgcagaggagaggttaggcaggcaggcaaagcttgatgggttttgtgttttgcagagcaccgtggcctcctgggatgctaaggtcaccctcaggtcatcccaggtgtttgctcatggcaactcgcttccctggcggttgtcaaagcccctccaggcccatgcttgtcttcaccaaggcctttctttctccttcagaggcccctgggagcagctcctgagctggtgctgaggagcctcaaggtacaagatgggaaagaaattggaggccacaggctggacacctgattggaacaagagctatagcctgagcgtccaggtgtccagccaagttcccaacccatcttccctgagccgcttaaatttacattgttctcttgctccctggaggaatggcaagttttctgttttcctctccctacatggatccatatcttcctatagccacacagaaggtgccaagtaaatgtttgttgaatgaatgactgacctctggacaagaggttttcctgcttccccattgattccagctgatctctgggcttctttccatggctaccgaaggaagagtaaagtttctcttcaagcagccgtgcctctgggctctcagctgtgcccatctttctcttccccacagggaggatgtcccatcccagagcctccctgggcccctgcctctgctggcccatacgtgtgtgggctgggattctgtcctcctgtccttgtcctcatctgctccctatggttttgctccttcttccatccccccactcatctgggaccctccagccactaagagactccacagcagccctaggccagctctagcctagtgtcttccctttgctaggtccccactctcctgcatgaggcgtccacgccaggcactgtcttcactgtgtaatgtcacccactccatcttagggatgcttgggtcatattttgaagggggggtgtttgagacctctcccttctctcttcccccatctcacctccacgccttcggagagagaagtgatcatgtgaccgcggaaacagggatcagaaaggaaatcaaataacaggaattccatcctggacactggggcctgacaaagagctcttggaccagtgctggatgcaatttgggcggtttggtttgaatgggggaaatatgagtttccagaacagggtatttgaaatcatggctactcagaaaattgaggcagtggtcactctggctgtaaatgcggcactctgtgattgtcaagacctttgtaattgagggtgccttggctgggtccaggatatacttcatcataagccatatctggagccagcatgaattacaggggacaggaattcccattcatcggtcacttcccacatggggctagggatttcgtgtgtacactcattccatcttctcangtggctctgtgaagtaggttttgatattccctttttacagatgagagagtggagactctgaaaagttaaataactggcccagatttagttagtaaacagcagaggtggactttgacccgttgctctcactggccccaaagcctgtgttcatgttacacactggtcccctcccactccaggtgtctgtactttttgtgtcacctttgagaaaggtggtcttttagtttctttagccacacggtgagcagcttggactctggggatacactaaacttgccagctctcttcaatcctcacatcctgtgtttcattgctagtgtccctccaggatggatattccagtcctcgcagctcagggctctgcactccccatgaaagaagcataacaattagcaccaaaagcaagctactggggaggctgaggcaggagaattgcttgaacctgggaggcggaggttgcagtgagccaaaatcacaccattgctctctaacctgggagacaagagcgaaactccatctc

SEQ ID NO: 274006 - DNA, 613 bp, Homo sapiens
tatatatagagcacctggcacagtgcccggcagagggtgggtttgtagattccctctgtaacttctcagccttgtttgcacactggcttttttgtcctgctggcttcctggcctctgcttcgtggccttgcgacttcatgcttaagcacggagcagggttggaaggaagaaacatggagtagtggcccctgactggaagcttcttcggacaggtgtacaacccttccagagcccctgtagttgctgccactgtcactgctgctgctgcaacctcaagataaggatcacactgcccaagttcagcctgctgtctgggtgtcagcctggagcccaggcagcacggtggccattcattgctgcttgtcagagaagaatgcagctatcttctttcctgcgtgtgctggcagccgtctgggtggcttttgcaaagatgaccggcatagggcatgccagctccttgagacgggcttcaacaatggttcctgcttgggtgtcccagcgggcgcctatggcaaaaacacagcggttgcaattgtgtggcagcttgctactaatgataatgatcaagttgtttgatgcaataaacattcaacattctggttttgtcataaaa

SEQ ID NO: 274007 - DNA, 635 bp, Homo sapiens
ctggaaatcagctccttcgactaaaaaaggtggacacagccacgctgcgctctgagctgtcgcgcattgatagccagtggactgacctgctaaccaatatcccagccgtccaggagaagctccaccagctccagatggataaactgccttcccgccatgccatttctgaagtcatgagttggatttctctaatggaaaatgttattcagaaggatgaagataatattaaaaattccataggttacaaggcaattcatgaataccttcagaaatataagggttttaagatagacattaactgtaaacagctgacagtggattttgtgaaccagtccgtgctacaaatcagcagtcaggatgtggaaagtaagcgtagtgataagactgattttgctgagcaacttggagcaatgaataaaagttggcaaattctgcaaggtctagtaactgagaagatccagctgttggaaggcttattggaatcttggtcagaatatgaaaataatgtacaatgtctgaaaacatggtttgaaacccaggaaaagagactaaaacaacagcatcgaattggagatcaggcttctgttcaaaatgcactgaaagactgtcaggatctggaagatttgattaaagca

SEQ ID NO: 274008 - DNA, 794 bp, Homo sapiens
tgcctgatgtttaacttcaagctttcagaaaggctccagatggataaactgccttcccgccatgccatttctgaagtcatgagttggatttctctaatggaaaatgttattcagaaggatgaagataatattaaaaattccataggttacaaggcaattcatgaataccttcagaaatataagggttttaagatagacattaactgtaaacagctgacagtggattttgtgaaccagtccgtgctacaaatcagcagtcaggatgtggaaagtaagcgtagtgataagactgattttgctgagcaacttggagcaatgaataaaagttggcaaattctgcaaggtctagtaactgagaagatccagctgttggaaggcttattggaatcttggtcagaatatgaaaataatgtacaatgtctgaaaacatggtttgaaacccaggaaaagagactaaaacaacagcatcgaattggagatcaggcttctgttcaaaatgcactgaaagactgtcaggatctggaagattttgattacagcaaaaaaaaaacacaacaacaaataaaaaaaattttttgggcccgccttggcccctcaaaaaagtttttaaaccatttttttgtgggcgcggggcccccattggtttgttgacactggccaagcggtttccacaggaaacctggtctagcactggttggttttcccccaataaaaagccccgggggaccgggtgtttaaaaacccaggggtcggggcttacgggcttcacaggaccgcggatctattaccccggg

SEQ ID NO: 274009 - DNA, 450 bp, Homo sapiens
tcaaggaagtaatacatattgacatcattgaaacagcagcaccctctgagaggcaagcatttagtaggattttaaagaaacttgagaactgttacataaggtgatgaattgggcatagcatgtaaaattatatttaagcaaggaaatgatctctggtgttttaatattcaacttgattgcttcctcttgggttctgtgtttcccactgtgtgacctgagctgtcagaaaaccttaagaattttctttgcatcatttttccatgcagtttgtgtacatgtctcatgtacctcgtggcagccactggttttgttcatcaaatggtgggttgtgggatgctctcctgcagtctccctctaattaaagaggttaaattgccgtttgctcagcctttagttcctttccacagcttcctaggctcttaaaaattagcactatattcctttcagatt

SEQ ID NO: 274010 - DNA, 421 bp, Homo sapiens
ttgagaagactcattaggcctagagtttcttctagttgaagtaataatacttgttttcctcatcaagtgtttgaaggcagatctcagttaaccatggccccaggaccatagatgagttgattggcttctttatcttcatgaaattgacataagcagtacctactctggcaggtctgttcttctagaaattactttacaatacatattttgcaacacaatgtacaatgcaaatatgctatgcatatggactatgttatactaattagattcagcatctatttagagagtgtttctaattggtttctctacttgggaaaataagtcgagggtaagaagtcttactgtgaatttaaatcaaattaattgtagccttttatatcagttatgcctaataaaatgttattttcttgaattaattaat

SEQ ID NO: 274011 - DNA, 536 bp, Homo sapiens
ttgaattgcttttgcatctttggcaaaaatcagttgagcatatctgtgtgaatctgtttctggattttttattctgtttcattgatctatgtgtccatccttccgccaacatctgcaaaaccagttctgaggccccaggaaggaatcggctctttgagcctcagaagggtacagctgtgcgtggccacagggaacacactccaggctactggggtctagtgatgaggcacttttgtcaggacgtggtccacagagaggagaaaagaaatgttctttagtctcagaggccaagacagacgcatgggaggagagggagatggcaaggacctggataactggaggcgtgatgaatggagagtctggtgcaggatccatgccacgggaggaggcccctgtggagagtgagaccttgggcggttagggctggccggactgggccccctgctcctcacagtgtgacctaaagccgcggcctggtatctagtgctttccagcgtagcccaggaaggcgcgccctccttcggcagaaacacctt

SEQ ID NO: 274012 - DNA, 1029 bp, Homo sapiens
gcggcaagagtacccagaaagtgccctctccgcgggggtctgcggccaaggaggatcctgctcgtggaatagctaccaaatcggcctccagcccaccccaggggcggggtagagaaagggcaaactgtgaccgggacttgtgcacccgattaattgaatattaatcaccccaaggcctaggccaaccgccacccagagagtggcagctgcagaacccaaagacgtggagccgggctgggggtggggaagggaggccgccacagctcccgccccgccggcagtttaactgcttccgcagcctcaggcctcccggtgcgaccccggctgcgactcggatccgtttattccaaatgtcccagcccacgccgtgcccagagtgtggcgacacgaggccaaactgcccacctactgaaaatctgtctgtgtgccgagcacgcgctccccatccctctaccaaatgcctggctggcgcgtcatccctggctttgatggacggagtcttgctgtgttgcccaggctggagtgcagtggcatgatctctgttcacttcaacctccgcctcctgagttcaagcgattctcctgcctcagcttcccaagcagctggactacagcagggatgacggcgctcctggaggctggctgggaagctggtcagggtcccaggactctgacacccccaatggcccttgtagccttggggagtcctgtgatccaaggctggaggactgagtcccctccaggtctcatagcagacgaatagcagcttcacccaggcctgttttgtcgtggccccattcagaggccgccctcctctgtggtttagagcatgccctggaatccctagcacaaccaggggttacctcctgctggctgaccccttcctgtgctgcgggctggaatatagggtttaaccctgttataacccagaggaacacaaaaggaggaacatcaggctttatggagagactggaaatgaagtggaggttttccttgctcatgaaacctggctcaccctacaggtagtccc

SEQ ID NO: 274013 - DNA, 496 bp, Homo sapiens
gcggcaagagtacccagaaagtgccctctccgcgggggtctgcggccaaggaggatcctgctcgtggaatagctaccaaatcggcctccagcccaccccaggggcggggtagagaaagggcaaactgtgaccgggacttgtgcacccgattaattgaatattaatcaccccaaggcctaggccaaccgccacccagagagtggcagctgcagaacccaaagacgtggagccgggctgggggtggggaagggaggccgccacagctcccgccccgccggcagtttaactgcttccgcagcctcaggcctcccggtgcgaccccggctgcgactcggatccgtttattccaaatgtcccagcccacgccgtgcccagagtgtggcgacacgaggccaaactgcgtagcaacgacgcctgattggctgcgctggtcccttcgcaacgaggcgattggctgcctggtatccaggagaccgacgtcaaactcggactggga

SEQ ID NO: 274014 - DNA, 339 bp, Homo sapiens
gtgacatttgtgttgtgcctgattacactgtgagccccactcaccctctctgtggctcctgggggcacttgtgagtgcatctgtcacctggaatcacctcaggttccctaccgtgttacctctctcctgctctggctcccactcgtaagggacatcagtagggccggtgtcatgaatagccactatttttttttctttgagaaggaggctcactctgtcatccaggctggagtgcagtggcaaaatctcagttcactgcaacctacacctcttgggttcaggagaatcacttgaacccaggaggctgggttgccgtgagctgagatcacaccattgcac

SEQ ID NO: 274015 - DNA, 441 bp, Homo sapiens
agtaggccaattagcagacaacaggtgaaaccaacagggtttcatctactccaatagtaggtgattacaaggtgcacagtaaaatctgaagagtccataaacttttgaaaatgatcagccagggctcccttccaggccagggccccaacactatagcaaaagggctgatagtaaaccaaacctcaaaaggaccaagacaacagagagcatggaaagaaatggtgcagataaaagtgggagagggaagcaaaatcaggaaatttaagaacacaagctacggtattatgttaacaccataagaaaacaagcggtagctctgtgaaatcagaaaaactccctgaatcaagcctctttctaaaagttaaggctaactaatgccacataaaaataaacacttgaagtactgaagtcagatttcatgctgttattaaaaaaaaaaaa

SEQ ID NO: 274016 - DNA, 458 bp, Homo sapiens
ctaaatattttatggtgatgctattgcaaacataattgatttttaaatttcatagttcagtgggtttctcctggtatataaaatatatacaatttttatacattaatattgtgatatttgagctgtctaaaattactcgtttattctatcaattttgtacattcctttggatattctatgtaaattttcatatcattaggaaatataggtggttttacttctacccttctaatgtttatacattttatttctttctcttattgcaatgagtatggcctctagtaaaacagtgggtgagttgtgagactatacatcattacctttgtcttaattttaggaggagaattacattcaatatttgaccattaagttagatattagctgtagcattttctagcacctttatcaggttgaagaaattttcttcttttcccggttttctaagagtcttttttgaa

SEQ ID NO: 274017 - DNA, 670 bp, Homo sapiens
ttattctattttacctctaacagaagtttaaggttcgtgtaagtttcgttcctctctgattgtaggggagacgcccagagcgccatttggaggagagaacctggcatcctttccttaccttgatttcaggtacccagctcctagcaaatgtgtcttcctcccagggttctttggggtaaagaatttggtgagaaggagctgaatgttatggctgcgtttctcagccacttgctcggagccaagcatcctctcaccctttctttcaactggtagccagaaaatacgggttgagcatcagggattctcaaccgtgtcaagctccagccctgcctgttgtgacagacgtttcctgatgcctgttgctctctggaatgaaggtcatgggcagtattacccacacagccattcaaaatcagtcggcttcgtgacctgttgtgaaaggatggcgattgccgtgccagcacgtgacatggactcggatgcctgcgcacacaggtgcaccttccagaaggtgaggtcagcccgagcgcccaccgccatgtgagtgcgctgctgcagtgaccagttgctggaatgttctgaacagagcccagtgccacccactttgatgtgcgctattgttagatctccggaaaaatcagagtgcattaaattcctgcaaaaattctgt

SEQ ID NO: 274018 - DNA, 325 bp, Homo sapiens
acatgcccatggttggccctcaccgacgaggtccagcctcgggtcgccaagcagccgcctgctcgctgccagtgagccctccctttctcagcccacggcccctgccccggtggacttccaccacctgacctgcaggcacgcttccaggagctcagaggccactgccctggcggatgacaccctggaagcacacactcccccttgacagagagctttgcacatcagcagagggcaagccagcagcaaacttcgcaggccctggctggcaaacagactccagcctggaccccaggcccataggagaagcttcaccctggcagggtca

SEQ ID NO: 274019 - DNA, 377 bp, Homo sapiens
ttttagatttcttagtggggcaacaaggatgcatgcttatgtactgtgacgtggtaggagaagtgggccaatatgagaggtggagataaaactcgactgtcttccatggcatatttacttttacttgatgctaaatcaaatgaaacaagaccttgtacagctgttattaactgcctttgaaaatttggccctttttttcccaggaacttgaaataaaaatgccaacaaatggttcttgtgtattttggtagaaaaaaacttattttccttttcttttgattgaaaaaaaattattgttgatctttgaaaatgaatcaaggctttaaagaggattatagtagatatttcattctttataaaactttccttaatgccta

SEQ ID NO: 274020 - DNA, 484 bp, Homo sapiens
acccaccttggcctcccaaagtactaggattacaggcatgagccaccatgttcggccagtgcatgtctttttaatattctgtgtgacaaaaataagagtaaaatacctgtgctacacatcatagtataacaggagtctcacagtgcttgtgtgattgagttgtgagctgaacttgctgctttttccatggaatactatttttacttaaaaaaatctgacaaactatgcttactctgtcttgtgtttttgtcaacaatttttgtgaaaacaaagtgagcctgtcactttaagagacagaatttgttgccaatgataaaaatctcagctttcaagcgaaaagtgaaattttggaaaacgaatatccaccacattgagcttgacaactttgcaatacttaaaagactttcctgaggagattggtggtaatattaacaaatgttactgttgacactgaataaatgcagaaataatgacatggaataat

SEQ ID NO: 274021 - DNA, 4852 bp, Homo sapiens
gtgggcagccgcgcagcgggaagagccggccgaagcgtggcggccacagactgtgggtaccgggtccgagggactcgcgcttttctctccgtgccatggcgccagcgaaagccacgaacgtggtgcggctgctactaggctccacagcgctgtggctttcgcagctcggctccgggacggtcgccgcgtccaagtcggtgactgcccacttggccgcgaagtggcccgagaccccgctgctgctggaggcaagtgaatttatggcagaagaaagtaatgaaaaattttggcagtttttggaaactgtgcaagaattagcaatttataagcaaacagaatcagattattcttattacaacttaatcctgaagaaagctggacagtttctagacaatttacacatcaaccttttaaagtttgctttctctataagggcatactccccagctattcagatgtttcagcagattgcagctgatgagccaccaccagatggttgtaatgcatttgtggttattcataagaagcacacctgtaaaattaatgagattaaaaagctgctgaagaaagctgcttcaaggactagaccttatctatttaaaggagatcacaaatttcctacaaacaaagagaacttaccagtggtgattctctatgccgaaatgggtactagaacatttagtgcatttcacaaagtattgtctgaaaaagctcaaaatgaggaaattctgtatgttcttcgccattatattcagaaaccaagctcacggaaaatgtacttatctgggtatggtgtggagctagcaattaagagtacagaatacaaagcactggatgatacccaagttaaaactgtgactaatactactgtagaggatgagactgaaacaaatgaagttcaaggatttctctttgggaaactaaaagaaatatattcagatcttagagataatctgacagcattccaaaaatacctgattgagagtaacaaacaaatgatgcctttgaaagtctgggaactacaagatcttagttttcaagcagcttctcaaataatgtccgctccagtttatgatgccattaaattaatgaaagacatttcacagaacttccccataaaagccagatctctaaccagaattgctgtaaatcaacatatgagagaagaaataaaggaaaatcaaaaggatcttcaagttagatttaaaattcagccaggcgatgctcgtctatttataaatggccttcgtgttgatatggatgtttatgacgcttttagtattttggatatgctgaaattagaaggaaaaatgatgaatggccttcgcaatcttgggatcaatggggaagatatgagcaaatttttaaaattaaattcacacatttgggaatatacttatgtattagatattcgacattcttctataatgtggattaatgacttagaaaatgatgatttgtatattacatggcctacaagttgccagaaacttctgaagccagtatttcctggaagtgtaccttccataaggcgcaattttcataatttggttctgtttattgatccggcccaagaatataccttggattttataaaacttgctgatgttttctattctcacgaagttcctcttagaattggttttgtgttcattcttaatacagatgatgaagttgatggagcaaatgatgctggagttgctctctggcgagctttcaactatattgcagaagaatttgatatatcagaagcatttatttctatagtacacatgtaccaaaaagtgaagaaggatcaaaatatactcactgtggacaatgtgaagagtgttctccaaaatacatttcctcatgctaatatttgggatattttgggaattcattctaaatatgatgaagaaagaaaggctggagcaagcttttataagatgactggcctgggtcctttgcctcaagctctttataatggtgaaccctttaaacatgaagagatgaatattaaagaactaaaaatggctgttcttcaaagaatgatggatgcatctgtatatttacaaagagaagtttttttgggcacattaaatgatcgcacgaatgcaattgattttctaatggataggaataatgttgtaccccgtataaatactttgattttgcgtactaaccagcagtacctcaatttaatatctacatcagtaactgctgatgttgaagatttctctactttctttttcttggattcacaagataagagtgctgtaattgcaaagaacatgtattatttaacccaagacgatgagagtataatttctgcagtcactctctggattattgcagattttgataagccttctgggagaaaacttctttttaatgcattaaagcacatgaaaacaagtgttcatagtcggttggggattatttataatcctacatcaaaaataaatgaagagaacacagctatttctagagggattttggcagcttttcttacacagaagaacatgtttttgagaagctttcttgggcaactggcaaaggaagaaattgctacaactatttactctggagataaaattaaaacattccttattgaggggatggataagaatgcttttgagaaaaaatataatactgttggagtgaatatttttcgaactcaccagttgttctgtcaagatgtacttaaattacgtcctggagaaatgggtattgtcagcaatgggagattcttaggacctttagatgaagatttttatgcagaagatttttacttgttggaaaagataacatttagtaatttaggagagaaaattaaaggcattgttgaaaatatgggaatcaacgcaaataacatgagtgactttattatgaaagttgatgcccttatgtcctctgtgcctaagcgtgcatctcgatatgatgtcacatttcttagggagaatcacagtgttataaagacgaatcctcaagagaatgatatgttcttcaatgtcattgctattgttgatccattaacaagagaagcacagaaaatggcacagttgttggttgtacttggcaagattatcaacctgaagataaagttgttcatgaactgtaggggcaggctttcagaagcccctttagaaagcttttaccgttttgttctggaaccagaactgatgtcaggggctaatgacgtttcttctcttggaccagtggcaaaatttttggatattcctgaatcacccctcctaatcctcaacatgattactccagaaggctggttggttgaaacagtgcacagcaactgtgaccttgataatattcacttaaaggatactgagaaaactgttacagcagaatatgaactagaatacttactactggaaggacaatgctttgataaagtgacagaacagcctcctcggggtctgcagttcacactaggcacaaaaaataaacctgctgtggttgatacaatagtgatggcacatcatgggtattttcaattaaaagcaaacccaggtgcttggatactgaggttacaccaaggaaaatctgaagatatttatcaaatagttgggcatgaaggaactgactctcaagcagacctagaagatatcattgttgtattaaacagcttcaaaagcaagatactcaaagtaaaagtgaaaaaagaaacagacaaaattaaggaagatatccttaccgatgaagatgaaaaaacaaaaggactgtgggattccattaaaagtttcacagtaagcttgcataaagaaaacaaaaaggaaaaagatgtcctaaacattttttcagttgcttctggtcatttatatgaacgttttttaagaattatgatgctttctgttttgcgtaacaccaaaacaccagtgaaattctggttgctaaaaaattatctctcaccgacatttaaagaagtaattcctcacatggctaaagagtatggattccgatatgaactagttcaatataggtggccccgttggcttcgtcaacagactgaaagacagaggattatttggggttacaaaattcttttccttgatgttcttttcccactagcagtggacaaaatcatttttgttgatgctgaccagattgtgagacatgatctaaaagaacttcgagatttcgatctggatggagctccttatgggtatactccattttgtgatagccgcagggaaatggatggatatcgtttctggaaaacaggatactgggcatcacatcttttaagacggaaataccatatcagtgctttatatgtagtggatctcaagaagttcaggagaattggagcaggtgacaggctcaggagccagtatcaagctctcagtcaagatccaaacagtctttcaaacctagatcaggatctccccaataatatgatttaccaagtcgccattaagtctcttcctcaagactggctgtggtgtgaaacctggtgtgatgatgaatccaaacaaagagccaaaacaattgatctgtgcaataatcccaaaacaaaagaatccaaactaaaagctgctgccagaattgtcccagaatgggtggagtatgatgctgagataagacaactattagatcatcttgaaaacaagaagcaagatacaattttgacacatgatgaactctagcactggtgtatatgagaaggaaggcgaaagcatgacaggaaacctgccgcctgctggggaagtctggagcccctgctgagacgatttggaagtctcgttaagatcagtgacatattctttaattttaaaaaattgtaattatttaaaacagttatttaatgtattgaatgagtttaagttatataataaatgaccattgagtattt

SEQ ID NO: 274022 - DNA, 1561 bp, Homo sapiens
gtgggcagccgcgcagcgggaagagccggccgaagcgtggcggccacagactgtgggtaccgggtccgagggactcgcgcttttctctccgtgccatggcgccagcgaaagccacgaacgtggtgcggctgctactaggctccacagcgctgtggctttcgcagctcggctccgggacggtcgccgcgtccaagtcggtgactgcccacttggccgcgaagtggcccgagaccccgctgctgctggaggcaagtgaatttatggcagaagaaagtaatgaaaaattttggcagtttttggaaactgtgcaagaattagcaatttataagcaaacagaatcagattattcttattacaacttaatcctgaagaaagctggacagtttctagacaatttacacatcaaccttttaaagtttgctttctctataagggcatactccccagctattcagatgtttcagcagattgcagctgatgagccaccaccagatggttgtaatgcatttgtggttattcataagaagcacacctgtaaaattaatgagattaaaaagctgctgaagaaagctgcttcaaggactagaccttatctatttaaaggagatcacaaatttcctacaaacaaagagaacttaccagtggtgattctctatgccgaaatgggtactagaacatttagtgcatttcacaaagtattgtctgaaaaagctcaaaatgaggaaattctgtatgttcttcgccattatattcagaaaccaagctcacggaaaatgtacttatctgggtatggtgtggagctagcaattaagagtacagaatacaaagcactggatgatacccaagttaaaactgtgactaatactactgtagaggatgagactgaaacaaatgaagttcaaggatttctctttgggaaactaaaagaaatatattcagatcttagagataatctgacagcattccaaaaatacctgattgagagtaacaaacaaatgatgcctttgaaagtctgggaactacaagatcttagttttcaagcagcttctcaaataatgtccgctccagtttatgatgccattaaattaatgaaagacatttcacagaacttccccataaaagccagattaagaatgaatatattgatatgcctctttcagtcaactttaaatgtcaagaatttgagaagtcgtcatttatataataaaacatgaaatatatatgggtgtgtataaatgtcatatctgtttagccataatattttaattaatggccgttataaaaattattagatcaaatacaaataaagtaaaataactttagtcttgatcagacagttgattagctctattgatgctaagtcagtataactgttcagaggttctgatgcaaaactctgctgttaatctgtaattaagaaaaaattataaaatatgctaacattgcttaatggctaaattgtaggcttgagcatatctctaaaaccacttggtagacaatctgtaaatgtttgttgaaatgaaatatttgctaaataaatgaaaaatttgccttattaaat

SEQ ID NO: 274023 - DNA, 1260 bp, Homo sapiens
gtgggcagccgcgcagcgggaagagccggccgaagcgtggcggccacagactgtgggtaccgggtccgagggactcgcgcttttctctccgtgccatggcgccagcgaaagccacgaacgtggtgcggctgctactaggctccacagcgctgtggctttcgcagctcggctccgggacggtcgccgcgtccaagtcggtgactgcccacttggccgcgaagtggcccgagaccccgctgctgctggaggcaagtgaatttatggcagaagaaagtaatgaaaaattttggcagtttttggaaactgtgcaagaattagcaatttataagcaaacagaatcagattattcttattacaacttaatcctgaagaaagctggacagtttctagacaatttacacatcaaccttttaaagtttgctttctctataagggcatactccccagctattcagatgtttcagcagattgcagctgatgagccaccaccagatggttgtaatgcatttgtggttattcataagaagcacacctgtaaaattaatgagattaaaaagctgctgaagaaagctgcttcaaggactagaccttatctatttaaaggagatcacaaatttcctacaaacaaagagaacttaccagtggtgattctctatgccgaaatgggtactagaacatttagtgcatttcacaaagtattgtctgaaaaagctcaaaatgaggaaattctgtatgttcttcgccattatattcagaaaccaagctcacggaaaatgtacttatctgggtatggtgtggagctagcaattaagagtacagaatacaaagcactggatgatacccaagttaaaactgtgactaatactactgtagaggatgagactgaaacaaatgaagttcaaggatttctctttgggaaactaaaagaaatatattcagatcttagagataatctgacagcattccaaaaatacctgattgagagtaacaaacaaatgatgcctttgaaagtctgggaactacaagatcttagttttcaagcagcttctcaaataatgtccgctccagtttatgatgccattaaattaatgaaagacatttcacagaacttccccataaaagccagatctctaaccagaattgctgtaaatcaacatatgagagaagaaataaaggaaaatcaaaagtatattccagaatttcttccgaggtagtatggttttcttcataggataaagaataaaggctgtgagttaatta

SEQ ID NO: 274024 - DNA, 375 bp, Homo sapiens
ttttttgcataggatagctttgtttattccaagtcttttgtggttctatataaatttcaagattgttttttctatttctctgaagaatttaattggtattttgatagggaatacactgaatctgtagattgctttggttagtatggacattttaacaatattgattcttccaatccatgaacacagaatatctttcctttgtgtgtgtgtttgccttcaatttcttgaaccaacattttatagctttcactgtagagacttttcacttttttggttaactcccaggtattttatttctagctgttgtaaatctagctgttgttactttcttgatttctttttcacattgttcagtgttggcatatgtaaatgata

SEQ ID NO: 274025 - DNA, 205 bp, Homo sapiens
caagagcatcaggcctcttgttaccggatagaattgtgttttggtgactaggcacagtggctcatgcctgtaatcccagcagtttgggaggccaaggtggccagatcacttgaggtcaggagttcgagaccagcctggccaacatggtgaaacgctgtctctactaaaaatacaaaaattagctgagcgtggtggcatgcacttg

SEQ ID NO: 274026 - DNA, 338 bp, Homo sapiens
acaggcagaaaaagccacaatctcctacttgcctaaagatctagtagtttttcaagaataaatgctgctcaattttttgcctgcattttgtcaatttccagtttcctgaaatggttggttttgataaataattttgtctagttttatatattttttggttggttgttgcttttttttttttttttacagaaagaaattgcctgcctctttgtgctgccataactggaaggccttctcctcattattattattttttgagatggagtttcgctcttgttgcggtgagctgagaccgcgccactgcactccagcctgggcaacaaaagtgaaactgtctc

SEQ ID NO: 274027 - DNA, 412 bp, Homo sapiens
atgaatcagtaagggagaaagaccatcaaaatttttcctgtacttatggatctcaaaaattcttcattaaaaataatttttaagctgactgtctcaagtttctgtagggacagctattatgtaaagaaatctccttctgactctattttagcccacctaataaaatctgatggcagcacatggattgcttcagggaaaatagtttcggggttaaaaaaagacttagaattaaactttatatcttgctccaaaaggactctgtctctgagagtatatggaaacgatgtttttggccatgaattaaagaactgttttatgaagatggttcagatctaagatttgaagaggccattactttaactagaagcttgtaatatgtactcataagtaactgtgaagaccccctcctcca

SEQ ID NO: 274028 - DNA, 445 bp, Homo sapiens
actttttttttctttcttttttgagatggagtctcactctatcgctcgagctgaagtgcagtgtcgcgatctccgctcactgcaacctctgtctcctgggttcaagcaattctcccacctcagcctccccagtagctgagactacaggtacctgccaccacacccggctaattttgtagttttagtagaggcagggtttcgccatgttggccaggctggtcttgaactcctgacctcaagtgatccaccccccacttggcctcccaaagtgctgagattgcaggcttgagtcactgggcccctgcctgcttaacttaatactaaataacatatgagagagtacaatgaaacaacttaggaagttttttcttttagttttcttcatttctctagtaagccagtatatctccagccaaacaattcactgtgtttttttagaaaaagt

SEQ ID NO: 274029 - DNA, 106 bp, Homo sapiens
cccacaacgtccaacgcaccccctcgaagcacagcctgtccttcttttgagctggctctgtgtgatgaagggacacccagcaaatggcccagacccatgggcattc

SEQ ID NO: 274030 - DNA, 321 bp, Homo sapiens
tttcatttgatgtggcaaaaattaagtactgcttcagatgaagaggtagaagaataaagcctgacattgaatggaaggtagtaaaatgaactcacattagttccaggcgcagccctcatgctgtgacagctcaggagttttgatagaaaaggtagtgcctctgagtggaaaagaactgaaacccaaagaattcaggcaccgattcctaaactgtcccagccagccttgcctcttacagagcagggtgacctggagccagcccctaagccccccagggcttctgtggatgggagatctgtgccaacctgaagccaaatctca

SEQ ID NO: 274031 - DNA, 207 bp, Homo sapiens
ctgtgaggcagaggctgggcctgtacatgccctcgggaagcaggaggctgggcctggagaggccgacttgaggcagttttgctcctgcagaggccacttacagacaagagctgggtgtgaagaggctgacttgaggtcgattttggcctgcagaagccaccggtagctaggagttggccctggagaggctgacttgaggacaatttt

SEQ ID NO: 274032 - DNA, 390 bp, Homo sapiens
gcttcgaccatgaacctgagtggaaatagcccctccttgatggcccggagaagagtcctgctaagccctaagctgagccgcagtcccatctgtaggtgaaaggaaggaggctgagggacatcagggacttgcccaaggtccctcagctgggaagtgagcagaggagggttaaatcccaggcttccctggtgccataacctgggtgtcatcccctgcaccagatgggcacactgcttctgtccagagccaggtaacctggcaaaaaagctttttaggctttgcaggccatgtggtcgctatggcaactgctcaactctgccgctgatcgagaaagcagccatagtctctgtaaacaaaggaccgtggcttgttccagtaaaactttactta

SEQ ID NO: 274033 - DNA, 248 bp, Homo sapiens
ggcaaggccccttttaaatccttcctagaactcattcaccttatgaagttcaaatttcattaactttcttttcttagaactcagcaaattcatgccatttgggtcttccttttgcctgggaactctgtgccctcagttcttcacatggcctctccttgtcattcaaccctgatctaagtcacctcctgcccgaggtccttcttgaccatctcgtctaaaatagcctccttcccttcacctgctattac

SEQ ID NO: 274034 - DNA, 460 bp, Homo sapiens
ccgaagagaaggaaaactttactgggaaggagataacttgaaaataattttattctgctgtttaaacttcgttataacaaatgtttcactcctaaaatgtaaagaattttgccaggcatacttgtgggagatgtatcaaaccttaacattttgccatttttctatggagcctgtttttttgattgctgaaagtgtgtatccatgcacaatagttgtttttgttatgcaagttttaaagctctatataaataacactccgtctatattgttataaaagttgctttttgcccttgtcagtattcatgttacatgttatgtaactttagttcattgtttactgctatacagtatgtcacttaattagtataacataacatgtccactctctcaatgatgggcatttattttcgtatttttgttattagaaacaatgccgaaataaatattcttatacatgtga

SEQ ID NO: 274035 - DNA, 477 bp, Homo sapiens
cgggtcgactactaatactaattcgcggccgcgtctatctcagtttaaattgtaattattattggattattttgggaggtcacactcatttatataattctgtaccagtggagtcatctctgttgagtaatgccattgagtgttaaatagattatatttttggcttaaaattccagaacttgtggctgggcgcagtggctcacgcctgtcatcccagcactttgggaggccaaggcgggtggatcacctgaggtcaggagttcaagaccagcctgaccaatatggtgaaaccccatctctactaaaaatagaaaaattagcttggtatggtggcgggcccttctagtcccagctacttaggaggctgagacaggagaattgcttgaacctgggaggtggaggttgcagtgagccgagattgtgccactgcacttcagcctgggtgacagagcaagactccatctcaaaaaaaaaaaa

SEQ ID NO: 274036 - DNA, 503 bp, Homo sapiens
agcaggagaaaagtctcacagccagggagcagcatgcggcactgtcactaagtgcctccttcaagagttcacaatttgctctcagccaagcttcattccaagaatgagagtttgctcaagctggaaggggtctgaacagcatcgagtcccttactcatcctctccatcagctgggagggaagctgaggtcctgagagggaagagggctgctcgcagtcagtctaatgtgccattaggattttagtctagtctagtgggtaagcattcagggcccggagtcagacagacctgagtacaagtcctagtgacaccatttactagctgtgtgacattctgcaaaccagctgacctcgtaaactctttctgtaagatgaggatctcactaatgtcagcctcagagggtggtgagaactcagtgaactaatgcatgagaagcacttacacagtgtctaacctgcaatgagcttgcaataaattgcgtgttattctttcaaaaaaaaaaa

SEQ ID NO: 274037 - DNA, 668 bp, Homo sapiens
ggaatactggaattactgcataatttatgtgtggcaaaggccatagtgcaaattaaatgacatgatctttgaataagatcaagactccttttgaaaggctgtttgatcagggaacctgcattgctctaccaccttatttcatggctatgagcatcaaattttagggagttgattctgacctataacaaatttagtgccttagctatgcactgatacctccagtttaaccactacttatttggtattccaagaactacccatttgtcttttttacagttttgaaattttcttacaaaagcaatacaacactggaacttttgggcccatgaagtccaagaggactttattaacattaaaacctaggggtttgctgcaacttggcctggttttctagactgtacaaaacaccacctatcttacgatttatattgagggacaagtcttgtgtttctgcatgggccagatcctttgagtggagatatttacaaccaagttaaaactgtttgtataagaatgtgtggctgggcgcgatggctaatgcctgtaatcccagcacttcaggaggctgaggcaggtggatcacctgagattgggagttggagacaggcctgaccaacatggagaaaccctctctctactaaaaatacaaaattagttgggcgtggtgg

SEQ ID NO: 274038 - DNA, 684 bp, Homo sapiens
ggaatactggaattactgcataatttatgtgtggcaaaggccatagtgcaaattaaatgacatgatctttgaataagatcaagactccttttgaaaggctgtttgatcagggaacctgcattgctctaccaccttatttcatggctatgagcatcaaattttagggagttgattctgacctataacaaatttagtgccttagctatgcactgatacctccagtttaaccactacttatttggtattccaagaactacccatttgtcttttttacagttttgaaattttcttacaaaagcaatacaacactggaacttttgggcccatgaagtccaagaggactttattaacattaaaacctaggggtttgctgcaacttggcctggttttctagactgtacaaaacaccacctatcttacgatttatattgagggacaagtcttgtgtttctgcatgggccagatcctttgagtggagatatttacaaccaagttaaaactgtttgtataagaatgtgtggctgggcgcgatggctaatgcctgtaatcccagcacttcaggaggctgaggcaggtggatcacctgagattgggagttggagacaggcgccaccacgcccaactaattttgtatttttagtagagagagggtttctccatgttggtcaggcctgtctgtcgacg

SEQ ID NO: 274039 - DNA, 331 bp, Homo sapiens
ctttttgccttgtaattactatcactgccctggtccaatttacttgagaaatcaattgaagtaaattttacctaaaatcaacttaaaaaaacagtaattatcctgaaagatattttataatattgataacttgagaataaaatgccaatggaccgattacaaatatttatatatttgcaaaataaatttaaaaagaaaagagcaaatcttctgttccttttggtatttgctcattctaatccctctgcatgattgcttattttttagttttaaaaagttttgtcacttccatgcaccccaagtatgacttaaatgaatgtcgagaaatgtt

SEQ ID NO: 274040 - DNA, 320 bp, Homo sapiens
atccgaaaaatttggaaagaaaaaaaaaaaaagacactaacccacattgggtctgccttcccaattacacttcaagtttcctggaggaaaaggttatcttctgcttctctgctaagtcttctcatagatactaagacagcaagctagtaattaaaactgcttacagctaaacaataaatgtttagtgaacaatctggatcaactcaatttcaccagtttaagcaatactctgctggtctttcatagccagtctgtggtatacttattactaatgtttcggtttcatatgtctattaataaaaatggattttcacaccaag

SEQ ID NO: 274041 - DNA, 355 bp, Homo sapiens
gttttttaatttatttactctctttatttacaactgttctttcaaatgatgatgataagaataaccataattagccagacgcggtgtctcacgcctgtaatcccagcactttgggaggccgaggcgggcagatcacgaggttaggagatcgagaccatcctggctaacacggtgaaaccccgtctctacaaaaaataaaaaaaaaatagccgggcatggtggggggcgtctgtagtcccagctgcttgggaggctgaggcaggagaatggcttgaacccgggagacggagtttgtagtgagccgagattgcgccactgtactccagcctgggcgacagagtgagactccatttca

SEQ ID NO: 274042 - DNA, 327 bp, Homo sapiens
gtgtcaaagtacgtggaaaactgaagctttaagcaaaagatggcttgggtatatatttaacctagcttctgttgaagcatcactagtctgcaaataccacatttctctagtgaccatcttcatgtctctgagccttaaagaatactggttaaaacactaacagatattatgtttctgaatatgtgctttatttgctagttatcctatttctaatgacatattcagtagatttgtttatgttgtaaaatgaagtgctatcaatttattgttatcatgaacagtcagaataaatattgaaacctcttatttgggcaaaaacatgatctg

SEQ ID NO: 274043 - DNA, 401 bp, Homo sapiens
gagtgtaagaatagaagccccccagtttagttaaattatattagtagtctagacaatttgttcatttcacaataagagtgatagaaattgtgataagtacttggattcatgatgtattttgaagttacagttagtagccctttgctgatggatatggaagcgtgagggagatgaatcaaagatgactcctaaactttgagccagagaaactgagtgagtggtgtcatttactgatatgaaggaagctgggtgggacatattcttcaggataaaatatttggtgtcagggttcatcagtttcagcatgtgatttattaatatttacatagtctttgggtgctttggatatttggattccagtcctttatgtgaatttctgtttgaaggtggaaacagcttct

SEQ ID NO: 274044 - DNA, 399 bp, Homo sapiens
ttttttttgagacggagtctcactctgttgcccaggctggagtgcaatgggtgcaatctcggcccactacaatctccacctcccaggtgttcaagtgattctcctgcctcagcctcctaagtagctgggattacaggtgcccaccaccacgcccagctaatttttgtatttttagtagagatgaggtttcaccatgctggccaggctggtcttgaactcctgacctcaggtgatccacccgcctcggcctcccaaagtgctgggtttataggcgtgagccatcacgcccagccccagctgtacttataaatgtaacatatatgctagtaattcaagtcacagatcaactagaaatttcctataaaattgactttaaccccaattaaataaaaaaggggg

SEQ ID NO: 274045 - DNA, 414 bp, Homo sapiens
aaatcacaatatggatatagtttttaaatctccattttaaagtggctgtatcaatgtttttgcccctccattgtgtgtgatttgatgtttaaagtgataaacatctgtcttagctctaagaaaatggaccagagtggtttcttgccttacccaacctgtggcagaactgcccaacaactttcatagtattttaataccgttgttataacatatattttatttttttaatttggcatttgttattacagatattggttactctctgcatatctccaccctcaaattattactaacacccctccttgtgtttacattaagcaatttactgttataaagattaactttgtaaataaactatatataaaatctcccccaaaatacaaatatatttattcctaattattttcacaaata

SEQ ID NO: 274046 - DNA, 659 bp, Homo sapiens
tgcagggtccagagataagcaacatcacaatagccaccaagggtcccaagaaggggagaaaccagggcatccattggttgacaatactccaaagtcctgtgtcttggagctcttgtgcctggcactgtatctggtctcgaagctccttaaccttttttggtgacaattctgtattgattaacaaaatagtaacactcttctcctagaaaaagacaggttccacttctttcagctgttaataaatttaaggctttccaattctggagggctactgctgctaaagagttaagctagctttgtaaggtgaccagtgaatctgcaactcgttccatgtcatcatttaactcttgtgataatttgtaatatgttggggtgatcagacccaacaccaggctgtgggggctacgaagtccggcggagtcaaaggaatgagataagttaagagtgcaagaagtgggaccagggggtcaatgctagtatggaggctgtgaaggccctgagctcttgaagcctgcactatttattggtgatcaaacaaagaagcaggtggtgaggatgtgggggttcaaagaaagcagtgtatcaagtgtgtgatctacagctgtgacagtttagcattttctttgaagcatatggaacatgttctgctacttgagata

SEQ ID NO: 274047 - DNA, 218 bp, Homo sapiens
gaaagtcaagggctctctcggcaagcctgagaaccaatgccttatcgctgcctggaaaatgctgagatgtgttcacagcgttaagaggctgagcccaggcacccgtgtctggctggtaccgccccatcccacaggccgctctcccacacaagagtgctcaaagacacattggtgtgcttgtccgagcaggctggggaggacggacaccgtggcttttt

SEQ ID NO: 274048 - DNA, 184 bp, Homo sapiens
cccagggctgggaagacacttgactaaggttctagagttacgaggatcaagatctaaaaccacatctggccgggcacagtggctcacgcctgtaatcccagcactttgggaggccgaggcaggaggatcacttgaggtcgggagttcgagagcagcctgggcaacgtggtgaaaccccatctct

SEQ ID NO: 274049 - DNA, 242 bp, Homo sapiens
ccatgttggccaggctggtctggaactcctgacctcaagtgatccacccacctcggcctctccacccggcctgggcctcatctttgaggggcctgctaagcttctttctatcctgcaagcttcgtagagctctgactttgagtcttgctctgtcccggaataggagaagacagaggcgtggcactgtgggctgaaagcaacagatttaggggaaactatctttaagactaagccttctttct

SEQ ID NO: 274050 - DNA, 506 bp, Homo sapiens
tatattgactattctaggtctttggttctccttataaattaataatcaacttgtaaatatttgcaaaatgtttgcaaaactctataaagaagattaaaaatagaaggttagtggtttcctggagggagggagagaggagggttgaataggtgaagcactagggattttttagggtggtgaaaatatcctgtacaatattgtaattgtggccaaatgacactttgccaaaacgcattgaactttgcagttcaaagagtgaaaatccatataaattttaaaaatcatttaagagtttgggagaatgtcaggatgaaatgcaaaatgtgacaatataatttctttattatttatttatttttatttttattttattttactttttaaattttttattattatactttaagttttagggtacatgtgcacaatgttcagatttttctgcatccttgccagcatctgtaaattaattgggttatatggtcatttttatgatattgattctt

SEQ ID NO: 274051 - DNA, 808 bp, Homo sapiens
tattattctcactaaaaaattttttattttactaagaataatttgtcatttcagacaaaactaacatttttccatggttgctactatttctacttcttgaatacccaatttaaggtttagtcctcattgaacattaaaatggcatagatagatataaataatagatataaataagatacaagtataaagttactaaggttttctttttttcttttgagaccaaatctcgctctgtggcccaggctggagggcagtggtgcgatcctggctcactgcaacctccgcctttctagttcaagtgattctgtgtcagcgttaggccgctttggcctcttaaagtgctgagattgcaggcgtgagccaccacacctggcccttttacaaaattgaagaaatgaaagggttaccccgcccaaaaaaaaaaaaaaaaagattacactggaaggaagtcacagattaaggatcaagactgttgagtctttaggttccaaaagcttcacctacatttttcttatatgtatttggatattaaagaaaataagttacatatacaccatggaatattattcagccatttaaaaaaaataaaatcttgtcatttgtagcaacatggatggaactggaagtcatcatgttacgtgaagtaagtcaagcacagaaagacaaaacttggatattctcactcacatgggagcttaaaaagtggattttggccaggcgcggtagctcatgcctgtaatcccagccccttgggaggccaaggcgggtggatcacctgagctcaggagtttgagaccagcctggccaa

SEQ ID NO: 274052 - DNA, 379 bp, Homo sapiens
aggctgctgaccctgaggctgctgctgggcgccctgctggtctggaccgctgcctacgtgtacgtggtgaaccccacacctttcgaggggctggtgccacccctgctgagccgtgccaccgtctggaagctccgggccctgctggaccccttcctgcgcctcaaagtggacggcttcctgcccttctaggccagaggcccagcggccccagcaaggaggccaggcgaccagcactgccccggatgcccagtggccgtgccagccccctgcacatggcaccactgtgcaccatccttgccagaagctgcagagaagggtggaggtggggtctgtcctgagggctgggcctgtggctggacatagaatcatgacataagtg

SEQ ID NO: 274053 - DNA, 1177 bp, Homo sapiens
tatgacaaggcagtactgagttcaatgtaaagttacccagtcattctgctctccctctctcccaagagtacgaaatttccgaaatggtaggctactgtgctgcgaggagtgaggggttgctaccatcatttcataccatctctccaaccctcttcaatgcctcatccaatgatatgaagttaaaaccagagctatttctgacacagcaatttttgagcgggcatttgccaaaatacgaacaagttcacatcctcccagtaggaagaatagaggaacccttctggcaaaatttcaagcatctacaagaggaggttttccagaaaataaagacactggctcagctctcaaaggatgttcaggatgtcatgttctacagtatcctggccatgctcagagacagaggggctctacaggacctgatgaacatgctggaattggacagctcaggtcatttggatggccctggtggtgccatcctaaagaaacttcaacaggattcaaaccatgcatggtttaacccaaaggaccccattctttatctccttgaagccataatggtgctgagtgacttccaacacgatttgctggcctgttccatggagaagaggatcctgcttcagcaacaggagctggtaaggagcatcctggagccaaacttcagatacccctggagcattcccttcaccctcaaacctgagctcctcgccccactccagagtgagggtttggccatcacctatggcctgctggaggagtgtggccttaggatggagctggataaccccaggtcaacctgggatgtagaagcaaagatgcccctgtctgccctctatgggactctctcgttgctgcagcagctggctgaggcctaagccctccctgatgggcagtcagtccagagatgctggccctcgcccagtctatgctgtgagtgtccttatgggtgcaagagatagggctgtgcctctctgcgtttccaggtggagtagagacagtaatgggtagagactttaggaaatgttttggggtggtggaatactctatatattgacaagagtttatatattgacaagagtttatatatttgtcaaaactcctcaaatagtatgttaaagacgtaagcgtttcactatgtataaattttacttcaaaataataaaaacaaatactgactcta

SEQ ID NO: 274054 - DNA, 2725 bp, Homo sapiens
ttcggcacgagccacatgtaggcagttcagaggtgcttcccagggccctggcgctagtgcctgtccctcctgctgaagttgcctttcctggtgtccagtgattgaattctaaattcagcacatataccagaggaatacgagccaaagaagttgttccagctagagttgctgggaatccatgaatcaaagacttgctcagctagttctgtatgtgaaaggaaatgggtgtgactctgaggaagcctttttaattctgattcaggagatacataattagatgccacttgattttgttccacagactttttgctgaggacttgagagctaaggttctgtgatccagaactagttccagacttactcttctggaaatgaacagggccctcctgtgcttatttttccaggatactgcattggaaattgagtcagggacccattggtgagaagagaacagtgaacagaatcacattgatctggtcctggagtttgtctgacaatttctacttgaccgcaggaggtctgaagattggaaggggccctactcaattgtgctatttttctctcttttttttttttttgagacggagttgcccaggctggagtgcagcggcatggtctcagctcactgcaacctctgcctcccgggttcaagcagttctctgcctcagcctcccaagtagctgggattacaggtgcctgccaccattcctggctaatttttgtattttcagtagagacagggtttcaccatcttggcctggctgatcttgaactcctgacctcgggatccaccggcctcagcctcccaaagtgctgggattacagacgtgagccaccgtgcccggccaatcctgctatttctctacaggacaaagggatatataatctgcaacatgccctccatgttggaacgcattagcaaaaatttggtcaaagagattggaagcaaagacctgacacctgtcaaatacctattgagtgccaccaaattacgtcagtttgttatattacgaaagaagaaggattctcgttcatcattttgggaacaatctgactatgttccagttgaattctccctcaatgacatcctggagccaagttcttcagtcctagaaactgttgtgacaggaccgttccacttcagtgacattatgatccagaagcataaggctgacatgggtgtgaatgttggtatagaagtgagtgtgtcaggggaggcctctgtggaccatggatgctccctcgagtttcaaattgttaccatcccatcaccaaacctggaagactttcaaaaaaggaaactgttggatccagagccatcatttctgaaggagtgccggaggagaggggacaacctgtacgtggtgacagaggctgttgaactgatcaacaatactgtgctgtacgatagcagtagtgtgaatattttagggaaaattgctctttggattacctatggcaagggtcaaggccaaggagagagtctcagagtgaagaagaaggcgctgactcttcagaaaggcatggtgatggcttataagagaaagcagctggttatcaaggagaaagccattctcatctcagatgatgatgaacagagaacctttcaagatgagtacgaaatttccgaaatggtaggctactgtgctgcgaggagtgaggggttgctaccatcatttcataccatctctccaaccctcttcaatgcctcatccaatgatatgaagttaaaaccagagctatttctgacacagcaatttttgagcgggcatttgccaaaatacgaacaagttcacatcctcccagtaggaagaatagaggaacccttctggcaaaatttcaagcatctacaagaggaggttttccagaaaataaagacactggctcagctctcaaaggatgttcaggatgtcatgttctacagtatcctggccatgctcagagacagaggggctctacaggacctgatgaacatgctggaattggacagctcaggtcatttggatggccctggtggtgccatcctaaagaaacttcaacaggattcaaaccatgcatggtttaacccaaaggaccccattctttatctccttgaagccataatggtgctgagtgacttccaacacgatttgctggcctgttccatggagaagaggatcctgcttcagcaacaggagctggtaaggagcatcctggagccaaacttcagatacccctggagcattcccttcaccctcaaacctgagctcctcgccccactccagagtgagggtttggccatcacctatggcctgctggaggagtgtggccttaggatggagctggataaccccaggtcaacctgggatgtagaagcaaagatgcccctgtctgccctctatgggactctctcgttgctgcagcagctggctgaggcctaagccctccctgatgggcagtcagtccagagatgctggccctcgcccagtctatgctgtgagtgtccttatgggtgcaagagatagggctgtgcctctctgcgtttccaggtggagtagagacagtaatgggtagagactttaggaaatgttttggggtggtggaatactctatatattgacaagagtttatatattgacaagagtttatatatttgtcaaaactcctcaaatagtatgttaaagacgtaagcgtttcactatgtataaattttacttcaaaataataaaaacaaatactgactcta

SEQ ID NO: 274055 - DNA, 423 bp, Homo sapiens
tagtgtgaatacactcaccgatcaatagaggagaacaaatggtctcagagagagacccacacatttagtacgtggagaaggtgatgtcttgagtcagtgggaaaatatgaactattgaatgaatggcattggaacagctagttagccatctggagaaaagtatccattcctactaccagaaaacaaatccaaatggattgacggtttaaatgttaaaaataaaaccataaaaatactagaacgagaataagcacaattttttataaccttggagtggaaaaggcttttctaaccaggactcagaaatccaaaatccataaatgaaaagattgacaggttcaactacagaattttttttttcttttttggcacggcaaagaacaccagaagtcaaaacaacaaaacaaatgacaaaaaacaagc

SEQ ID NO: 274056 - DNA, 370 bp, Homo sapiens
cttccagagctatgacaagttccactgtggatggcaaggaaatgaggggggcagcaacctgttaatgagactcaagagtgtcaagacccatttttgttatctggattttcaaggccgagttcaaacatgaggatcctggaaaggttggcagacgtctgcggaagctaccttctctgttgtaaaagtccacaaatgagaagtggctgcagtgtataaacctgtggacagctcttcttgtactgtcacccactctcatagctcaccatcctcaggcaccctcttatctctgctcacagagtacccacctgaaatgcctaacctgctaactccacccagtgaaattctgtgaatcccacaaggtgtgtcttat

SEQ ID NO: 274057 - DNA, 304 bp, Homo sapiens
gagttgcagcccacagctatggccaggagacagaggaggggagtgatgggagggagcggggaacagctgtcctctgtcacaggatctagctgccgtcaatccaggaagaactgcacgggacaggcagtgttaggcaagttagtaaacagtttgcctcataaacactgaccagcagtggaaaatatctgacctagatagatagtggactgtgagcaccttaggggcaaggaccacgtctaatttgcttttctgttctcaaaaaagtaggcctcaaatatttgttgttgttgtttttgagacagag

SEQ ID NO: 274058 - DNA, 185 bp, Homo sapiens
atatgtgcttgttgaacaaagttgaactcttctggagagatggctaggccccctctgacctggcatggggtggcatgaagacagggggataaatcccgtttcaaattggggtctgaaccccttttcaaattggggttcagcgtttttacagtttcaacaataaagatttgaaaacttctggttca

SEQ ID NO: 274059 - DNA, 680 bp, Homo sapiens
aggcagctgggcccccgggacagcaaccaggggactgccctggccctggatggcagccgggaccggctcacaagcttctgtttggagcagttctgttggcagccccccgcctccagtggagatgtgacacgactctttcttgcctgccaaacgttctctgattctttggatcatcgatcctaacacagcaaaggcggtattgttgctgtcctttcaaggttaatccaggatcagaaaagtctaatcatttctctgtggtttttggaatttccaaagagcacccagattttaaccctcagtcctcggggttgtccggctgcggctgtgctgctgttgagcattaagctcattccacttcacatgtaaacttgtttctatgcattcacctcctgggagactccacattcctgagagaactgcatggttatgaactcttactcgtgtgcactaaagtgcacgtgctgtgtgtgtactgaccctctgccctgtgggagccacgtgctgtggggagaacagaccagcagcagatgggactcctcctccaggaacctgctaccagctaggcgtggtggtgcaagcctatacttctggcactttgggaggctgtggcaggaggatcacttgaggccaggaatttgaggccagcctgggcaacatagtgagaccacgtctctttttga

SEQ ID NO: 274060 - DNA, 398 bp, Homo sapiens
tatttatgtgaacaaagatgtggatgttttgatagggattacattagatctgtagattgcttcaggacattttgataatattaaattcttctgatccaggagcatggaaaatctttccatttgtttttgtcctcttcaatttctttcattagtgctttgtagttttccttgtagaggtctttgaccttcttggttaaatttatttctaggtattttatattttttatagctattgtatatgggatttctatcttgatttattcttcagctagtttattagtgtgtgtagaagtgctactgatttttgtatgtcgattttctatcctttactgaatttatttatcagatctaagagtttttgttggagtctttaggttgttatagatatgagaatatgt

SEQ ID NO: 274061 - DNA, 333 bp, Homo sapiens
taacttcagggcctggactctagtctgaggggaagcctggacaatgggttttttaaaggtccctggtgattcttacatgcatccagggttgagacccactgttctaaaacatagccctgatctgtcatcttcattttccacccatttctttctttccaaatatatctttagagggattgagatgccttcatgtagcttttcacatgttccttttttacatgtaatttactacttccctctgtactcctccccatagaaccttctctcgtcacagtcctgtgcctctttaaagactcacccccaatgccaccttcccttcatgttgttcttttc

SEQ ID NO: 274062 - DNA, 458 bp, Homo sapiens
actattttacagttctgggcgtcacggaatcttgcatgaagagcccctaacctggcccgggtggaggctctgcttcctcagtgtcagcatcattcacagcaggcatgtccctcctgcctccaagagagtcaccagcagcttcctcctccacatctgttctctctctctctctggccattcactgtgggggaagtcagttccatgccctgagtccattcaggcagcttgtgaagaggcccacatggccaatagccagtgaggaactgaggcctgcagtgaccacttggatgagcttggaagcacgtcctccagccccagtcaagtcttgaggtgagaccacagtcctggccaacaggtgactacaacatcacgggaaacccaaagccattcagctaagccactctcagattgctgatccccagaagctgcatgagataataaatgtttgttgttttaag

SEQ ID NO: 274063 - DNA, 403 bp, Homo sapiens
gtgatcctcctgccttagcctcccaaagtacttggaattacaggcatgagccaccacacctgtcctatgtcacactatttcttaagcaatctatattatgaaaaaaatatgagacattgccattgctagaaaggctaaggcaggaggactgcttgaacccaggaggttgaggctgcagtgagctgtgatcatgccactgtactccagtctggacaacagagtgagactgtctttttttttaagacatttatggctgcattatgtcatagtatctagtatggatgtattatcattcacttaagcatttccatatcactggacatcaattgtctgtgattattattattattattattgagacagagtctcagtctgtcacccaggctggagtacagcgatgtga

SEQ ID NO: 274064 - DNA, 287 bp, Homo sapiens
gggcagcaattttaaaggtacccttaacagctaccaagtcatctaaaacatatttttgaagctttattgcagtgaaatttgttatattctctcttataaatagtttggtgtataataaagatatgtgtatgttaagggtttaattcttctcttgatgctttccatagcatgtggaataccaattctagattatacagtataagaattaatatttaaacattgacttgaacaggttgggcttgctttcatgaattgtcaggaggctagctagtcaaaattcaaattaa

SEQ ID NO: 274065 - DNA, 648 bp, Homo sapiens
cttctgtttgagcctcctgagtagtgggactgcaggcatgtgccactatgccccattatgtatttttagtagagatgagatttcaccagattggccaggctggtctcgaactcctgacctcaaatgatctgcctgcctcggcctcccaaagtgttgggattataggcatgagccaccatgcccgcccgcttcgtcttttcactggactaatgaagatacaggtgtggaatggtttcacagcatgcccaacctcatgaggcttgttgggtcagagcttgtgccagatgccagtcttctgccttccagtcttatagttgttacgctatagccttctgcagtggatggtaacgtggccaaaataagcctttggttttggagtattcgtaaaatgaaagtggtgccatctaccttaatgctgggggaatatatttcaattgactcaagtcttcattgctgaatgatatcttaaaaaaaaaaaaggtatttggcctgatattttcacagtggttctgcttgaaatgtaaaattccaatttctaaatgtaataccaagatttatcctaaattaacaataagcagggtttctaatagctttccatatatgtctgggtgtataatctccgatttggacgcgtattgtgcgtgaggt

SEQ ID NO: 274066 - DNA, 349 bp, Homo sapiens
gcaaaatgccttgtcctaatgtttgtaaaatacaccaacctcacacagcccacatcggattcattttccatcagcacttccaaaagcaatcttgtgctgggcaaagagacaaatttcaccctgaagaactgttttgggaaattggaaggtcaaacccttccccaacgatttcagcggacaaagtcaaataagaaaatctcagattccaagagttttgttttgtttttgtcttgtacaactagaccaaaacaagtcataagaaatagatttaaaaaagattgaattttgctctatatgccccttttatgcagaagaaagaccccacaccactaaagactttttacaagca

SEQ ID NO: 274067 - DNA, 372 bp, Homo sapiens
  misc_feature (28)..(28): n is a, c, g, or t
ctacgtgcttgatctgtctcctcctaangggcatgcagaaccccagcttttaagttggtctccgcagaggacaactgcattctccagcctcctgtacagcagagagtgccatgtgactaagaccaagttctaaccagtgggatcaaagcagggaagtgttgccttctttgccccttcctgctggctggaatatgacaaaacggctgcagcatgagcaaccttcttgggccctgaggtggaagccacctgttggttgaccgaccagatggtggagtgaccagatagaaggggcctggtgattgtggattctgccacactacctctggtcccctatacctatgtgaaaggaaaagaaatgtctgccatgttcgt

SEQ ID NO: 274068 - DNA, 387 bp, Homo sapiens
ccaacactggcccaaagagagaagcaggggcccgcccaggtgactgccaggcactgtcagccacactgacagggagagcggcccagatgagaggcccaggaaggcactctgcctttgcaacgtcctggcctgtctccatgaccacaggtgcccagtggtgccagggttgccagacagtggtggtttagttgtgtgcaagaactactctgcacagcaagaatgattggttgagactgacagatcgcaaacacactgcattcaggaacccttcaccctctcttagaaatggctgagggtctcagcgggctttcattcatatgagtttatctatcaatatttacggtagtagaagttcaagtgaaaaataaataaatattcatttatctt

SEQ ID NO: 274069 - DNA, 155 bp, Homo sapiens
actacacatctgggagtcatgctcatcctcactccttctcaccctgtatgcaatctgcctaaatcctgtggacctagatcctctctcagaaccatctcctgaacctggccctcctctccaccccctctgccatcctcctcatcaagaggcctctg

SEQ ID NO: 274070 - DNA, 272 bp, Homo sapiens
ggatcagagtcggcaggtgaaagctgggagtaagggtgccagctatagaatctggccagggtttgaatgctgctctgccgccaggagctgtttgactttgagcaagttacttaatctctctgaacctccatttatataaaacgagatatggcaatacttactccatggggaagtaagtttctagctcacagcaagccttcaacagcagcgatgattatttagctggagaagaaaggagctgacagcagtggttacaggagtgagaaagtggg

SEQ ID NO: 274071 - DNA, 289 bp, Homo sapiens
ggccctgcacgcttgatggcacccacagatgcctgccctgtaccctccatggtaaacagttcttgatccttctccagcatccagcagtcaccctgaaactggctggggtcatggatgctcaacctcatcctcaaaggcctagaacagagcagctcaattgccacttatttattctgatgaagtcagtcagtcaaaacgcgaggatttttggtctcagctcctccactggcttgttgctttgtgcctggagagttcaacaactgttaaatctttcagctttcactcaagt

SEQ ID NO: 274072 - DNA, 328 bp, Homo sapiens
tccagtcagtgttttgtaaccagaatagaggaggtctcatggaaatttgaatggagaaaaatggagagagaactcaatcacatggagtgcagtaggagccatgtaccaaactgaaaaggctgtagtcacatcaggtagtgccatttttatgcctcaagtacacagttagtttgtgcaaaataacattaccattaaatccatttaatgttaattttatgtgtgcaatactttaaatatgttttgggacaagctaaatctataaggagtgtatacctaaatatgtatttatttggatttaagaaactgtataataaaagtaacttaagtc

SEQ ID NO: 274073 - DNA, 329 bp, Homo sapiens
gaccgctcctcccccagcctggctgccgccgtgcagtttgatctcagactgctgtgctagcaatcagcgagactccgtgggtgtaggaccctccgagccaggtcagtgttttgtaaccagaatagaggaggtctcatggaaatttgaatggagaaaaatggagagagaactcaatcacatggagtgcagtaggagccatgtaccaaactgaaaaggctgtagtcacatcagacaatagctgaagaatgtgagaaagaaaaatccaaagcacacaaatgagactgtgcagtgaagaggccacagagacaaccatactgtctttttgtatc

SEQ ID NO: 274074 - DNA, 1920 bp, Homo sapiens
gcggggcagaacataggttgccttagagaggttccccggtgtcccgacggcggctcaagtcagagttgctgggttttgctcagattggtgtgggaagagcctgcctgtggggagcggccactccatactgctgaggcctcaggactgctgctcagcttgcccgttacctgaagaggcggcggagccgggcccctgaccggtcaccatgtgggccttctcggaattgcccatgccgctgctgatcaatttgatcgtctcgctgctgggatttgtggccacagtcaccctcatcccggccttccggggccacttcattgctgcgcgcctctgtggtcaggacctcaacaaaaccagccgacagcagatcccagaatcccagggagtgatcagcggtgctgttttccttatcatcctcttctgcttcatccctttccccttcctgaactgctttgtgaaggagcagtgtaaggcattcccccaccatgaatttgtggccctgataggtgccctccttgccatctgctgcatgatcttcctgggctttgcggatgatgtactgaatctgcgctggcgccataagctgctgctacctacagctgcctcactacctctcctcatggtctatttcaccaactttggcaacacgaccattgtggtgcccaagcccttccgcccgatacttggcctgcatctggacttgggaatcctgtactatgtctacatggggctgctggcagtgttctgtaccaatgccatcaatatcctagcaggaattaacggcctagaggctggccagtcactagtcatttctgcttccatcattgtcttcaacctggtagagttggaaggtgattgtcgggatgatcatgtcttttccctctacttcatgatacccttttttttcaccactttgggattgctctaccacaactggtacccatcacgggtgtttgtgggagataccttctgttactttgctggcatgacctttgccgtggtgggcatcttgggacacttcagcaagaccatgctactattcttcatgccccaggtgttcaacttcctctactcactgcctcagctcctgcatatcatcccctgccctcgccaccgcatacccagactcaatatcaagacaggcaaactggagatgagctattccaagttcaagaccaagagcctctctttcttgggcacctttattttaaaggtggcagagagcctccagctggtgacagtacaccagagtgagactgaagatggtgaattcactgaatgtaacaacatgaccctcatcaacttgctacttaaagtccttgggcccatacatgagagaaacctcacattgctcctgctgctgctgcagatcctgggcagtgccatcaccttctccattcgatatcagctcgttcgactcttctatgatgtctgagtcccttgatcattgtcctttacctcacagtctctaggattcctgactcaggctgacctctctctctggtcccagactgcctccttgcccaggcctctctcactcttcatactcctccagattttgttctcagcattttcctttctctgtgatcattggcatcctgggcgtttcttgccctctgctgactactgattggattttacctatggctttctgcaacttgctactctctccctctccatcccatctttgcagcctcatagggtgggatacagcagctttttttgcagttatccacactcacatttcagagtcctgactctcaaggaaccactggtttttgggatagaacttgggccagggctaggaacacaggctccacggtgacatgtcatttgattgtaaattaagtgttctgattagtaagaactaagcagggggccacatgctctcaatggagacaataaagtgttgtctttttctta

SEQ ID NO: 274075 - DNA, 2775 bp, Homo sapiens
gcggggcagaacataggttgccttagagaggttccccggtgtcccgacggcggctcaagtcagagttgctgggttttgctcagattggtgtgggaagagcctgcctgtggggagccgggcccctgaccggtcaccatgtgggccttctcggaattgcccatgccgctgctgatcaatttgatcgtctcgctgctgggatttgtggccacagtcaccctcatcccggccttccggggccacttcattgctgcgcgcctctgtggtcaggacctcaacaaaaccagccgacagcagatcccagaatcccagggagtgatcagcggtgctgttttccttatcatcctcttctgcttcatccctttccccttcctgaactgctttgtgaaggagcagtgtaaggcattcccccaccatgaatttgtggccctgataggtgccctccttgccatctgctgcatgatcttcctgggctttgcggatgatgtactgaatctgcgctggcgccataagctgctgctacctacagctgcctcactacctctcctcatggtctatttcaccaactttggcaacacgaccattgtggtgcccaagcccttccgcccgatacttggcctgcatctggacttgggaatcctgtactatgtctacatggggctgctggcagtgttctgtaccaatgccatcaatatcctagcaggaattaacggcctagaggctggccagtcactagtcatttctgcttccatcattgtcttcaacctggtagagttggaaggtgattgtcgggatgatcatgtcttttccctctacttcatgatacccttttttttcaccactttgggattgctctaccacaactggtacccatcacgggtgtttgtgggagataccttctgttactttgctggcatgacctttgccgtggtgggcatcttgggacacttcagcaagaccatgctactattcttcatgccccaggtgttcaacttcctctactcactgcctcagctcctgcatatcatcccctgccctcgccaccgcatacccagactcaatatcaagacaggcaaactggagatgagctattccaagttcaagaccaagagcctctctttcttgggcacctttattttaaaggtggcagagagcctccagctggtgacagtacaccagagtgagactgaagatggtgaattcactgaatgtaacaacatgaccctcatcaacttgctacttaaagtccttgggcccatacatgagagaaacctcacattgctcctgctgctgctgcagatcctgggcagtgccatcaccttctccattcgatatcagctcgttcgactcttctatgatgtctgagtcccttgatcattgtcctttacctcacagtctctaggattcctgactcaggctgacctctctctctggtcccagactgcctccttgcccaggcctctctcactcttcatactcctccagattttgttctcagcattttcctttctctgtgatcattggcatcctgggcgtttcttgccctctgctgactactgattggattttacctatggctttctgcaacttgctactctctccctctccatcccatctttgcagcctcatagggtgggatacagcagctttttttgcagttatccacactcacatttcagagtcctgactctcaaggaaccactggtttttgggatagaacttgggccagggctaggaacacaggctccacggtgacatgtcatttgattgtaaattaagtgttctgattagtaagaactaagcagggggccacatgctctcaatggagacaataaagtgttgtctttttcttaaaaaaaaaaaaaaaaaaaactcgagactagttctctctctctcctaaatcattgataatttaaatattttttaaagccaccttaatttaggtagctcttggaatcgatgtttgaattcactagccacattttcttcatgatatgcctcgtggcaaacaaagatgtttccttaagatgaatcttacatttcccatagaaaataacccatttcctttggcactgcagttgccctcaaactgcttgcagttgtattcattttagtacaacaaaggttttcataatatgggaggccaagtctatgatactgcctcaaagagaccctattgtgtagatgcatcatcttctctcatttgatccatagagcataggcaaagatgtcaacctcaggccttagagaaaagtggaaatgttattatgacagccgtccatgagttatcgctttgtatgaagttaaatacagtcatgcgttgcttaacagcagggatacattctgagaaatgcattgttaggcaattccgttgtgcgaacatcctagtgtacttacacaaacctaggtggcatagcccacaacgtacccaggctatatggtaaacctgtacagcatgttactgtactgaatactgtaggcagttgtaacacaatggtatttgtgtatctagacatagaaaacatacagtaagaatatggtattataatcttacgggaccactgtcaaatacgcggtctgtctttgaaaagttgtaatgcggcgcatgactataaatacctagctggttagcatttacattccttgccagggagtttgaaatttatactatagaaataactttaggttttaggtagagttaaagaggtaaagcacatgttgccacaacccaggaaagtatttttaagaaagattggattttcctacctttagagatct

SEQ ID NO: 274076 - DNA, 426 bp, Homo sapiens
cctctctcaactcttcagtactcctccaagaatttttttggtttcccctccgagcaccaaattttttcccccattttcctttctctgtgatcattggcatcctgggcgtttcttgccctctgctgactactgattggattttacctatggctttctgcaacttgctactctctccctctccatcccatctttgcagcctcatagggtgggatacagcagctttttttgcagttatccacactcacatttcagagtcctgactctcaaggaaccactggtttttgggatagaacttgggccagggctaggaacacaggctccacggtgacatgtcatttgattgtaaattaagtgttctgattagtaagaactaagcagggggccacatgctctcaatggagacaataaagtgttgtctttttctta

SEQ ID NO: 274077 - DNA, 1949 bp, Homo sapiens
gtggaggcggacggagctaaaactgacgtggaaccggaatgtgagcggtgtcagacacgtggtacaaggaggcattcatcttggaaccgggcaattggcatttccgctctggattggtgtgggaagagcctgcctgtggggagcggccactccatactgctgaggcctcaggactgctgctcagcttgcccgttacctgaagaggcggcggagccgggcccctgaccggtcaccatgtgggccttctcggaattgcccatgccgctgctgatcaatttgatcgtctcgctgctgggatttgtggccacagtcaccctcatcccggccttccggggccacttcattgctgcgcgcctctgtggtcaggacctcaacaaaaccagccgacagcagatcccagaatcccagggagtgatcagcggtgctgttttccttatcatcctcttctgcttcatccctttccccttcctgaactgctttgtgaaggagcagtgtaaggcattcccccaccatgaatttgtggccctgataggtgccctccttgccatctgctgcatgatcttcctgggctttgcggatgatgtactgaatctgcgctggcgccataagctgctgctacctacagctgcctcactacctctcctcatggtctatttcaccaactttggcaacacgaccattgtggtgcccaagcccttccgcccgatacttggcctgcatctggacttgggaatcctgtactatgtctacatggggctgctggcagtgttctgtaccaatgccatcaatatcctagcaggaattaacggcctagaggctggccagtcactagtcatttctgcttccatcattgtcttcaacctggtagagttggaaggtgattgtcgggatgatcatgtcttttccctctacttcatgatacccttttttttcaccactttgggattgctctaccacaactggtacccatcacgggtgtttgtgggagataccttctgttactttgctggcatgacctttgccgtggtgggcatcttgggacacttcagcaagaccatgctactattcttcatgccccaggtgttcaacttcctctactcactgcctcagctcctgcatatcatcccctgccctcgccaccgcatacccagactcaatatcaagacaggcaaactggagatgagctattccaagttcaagaccaagagcctctctttcttgggcacctttattttaaaggtggcagagagcctccagctggtgacagtacaccagagtgagactgaagatggtgaattcactgaatgtaacaacatgaccctcatcaacttgctacttaaagtccttgggcccatacatgagagaaacctcacattgctcctgctgctgctgcagatcctgggcagtgccatcaccttctccattcgatatcagctcgttcgactcttctatgatgtctgagtcccttgatcattgtcctttacctcacagtctctaggattcctgactcaggctgacctctctctctggtcccagactgcctccttgcccaggcctctctcactcttcatactcctccagattttgttctcagcattttcctttctctgtgatcattggcatcctgggcgtttcttgccctctgctgactactgattggattttacctatggctttctgcaacttgctactctctccctctccatcccatctttgcagcctcatagggtgggatacagcagctttttttgcagttatccacactcacatttcagagtcctgactctcaaggaaccactggtttttgggatagaacttgggccagggctaggaacacaggctccacggtgacatgtcatttgattgtaaattaagtgttctgattagtaagaactaagcagggggccacatgctctcaatggagacaataaagtgttgtctttttctta

SEQ ID NO: 274078 - DNA, 1850 bp, Homo sapiens
gcggggcagaacataggttgccttagagaggttccccggtgtcccgacggcggctcaagtcagagttgctgggttttgctcagattggtgtgggaagagcctgcctgtggggagccgggcccctgaccggtcaccatgtgggccttctcggaattgcccatgccgctgctgatcaatttgatcgtctcgctgctgggatttgtggccacagtcaccctcatcccggccttccggggccacttcattgctgcgcgcctctgtggtcaggacctcaacaaaaccagccgacagcagatcccagaatcccagggagtgatcagcggtgctgttttccttatcatcctcttctgcttcatccctttccccttcctgaactgctttgtgaaggagcagtgtaaggcattcccccaccatgaatttgtggccctgataggtgccctccttgccatctgctgcatgatcttcctgggctttgcggatgatgtactgaatctgcgctggcgccataagctgctgctacctacagctgcctcactacctctcctcatggtctatttcaccaactttggcaacacgaccattgtggtgcccaagcccttccgcccgatacttggcctgcatctggacttgggaatcctgtactatgtctacatggggctgctggcagtgttctgtaccaatgccatcaatatcctagcaggaattaacggcctagaggctggccagtcactagtcatttctgcttccatcattgtcttcaacctggtagagttggaaggtgattgtcgggatgatcatgtcttttccctctacttcatgatacccttttttttcaccactttgggattgctctaccacaactggtacccatcacgggtgtttgtgggagataccttctgttactttgctggcatgacctttgccgtggtgggcatcttgggacacttcagcaagaccatgctactattcttcatgccccaggtgttcaacttcctctactcactgcctcagctcctgcatatcatcccctgccctcgccaccgcatacccagactcaatatcaagacaggcaaactggagatgagctattccaagttcaagaccaagagcctctctttcttgggcacctttattttaaaggtggcagagagcctccagctggtgacagtacaccagagtgagactgaagatggtgaattcactgaatgtaacaacatgaccctcatcaacttgctacttaaagtccttgggcccatacatgagagaaacctcacattgctcctgctgctgctgcagatcctgggcagtgccatcaccttctccattcgatatcagctcgttcgactcttctatgatgtctgagtcccttgatcattgtcctttacctcacagtctctaggattcctgactcaggctgacctctctctctggtcccagactgcctccttgcccaggcctctctcactcttcatactcctccagattttgttctcagcattttcctttctctgtgatcattggcatcctgggcgtttcttgccctctgctgactactgattggattttacctatggctttctgcaacttgctactctctccctctccatcccatctttgcagcctcatagggtgggatacagcagctttttttgcagttatccacactcacatttcagagtcctgactctcaaggaaccactggtttttgggatagaacttgggccagggctaggaacacaggctccacggtgacatgtcatttgattgtaaattaagtgttctgattagtaagaactaagcagggggccacatgctctcaatggagacaataaagtgttgtctttttctta

SEQ ID NO: 274079 - DNA, 2845 bp, Homo sapiens
gcggggcagaacataggttgccttagagaggttccccggtgtcccgacggcggctcaagtcagagttgctgggttttgctcagattggtgtgggaagagcctgcctgtggggagcggccactccatactgctgaggcctcaggactgctgctcagcttgcccgttacctgaagaggcggcggagccgggcccctgaccggtcaccatgtgggccttctcggaattgcccatgccgctgctgatcaatttgatcgtctcgctgctgggatttgtggccacagtcaccctcatcccggccttccggggccacttcattgctgcgcgcctctgtggtcaggacctcaacaaaaccagccgacagcagatcccagaatcccagggagtgatcagcggtgctgttttccttatcatcctcttctgcttcatccctttccccttcctgaactgctttgtgaaggagcagtgtaaggcattcccccaccatgaatttgtggccctgataggtgccctccttgccatctgctgcatgatcttcctgggctttgcggatgatgtactgaatctgcgctggcgccataagctgctgctacctacagctgcctcactacctctcctcatggtctatttcaccaactttggcaacacgaccattgtggtgcccaagcccttccgcccgatacttggcctgcatctggacttgggaatcctgtactatgtctacatggggctgctggcagtgttctgtaccaatgccatcaatatcctagcaggaattaacggcctagaggctggccagtcactagtcatttctgcttccatcattgtcttcaacctggtagagttggaaggtgattgtcgggatgatcatgtcttttccctctacttcatgatacccttttttttcaccactttgggattgctctaccacaactggtacccatcacgggtgtttgtgggagataccttctgttactttgctggcatgacctttgccgtggtgggcatcttgggacacttcagcaagaccatgctactattcttcatgccccaggtgttcaacttcctctactcactgcctcagctcctgcatatcatcccctgccctcgccaccgcatacccagactcaatatcaagacaggcaaactggagatgagctattccaagttcaagaccaagagcctctctttcttgggcacctttattttaaaggtggcagagagcctccagctggtgacagtacaccagagtgagactgaagatggtgaattcactgaatgtaacaacatgaccctcatcaacttgctacttaaagtccttgggcccatacatgagagaaacctcacattgctcctgctgctgctgcagatcctgggcagtgccatcaccttctccattcgatatcagctcgttcgactcttctatgatgtctgagtcccttgatcattgtcctttacctcacagtctctaggattcctgactcaggctgacctctctctctggtcccagactgcctccttgcccaggcctctctcactcttcatactcctccagattttgttctcagcattttcctttctctgtgatcattggcatcctgggcgtttcttgccctctgctgactactgattggattttacctatggctttctgcaacttgctactctctccctctccatcccatctttgcagcctcatagggtgggatacagcagctttttttgcagttatccacactcacatttcagagtcctgactctcaaggaaccactggtttttgggatagaacttgggccagggctaggaacacaggctccacggtgacatgtcatttgattgtaaattaagtgttctgattagtaagaactaagcagggggccacatgctctcaatggagacaataaagtgttgtctttttcttaaaaaaaaaaaaaaaaaaaactcgagactagttctctctctctcctaaatcattgataatttaaatattttttaaagccaccttaatttaggtagctcttggaatcgatgtttgaattcactagccacattttcttcatgatatgcctcgtggcaaacaaagatgtttccttaagatgaatcttacatttcccatagaaaataacccatttcctttggcactgcagttgccctcaaactgcttgcagttgtattcattttagtacaacaaaggttttcataatatgggaggccaagtctatgatactgcctcaaagagaccctattgtgtagatgcatcatcttctctcatttgatccatagagcataggcaaagatgtcaacctcaggccttagagaaaagtggaaatgttattatgacagccgtccatgagttatcgctttgtatgaagttaaatacagtcatgcgttgcttaacagcagggatacattctgagaaatgcattgttaggcaattccgttgtgcgaacatcctagtgtacttacacaaacctaggtggcatagcccacaacgtacccaggctatatggtaaacctgtacagcatgttactgtactgaatactgtaggcagttgtaacacaatggtatttgtgtatctagacatagaaaacatacagtaagaatatggtattataatcttacgggaccactgtcaaatacgcggtctgtctttgaaaagttgtaatgcggcgcatgactataaatacctagctggttagcatttacattccttgccagggagtttgaaatttatactatagaaataactttaggttttaggtagagttaaagaggtaaagcacatgttgccacaacccaggaaagtatttttaagaaagattggattttcctacctttagagatct

SEQ ID NO: 274080 - DNA, 1284 bp, Homo sapiens
gatcccttacagcttcacgatcaccaagcccttccgcccgatacttggcctgcatctggacttgggaatcctgtactatgtctacatggggctgctggcagtgttctgtaccaatgccatcaatatcctagcaggaattaacggcctagaggctggccagtcactagtcatttctgcttccatcattgtcttcaacctggtagagttggaaggtgattgtcgggatgatcatgtcttttccctctacttcatgatacccttttttttcaccactttgggattgctctaccacaactggtacccatcacgggtgtttgtgggagataccttctgttactttgctggcatgacctttgccgtggtgggcatcttgggacacttcagcaagaccatgctactattcttcatgccccaggtgttcaacttcctctactcactgcctcagctcctgcatatcatcccctgccctcgccaccgcatacccagactcaatatcaagacaggcaaactggagatgagctattccaagttcaagaccaagagcctctctttcttgggcacctttattttaaaggtggcagagagcctccagctggtgacagtacaccagagtgagactgaagatggtgaattcactgaatgtaacaacatgaccctcatcaacttgctacttaaagtccttgggcccatacatgagagaaacctcacattgctcctgctgctgctgcagatcctgggcagtgccatcaccttctccattcgatatcagctcgttcgactcttctatgatgtctgagtcccttgatcattgtcctttacctcacagtctctaggattcctgactcaggctgacctctctctctggtcccagactgcctccttgcccaggcctctctcactcttcatactcctccagattttgttctcagcattttcctttctctgtgatcattggcatcctgggcgtttcttgccctctgctgactactgattggattttacctatggctttctgcaacttgctactctctccctctccatcccatctttgcagcctcatagggtgggatacagcagctttttttgcagttatccacactcacatttcagagtcctgactctcaaggaaccactggtttttgggatagaacttgggccagggctaggaacacaggctccacggtgacatgtcatttgattgtaaattaagtgttctgattagtaagaactaagcagggggccacatgctctcaatggagacaataaagtgttgtctttttctta

SEQ ID NO: 274081 - DNA, 1186 bp, Homo sapiens
cttcttagcccggcgcgggggctcacgcctgtactcgcaacactttgggaggccgacgtgggtggatcatgaggtcaggagtttgagatcagcctggccaatatggtgaaacccgtctctactaaaaatataaaaattggccgggcgcggtggctcacgcctgtaatcccaccactttgggattgctctaccacaactggtacccatcacgggtgtttgtgggagataccttctgttactttgctggcatgacctttgccgtggtgggcatcttgggacacttcagcaagaccatgctactattcttcatgccccaggtgttcaacttcctctactcactgcctcagctcctgcatatcatcccctgccctcgccaccgcatacccagactcaatatcaagacaggcaaactggagatgagctattccaagttcaagaccaagagcctctctttcttgggcacctttattttaaaggtggcagagagcctccagctggtgacagtacaccagagtgagactgaagatggtgaattcactgaatgtaacaacatgaccctcatcaacttgctacttaaagtccttgggcccatacatgagagaaacctcacattgctcctgctgctgctgcagatcctgggcagtgccatcaccttctccattcgatatcagctcgttcgactcttctatgatgtctgagtcccttgatcattgtcctttacctcacagtctctaggattcctgactcaggctgacctctctctctggtcccagactgcctccttgcccaggcctctctcactcttcatactcctccagattttgttctcagcattttcctttctctgtgatcattggcatcctgggcgtttcttgccctctgctgactactgattggattttacctatggctttctgcaacttgctactctctccctctccatcccatctttgcagcctcatagggtgggatacagcagctttttttgcagttatccacactcacatttcagagtcctgactctcaaggaaccactggtttttgggatagaacttgggccagggctaggaacacaggctccacggtgacatgtcatttgattgtaaattaagtgttctgattagtaagaactaagcagggggccacatgctctcaatggagacaataaagtgttgtctttttctta

SEQ ID NO: 274082 - DNA, 1862 bp, Homo sapiens
gcggggcagaacataggttgccttagagaggttccccggtgtcccgacggcggctcaagtcagagttgctgggttttgctcagattggtgtgggaagagcctgcctgtggggagcggccactccatactgctgaggcctcaggactgctgctcagcttgcccgttacctgaagaggcggcggagccgggcccctgaccggtcaccatgtgggccttctcggaattgcccatgccgctgctgatcaatttgatcgtctcgctgctgggatttgtggccacagtcaccctcatcccggccttccggggccacttcattgctgcgcgcctctgtggtcaggacctcaacaaaaccagccgacagcagatcccagaatcccagggagtgatcagcggtgctgttttccttatcatcctcttctgcttcatccctttccccttcctgaactgctttgtgaaggagcagtgtaaggcattcccccaccatgaatttgtggccctgataggtgccctccttgccatctgctgcatgatcttcctgggctttgcggatgatgtactgaatctgcgctggcgccataagctgctgctacctacagctgcctcactacctctcctcatggtctatttcaccaactttggcaacacgaccattgtggtgcccaagcccttccgcccgatacttggcctgcatctggacttgggaatcctgtactatgtctacatggggctgctggcagtgttctgtaccaatgccatcaatatcctagcaggaattaacggcctagaggctggccagtcactagtcatttctgcttccatcattgtcttcaacctggtagagttggaaggtgattgtcgggatgatcatgtcttttccctctacttcatgatacccttttttttcaccactttgggattgctctaccacaactggtacccatcacgggtgtttgtgggagataccttctgttactttgctggcatgacctttgccgtggtgggcatcttgggacacttcagcaagaccatgctactattcttcatgccccaggtgttcaacttcctctactcactgcctcagctcctgcatatcatcccctgccctcgccaccgcatacccagactcaatatcaagacaggcaaactggagatgagctattccaagttcaagaccaagagcctctctttcttgggcacctttattttaaaggtggcagagagcctccagctggtgacagtacaccagagtgagactgaagatggtgaattcactgaatgtaacaacatgaccctcatcaacttgctacttaaagtccttgggcccatacatgagagaaacctcacattgctcctgctgctgctgcagatcctgggcagtgccatcaccttctccattcgatatcagctcgttcgactcttctatgatgtctgagtcccttgatcattgtcctttacctcacagtctctaggattcctgactcaggctgacctctctctctggtcccagaattttcctttctctgtgatcattggcatcctgggcgtttcttgccctctgctgactactgattggattttacctatggctttctgcaacttgctactctctccctctccatcccatctttgcagcctcatagggtgggatacagcagctttttttgcagttatccacactcacatttcagagtcctgactctcaaggaaccactggtttttgggatagaacttgggccagggctaggaacacaggctccacggtgacatgtcatttgattgtaaattaagtgttctgattagtaagaactaagcagggggccacatgctctcaatggagacaataaagtgttgtctttttctta

SEQ ID NO: 274083 - DNA, 1857 bp, Homo sapiens
gcggggcagaacataggttgccttagagaggttccccggtgtcccgacggcggctcaagtcagagttgctgggttttgctcagattggtgtgggaagagcctgcctgtggggagcggccactccatactgctgaggcctcaggactgctgctcagcttgcccgttacctgaagaggcggcggagccgggcccctgaccggtcaccatgtgggccttctcggaattgcccatgccgctgctgatcaatttgatcgtctcgctgctgggatttgtggccacagtcaccctcatcccggccttccggggccacttcattgctgcgcgcctctgtggtcaggacctcaacaaaaccagccgacagcagatcccagaatcccagggagtgatcagcggtgctgttttccttatcatcctcttctgcttcatccctttccccttcctgaactgctttgtgaaggagcagtgtaaggcattcccccaccatgaatttgtggccctgataggtgccctccttgccatctgctgcatgatcttcctgggctttgcggatgatgtactgaatctgcgctggcgccataagctgctgctacctacagctgcctcactacctctcctcatggtctatttcaccaactttggcaacacgaccattgtggtgcccaagcccttccgcccgatacttggcctgcatctggacttgggaatcctgtactatgtctacatggggctgctggcagtgttctgtaccaatgccatcaatatcctagcaggaattaacggcctagaggctggccagtcactagtcatttctgcttccatcattgtcttcaacctggtagagttggaaggtgattgtcgggatgatcatgtcttttccctctacttcatgatacccttttttttcaccactttgggattgctctaccacaactggtacccatcacgggtgtttgtgggagataccttctgttactttgctggcatgacctttgccgtggtgggcatcttgggacacttcagcaagaccatgctactattcttcatgccccaggtgttcaacttcctctactcactgcctcagctcctgcatatcatcccctgccctcgccaccgcatacccagactcaatatcaagacaggcaaactggagatgagctattccaagttcaagaccaagagcctctctttcttgggcacctttattttaaaggtggcagagagcctccagctggtgacagtacaccagagtgagactgaagatggtgaattcactgaatgtaacaacatgaccctcatcaacttgctacttaaagtccttgggcccatacatgagagaaacctcacattgctcctgctgctgctgcagatcctgggcagtgccatcaccttctccattcgatatcagctcgttcgactcttctatgatgtctgagtcccttgatcattgtcctttacctcacagtctctaggattcctgactcaggctgacctctctctctggtcccagactgcctccttgcccaggcctctctcactcttcatactcctccagattttgttctcagcattttcctttctctgtgatcattggcatcctgggcgtttcttgccctctgctgactactgattggattttacctatggctttctgcaacttgctactctctccctctccatcccatctttgcagcctcatagggaaccactggtttttgggatagaacttgggccagggctaggaacacaggctccacggtgacatgtcatttgattgtaaattaagtgttctgattagtaagaactaagcagggggccacatgctctcaatggagacaataaagtgttgtctttttctta

SEQ ID NO: 274084 - DNA, 1457 bp, Homo sapiens
  misc_feature (1413)..(1413): n is a, c, g, or t
gcggggcagaacataggttgccttagagaggttccccggtgtcccgacggcggctcaagtcagagttgctgggttttgctcagattggtgtgggaagagcctgcctgtggggagcggccactccatactgctgaggcctcaggactgctgctcagcttgcccgttacctgaagaggcggcggagccgggcccctgaccggtcaccatgtgggccttctcggaattgcccatgccgctgctgatcaatttgatcgtctcgctgctgggatttgtggccacagtcaccctcatcccggccttccggggccacttcattgctgcgcgcctctgtggtcaggacctcaacaaaaccagccgacagcagatcccagaatcccagggagtgatcagcggtgctgttttccttatcatcctcttctgcttcatccctttccccttcctgaactgctttgtgaaggagcagtgtaaggcattcccccaccatgaatttgtggccctgataggtgccctccttgccatctgctgcatgatcttcctgggctttgcggatgatgtactgaatctgcgctggcgccataagctgctgctacctacagctgcctcactacctctcctcatggtctatttcaccaactttggcaacacgaccattgtggtgcccaagcccttccgcccgatacttggcctgcatctggacttgggaatcctgtactatgtctacatggggctgctggcagtgttctgtaccaatgccatcaatatcctagcaggaattaacggcctagaggctggccagtcactagtcatttctgcttccatcattgtcttcaacctggtagagttggaaggtgattgtcgggatgatcatgtcttttccctctacttcatgatacccttttttttcaccactttgggattgctctaccacaactggtacccatcacgggtgtttgtgggagataccttctgttactttgctggcatgacctttgccgtggtgggcatcttgggacacttcagcaagaccatgctactattcttcatgccccaggtgttcaacttcctctactcactgcctcagctcctgcatatcatcccctgccctcgccaccgcatacccagactcaatatcaagacaggcaaactggagatgagctattccaagttcaagaccaagagcctctctttcttgggcacctttattttaaaggtggcagagagcctccagctggtgacagtacaccagagtgagactgaagatggtgaattcactgaatgtaacaacatgaccctcatcaacttgctacttaaagtccttgggcccatacatgagagaaacctcacattgctcctgctgctgctgcagaacctgggcagtgccgtcaccatcaccaaacgataccagcacgaccnacacaacaaagatgacagagacccaagaacaatgaccaaaacca

SEQ ID NO: 274085 - DNA, 1337 bp, Homo sapiens
gcggggcagaacataggttgccttagagaggttccccggtgtcccgacggcggctcaagtcagagttgctgggttttgctcagattggtgtgggaagagcctgcctgtggggagcggccactccatactgctgaggcctcaggactgctgctcagcttgcccgttacctgaagaggcggcggagccgggcccctgaccggtcaccatgtgggccttctcggaattgcccatgccgctgctgatcaatttgatcgtctcgctgctgggatttgtggccacagtcaccctcatcccggccttccggggccacttcattgctgcgcgcctctgtggtcaggacctcaacaaaaccagccgacagcagatcccagaatcccagggagtgatcagcggtgctgttttccttatcatcctcttctgcttcatccctttccccttcctgaactgctttgtgaaggagcagtgtaaggcattcccccaccatgaatttgtggccctgataggtgccctccttgccatctgctgcatgatcttcctgggctttgcggatgatgtactgaatctgcgctggcgccataagctgctgctacctacagctgcctcactacctctcctcatggtctatttcaccaactttggcaacacgaccattgtggtgcccaagcccttccgcccgatacttggcctgcatctggacttgggaatcctgtactatgtctacatggggctgctggcagtgttctgtaccaatgccatcaatatcctagcaggaattaacggcctagaggctggccagtcactagtcatttctgcttccatcattgtcttcaacctggtagagttggaaggtgattgtcgggatgatcatgtcttttccctctacttcatgatacccttttttttcaccactttgggattgctctaccacaactggtacccatcacgggtgtttgtgggagataccttctgttactttgctggcatgacctttgccgtggtgggcatcttgggacacttcagcaagaccatgctactattcttcatgccccaggtgttcaacttcctctactcactgcctcagctcctgcatatcatcccctgccctcgccaccgcatacccagactcaatatcaagacaggcaaactggagatgagctattccaagttcaagaccaagagcctctctttcttgggcacctttattttaaaggtaacagggtaacaaggaggtaaggccctaggctgccatcctgaccttgaggaatggggaacctagtcctacatcagatccaaggggaacttgaaagcattaaatagatccacattcctaaagcata

SEQ ID NO: 274086 - DNA, 680 bp, Homo sapiens
gcggggcagaacataggttgccttagagaggttccccggtgtcccgacggcggctcaagtcagagttgctgggttttgctcagattggtgtgggaagagcctgcctgtggggagcggccactccatactgctgaggcctcaggactgctgctcagcttgcccgttacctgaagaggcggcggagccgggcccctgaccggtcaccatgtgggccttctcggaattgcccatgccgctgctgatcaatttgatcgtctcgctgctgggatttgtggccacagtcaccctcatcccggccttccggggccacttcattgctgcgcgcctctgtggtcaggacctcaacaaaaccagccgacagcagatcccagaatcccagggagtgatcagcggtgctgttttccttatcatcctcttctgcttcatccctttccccttcctgaactgctttgtgaaggagcagtgtaaggcattcccccaccatgaatttgtggccctgataggtgccctccttgccatctgctgcatgatcttcctgggctttgcggatgatgtactgaatctgcgctggcgccataagctgctgctacctacagctgcctcactacctctcctcatggtctatttcaccaactttggcccggcatacttcggggatcctctatgattctaacctacag

SEQ ID NO: 274087 - DNA, 242 bp, Homo sapiens
tgctgggtgacttagaggatcccagcggccgccttctttttttgcagttatccacactcacatttcagagtcctgactctcaaggaaccactggtttttgggatagaacttgggccagggctaggaacacaggctccacggtgacatgtcatttgattgtaaattaagtgttctgattagtaagaactaagcagggggccacatgctctcaatggagacaataaagtgttgtctttttctta

SEQ ID NO: 274088 - DNA, 256 bp, Homo sapiens
cgagtttatacctccgtgtctccctttctgcgtgattcttactccagtccatttctccttgcagatcctgggcagtgccatcaccttctccattcgatatcagctcgttcgactcttctatgatgtctgagtcccttgatcattgtcctttacctcacagtctctaggattcctgactcaggctgacctctctctctggtcccagactgcctccttgcccaggcctctctcactcttcatactcctccagattttg

SEQ ID NO: 274089 - DNA, 878 bp, Homo sapiens
gcggggcagaacataggttgccttagagaggttccccggtgtcccgacggcggctcaagtcagagttgctgggttttgctcagattggtgtgggaagagcctgcctgtggggagcggccactccatactgctgaggcctcaggactgctgctcagcttgcccgttacctgaagaggcggcggagccgggcccctgaccggtcaccatgtgggccttctcggaattgcccatgccgctgctgatcaatttgatcgtctcgctgctgggatttgtggccacagtcaccctcatcccggccttccggggccacttcattgctgcgcgcctctgtggtcaggacctcaacaaaaccagccgacagcagatcccagaatcccagggagtgatcagcggtgctgttttccttatcatcctcttctgcttcatccctttccccttcctgaactgctttgtgaaggagcagtgtaaggcattcccccaccatgaatttgtggccctgataggtgccctccttgccatctgctgcatgatcttcctgggctttgcggatgatgtactgaatctgcgctggcgccataagctgctgctacctacagctgcctcactacctctcctcatggtctatttcaccaactttggcaacacgaccattgtggtgcccaagcccttccgcccgatacttggcctgcatctggacttgggaatcctgtactatgtctacatggggctgctggcagtgttctgtaccaatgccatcaatatcctagcaggaattaacggcctagaggctggccagtcactagtcatttctgcttccatcattgtcttcaacctggtagagttggaaggggtgcgcgagacaggtttcccctaccagg

SEQ ID NO: 274090 - DNA, 1799 bp, Homo sapiens
gcggggcagaacataggttgccttagagaggttccccggtgtcccgacggcggctcaagtcagagttgctgggttttgctcagattggtgtgggaagagcctgcctgtggggagcggccactccatactgctgaggcctcaggactgctgctcagcttgcccgttacctgaagaggcggcggagccgggcccctgaccggtcaccatgtgggccttctcggaattgcccatgccgctgctgatcaatttgatcgtctcgctgctgggatttgtggccacagtcaccctcatcccggccttccggggccacttcattgctgcgcgcctctgtggtcaggacctcaacaaaaccagccgacagcagattttgtggccctgataggtgccctccttgccatctgctgcatgatcttcctgggctttgcggatgatgtactgaatctgcgctggcgccataagctgctgctacctacagctgcctcactacctctcctcatggtctatttcaccaactttggcaacacgaccattgtggtgcccaagcccttccgcccgatacttggcctgcatctggacttgggaatcctgtactatgtctacatggggctgctggcagtgttctgtaccaatgccatcaatatcctagcaggaattaacggcctagaggctggccagtcactagtcatttctgcttccatcattgtcttcaacctggtagagttggaaggtgattgtcgggatgatcatgtcttttccctctacttcatgatacccttttttttcaccactttgggattgctctaccacaactggtacccatcacgggtgtttgtgggagataccttctgttactttgctggcatgacctttgccgtggtgggcatcttgggacacttcagcaagaccatgctactattcttcatgccccaggtgttcaacttcctctactcactgcctcagctcctgcatatcatcccctgccctcgccaccgcatacccagactcaatatcaagacaggcaaactggagatgagctattccaagttcaagaccaagagcctctctttcttgggcacctttattttaaaggtggcagagagcctccagctggtgacagtacaccagagtgagactgaagatggtgaattcactgaatgtaacaacatgaccctcatcaacttgctacttaaagtccttgggcccatacatgagagaaacctcacattgctcctgctgctgctgcagatcctgggcagtgccatcaccttctccattcgatatcagctcgttcgactcttctatgatgtctgagtcccttgatcattgtcctttacctcacagtctctaggattcctgactcaggctgacctctctctctggtcccagactgcctccttgcccaggcctctctcactcttcatactcctccagattttgttctcagcattttcctttctctgtgatcattggcatcctgggcgtttcttgccctctgctgactactgattggattttacctatggctttctgcaacttgctactctctccctctccatcccatctttgcagcctcatagggtgggatacagcagctttttttgcagttatccacactcacatttcagagtcctgactctcaaggaaccactggtttttgggatagaacttgggccagggctaggaacacaggctccacggtgacatgtcatttgattgtaaattaagtgttctgattagtaagaactaagcagggggccacatgctctcaatggagacaataaagtgttgtctttttctta

SEQ ID NO: 274091 - DNA, 828 bp, Homo sapiens
accgctccaagaactttccctttgcccctggatgtccacccaggaccagtatggttccagaacaggcgtgccaagtctcggcgtcagagtgggaaatccttccaacctttggctaggccggagattatcctcaaccactgtgctcctggaactgaaacgaaatgtctgaagccccagctgcctcttgagacattggttcaaagctggactcatgggaggaacacatcttttctgcctttggtaacttttgaggattctgggagaattcgggataagctctgaggagccatgactgacagcctgggagagacacatcagcatactgtcctttctgacttccatgctaaggacatgtccttgttaaccttgatgatggttttgacagcacctctcacatttgaaggtaccccgccactttgtcaatgacgttttaagcccacactcccaccccagagttcccgcattcgtttttacctgtgttctctccaagcctgcacattccattggtctgcatccctatgccttcttgccaggcctgtttttagtttttggactggttgttcagaactcattattttcttcacaagaatgcctcagcttgactcagtttccccttgtgtttgacagctgccattttctcctggtccctccaaggcttataatcttaaagtcactctaccccgtctcttcaaccctcatcctaggtttattactttttaaaattgggcctgtcatcttcacgttcaatcatagctccaatgactctgcatgcagattatttcgacagcccccttgcctctagcttctcaactacttaaaaaaaattac

SEQ ID NO: 274092 - DNA, 1276 bp, Homo sapiens
atggccacagccgagtcccgtgcgctccagtttgccgagggcgccgcgtttccagcgtaccgggccccccacgccggcggggcgctcctgccgcccccgagccctgcggcagccctgctccctgcgccgcccgcgggccccggcccagcgacctttgcgggcttcctcggccgggaccccgggccggccccgccgccccccgccagcctgggctcgcctgcgccccccaaaggcgcggccgccccgtcggcgtcgcagcgccgcaagcgcacgtctttcagcgccgaacagctgcagctgctggagctcgtcttccgccggacccggtaccccgacatccacttgcgcgagcgcctggccgcgctcaccctgctccccgagtccaggatccaggtatggttccagaacaggcgtgccaagtctcggcgtcagagtgggaaatccttccaacctttggctaggccggagattatcctcaaccactgtgctcctggaactgaaacgaaatgtctgaagccccagctgcctcttgaggtagatgtgaactgcctgcccgaaccaaacggggttggagggggcatctctgactctagctcccaaggtcagaattttgaaacctgttcccctctctctgaagacattggttcaaagctggactcatgggaggaacacatcttttctgcctttggtaacttttgaggattctgggagaattcgggataagctctgaggagccatgactgacagcctgggagagacacatcagcatactgtcctttctgacttccatgctaaggacatgtccttgttaaccttgatgatggttttgacagcacctctcacatttgaaggtaccccgccactttgtcaatgacgttttaagcccacactcccaccccagagttcccgcattcgtttttacctgtgttctctccaagcctgcacattccattggtctgcatccctatgccttcttgccaggcctgtttttagtttttggactggttgttcagaactcattattttcttcacaagaatgcctcagcttgactcagtttccccttgtgtttgacagctgccattttctcctggtccctccaaggcttataatcttaaagtcactctaccccgtctcttcaaccctcatcctaggtttattactttttaaaattgggcctgtcatcttcacgttcaatcatagctccaatgactctgcatgcagattatttcgacagcccccttgcctctagcttctcaactacttaaaaaaaattac

SEQ ID NO: 274093 - DNA, 1021 bp, Homo sapiens
ggctggtactggtctgggatttagggatccgaacagctgcagctgctggagctcgtcttccgccggacccggtaccccgacatccacttgcgcgagcgcctggccgcgctcaccctgctccccgagtccaggatccaggtatggttccagaacaggcgtgccaagtctcggcgtcagagtgggaaatccttccaacctttggctaggccggagattatcctcaaccactgtgctcctggaactgaaacgaaatgtctgaagccccagctgcctcttgaggtagatgtgaactgcctgcccgaaccaaacggggttggagggggcatctctgactctagctcccaaggtcagaattttgaaacctgttcccctctctctgaagacattggttcaaagctggactcatgggaggaacacatcttttctgcctttggtaacttttgaggattctgggagaattcgggataagctctgaggagccatgactgacagcctgggagagacacatcagcatactgtcctttctgacttccatgctaaggacatgtccttgttaaccttgatgatggttttgacagcacctctcacatttgaaggtaccccgccactttgtcaatgacgttttaagcccacactcccaccccagagttcccgcattcgtttttacctgtgttctctccaagcctgcacattccattggtctgcatccctatgccttcttgccaggcctgtttttagtttttggactggttgttcagaactcattattttcttcacaagaatgcctcagcttgactcagtttccccttgtgtttgacagctgccattttctcctggtccctccaaggcttataatcttaaagtcactctaccccgtctcttcaaccctcatcctaggtttattactttttaaaattgggcctgtcatcttcacgttcaatcatagctccaatgactctgcatgcagattatttcgacagcccccttgcctctagcttctcaactacttaaaaaaaattac

SEQ ID NO: 274094 - DNA, 494 bp, Homo sapiens
tgcaggaggtttcctatgagtggtctcaggaccagcccctgcgaggggtgagggaagcagaagtgggcagggggaataaactatgatccagttgcaacagcagactcagccaatcctgtggggagctctggaactggactctttccagttgaggcaagacggctggaaccctgtgccccttcatcagtgagtaataggatgcaggctgcctccaggtaagggatgtatctttgggtgagactgcttcttaggaccaatggtaattctggagaggggctcagcaagaggctacaatatctacatcttgcagcagctaggggaagtagtgctcccatcctgatggcacatctgggcagcatgtcccttcactttttctctccaatgagagagaagaaaagagattaaaaataaaatagcccctttgttttatatttgaaatgattgctcttgtgattataatttgcaaccttaatataaaatgcactgaattaaca

SEQ ID NO: 274095 - DNA, 268 bp, Homo sapiens
accccctccttaggcaacctggtggtcccccgctcccgggaggtcaccatattgatgccgaacttagtgcggacacccgatcggcatagcgcactacagcccagaactcctgacctcaagtgatcctcccgccttggcctcccaaagtgctggcattacaggcgtgagccacccttcccggccactgcttttatcttgatgtataactgagttgatgctagatttcaattccttctttgtccttttactattctgtcctatagccacc

SEQ ID NO: 274096 - DNA, 1200 bp, Homo sapiens
cagccatgcgagatttctctcactgtcatgatctttgcaaaggcagtttcagaactatatttggctcacagcgctggaggctgggaaatccaagggcatggtggcagcttctggcaagggcttttttaccacatcataacatggtgaaaagcagaagggcaagaaagcttgtgcaaaagagacaaaacatgatagccttccctcaaaacaacctactcttgaggtagctaatccagtcccgtgagaggaagaattcacttacttccaccagaattcatctgaaagagcaacattagtccctcttaaagatctaatcacctcttaaaggcctcacctcccaaaaccaccataccaggaccaggtaccagatttccaacacatgaattctgagggacacattcaacccatagcaagacccctgtaggccatgtcgcagggttaaattgtattccaaatgagattggatgccattagattttaaacagctttttaaaaactaaaaaagtgtttcactcttgctgcaatggggatatagacagacaagagtagaaagcagagaaactagtaaggaggtacactattcatttatcagtctagaggagaaatgataggggatgtgcattgggtgccagcagtagaattgaagacctgtggtcagagtcaggttatattcagaatttgctgacagagtagatagagattaggagagaatttttttgtttgagcaagggtgtgaatgatggtagataagacaatggggaggagcaggtttgagggatgggaatctagggtttttgaaggctatcttaatttttaaatgcatggttctggcatttattacttgtggaatattgaacaaattatttcaatttcctcatctgtgaaactgggttggtaatagtatgtatgctatatggtttacatgaaaattaaatgtattaatgccctgaagcacttaaaacacaactggacacatactgtgttctcagtaaatgttagctattgttgctgctactgttaatattattactattacccataatcataatattagtgtatgtccacatgagatattgaagaggcaataggatttatgagtctggaactcaggagagaaatcaggactggagataaactttgagagttattagcatacagatgggtattgaaaaccatgggactgggtgagatttcctatgg

SEQ ID NO: 274097 - DNA, 251 bp, Homo sapiens
acatacgtttaataataatacatatgtataaagcaaaataatgatgatagctaatatttcgggcctcaacatatactagtgtttttatatgcgttgtatttaattaaaaaaaaacttaaaggaatcacatagacctccgtttaaatttaggctctaccacttgcagctgccagaagtttgatttatataatctttcattgccaaaacgggtcagattcagaaccagcctcttcagggtaactgtgaggatc

SEQ ID NO: 274098 - DNA, 361 bp, Homo sapiens
cttcttattgtctgaggatctttttctaaacctctgttgaattcattcattcaattagccaaatatttattgagcacctaattgtaagccaagctgagagtacacaagtgacaaaaatgaacaacattgctgtgctcatgacacctccattctagttgggtgaaacagatggtaaacatttaaatcaagaaataagataatttcatatagataatttttatagacagaaataaaataatttctcctaaggaaataaagtatgatgggatagtgacagtgaaggtataattgtaaagggttttttttgtttaatagccctattgaaatataattgacataagataaatggcatgtatttaaa

SEQ ID NO: 274099 - DNA, 237 bp, Homo sapiens
aaaggtaccacttagtcctcatgttaacccaagtatcttctattattagctcccattttgcagaggaagaaactgaagtgcaaggagtttttaaaatttgcacaaggtcacagccagagcatgacagagccaggtcccccagataccaaagttcagacttttagccactgtaccagactggacatggtgtgccttatcctaaagtatctatcgtagagccctgttttaagaatggaa

SEQ ID NO: 274100 - DNA, 664 bp, Homo sapiens
ttttcagaagagatatgttgcatattttgcacaagtgaaacatctctacaactggaatctccctccaagacggatactctttataaaacacttcattatttattcgattcctcgttatgtacgtgatctaaaaatccaaatagaaatggagaaaaaggttgtcttttccactatttcattaggaaaatgttcggtacttgataacattacaacagacaaaatattaattgatgtattcgacggtccacctctgtatgatgatgtgaaagtgcagtttttctattcgaatcttcctacatactatgacaattgctcattttacttctggttgcacacatcttttattgaaaataacaggctttatctaccaaaaaatgaattggataatctacataaacaaaaagcacggagaatttatccatcagattttgccgtggagatactttttggcgagaaaatgacttccagtgatgttgtagctggatccgattaagtatagctcccccttccccttctgggaaagaattatgttctttccaaccctgccacatgttcatatatcctaaatctatcctaaatgttccttgaagtatttatttatgtttatatatgtttatatatgttcttcataaatctattacatatatatagataaaaaaaaagt

SEQ ID NO: 274101 - DNA, 571 bp, Homo sapiens
ttttcagaagagatatgttgcatattttgcacaagtgaaacatctctacaactggaatctccctccaagacggatactctttataaaacacttcattatttattcgattcctcgttatgtacgtgatctaaaaatccaaatagaaatggagaaaaaggttgtcttttccactatttcattaggaaaatgttcgaatcttcctacatactatgacaattgctcattttacttctggttgcacacatcttttattgaaaataacaggctttatctaccaaaaaatgaattggataatctacataaacaaaaagcacggagaatttatccatcagattttgccgtggagatactttttggcgagaaaatgacttccagtgatgttgtagctggatccgattaagtatagctcccccttccccttctgggaaagaattatgttctttccaaccctgccacatgttcatatatcctaaatctatcctaaatgttccttgaagtatttatttatgtttatatatgtttatatatgttcttcataaatctattacatatatatagataaaaaaaaagt

SEQ ID NO: 274102 - DNA, 371 bp, Homo sapiens
gatgaaaattttaacctaagaaagttggtgcaaatataaatgaaacaagattaagcatatattgatggtcctgtccaggtgaggtggcttacacctgcaatcctagcactttgggaggccaaggcaggtgaactgcttgagctcagaagttcgagaccaagctgggcaacatggcaaaactccgtctctaccaaaaaaaaaaaaaattagccaggcatggtggtgtgtgcctgtagctcagctactcgggtgggtaagaggtgacaggattgcttgagcccaggaagttgaggctgcagtgagccaagattgtgccactccatcctgggtgacagagcaagacctatctctacataaacaaacaaataggt

SEQ ID NO: 274103 - DNA, 584 bp, Homo sapiens
cttggcatttgctcttccctctgccttgaattgctacccctgatacccaaatgatggtctctcttctgttccaatctctgctgaaatgtcaccttgtcaataatgtcttcccagatcacttgtagtgatcatccattaggaacagtgttgacacccacccccaaaccaccaccccctattaacttcctgccccatttctcttgcagccctcattatcattcagcatgccaaataccatccttatttgtgtatttgtctccttcattgctagattgtaagtttgatgagggcaggatttttttccactttgtcactgctttatctccaacgactcttacagagtaagcacacagtaaatgcctgttaaaagaacgattgaattgcatgaggacaaagaaacttttattttactgtcgtaacgccatgacttcctccaaatctccatgtggatctctatgccagcttttttctgcctctacttaattttctccaagaccttccttggaaatatctgtatgcttaggaagttttaatagtaaagagtggagtaacagctaaaaataaaataagttatgaaatataaa

SEQ ID NO: 274104 - DNA, 273 bp, Homo sapiens
ccttcaaaattgtaattcttgttggaaaactgttctacgattgtcgaatctttcctgatggtacagtgctgcgtaatgaacatgatgaaacttaaaaaattgtgttcctcctagaacttcttgggcatcagtttctgttgtctttaatggtaaacagtgctcaggatgtgaactgaacagacctcggcatgacttttttgaatgaaaccttgtcaccactccagcatggagctaagtgggcaatctctggataaatggttctgaatcctggct

SEQ ID NO: 274105 - DNA, 426 bp, Homo sapiens
gtcccagatggatctggccttagctttggatttccattctcatctgagtttccccatatccctggtcactgggtgaagacagcctgtccttgagccagggatctgcgctcaccttcctttccctttgagacacttgggtagaaatatttgagaagcatggtgacccccctggattttttagctctgtcactctgtgagaatctgcattcatagcccaatccttatggagcgactgaccagggatccctcctctcatcatgcgggttcctttctcctattatgcatctgccacaagtgaaaggaacactgtaagcatcttccctggaacaggaggccatctgccactccacgtataaagatgctccttcccgcagggaggctccacgtgtcccagatccatttccccttgtgatggctccagacaca

SEQ ID NO: 274106 - DNA, 466 bp, Homo sapiens
tagacattctgtgtcttctggaagcacacatgaaacagtgccaggctaacctgttagcttgcaagtaaagcctcagacccattacagtttttgagagttaccagttcaagtttatcatggtcagcatttagtaaatgtctctggctagccaaacatttttagctttccaggatcccaagtagcaggcttaaactgacatttcatctttggttaaatgaaataagtgataacagtgtaaattttgtagcccccaggcatatgtaacataataccaaggcctccacattgtacaactccgggtgctctgttcatatcatagtctatgaatatgaaatatagctgctctaactattataagatttcatcatatctaacacccttaatagtagaacacacctttactttaggtgtaacagaaataaaaaagaaacttccaactaaactatgataaaatgctcttctgtca

SEQ ID NO: 274107 - DNA, 481 bp, Homo sapiens
ctggttcaaatggactattttatccatttatatttattgcagttactcataaacttaatttataatcatcatcttttttttgctttctatttatttgtctcactttaaaaaatatagtcatgctgatcatttaagggtttagttgaaggtaaatttctccagcagaatttgcatttgtttctgacaggtgtcaggggtcactaccatcttgagaacctttaaattattttctcagggtttgggggtttatccaaggagtgggaattccatccataagtccatgttagggccggcttgtattcacgaatcttcatctgactcctttcaccaagagtttacttgtcatctccctcaaaggagtggattttttcccaaatgtcctctgaaagtgaagatttatactgggtccttcactgtaactctccagcttaagtggctctaggcttcatttactgtctttcacatagttattaagtgcagt

SEQ ID NO: 274108 - DNA, 512 bp, Homo sapiens
ctcttgaacaccatctttctgtccactccactcccttctcctgccccctagccctcaagttttctggggcccccacccctagaaaacaggcacagtgcctgtgtgaagaggttggtttcgatctgtttcctctagattgtgccttcatcagcctggccacggctgtggggctaacgtaggcagcaggtggtgagaccgttgaggggaagggctacagaaagacaaagttggagtttcaggtagtacagcaattgatgaaatctggcaggaaaatagcatgaggagggaccccagtcacgaacagaaaaaagggatatgccctgggcttttcttgaaaaggttgcaccaatttatgtttgcctcgatcctgtaggagagcatccttaccagcattgggtatctgtatttcagcatgtttttgctaattggagaggtgaaaaatgacattttgcagtgggtttaatttgcatttcttatattattagagcacttaaacaattttttcaagtatt

SEQ ID NO: 274109 - DNA, 247 bp, Homo sapiens
cgccggccttcctcactgccatggagatctgaccatcctcattctgggccaaagaaaacaggatccacttccccatattccagaaagcccactgtttccatgtcagtggaatttccatctaatgctgtcattgctgctgtgatcagcccagatgtttgccagcgctgcttctttgtggtcaacagaaacgaactcagcaaaatgtaattttaaaaaagtaatgtgtattatttttcctgagttatac

SEQ ID NO: 274110 - DNA, 475 bp, Homo sapiens
tcgggaaaatgcaaatcaaagccaccttactactgcaagaatgtctctaatcaaaatatcaaaaaataatagatgttggcatggatgtggtgaacaggcaacacttctacactgctggtgggaatgtaaactagtacaaccactatgaaaaacagtgtgaagagattccttaaagaagtaaaagtagaactaccattgatccagcaaccccactattgggtatctacccagaggaaaagaagccattatacgaaaaaaatacttctacatgcatgtttatagcagcacaattcacagtcggaaaactatgaaaccagcccaaatgcccgtcagtcaacgagtggataaagatatttctcgtcattttcacagtaccgggtattaagttgggaaaccttataggaacattttagaactctgtctaccagaccctcaataaatgttgttagtttatcgtgctatttccgaagaagct

SEQ ID NO: 274111 - DNA, 518 bp, Homo sapiens
tctggtgagaagtcaggatagtgattatcttagtgctctgggggagggtggctctggtaatattctatttcttgatctgagggctggtgtcccagacgtattcactctacgataatttaccaagctgccctctggggattggtggcttctctgtatgaatattacactcaattaaaaaaacaaaaacctaacagtcaaagtactgggattacaggtgtgagccaccgcgcccggctgagattttcataatgtgtttgagacatgctgtttatttcttctttttttttacttttaattgaaatattgtatacatagcaaaaagtcattcctgtcataaatgtacagctcaaaattttcatgaaatttaatcattaaccagattgaaatgaaaaccacaacaaaacccatgactggaagccatccccgataagtcttctgcggccagcttcctgtggtgagcctccccatcaagggtaactgcagcctccttggaaataaaggagatcaggactccaaaa

SEQ ID NO: 274112 - DNA, 479 bp, Homo sapiens
ttcagtactccttggggagatgaatttgaggatctcctcctagcttctcattcagccaccttgtgatcattaaactctctgctgcaaaccctgctgtctcagaatattgctaagctactgtgcagcaggcataggaacctgatggtcctgtaataaagtcatgtcaaaattacaaatggaagtgagggtggagctggtcagggttgagctgggtttttaatgggaacctgggagtgaagcaagacttgctgaacatgttgggggttattgagtgggtgtaagaggaatctatctaacattgcactgatgcccttttggttttaatccttatgaccaagtatgagtctttcaaaacaatttgtataatcctccttatttttcctttcaaaaccttcaacttcctttatctccccaaataatctcgcatctattgccacttctttgcttacttcataataaacatttttttttacagagtc

SEQ ID NO: 274113 - DNA, 547 bp, Homo sapiens
tttttttttttgtaataagcaagagtatagagattaaatagggtcttgggtccacttaaattgcccacaggtcaaaacattctgagaaacaacgctgccagtgattaaaaagagccaatttagaggctaatttagtaatttattaattaatttactaatttcttaaatgtatttagaggctactttagtagttatcctccctgttaggcaggcacaaaaagatccttggcctctgtcccttctctttacctctcacgttgactgttgatctggtggattctacttccttcaataccttcacagctgtccccttcttacaagtcccactgccactggctgtcttcaccccaggagatgcagtgccttcatccctgctccccctctctccgccttccatctgcccaccaccattctcaatgtgggctttgactgggtcattccccttctcagaaactttcaattgcttttaaaaaatgtattctcaaatcctggtccgctgttccaggctcccatcccttgcccttctgcccctgcagcttccgaatca

SEQ ID NO: 274114 - DNA, 657 bp, Homo sapiens
gtaaacacatcatttttgtgacatttttcaagatatacaccaaaaggaccaggtaatggtgactcatgcctgtaatcccagcaccctgggagaccaaggcaggcagataccttgaatccaggagttcaaaaccagtctaggaaaaatggcaaaaccccatctctactaaaaatacaaaaaattagccgaacatggtggtgcatgcctgtagtcccaactactcaggaggctgaagtgagaggatcaccagagtctgggaggtcaaggctgcaatgagccaagattgcaccactgcactccagcctgtgcaaccagagtgagaccctgtctaaaaaaacaagaaagaaaaaaagaaaagaaaaaagaaaaagaaaaaaatatatacaccagaaatgtttgtcagtttagggttgagggtttgacctattttggacaatgcaggagtaaactagttaccatctgaatacttggaataataaaataaggcctttcagtaatttgatattgctttctacagagctggggccccctgggcatgatgctatattctgaagaactgaggctttattccatccagcagtattcactactacttgcatatgattatgagaataacccttcgagttttttgttttgttggttttttttagtctagac

SEQ ID NO: 274115 - DNA, 528 bp, Homo sapiens
gcaaaggaaagcaagtgatagtgtattttttaattgttaattttatcacttatcaaaaaaggcttgaaccattgactttaatagaatactgattactctgataattttgggatgagaaaacaaacatatcaatacttggaacacagtctctttctccatcccatcctgctaccagaaagaagaataacctatcagtcacctaatgggcaaagaacacattgattaggaaatagctgtcacttatagttgaaagactcaaggcagatgtgacaatataacaaatgtatgattctcttaggcagctagaaaattagaaacaggccattaaaatgtacatgctagttagtaagaggaaatgccactggccaaatcatttgtaggttagagtccctatgtaatgacatatgtttaatattaaagctatctgtgaatatatttttctttcagagtcttcgcttcactcttcttaacttctgccattcctgttattatccagcttgccgttctccaaattacatatcttcctca

SEQ ID NO: 274116 - DNA, 945 bp, Homo sapiens
cacaggtacccaggccctggaaatcctggaaatgccctgctccttctcctcatgccctaggtcccctgtgagtcccagggattctttctttgccacatccattcctgctgtctcatgtctagcctcactccaggctcttgttgtcctcagcctgaataatcacaaaatttcctaactcatctctaggtaactggcccacctttgagccagcgggtctcaccacgccttctccccaccagaactctccagcggctccccatcattttcaggatcagactcaaaccccgtaaaagtctgatctctgaaacctcaccatccactcttccttgtcactcttcaccttccctcctactctggtcacactgcataacacgcattctctttccaggtttccacctcactcctcgtgcctgtctatctttgtcatctctgttgccgtgtgtctaaatcctattagctcagaaggtccatgttcgatgccacctcttccaggcagcctcacatgcgggtgcatccttcatccctccccactgtggtcccacagtccgcttccgtggtttatgtcctcactcaactggaaactccttgaggacagtggtcttatctgactacctttcgcatttccatggtatccaaataaagccttgtacacagtaggtgctcgatgaatgcttgttgtgtacctatgtgagcaagtgggtgagtgagtaatggagtgctttgttcaccttatgggacattgaatgggatgggagggacatgcgcaaagttggaaaatgccgaatgctgtccagatgccctggaacccttgtctagaggttgctgttggggtcatgggattggtgaggctttgagtggaactcctccgaccaggctgtgtgcctggctccagctcctggtcatcctcaaagccaggaatccagcctcctcagtaccagcatcccg

SEQ ID NO: 274117 - DNA, 295 bp, Homo sapiens
gtcctcatcttgcctccaggcaaaggtctgctcatcttttgagctgtacatacatatcacctcccctcctatgctggccacaacctccaggtgcctcctcaaacaccttttcatacttgacgccttcatgttacctactgtaattatttccccacgagatgtggaacttttctgagtgcgaaactaagcctttctcactttgcatctccagtctccagtatctggtacaagttttgacacagagtgggtattcagtatgagttcatttaataaataactttcatcactctcaagg

SEQ ID NO: 274118 - DNA, 1274 bp, Homo sapiens
aagtatccgttcttggctgcctttctttaattgcgtttccagtactctctcggtgattctactcttgaacataggatgaaatttggaatcacacttctcttccacttccatccccaccctctaatgcccatattaaaaatggcggccgccgccttccgcagtaatggttgttcagcgaacaagatccgggcggaaacagtagataggcgggtgcagcggggcagaacataggttgccttagagaggttccccggtgtcccgacggcggctcaagtcagagttgctgggttttgctcagattggtgtgggaagagcctgcctgtggggagcggccactccatactgctgaggcctcaggactgctgctcagcttgcccgttacctgaagaggcggcggagccgggcccctgaccggtcaccatgtgggccttctcggaattgcccatgccgctgctgatcaatttgatcgtctcgctgctgggatttgtggccacagtcaccctcatcccggccttccggggccacttcattgctgcgcgcctctgtggtcaggacctcaacaaaaccagccgacagcagatgtgagcagcggcacacgggtccgggcagggggcaagggctaaggaaggagtggctagggcaggggcgggaaccggggtgcttgaccacacgtgaagactcagaactaacccaggcagcctggaactcggagaggtgatgagcagaacttactcgcattggggaaaggatgggtagggacccttgggtatatctgggactctggcagtggtgctttcctccctccgcccccctcaccacttaccagaataaaaaaccgggaatgagaagaccactttgggttactgtaacacctgcactagtgagtgaccacgccccctttcctcttccccctcgcccccttgctgctgggccacagcccagaatcccagggagtgatcagcggtgctgttttccttatcatcctcttctgcttcatccctttccccttcctgaactgctttgtgaaggagcagtgtaaggcattcccccaccatgaatttgtggccctgataggtgccctccttgccatctgctgcatgatcttcctgggctttgcggatgatgtactgaatctgcgctggcgccataagctgctgctacctacagctgcctcactacctctcctcatggtactatttcaccaacttgggcaacacgaccattgtggtgcccaagcctttccgcccgatacttggcctgcatctggacttggg

SEQ ID NO: 274119 - DNA, 918 bp, Homo sapiens
aagtatccgttcttggctgcctttctttaattgcgtttccagtactctctcggtgattctactcttgaacataggatgaaatttggaatcacacttctcttccacttccatccccaccctctaatgcccatattaaaaatggcggccgccgccttccgcagtaatggttgttcagcgaacaagatccgggcggaaacagtagataggcgggtgcagcggggcagaacataggttgccttagagaggttccccggtgtcccgacggcggctcaagtcagagttgctgggttttgctcagattggtgtgggaagagcctgcctgtggggagcggccactccatactgctgaggcctcaggactgctgctcagcttgcccgttacctgaagaggcggcggagccgggcccctgaccggtcaccatgtgggccttctcggaattgcccatgccgctgctgatcaatttgatcgtctcgctgctgggatttgtggccacagtcaccctcatcccggccttccggggccacttcattgctgcgcgcctctgtggtcaggacctcaacaaaaccagccgacagcagatcccagaatcccagggagtgatcagcggtgctgttttccttatcatcctcttctgcttcatccctttccccttcctgaactgctttgtgaaggagcagtgtaaggcattcccccaccatgaatttgtggccctgataggtgccctccttgccatctgctgcatgatcttcctgggctttgcggatgatgtactgaatctgcgctggcgccataagctgctgctacctacagctgcctcactacctctcctcatggtactatttcaccaacttgggcaacacgaccattgtggtgcccaagcctttccgcccgatacttggcctgcatctggacttggg

SEQ ID NO: 274120 - DNA, 1201 bp, Homo sapiens
aagtatccgttcttggctgcctttctttaattgcgtttccagtactctctcggtgattctactcttgaacataggatgaaatttggaatcacacttctcttccacttccatccccaccctctaatgcccatattaaaaatggcggccgccgccttccgcagtaatggttgttcagcgaacaagatccgggcggaaacagtagataggcgggtgcagcggggcagaacataggttgccttagagaggttccccggtgtcccgacggcggctcaagtcagagttgctgggttttgtcagcttgcccgttacctgaagaggcggcggagccgggcccctgaccggtcaccatgtgggccttctcggaattgcccatgccgctgctgatcaatttgatcgtctcgctgctgggatttgtggccacagtcaccctcatcccggccttccggggccacttcattgctgcgcgcctctgtggtcaggacctcaacaaaaccagccgacagcagatgtgagcagcggcacacgggtccgggcagggggcaagggctaaggaaggagtggctagggcaggggcgggaaccggggtgcttgaccacacgtgaagactcagaactaacccaggcagcctggaactcggagaggtgatgagcagaacttactcgcattggggaaaggatgggtagggacccttgggtatatctgggactctggcagtggtgctttcctccctccgcccccctcaccacttaccagaataaaaaaccgggaatgagaagaccactttgggttactgtaacacctgcactagtgagtgaccacgccccctttcctcttccccctcgcccccttgctgctgggccacagcccagaatcccagggagtgatcagcggtgctgttttccttatcatcctcttctgcttcatccctttccccttcctgaactgctttgtgaaggagcagtgtaaggcattcccccaccatgaatttgtggccctgataggtgccctccttgccatctgctgcatgatcttcctgggctttgcggatgatgtactgaatctgcgctggcgccataagctgctgctacctacagctgcctcactacctctcctcatggtactatttcaccaacttgggcaacacgaccattgtggtgcccaagcctttccgcccgatacttggcctgcatctggacttggg

SEQ ID NO: 274121 - DNA, 479 bp, Homo sapiens
caaaaacatttatcttgccccatgtcaccattctctaatccctttcaactctgctttataagctaccattagctccagataattatctgtcacatgaaatgtgctgtatgttacataaatatgcattttaatgtcttcgctgtactttcccaagagacaataactaaggcctaatatgtgacttcatggtcttagatgaattatttatctatagtaagcagaaaataagtttttcctttgcttaggttattacataaaagcattgttgaccacagttttttttaatgaaaaaaatgtgttttgcttaaactttgtgaaattaaaatattttaattggttatatgtgtgctacatacttccctatttatgaaatagtatatttgggtaatatagcttccacacttcaataaaacaattgaaacattacaaaattttctaacacatgaataaaatccatatgtatttctgcatagtagtaa

SEQ ID NO: 274122 - DNA, 544 bp, Homo sapiens
ccttgccattgcacactcctatctttctgaacacacaccaccccacacacacaccatacacacttgtttcattgcgcttcattttattgcacttctcgaagaatgtgttttttacaaattgaagatttgtggcaacttttcatcgagtgagtctattggcatcatttttgcaagagcatatgctcacttcctgcctctgtgacagcattttttagcaataacatatttttaatgaaggtatgtacattgttttttagacataatgctattgcacacttgactaaaatgtagcctaagtataatttttatatgccatgggaaactaaaaaaagtgacttactttattgtaatatttgctttattactttggtctggaactgcctcacactatctctgaagtatgcatgtatagcttttcataacacagatatcacatttgaccagatcctattgttactgaacaatgttgatgctaacattgatgatatcaatcactattactggaatcattatcaacatatcaataaatatttttagaacattt

SEQ ID NO: 274123 - DNA, 732 bp, Homo sapiens
aaataaagaacctgcgagtgagttcccacacgttttcctaatgggctgctgctttcctaggagtctctcgctcatagaaaaggcacacactgaaagaggaagcagatcccattgctgtggaagtcccattgttaggaagctctgcttttctggagttcaaattcgcattcatgatgctttaaaccgtcagagctgggtgggtccttctacaacaaaatcgtttgctctctctctcctagttaacaggctttcaaatattagaagatcaatgttctgaccccattaaaatttctcttttgtggaatgaaaatctctgatttaacccatcttcaagcctggtttgcatattcctctctcttccggccaccttgtctagacacactacactgaggccatgcccatcgtaaatgatgttgatatgttgtcaaaaaattggcaaaccaggcgcggtggctcatgcctgtaatcctaccactttaagaagcagaggcagacagatcaccagaggtcagaagttcgagaccagcctgtccaacatgtttaaatccgtctctactaaaaatacagaaaaaatgagctgggcgtgggggtgcacatctgtaatcccagctacttaggaggccgaggcaggagaatcgcttgaacctggaaggcagaggttgcagtgagccgagattgcatcactgcactccagcctgggtgacagagcgagacaccatcgcaaaaaaaaaa

SEQ ID NO: 274124 - DNA, 358 bp, Homo sapiens
tcaacaaaaatgtaaaggacattttggtcaacctggatactttcagttgtttcaatattttcctatcttgatcttcctcatgtggttccaaaaaattccaattcataaagataagtagcaatataataatttctataattttcttgaatagatatgtccagttttgaatttcagggaaataaaagaacctcctaatcagagacatgcctgaaagaatttgactcgaactcaaaatatctgagatgattgataagctaattacccaaatctgaccactatacattatatgtgtggaagcttcactctgtagcccatacatatgtataattattatatgccaattaaaaaaagaaatttg

SEQ ID NO: 274125 - DNA, 239 bp, Homo sapiens
agtaaattgcctgatccctagctgagagtatagaattatctctgttcagttatctgttcaaacagattcttctctctggtgccttcttctggcctgcaagagggattggcgtctgtgtcccttttgccaagaaatcagatggtaaaagagaaggtgctccacgtccccttcccaccctgacatgggacactcctgtcttatcctggcagcttttggcctccacacccacagcccagttt

SEQ ID NO: 274126 - DNA, 389 bp, Homo sapiens
catatcctctctacatctccagcaggtgcagctaaagaaatatcacgtttttcttgttgaacccaaagtgggcttcagaacccttttcaacacagagctccaggcaaccattcatgatcaactgaggtgacacatgacatgaaatctatttgtcattatgtcttcaaaaacacttccaaaagcatattcattaaagcagaattctccaaacatgtcacgttgaaaaacagtcatagctgcagattcacaatgattacaagcatattaaactcattgagaaatcctcccagacaaattctttcactgattaatcctcattttttatattgatttgtccacagaaccatttttgttatattgtttctattaaaatactatgaaattagatt

SEQ ID NO: 274127 - DNA, 805 bp, Homo sapiens
ggagagagaagggggaaatcttcatattactctcctagatgggagagtttgagatacattttctaaaacttgcttctgaatagcctggaattctggatcagttggaacagcatagtcagtatttggaagatggtgaaacactgaatttgctaatttactggtgattataggtacctgaatacagaggtgatacggcctgcatatgatccaggcagattttattcatatgctgtagtttgtagtctgaatggtcttcttcaaagtgtactattatgtatattttttggactttgttgtctttccctgtctttccttatactgttaaagctttaataccctagactctatcatatctcaggagacactgacttcatcaaacttaggtttttgtctttggcaagctatctgccccaatatttgtattcctattcctaagcctggtcattgtcagatgactcatagaagcctttaggagaagccagagtatacctagctctaggagtgcttatcagattaatgacctgatcatgaaactggcttaaaaacattagacacatatactcacacacatacacatgctgtgtagatgtttttgcccacagaaggggctgccagctgcatcaggactggccgtagtcttctctgtgctcagatatgctaaatattcatggaagttgcagctgctggagtatctcttcccagaaagctcccacaccccaactggacattccattggtcactgttaggtggtgactgctcatagcttttctctgcagcagaaatgttgctttccacatagccggga

SEQ ID NO: 274128 - DNA, 256 bp, Homo sapiens
ggctttctaaatgtcattccatagtgccagtgagccctttcatccaggttgtttcttcctcccattgacgtaatcagtgttgtctcctctgtttatcttaggctatctcagatgagaggtgattttttttctttttgcataaattagactcctttttttttttcctctgccatgagatccttctgtcctctctactggaagcaccatgtgggaggcaggaatgatgacaatatacaaatatatttcctgccacgtg

SEQ ID NO: 274129 - DNA, 344 bp, Homo sapiens
gcacccatggtgacatctgtccattcatttattcaatgtatattcatttatttagcccttttctggacactagggaaagcaatggataaaagagatgaaaatccctgcccttgtgccatttacatcttagggaagggaagataataagtaaggaaataaacaaacaactaactaagttacataccttatgtcagatggtggtaagcgcaatggagaaagtaaatcaggaaagaagaggtcgggaaagaatcagagaaggccacactgagagggtgacctatgagcaaagacctgtaggaggaaaggaagtaagtcatgcaccatctgaggcaagagcatttagg

SEQ ID NO: 274130 - DNA, 341 bp, Homo sapiens
taattccattggaatggctaaggccacaagtaagtgctctgccttctcctctgtaatgagttctctagagtcaggaaggtggccattctcacctttcccaatcaaaacagttactcctaggagtcccctattcatctctctgctctctcttccacccacctttatttgcacgtaatagaaatgcatctgaatttagttatgcctgtgcccttttgtatattttcctttgtgctttcgcttgacagaagtgtctccggttgaaaacacaggctgctgagagtgtctatttgttatactttgtatagcatttaggacaataaaacctttttgtgctcataatg

SEQ ID NO: 274131 - DNA, 391 bp, Homo sapiens
gattatttctcaaattcttaaataaaatgacaagaaattcaagtacgcttttgttacacacacacacaaaggaaacttaaatattttacttcaaattgtcagcccaggccaggcgtggtgcctcacccctgttcccagcactttgggaggccgaggcgggcaggttacctgaggtcaggagtttgagaccagcctggccaacatggcgaaaccccatctctactaaaaatacaaaaattagctggacatggtggtgtgtgcctgtaatcccagctactctggaagctgaggcaggagaattgcttgaacctgggaggcagaagttgcagtgagctgagatcatgccactgtactccgccctgggccacagagcgagactccatctccaaaa

SEQ ID NO: 274132 - DNA, 408 bp, Homo sapiens
aggattgcttgagcccagttaaaagaccagcctgggtaacatagcaagactccatctcaaaaaaaaaaaaaaaaaaaaaattaagaagagtgagtaagacccagcctagttagtcaacaggtttagttcccagctagaacagaccagagaagagtgaatggactaggaccaaatctgtcaccctctcaccctcccacctccaccccctccagctgaaatgacagattcattttagcatagaaaggtaattgggtataatctgaataataaccatcaaaatataatacatctgttaatgatgaaagccagaaagtaatgtttaaaatcagacagtgtattcaaaccactgtgttctttgccaacaataatagtgactgagggtaattttacatttgtctcgttttttaa

SEQ ID NO: 274133 - DNA, 395 bp, Homo sapiens
tcttgaactcctgacctcgtgatccgcccgcctcaccctcccaaattgctgggattacaggcgtgagccactgtgcccagctgcgacatttcatatgatatttcaggaagacataacagtcagcagagcccccaaatacctgaaaacataaacttgataggattgatggaaattaatcagttatagttagagatttcaatatcccactctcaataattggtagaacatctagacaaaattggcaaggtatggaggacttgaagaacattattaactcacttagcctgacatctgtagaatacctggtgaatgcagaatacatcctcccaattgtaggtgaacgttctctgttgatcatacattggaccataaaacaaggctccagtatagctgta

SEQ ID NO: 274134 - DNA, 577 bp, Homo sapiens
gtgacgtgtcatgtgtggggggtgtgtgtgtgtgtgactgtgtacgtggtgtgtgtgagtggggtgtgtgatcgacgctgatgtgacatgtgcatgtgtgtgaggtgtgtgtgtgtgcctgtgtacgtggtgtgtgtgagtggggtgtgtgattgatgctgatgtgacgtgtgcatgtgtggggtgtgtgtgtgtgtctgactgtgtacgtggtgtgtgtgagtgggatgtgtgatcgacgctgatgtgatgtgtgcatgtgtggggtgtgtgtgtgtgtctgactgtgtacgtggtgtgtgtgagtgggatgtgtgatcgacgctgatgtgacgtgtgcatgtgtggggtgtgcgtgtgtgtgactgtgtacgtggtgtgtgtgaggggtgtgtgatcgacgctgatgtgacgtgtgcatgtgtgtggggtgtgtgtgtgtgtgactgtgtacgtggagtgtgtgatcgatgctgatgtgacgtgtgcatgtgtggggtgtgtgtgtgtgtctgactgtgtacgtggtgtgagtggggtgtgtgatcgacgctgatgtgacgtgtgcatgtgtggg

SEQ ID NO: 274135 - DNA, 456 bp, Homo sapiens
tctagccggataacaaaaagcttcatactaaaggcctatttacatcacttccaattaccttatatatcttgtgtggttttcaacagaaaagtacaagaaatgttaaaaggcaggaaaaaaacacagcctaaagagaaaaagcaatcatcagacccagaatctgatatgacacagaatggaattatcagccatggaatataaataactgtgattaatatgttaagggctctaatagaaacatgcagatgaacatcatgcaagaacagatgtgtaatgtaatcacagacatgaaactctaaaaaagaatcaaagcaatgctggaaatcaaaagcactggaaaagaaatgaataaattatttgataggctcatcagtaaactggatatggccaagaaaagaatctgaagttcaacataactcaattaaaacttcctaaactaatatgaaaattttattt

SEQ ID NO: 274136 - DNA, 349 bp, Homo sapiens
tccacatgctaaacagagtaaacaagacctgcctcctcccctctcatcctatttctaggcagctatttagttgctgacctaatgaccctcttatttacctcagatctgcattacggtagcagttgattattatttgattccccattttctactgctccttattgttagagatacatcatgaaccctgtggggataagtggcagggaagaatttgaacagtctattgtcatagcaccaatgttatcaaactagcaataaatcctacctcaattcctatgtggttttaattctctctcattcttgcatatttctacttccaataataccataccattttagtgtgcacttt

SEQ ID NO: 274137 - DNA, 345 bp, Homo sapiens
agcccatcctgactaacatggtgaaaccccgcctctactaaaaaatacaaaaaattagccaggtgtggtggtgggcgcctgtagtcccagctactcaggaggctgaggcaggagaatggcgtgaaactgggaggcggagcttgcatgagatagacttatatgtattaacagtggaaagatgtctataatgtttgttaaattagaaaaagagcaaattgtaaaacaatatgaatagccctcttgtgtaaatgaacccatttacacaaccaaaacaaaccttatgtgtatatatagtatatgtttataaatgcatagaaaaatatctggaaagaaatcctcccaatt

SEQ ID NO: 274138 - DNA, 347 bp, Homo sapiens
agcttaaaaatttccaacataaaaaattgtgcatatccttgcatgagatataaaatatacccatgcaggctgggcgctgtggctcacccctgtaatcccagcattttaggaggccgagtcgggcagatcacaaggtcaggagttcgagaccagccttgccaacatggtgaaaccctgtctctactaaaaacacaaaaatgagccagttgtggtggcgagcgcctgtaatcccagctacttgggaggctgaggcagaagaattgcttgaatccgggaggcaggggctgcagtgaggcaagatcgcgctgctgcactccggcctgggcaacagagccggagtctgtcta

SEQ ID NO: 274139 - DNA, 376 bp, Homo sapiens
ctgccctcagccccatctgccagttcttgctctgcaaaagccacactgttgaggccgtgaaagtatagttgagccttgaacattatgggtttgaaatacgaaggtccacttaaacagagacttttttcagtaaatgtattggaaaagttttctgagatttgcaacaatttgaaaaaatctgcagatgaactgtatggcctaaaaatatttcctgcctccccttccacctcttctgcttctgccactcctgagacagcaagaccagcccttcctcttccttctcctcctcagcctattcaacatgaagataatgaggataaagacctttataattaccacttttgcttaataaatagtaaatatatttctcttatga

SEQ ID NO: 274140 - DNA, 382 bp, Homo sapiens
ctgggacagaggagggtgcagtcaggcgacaggcttatcaggactccctgcctcaatccctggggattgtccaggcaaaacctggagggcagcgggcaagctgttggatggaacagagagaccctcgcagctgactagggcccaaggggacggacactcaagaagatgtaaaattgggaggggtggtattggccattggggcaggcagggccgggaagggaagtagcaccggccgcagccccaagccagtggcttttccacaagggcctatcctgcagccggcccgctccggcttcctccactgctgaagaccctgctgtagagctgaagctgaacatgtgtttgctaaataaagattcccattcctagcgcaaaccctctc

SEQ ID NO: 274141 - DNA, 437 bp, Homo sapiens
ccttggcctcccaaagtgctgggtttacaggtgtgagcctgtaaccggcctacagtggttccatttaggaagtggaattgagcagggcagaaggatagagaagaggaacaccttcctatttcattttatgccttgctggaccatgttttggttttttgttttgttttgttttttgtttgtttgttttttaccatgtgcatatattttacaaaaaaaaaaattataaagaaaatatataggaaggtgttgtgaaacaaataacatgcacataaaaggtgatactattaaggggtcaggaatctctctctaaatctgtgatttcaatgaataaaatgaaggtgactgaggcaagatcctgcatttccagagtgacttggtgtctggcctggagagcagacattgacaaggaaagaaatgtggccacaggaggggctgtg

SEQ ID NO: 274142 - DNA, 433 bp, Homo sapiens
accctagcagcgggcatgagctaggtgcttggccatgactgaggctggctgattggccaactgagacttactcaactttgaggcctgggctcctgaagagacaggagaaaacatctaagccagtggttttcaatttttaaaaaaacctgcagtgttctttcttcaaaggacattttacatgaagctcaagatattagcagatgaaagcaaagctactctggctgaagctgggtttggggcccagagccctgcctgcttgctccacccctgcccaaacaaagccatctctgagataccttcaaggaacctgatggcttcccagagcccagtctgagaaccacggatgaggaaaccaagatccagagcggggaaatgactaacccaaggtcacactgcaactagaactgaaaattgagtggcttttccagactcc

SEQ ID NO: 274143 - DNA, 462 bp, Homo sapiens
agttttgaattttatcaaaagattagtagtcacacacaaaccacagataactttggctaattaatatagagtcaaaaatacttctataaaacaagctatttcaatcaaacatgatgtttaatatgattaaggagggctcattccactgtgaaaagacaacttagcattaagaaccacatagccaggcacggtggctcacaagtgtaatcccagcactttgggaggctaaggtaggaggatcgcttgagcccaggacttcgagaccagtgtggtcaacatggtgaaaacctccctctataaaatttacaagaactagccaggtgtggtggtgcatgcctgtagtcccagctacttgggaggttgaggtgggaggatcacttgtgcccagaagattgaggctgcagtgagccgtgatcatgccacacacttccagcctgggcaatggagcaagaccttgtttca

SEQ ID NO: 274144 - DNA, 162 bp, Homo sapiens
caccagagggaagtgaggggacacaagagggtgatgaagggacaccagagggtgatgagggggcaccagagggcagtgaggggacaccacagagtaatgagtggacaccacagggcagtaaggggacaccagatggtggtgaagggacaccagggggaagtg

SEQ ID NO: 274145 - DNA, 761 bp, Homo sapiens
tgcctcaaatccttctcctgtagaggaagaggggtgtaaatacgaggtaaatatgtaaagaaaagcatgaaccaatgacctcagtaatggttccagagaccaggactccctattctgggggtgaggataaaagtttccatgtctgatttacccttgctcagggatgaacccatttgagcccccaaattgaagcctttggatttccctatgacatgtgaattgtatttatgtaggtattctgatgaaattgcacttccctcaaaaagatgaaacttaaatgaaagaggatgaacctggaacatgtgcagtgtgaaaatttacacagcgaaggagctaagtctcagccatgatcagtctattttgagcttcctgttaagcaccaaagtgatggaataggacaaagaaaaattgtacccataataaatagaggatgacccctgtgaaaagtaaagatagagcccatattggattagaaaaagacttgatatttccctccacctttacctccttctaagtctatccaggagtaacaaaaatgatgaacatgggatcttaagtagtcaaaaaactgtaagattaggaaaggaagctgtaattgtttagaatctactatgtgctagggattttatgtgtactgactcatgcaatagatgagatgagagcacaatgaagaatacttttctccactttacaggccaaagaagcagaggctcagcttggctcaactgcatatcagtaaatgacaggaataagattcaaac

SEQ ID NO: 274146 - DNA, 700 bp, Homo sapiens
tggacactcgagaaaatggccttagtcctgattcccctctctcttacccattctcaggcaggcacaggcggagagagggagactttcccatttgctctgattatggagaggccctttgaaagtatcactctgtcctcacaaagggctaagtttcacgttaatccaaatctaacctctctcagcctcaatttccccatctgaaatgaggaactggattagtcatctcaaggggtctttctggcctttcaaatacaaagcaaactaacagataaaatctcctttcctctatcatcagggctgggctcagttaaaactcagaatgaaaagttgtcagagaagaattataaatttctattaaaatagcaattgtaaatgattattatgtttaagtaacattgactaggtttttgattagataaatttaaagaatagaacaaaaatgttatccccaacaaccagataacccatgttggatataaatacagcaatgggtgcatggatggatggatgaatgggaactacagtgcacatatcttaaattattcaaatagtccagaaaggaatgaaatgaaatgcaaaaatctctctctccatccctcctgcaaacctgactcctcatctccccctaaagctacactttgctaacagttccatgtgtatctcaccaagaaaacaacattttttacactgataccagcgt

SEQ ID NO: 274147 - DNA, 401 bp, Homo sapiens
gagactccatctcaaaaaataaaaataaaaaaaagaaggttccaatctgactgaccccatcctgtcagcagagaacaactgaggcccagccctctacatctgcatgtttcctcatcctgcctgactcctttgatgaaggcagtttggatcttgggtgccatgatggtaaaagctaagtttgtgaactttgcgtcttgggagccaagggcaatatcctgtgtatgagcctagaggaagagaacgcacttggggaggaagagccccaaccccgctgtacatcggacagcgaacagcacacaaggcgtgggccgggatcaggagggcagttccattcctggctgtgctgattactcaccctgtggccatctctttgggggccaccataaaatgatagatttgca

SEQ ID NO: 274148 - DNA, 418 bp, Homo sapiens
ttcaggtgctgccctcagctagtccctttgaagagtgcaaggtgcccagtgttcctgatcttctagtttgaatgatgagaaagagcattctacctttccaccatcacttaagtgtcctttgaaattgaatttgcatgcacatatttactgctcattctttttaagtgagtaggtgtgctgagcttcaagtctattttgagactcagcccatgttaaccccttgaggcccacttcatgataggtactgccctgtgggaatcctgtcatttagtgaagcatgaagccataatagatccacagccataccaccattggggcatctcatttcgattaattccctgaagcctttggtgctgtggtttgcagaaatcaaatggcgcaaatgagaactacaaaattaggcaggttaaatttcgca

SEQ ID NO: 274149 - DNA, 343 bp, Homo sapiens
ggccgggtgcagtggtgcaattgtaactcactgcagccttgcactcctgggttcaagcaatcctcctgccttagcctccccagtagctgggattataggcacatgccaaccacatccagctggttttaaaatttttcttttgtagcgatgtggtctggctacgttcactagcctagttttgaactcttggcctcaagtgatcctccccccttcacttcccagtgttgggattacaggcatgagcccctgctcctggccaaaattactttttaaaaagtcatcaatgttttgccgatcttttaaagtatactgatcatgagtaactactcttaaagataatttc

SEQ ID NO: 274150 - DNA, 525 bp, Homo sapiens
catagtggctcatgtccgtaattccagcacttagggaggctgaggtgggtggatagctggaacccaggaatttgagatcagcctggacaacatggcaacaccccatctctacaaaaaatttaagaactagccaggcatggtgcacacttgtagtcccagttactggggaggcttaggtgggaggatgggttgagcacgggaggtcgaggctgcagtgtgctgtgattgcaccactgcactccagcctgagcggcagggtgagaccctgtctcaaaaaattaaaaaatcatgtgtattagtgaagatttgtaaagtagaaaataatagaaataaaattgaaatcaccagtaatcccaccattttgcgataactagtattaaatataggtatatttccctctgattattttccatgtatatttttatcatcattgagatgtacatagtttttcttaatcctgcttttttcattaactacatcattgttaatttttcttaataaatatttttgaaaacttaatttcta

SEQ ID NO: 274151 - DNA, 202 bp, Homo sapiens
ttcttctgcacagaatttgctccgtggtgagcctggagatgtctctggatggggacagctccattcccagctacttctgcggggctggtggcgcagagatgggcgcaaaggctgaaagtcgcaagtcctgtgcttctggagttcaaatgcttcctttccagcgggtctccttgcgccatggggccgtgctggggtgaatctg

SEQ ID NO: 274152 - DNA, 480 bp, Homo sapiens
acattctaatcaacgtttattataaagctgtggtatacatgaatgagtctctggtataaggagatacgaatatatccaatgaataaaaataaaagccagaaatagaccctttagaagggaatctggcttaccaaagaagggaaatttccaagcagtaggtaaatactggattattcaactaataatgctgagacaactgaccatcatatggaaaacaatcaaattagatctttagggtaggaaacgattccctaagacttcaaaagaccaaactataaaagattggtaaatttgggccaggtgcggcggctcacgcctgtaatcccagcactttgggaggccgaggccggcggatcacaaagtcaggaaatcgagaccatcctggctaacacagtgaaactccatctctactaaaaatacaaaaaattagccgggcatggcagcatgcgcctgtagtcccagctcctcgggaggctgagg

SEQ ID NO: 274153 - DNA, 357 bp, Homo sapiens
aataagtccctggaacagtggctgacaaagaaggggcaacgaaaggctaagacaaaatctactaaagccatgtatcagaatgatggagcagggccaggtgatgtggcttatgcctataatcccagcactttgggagatgaaggcaggtggatcacctgaggtcaggagtttgagaccagtttggccaaatagtgaaactcttgtctactaaaaatataaaaactggccaggtgtggtggtatttgcctgtagtcccggatacttatgaggctgagctagaagaactgcttcaacccaggagacagaggttgcagcgagccgagattgtgcaacagagtgagactctgtctcaaaaaa

SEQ ID NO: 274154 - DNA, 620 bp, Homo sapiens
agctgtgggatctgggacaagtgagtcatctttctcagcctcaacctccttatctacaaaataaaggtgctagcctggaatgtcactcaatgatcactgtgcttctatctgggaaaaatacatctgtgattcagtacatctatgcagataggcccaagagattcatctttcatactcatgttcccctaaaggataatgaaaacctgactggccttaggtgacatccatgtgcaaccgtgcttgtgaaggcagcagctgagctgtgggtccctgctgcagagtaaagtgctattgttaagtgaggtaagctccacatggggtcgtgttttcatctgtgctctggaaaaggcgaagggtagagaagatggaggcttatacatatgtggccttcccacataaccccataaaggtatggactgggttagagcagtgtgcctttgaatacaagccatgaggaaacacctgatgtcatcttgttctaataatttccaggctcaaagagactcttccagatagcacagtgtaccccaccattccagatgggagggtgcttggacctcatgggtccatgtttatgatatggatgatgattgcagccttctggtagccagcaagtgagt

SEQ ID NO: 274155 - DNA, 266 bp, Homo sapiens
ttctctgccatttactagctttgcaactgtagacaagttatttactctctcagtgtcagtgaaatctgaggatttgatgtagttccacatggaaagcaagcaataaatggtagcggcggcctctggaaagattttcatccctgttaatcctctcataagatagttaagtactgttatcattcctatttcacagatgaggaaactgaggctcagggagagtgggtaagtgttctgcttcccccaacacatggctgcaggagtcgtgg

SEQ ID NO: 274156 - DNA, 583 bp, Homo sapiens
aggcctctgggcctgtgatgggaggggctgccacaatgctctctgaagtgccttcaaagccttctccccattgtcctatcagcacttggctcatcttatgcaaatttctgcatctagcttaaattcattcccaggaaagaggttctttttttgtaccacaaggccaggctgcaaattttccagttttacactctgcttcccttttaaatgtaagttccagtttcaggtcattacattgctcatgcatgtgagcacaggctgtttgaagcagttaggtcaccttgaatattttgttggttagaaattttttctgccagataccctaaatcatcactctcaagttcaaggtcccacagatccttagctctttgctaacacataacaaaagtgacattttctccagttgccaatatattcttcatctctgtctgagacctgggcctcattgtccatatgagtattttggtcacaaccattcagtaagtctctaggaagttcaaactttccctcatctttgtcctcttctgagctctctgtactcctccaacctctgcttattacccgattccaaggttgattccac

SEQ ID NO: 274157 - DNA, 215 bp, Homo sapiens
gcgaagtttgcagtgagccaagatcatgccactgcactccagcctgggtgacagagcgagactctgtctagaaaaaagaaaaaagaaaagaaaagaaaagtaaggcacttagagggtaagtggcttcactcggtactaagtaggggagtgtggatttgagccaagctgtgggttcaaaccacatcaacacctgctatgcctgactgcgtctccac

SEQ ID NO: 274158 - DNA, 388 bp, Homo sapiens
atattattagttacttttggtcaggaactttgattggtctgtattcttcagattaaaccacaaccttgtgaagtggtaatcctgattttctagagtagcagaaggtgttttctatctcctacaaagtcgaaggctgacatgaatcatcttttgttgtaaaaggctattccggtgctttgcaaacttgatggctcccagctcatacagcagaggcaaccccatttccagtatcatttgtgatcacttacaaacagcaaaggttcaagtaagcatatgggttcacaggtgtctgcacattggttcttgaatcgtaacaggcccaagcttctctttacaggtttatgttgctagacttgctactctgtggcattcaagagcatggtacttc

SEQ ID NO: 274159 - DNA, 784 bp, Homo sapiens
ttttttttttttaagtagagacgaggtttctccatgttggtcagactggcctcaaactcccgacttcaggtagtccgcctgcctcggcctcccaaagtgctgggattacaggcatgagccactgcatccagccagttgtagaattttatatttccaccaaagtgcacaaggattccaatttctccacatcctcaccaacactttttattttctgttttcttcatagtagccaggctagtgggtgtgaggtgacatctcattgtagttttgatttgcatttgtgacacatctgttcatgtgcttattgtccatgtgtgtgtcttctttgggaaaatgtctgtatgagttccttgaccattttttaattagggtgtttggttttatcgtcgagttttaggagttcctctgtgtattctgggtctcatgtcttgtcagagattacagacaagacatgtctgtacctttgtgtcatatccaagaaatcattgacaattccagtgtctcgcttttagcctgtgttttcttctaacagttttaagttttaggttttacatttagatcatgatccattgtaggttgataattgtatatggcatttatttctggattctgttttattcccttctgtatgtctgtctcgcatgccagtaccagactgtttctgttactgtaactttgtagtaagttttggaatcaggaagtgttagcccgccacctttgtttttctttttcattaccattttggctttcagggtaccgtgaaattctatgtgacttttaggat

SEQ ID NO: 274160 - DNA, 273 bp, Homo sapiens
tgaacccaggaggcagagcttgcagtgaactgacattgtgccactgcactccagcctgggtgacagagtgagattctgtctcaaaaaagaaaaaagaaaagaaaaatgagatgtctcttgacctcatcacacagcctttccccgaagcttgttcagcgccgtccccactgtggcttgagctcacttcccaggaaagaggtttctgcagacaaagctactgccacagcctggagatgcttgcttttgacttgcttgtcatcagctccgtggggc

SEQ ID NO: 274161 - DNA, 211 bp, Homo sapiens
cctgcctgtcccacaactttacatggtgatagttctgtacaagatagtttcattggaaattaattaagtcttcaagaagacaagatagtgcttataaggagacatcatcagaccaccctatttgacacaggcacaaacaccatcaccactgtacactccctaaaaagcagctgctcaaattcacacacacacaccccctcttacctacccc

SEQ ID NO: 274162 - DNA, 561 bp, Homo sapiens
aagttttagactttagaacatttcagatttcagatttttggattacgaatgctcaaccggttaagtacaatacaaatatttcaaaattcaagatcagaaacactctggtctcaagctttcagataaggaatattcaacctgtaatactttctttctcacatctagtgtcaatgtcacccactaaggaagctccatcatatactccccgtggggaggcaaggagaaaaagagctgtaagagcactatgagtccaccagcacatgtcacttgggttcctccagaaggcatccctgacctaagaacttgggtgcaagcagcttatttgtgggaaggaaatcccaggaagcacacttgaggggatcagtgaaagtgagatggggagaaaagccaactggaggttcctcactgctgtgagcacctgcagttcagtccttcagggcatgcctcagaactctcccacagaggagaaagatgaggtatctctccacttccttgttaagggttactcctggggccattacattaaaaactcttaacacttcttggctgccagcatggggc

SEQ ID NO: 274163 - DNA, 414 bp, Homo sapiens
taccaaaacgatgcctcagtctaggaagaggtgcttcctctctggaagcagctgaacacctgagctgctgtccacaggcggacggactctccaggagcccccagtgggcctcggctcctccacgtcagctcctctcttgtccctctgctggtccacgggggccgctgcagctggccaggtctcctgggagtcggagggggccatgggttccaccccagggcccacctcatcagcacagtgctctcaccatctgagcaccagcccagaggaaaaggagaaagaatgggtgatgctgatcccccaagcagaatggtaacccctccacctcccaccctcagtgcccagggcccgttgttgggtgcttttgagggtgggaggtggaggggtttccattttgatgttggagcggccgca

SEQ ID NO: 274164 - DNA, 580 bp, Homo sapiens
aaagcacccaacaacgggccctgggcactgagggcctcacgggcagctgtttgcatcacagtgaaatctacaaagttcccatggcacgtgagtggacgcttcctccacacgggaatgtccggctgccccaaggaaggctgcaataatgttgagatctttgaataggagcaagggatcaaggccgatggcctctctgagggcctcagtttccatccatgtgggcaagctcccctttgggaatctgggttatggttcccgagatggggacaagaggcatccgctgacggctatatttacaaaaatccatcaagtcgacacgcttgtgagagtcaaagcagtacagtaactcactggaaaagtgaaaaattctcaccttcacacccacagagataacgggggcggcgtgggggcaagccgaacgcatgcgtgtgctctgtgcactcaccgccgccctctccgcggctgtctggctcctgatttgcatagtgagaggcagacaccaggcttgaatcaggaggggcagcgccttgtcccagtgagtttgggtcttgagacagtgagtagcaagggtgtagaaagg

SEQ ID NO: 274165 - DNA, 455 bp, Homo sapiens
ctcccccactccccttatggatgaatgtttacccaccttaaatcttcaagccagcctcaaatgccacttcctccggcctcgagtccattcggaaccaacctacccttcagctgagcatttggaattttccaaaattctctctttcctccttcagaggagtctgcctcactcagtgtgcagcctagcttgttcatctattctctccattgtttatttagcaaagtgtctttgctatcaagagcccaatgaatatggctaagtgtccgtttgattttaaagagattaggggcagaatgtttcggtcacttatctgtttggttaacctcatatttttcacagttagttcctccaaaaaaatagattcaatccttccaactgtaatgtgaactcattttctcttaaccctatgttctctactcttaaaccaaagtgaattaattttaaaaaatcacaaa

SEQ ID NO: 274166 - DNA, 571 bp, Homo sapiens
tatttttattttttttgaaataataaattgtcctttgaaaatattccattttattttcaaaagataaagtatccttcaggtgatgagaactattcttggggaaaactttgtgtttgcatttctagaaatgaactctcagacttaactcatagttaatacaaaacccaaaatgaacttgggcttattgatttgctttggatgtttattttgattgtagcatcacatttgaaatccaattgtaagcatcacctctaatcaaagctcttttagtatgtgtgacaaatgcattttaacaaaattgtacccatgttttatttggtgaaatattattttgcttaggaattaacactgtaattctgtttcacagtttatccatgtaatttcagtttttacatgtcttgcagtttctttcatcctagagtagcttttgagtttattagctggtttcacttagtcttgtttataggcctatcactatagcttctaagtgcttctcagattatgttcccttttatgtctatcaaactgtgtttccacataaataaaaactcttcaattgctggaattcttt

SEQ ID NO: 274167 - DNA, 179 bp, Homo sapiens
taatagtttattgctgggaaaaggtctgggtaaaaaaaaaaagtttagaacacactaaggcttggggcatcagtcatcatttactgatccctcctcactaaccttttcctgcctcttgtttacaaacaccaaatggcttcagggtttagggagcagcttttcccttctgtcgtcttctc

SEQ ID NO: 274168 - DNA, 505 bp, Homo sapiens
tcattacagggagggctttattcagctacatgaatagacaaggggttgagcgaatgagggatgaaaggcgacatttggggcctgttttctccctccttcccatcttcccattctggagcctggctttgtgacgggggctgccgaggaaccctccccgcggacagggctgggagacagacagagagcatcttccagctacggcctccccaggcttaaatttccaaccggtagatgacctgcagtcagatgtcttgaggctactggattctccccagggtggcaggcctggccctcgggcatgaaggtggggttgtgtccagccctgccctgccttcccccttgtgtccagggaacagccaagccaagggaggccaggggcacagggtggactcaccccaggtgttggtcccgtgcctcggtgctcctgagaagcccagcagagctgcggattgtggcatcttcacgcacttacgggtgaggaacggagccgctggtcccagccccg

SEQ ID NO: 274169 - DNA, 385 bp, Homo sapiens
cttccctactgtccatggagtggagtgagaggcctcgctccatgttagaggtgaccggccagggggctctggggatcagcacaggctgatgcagtctgatgaaccaggtgcttctgcaggtctcaaccctcccattgctgcttaatgctggtaatttctgctgcttcacctatttccactttgctcatttgacactatctaataagcacctgcatgggacgattcatgccactgcttatctactcattcaggagcttctgccagtggcagtggcctagttagaaaagacaaacatggtgttccatgcccgggtgacttcaggatatcccttgtttcagcgacctcaacaattcattgtaataataaaagctttggtccttgaagc

SEQ ID NO: 274170 - DNA, 302 bp, Homo sapiens
ttcatcatatccacttatgatttttacaatagttattatagtagtattctcttttttattcctgatatttgttatttgtacttccttgtgctcttttttcctttttgtcttgtcagggcttatcaatgttataaatcattttagagaatcaatatttgaccttgttaattctctatttttatgttgattttttatttcactgacttctgcttttatgtttattttcttgtttctttggggtttaacttgctgttcttttcctaacttcttgaaatgaaaaattcctaacttcctggaagctt

SEQ ID NO: 274171 - DNA, 280 bp, Homo sapiens
gcgggtatgggccctggattagggaattttaggggtagggagtggatcttgcccaaaattttagtatttaccttttaaactcaggctgcctcatttctgaataaactcaatgtattgtgtaacttaaaaaattggttaggaaattttattttttataacttctacagaattatattttaagaaacttagatttcgataggtaaggtgctagatatcagcacttaaccagcaaattctgattctgccacctaatagatgtaaactcaactttgtaaattcc

SEQ ID NO: 274172 - DNA, 309 bp, Homo sapiens
gtgtttaacgaaccctatcatgtggtactataatattggtttacatcccttttggactatgattgcattaacgtatgttttccaggggtggatatttttgaaaggtggctgtttattaatgttttgtcattttcttcataaagctcagtaatgtgctgtagctggctgatttaatccataaggcactttcatattctgttgcaggttttaaacagaagtcaaattgctttgttacgtttaggtatagaacaaaggcattatgtcatcctacatgtgtatattaatatatcccactgagctcaagtagtt

SEQ ID NO: 274173 - DNA, 485 bp, Homo sapiens
tagtttctatcctgccccaaaacacagactgtcactggcaccaccatgttgtggttttttccatgaatgaaaatataagagttctgtatgtaaatcatctttattgtgaactttatttctataataaagtcacacaaactatctttagtggaagttggatgaaataccggaaaagaagaatgtagagatagatgatagatatgtaggatatctctatccatctgccacccatctatctatcaagaaaggacttgagtaaagcactggctataaacgactgtaccttttgatcacaggaccttacaaataataggcacactagttatttgtttatttgatttgaataggatgactcatttgttactgttcatatgaagtttataaacttcattgagttgtttactgaaagtggactacaccatgacgaaaacagtatttggcaacacatatttgcatcttttaaaataaaattacacttatttgta

SEQ ID NO: 274174 - DNA, 485 bp, Homo sapiens
ttaattgtgcatgaacatttaattaatcttggtcttgtaaattaggtcacaggtgcacccaaaacaagccaaaatactagttaaaccagttctcagagggctcttcgggtgtatattcctgacagagcagtttggggatacttgatgcagacataagtaggtcagacagtggagaagaacaggcgcatatttatcacagggttattggacctctactgagataatttgttattgagaattgtactggtttctgtttagtgctgattctatcctgttcaaacaaggaaagtataaacttcaaaattgcattatatacatttattcattaaggactaattctcaaactttgaacatcagagaggcagtctcttccaggtgcaaccctcatgactatactatagctgattttggaccccattctcccaaattacttcttatgtaattattatcattataataaatgtgcacaatacattattttataa

SEQ ID NO: 274175 - DNA, 538 bp, Homo sapiens
gaaataacaactacaaaaagtatttgggggggtgatggagcatcaggtactcactcaaatggttgagagcaaaaagttatttgtactgtactttttcttaactttgtgaatattttgaaataaaagtacgtatgccatttggagaaaaagaagatagcatagtggtggttttttatgtctggaatatccatgtctgtctattccagtgtctggaatatccatgtctatctatccactggaatatccagtgtctcagttgagggtacttaaaagggaaaaacctcccacacttgattttctttgaagagtttacaaagatttgtaatttcagcctgggcaacatggtgagatcttgtctctatatgaaataaaaaaaatttaaaattagctggatgtagtgatatgtgcctgtggtcctagcccttaggaggctgaagcaggaggattgcttgagcacagaagttcaaggctgcagtgagccatgatgtctctcttgtattccagcctgggtgacagagcaagaccctgactcaaaaaa

SEQ ID NO: 274176 - DNA, 361 bp, Homo sapiens
tttttttttttacctgcttcaagttttaccatgttttaataataaccagttgtactacccaggtatgacattaaaattctaccagctcctctctcacctatgctatcctgagtaacatggatctaagtatgcttgcatcaagatgaatctcctagtctccactcattctagactgtcactcctaaaccctactaactgaaattccttagtttatgcctctaactcacctcttggttcctccattcaaggacttatctcccagccatcaaaatccacataatgtaattcatttgtagagaaaatgactgtggagtttgagaactgtttcatagatgaatgacattaattaaggatatcatct

SEQ ID NO: 274177 - DNA, 175 bp, Homo sapiens
cattttcgcctattatgcaaagtgccttcttcctagataatgctatagaatgttgttaaatattgcctctccaatttctctaagattttagtcataccctctttaattcattggatctcttctgtcaccaactgccttgtttattaaattatctcctcaaaaggattcttttaat

SEQ ID NO: 274178 - DNA, 218 bp, Homo sapiens
gtagaatttggcaatatctaacaaagccacacgtttattttttgacataagaatcacacttttaggaagttgttctgaggatatagcttcaataatatgaaaatacatgtgaacaagattgttctttgcagcactatttagaattgcagtccaaatgccaaacatgagaaagtaattaaaccatggtacagccaagcagtggggtactatgcagcggt

SEQ ID NO: 274179 - DNA, 889 bp, Homo sapiens
ggttgtgtttatatgtcacttctcatgtgactgtgatgactttaataaggatgtgctgcttaagtgtaaaggcccccttgctggcctttatggtattatagtattggtggcttgtctgttttattttccaagcactttataaactattcccaattttctcaggactatccttgtttcacaagtagggaaatcaaggcactaccacatacaatgatgaaatgagccacagagtatgtctgggctggttcccaggcctgtgcttgcaacacaggcctttatggtgctcttgtaagctgtttggctaatgggggctcacatgaatgcttcccatttcacagtgaggttttatgcttccatgtgagcttaaacccaaggattccaatggcgtctacatgtaaagaagctagccacacccccagcagggagagtatgggtgtaaattgtgcaggtggcagttaattggagtagcatatttctgctgggaagttaactgtataagaatctaaaaagaaacgttgtttatgttcccttttcttttcccagttttttagtttaagacagtcagtctgtcctgagcagttacttttttcttagataattgctggcttttaccctttctttttctgaatccttcatgctccatttaagagcttgtggaaacctgtgcttcagttgacaatctgtaaagctctgctcttctggtggaagctcatgacctgagaaccttttgagtggtctcttttgagaaactcctgtctagtggaaatatggtggaatttattaaaattttcaattcgaattataaatttaggttgacagaatccttgctcttgtgaaagaagtgagctgagactgggagtatccaaatgcaagaagtgctcagaatcct

SEQ ID NO: 274180 - DNA, 606 bp, Homo sapiens
tgtagagaggaggttttgccatgttgtccaggctggtctcaaactcctgagctcaagcgatccttgtgcctcagcctcccaaagtgctggcattataggcgtgagccatagctcccagccatatagatttatatgtatatatataaaatcaatttttgatcataaagctgctttctagattatatgtcaaattgttagatcacataacaaattgtcccataaattgaatcagctaaatctgcagctctaatattttgaggaaaacacatcatgtcacataatattactttgtcaaaggtataatgaagttaacagtgttttgtcttctcaaccccttctgtgtataacaggttaagcaaagtgccactaagtgaaacagtagcaggtgtaattaacttgaaaagttatggcgaagtctttggcatgtacccaagaaattgagaaaaagagtgacttttatgatctgaatcacaactctttttgtaagccatatagttttccattatttgctttcaggaaatctaattcattctttagctgaaagatgattaaaaataatatttgaccagcctgagcaatatagtgacaccctgtctctacaaaaaa

SEQ ID NO: 274181 - DNA, 359 bp, Homo sapiens
tctgtcccctaggctggggtgtcccttcccaaagtgctgggcttacaggctgagccactgtgcctggcctgcataacacttttaaacatgcttttctcctctgccttccatggtagtatgcctccctgttgcctccgaaacatcctttttcctgtttcctatcagctctgtttctttgtcccctcccttaaatgttgtttcttatctccttggttctcttttttttttccttcccccttgatctattttgtaaattatatttgcaaatgatgcatgtaaatagttttaaaaaattaaatagtttttcagggtttatcataaaaatagtgaatccctgtcctgtcccgttcctccccatc

SEQ ID NO: 274182 - DNA, 1796 bp, Homo sapiens
  misc_feature (3)..(3): n is a, c, g, or t
  misc_feature (326)..(326): n is a, c, g, or t
  misc_feature (1137)..(1137): n is a, c, g, or t
  misc_feature (1175)..(1175): n is a, c, g, or t
  misc_feature (1250)..(1250): n is a, c, g, or t
  misc_feature (1279)..(1279): n is a, c, g, or t
  misc_feature (1289)..(1289): n is a, c, g, or t
ggncactcttctccaacctctcactctgttgttctctcatctgccagaaagcacaccactcttggacaaagaaaaactgatgacccttcagtgctggagttttccaggcaggaaggacagggaggttcagagaatcccaacgtttgaagggagtgtgaagatcaggtggtccgatcccatgatgcatgaaaacctctataatattaggataagggcttcagttctctgccgggtttccagaacagattcaattacccaaaatggaggcaaggctcccaaagtattttaacaacagataaccagaaccagagaccccactcattgcnctagaaaatcccctcctgtcttcattaagctctttgaggctgtccacccaaagcattgggtctgattggggactgtcttttagccatgcttactggatccccaggagaggaaaactatttggatataaaaaattatttcagctgatttggacaagattatcgctttcttttcccaccaactccccccatctcccccacccctgccaactcttcacctcatctcacgagactggagagctcctggagtgatcttgtcccaccttccccagggcttccccacctcatctacctgctgaatgggtaggtaaaagatctctaaacttacagattcacagcaccaacatgaggttgcatgggggcaggccatgatgagagaagaagaagggtttggggacccatattctggcagtttttctaccatcaccccaaactacaagcaacagctcttggctgtacaaatgagagtgtctatgttgaacataaatatgcaatcattaaagatgtgtcagtttggagagaaagggactttagaggaggctgtgtctcaaactcttttcctatctcacccatcttccactctccctctcccagtctctgccctccccaacactttctcccatctttatctcctctcatacaacactgatgaattctatcagccatgacagtcttgtcctgctgcactttaaaatggcagatcttaaatcatctttccagtttcttccataattgacatagtcaagttttctgcttcatcttgagtcaagcttgagcatttgctaagatataatcaattttctttagctttaantgtttgtggccatagagttacttataatgttctcatanaacaatttcagtctctcctgtatgcatggttttatccccttctcatttctactcttacataattttgttatctcntttctttaatcaggtttgcaaggagttcnttaattttantgactttttcaaagaagcgattttggatttatttgtcctttctacttgttttggtttgttttctattgatttatttttcctgttttcttaaggtttaaatgttattttctaatgttttaaaattgatgtagaattccttcattttaggtctttctaacaacaaagccatttacagctattaattttctcctgagtacagctttagctggatactataggttttagaataaaggagtctacatttatcatttttaaaatagtttgtaattttaatttttattcctctttggttgtttgaggattatttaataatgggtttcttaatttctagcatttaggaatcttgatttttttaactttgtatatctagttttattggattatgagcagaaaacatggcctgtaaaaatctttattttaaaattgtgtgaatttttcttcattgtcaagtacctgattgattttggacatataaaattaaattttactttgaaagaaatacatatt

SEQ ID NO: 274183 - DNA, 377 bp, Homo sapiens
ggcttgcctctacttcagctcgggttctggcaacacctctgtcaggagctgtcggctagagccaagttagtctactccgtgtgtttggaagacaaggtgcctgttgttacctctgcttgcccacttgcaaccttaccctactaccctgttgcttaggcctggtctaaattttgaagcactataaagcctgattgttaaagagtccactctctgggctgggcgcggtggctcatgcctgtcatcccagcactttgggaggtcaaggtgggtggatcacttgaggccaggagttcgagaccagcctggccaacatggtgagaccccatctctctacaaaaaactagccaggcatggtggtgcacacctgcaatcctagc

SEQ ID NO: 274184 - DNA, 335 bp, Homo sapiens
cagctgctccagacaaacctttctgcctccaaatagcacaatcattacagcctggcagatggggccttcgctttcacttcagacgctccccttgccttcaggaaaccagtttcctcacggatatgagctacccaacgcttgccacaaactttcctgttaacagattcgttttgacagtggtctaaactacaaatgttctggaaccacatccaaagagcctctgaagtgtggttcaatctgtatgctacctctcagggccattttagaatagaattggctggggactgaacagcactgcatcagaaggagaaataaacctggatctaaagtcaaag

SEQ ID NO: 274185 - DNA, 428 bp, Homo sapiens
agctacttgggaggctgaggcaggagaatggcgtgaacccgggaggtggagcttgcagtgagccaagatcatgccactgcactccagcctgggcgatagagcgagactccgtctcaaaaaaaaaaaaaaaagaaaaaaagaggcaagaatgggtgagataaaataattttttgaatttggtaacttgattaggttaggagtctagggagaggggaggaatttttttttttttttttaagtgtaagcaacaggccaggtacggtggttcatgcttgtaatcccagcactttgggaaaccgaggtgggcagattacttgagatcaggcgttccagaccagcctggccaacatggttaaaccctgtcgctactaaaaatacaaaaaaaaattagcaaggcatggtgggtgcttgtacccagctgttcagga

SEQ ID NO: 274186 - DNA, 295 bp, Homo sapiens
gcaccctgcccctcatcatcctgtgcctcctggagatgactacctactactcagagtgcatgagctccctcatcatcaccaaggacgccctgatcagcatcctgggctttgtgggatttttggtggggaccttctaggccctccatgagctgatccagcctcaagacctctcctctttccaaactccactggcaccttgaaacagtgaccaattttcaactcaacatttcccgcttcacttcctaaactgacattctagcattgtttgaacaaagatccttctttaattgctaat

SEQ ID NO: 274187 - DNA, 188 bp, Homo sapiens
cccccttccaacagatcccattttactcattaattctccttgtctcttctcaccactagaaggtgagcaccacaagggcagggaccttttgctggttttgttcactgatgtttctcgtacctagaatcagcactgatgatatggatctagtacctagaatcagcactgatgatatggatctagtacct

SEQ ID NO: 274188 - DNA, 493 bp, Homo sapiens
tgagccgaggggagtgtgagtgccagctagctgctgtaacttaagtctcatttgcccaccattgtgactgttaaaaaggaatgataaagttgttactggttggtttttcgcggtttggggcggtggtggctctccctcactgcaaaatgaatgaatacttttcgggtcaaggttagcgtgaaaatgacagcccccttaggctgccccctttggcactgagctctagggacacagggaaataattccagcctgttatctgcctgtgaaaagttcttgcttggaaatctcactttgatgtgtgtgtctgagccgggtgctcagtccggctattgtttgcgagatggagccagacctgccggtggcatcttgtttactttcgtctccggctgctcagtaggggatggagatttgaaatagtcgccaagcctctgccacggagcctgtgctccccgttgattgcaaagggtaatgattaaacaggtcatttgaaaac

SEQ ID NO: 274189 - DNA, 252 bp, Homo sapiens
ggaggagctgggacccatcatgaggatggggacactagagaggctgtcactcaggctccctggctcactcactcacactctgcctcagtcgcaggttggagaggccactccctcccctgtaatgtcgccagccctcagccctccgccctcaccctcatccctccgccctcaccctcatccagggtcctcaagaagactcataataagaataagataagataacctcagtggtgtgccgggcatgaggctagg

SEQ ID NO: 274190 - DNA, 1371 bp, Homo sapiens
gtaatcctttggccttggcctcccaaagtcctgggattacagatgtgagctaccacgcccagagcatgttggttatttttataaaatcttaatgttgtatatatatatataaaattttcatttgaaaactatgtacaaggtagaccaatggattttaatgaaacattgcaattttttgtgcttttagctttcatattacaaccaacctttaggaaacaactacggtcctctgtcatttaatgacagggatatgttctgagaaatacatctctaggtgatttttttttttttttttaaatggagtctcattcttttgcccaggcggaggttgcagcgagctatcacaccactacactccagcctggcgacagagtgagacttcgtctaaaaaaaaaataagtaggaataaattaacgtacataaaaagcataacatactaaacacaaaccagtaacagtcatttatcattgtcaagtattatgtactgtatatatttttaagtcagatttgtaaaaatataaaactgccctccagcctgggcgagagagtgagactctgtctcaaaaaaataaaaatgtgtatctctgtcattgggattcctataagcttgtgcctagacaggatagttattttatctttaagaccctgttaaagcctgcctgaggtcttatctgcattcccctgtgggctgactcagcacctggttgccttgtattctcctgattatgaatctttcaacctctaggacatggaccattaacgtttagtatacttggctgtagctactttaagcttagatatctgccttcgaatattctaccttttttaaaataaaatataaatgtctagtgattctttcgttgttgtttttattttttggagacacggtcttgctgtgccacccagactcgagtgcaatggtgtggtcacagctcactgcagccttgaccttctgggctcaagtgatcctcccacctcagcctcctgagtagctgggactgcaggcgtgcaccaccatccttggataattttttattttttagagaaatgaggtctccctgtgttgcccagtctggtcaggctcaagcaatcctcccatgtcagcttcccaaagtgctggattacaagtataagccaccatgcctggctgtatcctgctttctgttataatagagtggattttggtcatcttgatagcccacacaacgttggtccgtttctttgatgatattatgctaattggacctgacaagcagaaaataataaacatcctacaagacttaataaaacacatgcatgacgggatgggaaggaaatcttgaataaaaattcatgattgaccacattcgtaaggtttttagggtctgattg

SEQ ID NO: 274191 - DNA, 946 bp, Homo sapiens
ggaaaacattaaccttggcttccacgtagtcaggatcatcagtatcacttgtcttcctcctctacatcttgccccattggaaggtcaccaagggcagtaacacgcatggagctgtcatctcctgtgataacagtgccttctggaacacctgaaggacctggctgaggctgttttatagtttttgttttgttttgtttttgagacggagccccgctttgtcgcacaggctggagtgcagtggcgcagtcttggcttgccgcaacctatgcctcccaggttcaggcaattctcctgcttcagcctcccgagtagctgggacaacaggtgtgagccaccgcacccaagcctattttttaatttatttaaatttaaaaatattttttagttttttaaaaagtaggaagctgggcacagtggctcacgcctgtaatcccaacactttgagaggccgaggcaggcgaatcacgaggtcaggagattgagaccattctggccaacatggtgaaaccccatctctactaaaagtacaaaaaattagctgggcatggtggtgtatgcctgtagtcccagctactcgggaggctgaggtagaaggatcgcttgagcccaggaggcggaggttgcagcgagctatcacaccactacactccagcctggcgacagagtgagacttcgtctaaaaaaaaaataagtaggaataaattaacgtacataaaaagcataacatactaaacacaaaccagtaacagtcatttatcattgtcaagtattatgtactgtatatatttttaagtcagatttgtaaaaatataaaactgccaatcttttctcattctcctggtaagtatttttcataaacatttatttggctgggtgcagtggctcacgcctgtaatcccaacactttgggaggccgagctgggtggatcacctgaggtcggaggtt

SEQ ID NO: 274192 - DNA, 770 bp, Homo sapiens
gaggctgaggtagaaggatcgcttgagcccaggaggcggaggttgcagcgagctatcacaccactacactccagcctggcgacagagtgagacttcgtctaaaaaaaaaataagtaggaataaattaacgtacataaaaagcataacatactaaacacaaaccagtaacagtcatttatcattgtcaagtattatgtactgtatatatttttaagtcagatttgtaaaaatataaaactgccaatcttttctcattctcctggtaagtatttttcataaacatttatttggctgggtgcagtggctcacgcctgtaatcccaacactttgggaggccgagctgggtggatcacctgaggtcggaggtttgagactagcctggccaaaatggtgaaaccctgtccctactaaaaatacaaacattggtgggctcggtggctcatgcctgtaatcccagcactttgggaggccaaggctggtgaatcacgaggtcaggagttcgagaccagcctggccaacatggtgaaaccccgtctctactaaaaatacaaaaattagctgggcgtggtggcttgggcctgtagtcccagctactcaggaggcagaggttgcagtgagtcaagatcaagccactgcactccagcctgggcgacagagtgagactgtctcaaaaaaacaaacaaaaatacaaaagttaactgggtgtgatggcacgtgcctgtagtctcagctgctcaggagtctgaggcagaggttgtagtgagctgaga

SEQ ID NO: 274193 - DNA, 218 bp, Homo sapiens
agttgtatattgtaaggctgacatgtctttgattaacttgagatattttgtattatattggcttggcagctttaaggcatactgcatatttgtaatgtcatatgctaaaataatgtgactattgtgacatttactgagacaaaattatgatttcttggtcatctgagcatatggaagaccatctaataaaatatcaagtcttgtacttaaaaggaaga

SEQ ID NO: 274194 - DNA, 205 bp, Homo sapiens
aggtgtggggttttgtctccagtgacattcccagctggctcttgcagcccctgccctagtgacagcatggggtgagggggccagaggaggctggaggtggagccctgcctctaggcggaactgtaccatctgtagttgcagggcaggattaaaaagggacagttttgctgtttgtttgtttgtttttttctgtcatctgactggg

SEQ ID NO: 274195 - DNA, 363 bp, Homo sapiens
  misc_feature (39)..(39): n is a, c, g, or t
cagtcagtcctggctgaaaaaaggtttgattacccatanagatcattcttaatttctttctatgtagaaggaacagccctccattgtaatgttactcctgggaaagcaatactattactgtttggctctttatctcactattatcatggttatcgtgtgagcttcggtttccttgtttaccctgccactagctgacatggttgatgcagatttactaaagtttaatcagcagtcaccccttccttcagtggtttttggcattaatgctttgtttaccaaatctgcccagtctttagcgcccatggtgatactctctaggctaaaccagtatgaatatggaaacacaaatagcaggtaaagtaa

SEQ ID NO: 274196 - DNA, 381 bp, Homo sapiens
aatcatatgttcactgcctgaaaagaaatctccaggtttgaattagcaaataagcatgaggcagagggttcagctgtggtattttcagtgatgttgaaaaaatagtaacaataataatgacaggtgataataagatactgatttcccactttccgttgggttcaataggtgtttcccagtcactgtcacttggttggattatactcttttcatagggtgctcgagtttctctctaaatctcctagaaactctttaaaatccttctgcattaacatatgcacccattttggaactagtagcactaagtttaaaacaaatttgaatagtacctctaagaatgtcatgacttacatttgggattgctaaatttgcttagacaaa

SEQ ID NO: 274197 - DNA, 877 bp, Homo sapiens
tctcctaacgttatttctagctgtacattcccaaaaggaatgggtggaagcaaatcagattctgaaaggtttcaatgatctttcaagtttaggatgagaccaagtctcaaggagctgggatcttctttctcttgtcagttgctgaagccagtagcttcgtcaaaaacatatgaattcatataaggaagccctttagatggtacattcactaagacgtgtctgggtgtgatcctgtttgggaaaaacagaatcctaggttctaaacaagaaaagaacgcccttcccaaagggtccgcacactttctgctttgcagcggatcaagtgtccttgtgagggtgagacttccttcaagggaagggaagccattgctctctctgtagatagagcccagctggtaacgggggagccacccaactgcaggggggtgtatgttcaggtgtgaaaaacagaaaactgggtctgaacatgaagagttgcacagcagtagttcgaagaagctggcatctctttggcaaacaccaacctcagcaaatgcaactcctacacttcattcccaaggaccaggtgttgctccttaaggaactctgtatccctctctcctctccagaaccccattcctcccactggctgagcttttcctttcctttccgggtcacccatagaccctctccgtctgtaccagtgcgtctgtgttgtgagcgtgacgaagcctttcctgtgaagagctttcatgaactcattctcatactccttccccatttccacccatggtgtgactgttttgctattcaagactatctgtaaaaatgtacaaataaaagtgaaaactgaaaataaaggggagggagattgagattaaacaaatgcaatgatgta

SEQ ID NO: 274198 - DNA, 1450 bp, Homo sapiens
ctaggaggaagacagctgcctcacctggcaggtgccgtgtgggcaagtgggcctcaggatgtcctgcggagggaaggacacaagatggctgtgcaggtagaggagagtgtggaggaaggaagggttttgtgttttaagagtctggtgtattcagggccaggcaaaagccagcttggggtgagggaggaagctggtgaaaagccctgggtgctgggtacaagagtgttgctggctcaggctctgtgatcacgcagtgtctgctcgccagtgccaggccctgagcaggtgctttgacacgcgcccctctcaccatctccccgtcccctaatccctgagacaggtgctccccacttttacaaacgaggaaacaactgtgggtgatgtgggaacgtggaatttcaacccaaggcttctgactccatgcctagaaccatccgtttcattgttcaccagccatgccgcaggatcccctagaattcccagggatcccctgagatctgctggattgtcacctctgaggccgaggtctggaaatttggatggatggaaagaaccccagggagctgtgaggcatggttgggaaccatgggaagtggggacttaccttccccgccggggcaggagcctccactgtgcgggcttccagggatgaccattaaggatggcgggagggggagggagagcccggatgggagagtggctgggaggggcagggcacgcagaggtggtctccaactccagcccacagtgggacacccaggatgcctggcttacctgagtcacccccacctcccaagctgctgagtcaggggtggggcttagaatctgcatttctaacaacctcctaggtgctgctgatgcggccgccgtgggaccccactttaagaaccactggggtagagtggccttgcacagaggagtgcttggtgaacatttggtggaggatacggaaacccacgtggattccaggtgctgacttttgtgccactacagagtctagcgtacattaggaagacgatgccaaccaccaccatctattgacttactcaacgtttactgcacacctactgtgtgcaggggtcctggggaccccatagatgaaaacataagcacatgatcaaatggaaagctgggcttcgtctattacagtgggtaccatacagttttacactcgtgtacctaaaacaacctggacaaggcacgggattgattttcaattttgtaaaacagagcaaaagtgcttttactgatgtttcttttctttttcctgagatcttatgtccctagacagaactataaagcgtttttatattaaaggtctgtgcctcagactttaaaaatatctgtagaatgtgtagtaaagttatccatttcatttgtgataatggtcattttataattttattttattttatttttttgtagactagcaaaaagaaattaaagttag

SEQ ID NO: 274199 - DNA, 506 bp, Homo sapiens
gagcccaggagttcaagaccagcctgggcaacatagtgagaccccatatcgaaagaaggaaaggaaaggaaaggaaaagaaaggaaaaaggaaaggaagagtttgctaatcattaatcaagatcttaccagtcttacaaaagcctccagattgggagagatcaccaaggaataaatgagaagcagacaaagaaaaaaaaaagaccaaggactgaatcccaaggcatctaatgttaagaggtggagagagagggaaaaatgagcaaagacaactcagatgtaggagaaaaacctactggaagcctgctggaaaaagtttgtgccttcagtctcttgcctcggcacctgggtaatcttccgcccacagtgaaccaccacgcccggccaagaatccagctttcaagtttctcttgaaacatcagaggatctgatcacactgggtcttccccttacccccatctttatttaggtctaactgacaaataaaaattatatacatttacggtg

SEQ ID NO: 274200 - DNA, 231 bp, Homo sapiens
gtcacagctactcaactgtgtagtgtgaagcagccagtaagtaaataaatgggtatggctgcgttccaataaaactttacttagaaacacaagccttgggcccaattagacccacaagctgaccttgataacaagtaaaaggctgaacaattaaaagcttgatttttaggccacatcaaaatgatcaagtcagacactctggaccctttccctcagagtccccagcttggt

SEQ ID NO: 274201 - DNA, 450 bp, Homo sapiens
gtagaaagaccagtagttatgagacaatataatagacatcacagtgtacaaagagctattctcgtgttgcgtaatgaagcatataggtactgaactagcaaataaaggatcctcagtcagtaccggtgcttcctcatcatatgtaagtaatatttaagatatttttatgtttaagatgccagaagctaaataaacttttctcccttatagttttgacacatgatgaactctagcactggtgtatatgagaaggaaggcgaaagcatgacaggaaacctgccgcctgctggggaagtctggagcccctgctgagacgatttggaagtctcgttaagatcagtgacatattctttaattttaaaaaattgtaattatttaaaacagttatttaatgtattgaatgagtttaagttatataataaatgaccattgagtatttaaaaaaaaaat

SEQ ID NO: 274202 - DNA, 4938 bp, Homo sapiens
cgcgccggagcgggacacgcatgcgccggtctggacccggcacccagtaacggactcgagctcctcccaccggaagtgggcagccgcgcagcgggaagagccggccgaagcgtggcggccacagactgtgggtaccgggtccgagggactcgcgcttttctctccgtgccatggcgccagcgaaagccacgaacgtggtgcggctgctactaggctccacagcgctgtggctttcgcagctcggctccgggacggtcgccgcgtccaagtcggtgactgcccacttggccgcgaagtggcccgagaccccgctgctgctggaggcaagtgaatttatggcagaagaaagtaatgaaaaattttggcagtttttggaaactgtgcaagaattagcaatttataagcaaacagaatcagattattcttattacaacttaatcctgaagaaagctggacagtttctagacaatttacacatcaaccttttaaagtttgctttctctataagggcatactccccagctattcagatgtttcagcagattgcagctgatgagccaccaccagatggttgtaatgcatttgtggttattcataagaagcacacctgtaaaattaatgagattaaaaagctgctgaagaaagctgcttcaaggactagaccttatctatttaaaggagatcacaaatttcctacaaacaaagagaacttaccagtggtgattctctatgccgaaatgggtactagaacatttagtgcatttcacaaagtattgtctgaaaaagctcaaaatgaggaaattctgtatgttcttcgccattatattcagaaaccaagctcacggaaaatgtacttatctgggtatggtgtggagctagcaattaagagtacagaatacaaagcactggatgatacccaagttaaaactgtgactaatactactgtagaggatgagactgaaacaaatgaagttcaaggatttctctttgggaaactaaaagaaatatattcagatcttagagataatctgacagcattccaaaaatacctgattgagagtaacaaacaaatgatgcctttgaaagtctgggaactacaagatcttagttttcaagcagcttctcaaataatgtccgctccagtttatgattccattaaattaatgaaagacatttcacagaacttccccataaaagccagatctctaaccagaattgctgtaaatcaacatatgagagaagaaataaaggaaaatcaaaaggatcttcaagttagatttaaaattcagccaggcgatgctcgtctatttataaatggccttcgtgttgatatggatgtttatgacgcttttagtattttggatatgctgaaattagaaggaaaaatgatgaatggccttcgcaatcttgggatcaatggggaagatatgagcaaatttttaaaattaaattcacacatttgggaatatacttatgtattagatattcgacattcttctataatgtggattaatgacttagaaaatgatgatttgtatattacatggcctacaagttgccagaaacttctgaagccagtatttcctggaagtgtaccttccataaggcgcaattttcataatttggttctgtttattgatccggcccaagaatataccttggattttataaaacttgctgatgttttctattctcacgaagttcctcttagaattggttttgtgttcattcttaatacagatgatgaagttgatggagcaaatgatgctggagttgctctctggcgagctttcaactatattgcagaagaatttgatatatcagaagcatttatttctatagtacacatgtaccaaaaagtgaagaaggatcaaaatatactcactgtggacaatgtgaagagtgttctccaaaatacatttcctcatgctaatatttgggatattttgggaattcattctaaatatgatgaagaaagaaaggctggagcaagcttttataagatgactggcctgggtcctttgcctcaagctctttataatggtgaaccctttaaacatgaagagatgaatattaaagaactaaaaatggctgttcttcaaagaatgatggatgcatctgtatatttacaaagagaagtttttttgggcacattaaatgatcgcacgaatgcaattgattttctaatggataggaataatgttgtaccccgtataaatactttgattttgcgtactaaccagcagtacctcaatttaatatctacatcagtaactgctgatgttgaagatttctctactttctttttcttggattcacaagataagagtgctgtaattgcaaagaacatgtattatttaacccaagacgatgagagtataatttctgcagtcactctctggattattgcagattttgataagccttctgggagaaaacttctttttaatgcattaaagcacatgaaaacaagtgttcatagtcggttggggattatttataatcctacatcaaaaataaatgaagagaacacagctatttctagaggaattttggcagcttttcttacacagaagaacatgtttttgagaagctttcttgggcaactggcaaaggaagaaattgctacagctatttactctggagataaaattaaaacattccttattgaggggatggataagaatgcttttgagaaaaaatataatactgttggagtgaatatttttcgaactcaccagttgttctgtcaagatgtacttaaattacgtcctggagaaatgggtattgtcagcaatgggagattcttaggacctttagatgaagatttttatgcagaagatttttacttgttggaaaagataacatttagtaatttaggagagaaaattaaaggcattgttgaaaatatgggaatcaacgcaaataacatgagtgactttattatgaaagttgatgcccttatgtcctctgtgcctaagcgtgcatctcgatatgatgtcacatttcttagggagaatcacagtgttataaagacgaatcctcaagagaatgatatgttcttcaatgtcattgctattgttgatccattaacaagagaagcacagaaaatggcacagttgttggttgtacttggcaagattatcaacatgaagataaagttgttcatgaactgtaggggcaggctttcagaagcccctttagaaagcttttaccgttttgttctggaaccagaactgatgtcaggggctaatgacgtttcttctcttggaccagtggcaaaatttttggatattcctgaatcacccctcctaatcctcaacatgattactccagaaggctggttggttgaaacagtgcacagcaactgtgaccttgataatattcacttaaaggatactgagaaaactgttacagcagaatatgaactagaatacttactactggaaggacaatgctttgataaagtgacagaacagcctcctcggggtctgcagttcacactaggcacaaaaaataaacctgctgtggttgatacaatagtgatggcacatcatgggtattttcaattaaaagcaaacccaggtgcttggatactgaggttacaccaaggaaaatctgaagatatttatcaaatagttgggcatgaaggaactgactctcaagcagacctagaagatatcattgttgtattaaacagcttcaaaagcaagatactcaaagtaaaagtgaaaaaagaaacagacaaaattaaggaagatatccttaccgatgaagatgaaaaaacaaaaggactgtgggattccattaaaagtttcacagtaagcttgcataaagaaaacaaaaaggaaaaagatgtcctaaacattttttcagttgcttctggtcatttatatgaacgttttttaagaattatgatgctttctgttttgcgtaacaccaaaacaccagtgaaattctggttgctaaaaaattatctctcaccgacatttaaagaagtaattcctcacatggctaaagagtatggattccgatatgaactagttcaatataggtggccccgttggcttcgtcaacagactgaaagacagaggattatttggggttacaaaattcttttccttgatgttcttttcccactagcagtggacaaaatcatttttgttgatgctgaccagattgtgagacatgatctaaaagaacttcgagatttcgatctggatggagctccttatgggtatactccattttgtgatagccgcagggaaatggatggatatcgtttctggaaaacaggatactgggcatcacatcttttaagacggaaataccatatcagtgctttatatgtagtggatctcaagaagttcaggagaattggagcaggtgacaggctcaggagccagtatcaagctctcagtcaagatccaaacagtctttcaaacctagatcaggatctccccaataatatgatttaccaagtcgccattaagtctcttcctcaagactggctgtggtgtgaaacctggtgtgatgatgaatccaaacaaagagccaaaacaattgatctgtgcaataatcccaaaacaaaagaatccaaactaaaagctgctgccagaattgtcccagaatgggtggagtatgatgctgagataagacaactattagatcatcttgaaaacaagaagcaagatacaattttgacacatgatgaactctagcactggtgtatatgagaaggaaggcgaaagcatgacaggaaacctgccgcctgctggggaagtctggagcccctgctgagacgatttggaagtctcgttaagatcagtgacatattctttaattttaaaaaattgtaattatttaaaacagttatttaatgtattgaatgagtttaagttatataataaatgaccattgagtatttaaaaaaaaaat

SEQ ID NO: 274203 - DNA, 5271 bp, Homo sapiens
cgcgccggagcgggacacgcatgcgccggtctggacccggcacccagtaacggactcgagctcctcccaccggaagtgggcagccgcgcagcgggaagagccggccgaagcgtggcggccacagactgtgggtaccgggtccgagggactcgcgcttttctctccgtgccatggcgccagcgaaagccacgaacgtggtgcggctgctactaggctccacagcgctgtggctttcgcagctcggctccgggacggtcgccgcgtccaagtcggtgactgcccacttggccgcgaagtggcccgagaccccgctgctgctggaggcaagtgaatttatggcagaagaaagtaatgaaaaattttggcagtttttggaaactgtgcaagaattagcaatttataagcaaacagaatcagattattcttattacaacttaatcctgaagaaagctggacagtttctagacaatttacacatcaaccttttaaagtttgctttctctataagggcatactccccagctattcagatgtttcagcagattgcagctgatgagccaccaccagatggttgtaatgcatttgtggttattcataagaagcacacctgtaaaattaatgagattaaaaagctgctgaagaaagctgcttcaaggactagaccttatctatttaaaggagatcacaaatttcctacaaacaaagagaacttaccagtggtgattctctatgccgaaatgggtactagaacatttagtgcatttcacaaagtattgtctgaaaaagctcaaaatgaggaaattctgtatgttcttcgccattatattcagaaaccaagctcacggaaaatgtacttatctgggtatggtgtggagctagcaattaagagtacagaatacaaagcactggatgatacccaagttaaaactgtgactaatactactgtagaggatgagactgaaacaaatgaagttcaaggatttctctttgggaaactaaaagaaatatattcagatcttagagataatctgacagcattccaaaaatacctgattgagagtaacaaacaaatgatgcctttgaaagtctgggaactacaagatcttagttttcaagcagcttctcaaataatgtccgctccagtttatgattccattaaattaatgaaagacatttcacagaacttccccataaaagccagatctctaaccagaattgctgtaaatcaacatatgagagaagaaataaaggaaaatcaaaaggatcttcaagttagatttaaaattcagccaggcgatgctcgtctatttataaatggccttcgtgttgatatggatgtttatgacgcttttagtattttggatatgctgaaattagaaggaaaaatgatgaatggccttcgcaatcttgggatcaatggggaagatatgagcaaatttttaaaattaaattcacacatttgggaatatacttatgtattagatattcgacattcttctataatgtggattaatgacttagaaaatgatgatttgtatattacatggcctacaagttgccagaaacttctgaagccagtatttcctggaagtgtaccttccataaggcgcaattttcataatttggttctgtttattgatccggcccaagaatataccttggattttataaaacttgctgatgttttctattctcacgaagttcctcttagaattggttttgtgttcattcttaatacagatgatgaagttgatggagcaaatgatgctggagttgctctctggcgagctttcaactatattgcagaagaatttgatatatcagaagcatttatttctatagtacacatgtaccaaaaagtgaagaaggatcaaaatatactcactgtggacaatgtgaagagtgttctccaaaatacatttcctcatgctaatatttgggatattttgggaattcattctaaatatgatgaagaaagaaaggctggagcaagcttttataagatgactggcctgggtcctttgcctcaagctctttataatggtgaaccctttaaacatgaagagatgaatattaaagaactaaaaatggctgttcttcaaagaatgatggatgcatctgtatatttacaaagagaagtttttttgggcacattaaatgatcgcacgaatgcaattgattttctaatggataggaataatgttgtaccccgtataaatactttgattttgcgtactaaccagcagtacctcaatttaatatctacatcagtaactgctgatgttgaagatttctctactttctttttcttggattcacaagataagagtgctgtaattgcaaagaacatgtattatttaacccaagacgatgagagtataatttctgcagtcactctctggattattgcagattttgataagccttctgggagaaaacttctttttaatgcattaaagcacatgaaaacaagtgttcatagtcggttggggattatttataatcctacatcaaaaataaatgaagagaacacagctatttctagaggaattttggcagcttttcttacacagaagaacatgtttttgagaagctttcttgggcaactggcaaaggaagaaattgctacagctatttactctggagataaaattaaaacattccttattgaggggatggataagaatgcttttgagaaaaaatataatactgttggagtgaatatttttcgaactcaccagttgttctgtcaagatgtacttaaattacgtcctggagaaatgggtattgtcagcaatgggagattcttaggacctttagatgaagatttttatgcagaagatttttacttgttggaaaagataacatttagtaatttaggagagaaaattaaaggcattgttgaaaatatgggaatcaacgcaaataacatgagtgactttattatgaaagttgatgcccttatgtcctctgtgcctaagcgtgcatctcgatatgatgtcacatttcttagggagaatcacagtgttataaagacgaatcctcaagagaatgatatgttcttcaatgtcattgctattgttgatccattaacaagagaagcacagaaaatggcacagttgttggttgtacttggcaagattatcaacatgaagataaagttgttcatgaactgtaggggcaggctttcagaagcccctttagaaagcttttaccgttttgttctggaaccagaactgatgtcaggggctaatgacgtttcttctcttggaccagtggcaaaatttttggatattcctgaatcacccctcctaatcctcaacatgattactccagaaggctggttggttgaaacagtgcacagcaactgtgaccttgataatattcacttaaaggatactgagaaaactgttacagcagaatatgaactagaatacttactactggaaggacaatgctttgataaagtgacagaacagcctcctcggggtctgcagttcacactaggcacaaaaaataaacctgctgtggttgatacaatagtgatggcacatcatgtaagtattatttaattgatggtgtttaatttgatgttttggtgaattctctgttttcctaagagtaaaatgaaataatctttattctgctgttgctgaacagtttgcagaaaacaaaattgaatctttgaataagataaataaaaaatggggaaaatcatactttaataatttttgacaggttattgtaaaatctctttacttggaattgatttatagaatttattcattctacagttaataaatactttcttagatcactcgtgtattcatgagcaattcgatggtttttagtcatattactcaatgattatttttttctcatcttaaaaggggtattttcaattaaaagcaaacccaggtgcttggatactgaggttacaccaaggaaaatctgaagatatttatcaaatagttgggcatgaaggaactgactctcaagcagacctagaagatatcattgttgtattaaacagcttcaaaagcaagatactcaaagtaaaagtgaaaaaagaaacagacaaaattaaggaagatatccttaccgatgaagatgaaaaaacaaaaggactgtgggattccattaaaagtttcacagtaagcttgcataaagaaaacaaaaaggaaaaagatgtcctaaacattttttcagttgcttctggtcatttatatgaacgttttttaagaattatgatgctttctgttttgcgtaacaccaaaacaccagtgaaattctggttgctaaaaaattatctctcaccgacatttaaagaagtaattcctcacatggctaaagagtatggattccgatatgaactagttcaatataggtggccccgttggcttcgtcaacagactgaaagacagaggattatttggggttacaaaattcttttccttgatgttcttttcccactagcagtggacaaaatcatttttgttgatgctgaccagattgtgagacatgatctaaaagaacttcgagatttcgatctggatggagctccttatgggtatactccattttgtgatagccgcagggaaatggatggatatcgtttctggaaaacaggatactgggcatcacatcttttaagacggaaataccatatcagtgctttatatgtagtggatctcaagaagttcaggagaattggagcaggtgacaggctcaggagccagtatcaagctctcagtcaagatccaaacagtctttcaaacctagatcaggatctccccaataatatgatttaccaagtcgccattaagtctcttcctcaagactggctgtggtgtgaaacctggtgtgatgatgaatccaaacaaagagccaaaacaattgatctgtgcaataatcccaaaacaaaagaatccaaactaaaagctgctgccagaattgtcccagaatgggtggagtatgatgctgagataagacaactattagatcatcttgaaaacaagaagcaagatacaattttgacacatgatgaactctagcactggtgtatatgagaaggaaggcgaaagcatgacaggaaacctgccgcctgctggggaagtctggagcccctgctgagacgatttggaagtctcgttaagatcagtgacatattctttaattttaaaaaattgtaattatttaaaacagttatttaatgtattgaatgagtttaagttatataataaatgaccattgagtatttaaaaaaaaaat

SEQ ID NO: 274204 - DNA, 1601 bp, Homo sapiens
cgcgccggagcgggacacgcatgcgccggtctggacccggcacccagtaacggactcgagctcctcccaccggaagtgggcagccgcgcagcgggaagagccggccgaagcgtggcggccacagactgtgggtaccgggtccgagggactcgcgcttttctctccgtgccatggcgccagcgaaagccacgaacgtggtgcggctgctactaggctccacagcgctgtggctttcgcagctcggctccgggacggtcgccgcgtccaagtcggtgactgcccacttggccgcgaagtggcccgagaccccgctgctgctggaggcaagtgaatttatggcagaagaaagtaatgaaaaattttggcagtttttggaaactgtgcaagaattagcaatttataagcaaacagaatcagattattcttattacaacttaatcctgaagaaagctggacagtttctagacaatttacacatcaaccttttaaagtttgctttctctataagggcatactccccagctattcagatgtttcagcagattgcagctgatgagccaccaccagatggttgtaatgcatttgtggttattcataagaagcacacctgtaaaattaatgagattaaaaagctgctgaagaaagctgcttcaaggactagaccttatctatttaaaggagatcacaaatttcctacaaacaaagagaacttaccagtggtgattctctatgccgaaatgggtactagaacatttagtgcatttcacaaagtattgtctgaaaaagctcaaaatgaggaaattctgtatgttcttcgccattatattcagaaaccaagctcacggaaaatgtacttatctgggtatggtgtggagctagcaattaagagtacagaatacaaagcactggatgatacccaagttaaaaggaaatggatggatatcgtttctggaaaacaggatactgggcatcacatcttttaagacggaaataccatatcagtgctttatatgtagtggatctcaagaagttcaggagaattggagcaggtgacaggctcaggagccagtatcaagctctcagtcaagatccaaacagtctttcaaacctagatcaggatctccccaataatatgatttaccaagtcgccattaagtctcttcctcaagactggctgtggtgtgaaacctggtgtgatgatgaatccaaacaaagagccaaaacaattgatctgtgcaataatcccaaaacaaaagaatccaaactaaaagctgctgccagaattgtcccagaatgggtggagtatgatgctgagataagacaactattagatcatcttgaaaacaagaagcaagatacaattttgacacatgatgaactctagcactggtgtatatgagaaggaaggcgaaagcatgacaggaaacctgccgcctgctggggaagtctggagcccctgctgagacgatttggaagtctcgttaagatcagtgacatattctttaattttaaaaaattgtaattatttaaaacagttatttaatgtattgaatgagtttaagttatataataaatgaccattgagtatttaaaaaaaaaat

SEQ ID NO: 274205 - DNA, 5596 bp, Homo sapiens
  misc_feature (5593)..(5593): n is a, c, g, or t
  misc_feature (5595)..(5595): n is a, c, g, or t
cgcgccggagcgggacacgcatgcgccggtctggacccggcacccagtaacggactcgagctcctcccaccggaagtgggcagccgcgcagcgggaagagccggccgaagcgtggcggccacagactgtgggtaccgggtccgagggactcgcgcttttctctccgtgccatggcgccagcgaaagccacgaacgtggtgcggctgctactaggctccacagcgctgtggctttcgcagctcggctccgggacggtcgccgcgtccaagtcggtgactgcccacttggccgcgaagtggcccgagaccccgctgctgctggaggcaagtgaatttatggcagaagaaagtaatgaaaaattttggcagtttttggaaactgtgcaagaattagcaatttataagcaaacagaatcagattattcttattacaacttaatcctgaagaaagctggacagtttctagacaatttacacatcaaccttttaaagtttgctttctctataagggcatactccccagctattcagatgtttcagcagattgcagctgatgagccaccaccagatggttgtaatgcatttgtggttattcataagaagcacacctgtaaaattaatgagattaaaaagctgctgaagaaagctgcttcaaggactagaccttatctatttaaaggagatcacaaatttcctacaaacaaagagaacttaccagtggtgattctctatgccgaaatgggtactagaacatttagtgcatttcacaaagtattgtctgaaaaagctcaaaatgaggaaattctgtatgttcttcgccattatattcagaaaccaagctcacggaaaatgtacttatctgggtatggtgtggagctagcaattaagagtacagaatacaaagcactggatgatacccaagttaaaactgtgactaatactactgtagaggatgagactgaaacaaatgaagttcaaggatttctctttgggaaactaaaagaaatatattcagatcttagagataatctgacagcattccaaaaatacctgattgagagtaacaaacaaatgatgcctttgaaagtctgggaactacaagatcttagttttcaagcagcttctcaaataatgtccgctccagtttatgattccattaaattaatgaaagacatttcacagaacttccccataaaagccagatctctaaccagaattgctgtaaatcaacatatgagagaagaaataaaggaaaatcaaaaggatcttcaagttagatttaaaattcagccaggcgatgctcgtctatttataaatggccttcgtgttgatatggatgtttatgacgcttttagtattttggatatgctgaaattagaaggaaaaatgatgaatggccttcgcaatcttgggatcaatggggaagatatgagcaaatttttaaaattaaattcacacatttgggaatatacttatgtattagatattcgacattcttctataatgtggattaatgacttagaaaatgatgatttgtatattacatggcctacaagttgccagaaacttctgaagccagtatttcctggaagtgtaccttccataaggcgcaattttcataatttggttctgtttattgatccggcccaagaatataccttggattttataaaacttgctgatgttttctattctcacgaagttcctcttagaattggttttgtgttcattcttaatacagatgatgaagttgatggagcaaatgatgctggagttgctctctggcgagctttcaactatattgcagaagaatttgatatatcagaagcatttatttctatagtacacatgtaccaaaaagtgaagaaggatcaaaatatactcactgtggacaatgtgaagagtgttctccaaaatacatttcctcatgctaatatttgggatattttgggaattcattctaaatatgatgaagaaagaaaggctggagcaagcttttataagatgactggcctgggtcctttgcctcaagctctttataatggtgaaccctttaaacatgaagagatgaatattaaagaactaaaaatggctgttcttcaaagaatgatggatgcatctgtatatttacaaagagaagtttttttgggcacattaaatgatcgcacgaatgcaattgattttctaatggataggaataatgttgtaccccgtataaatactttgattttgcgtactaaccagcagtacctcaatttaatatctacatcagtaactgctgatgttgaagatttctctactttctttttcttggattcacaagataagagtgctgtaattgcaaagaacatgtattatttaacccaagacgatgagagtataatttctgcagtcactctctggattattgcagattttgataagccttctgggagaaaacttctttttaatgcattaaagcacatgaaaacaagtgttcatagtcggttggggattatttataatcctacatcaaaaataaatgaagagaacacagctatttctagaggaattttggcagcttttcttacacagaagaacatgtttttgagaagctttcttgggcaactggcaaaggaagaaattgctacagctatttactctggagataaaattaaaacattccttattgaggggatggataagaatgcttttgagaaaaaatataatactgttggagtgaatatttttcgaactcaccagttgttctgtcaagatgtacttaaattacgtcctggagaaatgggtattgtcagcaatgggagattcttaggacctttagatgaagatttttatgcagaagatttttacttgttggaaaagataacatttagtaatttaggagagaaaattaaaggcattgttgaaaatatgggaatcaacgcaaataacatgagtgactttattatgaaagttgatgcccttatgtcctctgtgcctaagcgtgcatctcgatatgatgtcacatttcttagggagaatcacagtgttataaagacgaatcctcaagagaatgatatgttcttcaatgtcattgctattgttgatccattaacaagagaagcacagaaaatggcacagttgttggttgtacttggcaagattatcaacatgaagataaagttgttcatgaactgtaggggcaggctttcagaagcccctttagaaagcttttaccgttttgttctggaaccagaactgatgtcaggggctaatgacgtttcttctcttggaccagtggcaaaatttttggatattcctgaatcacccctcctaatcctcaacatgattactccagaaggctggttggttgaaacagtgcacagcaactgtgaccttgataatattcacttaaaggatactgagaaaactgttacagcagaatatgaactagaatacttactactggaaggacaatgctttgataaagtgacagaacagcctcctcggggtctgcagttcacactaggcacaaaaaataaacctgctgtggttgatacaatagtgatggcacatcatgggtattttcaattaaaagcaaacccaggtgcttggatactgaggttacaccaaggaaaatctgaagatatttatcaaatagttgggcatgaaggaactgactctcaagcagacctagaagatatcattgttgtattaaacagcttcaaaagcaagatactcaaagtaaaagtgaaaaaagaaacagacaaaattaaggaagatatccttaccgatgaagatgaaaaaacaaaaggactgtgggattccattaaaagtttcacagtaagcttgcataaagaaaacaaaaaggaaaaagatgtcctaaacattttttcagttgcttctggtcatttatatgaacgttttttaagaattatgatgctttctgttttgcgtaacaccaaaacaccagtgaaattctggttgctaaaaaattatctctcaccgacatttaaagaagtaattcctcacatggctaaagagtatggattccgatatgaactagttcaatataggtggccccgttggcttcgtcaacagactgaaagacagaggattatttggggttacaaaattcttttccttgatgttcttttcccactagcagtggacaaaatcatttttgttgatgctgaccagattgtgagacatgatctaaaagaacttcgagatttcgatctggatggagctccttatgggtatactccattttgtgatagccgcagggaaatggatggatatcgtttctggaaaacaggatactgggcatcacatcttttaagacggaaataccatatcagtgctttatatgtagtggatctcaagaagttcaggagaattggagcaggtgacaggctcaggagccagtatcaagctctcagtcaagatccaaacagtctttcaaacctagatcaggatctccccaataatatgatttaccaagtcgccattaagtctcttcctcaagactggctgtggtgtgaaacctggtgtgatgatgaatccaaacaaagagccaaaacaattgatctgtgcaataatcccaaaacaaaagaatccaaactaaaagctgctgccagaattgtcccagaatgggtggagtatgatgctgagataagacaactattagatcatcttgaaaacaagaagcaagatacaagctctacaagaagcatggcagcatctgcttctggggaagcctcaaggagcttttattcatggtggaaggcaaagcaggagcaggtgtcttacattggaggaacaggaccacgagagagaaggggaaggtgccacacacttttaaacaaccagatctcacactaactcactcactatcacaagaagagcaccgagggaatgctgctaacccattcatgaggactctgcccccgtggtccagttacctcctaccagggaattataccctcccacctccaacactggggatgagatttggtgaggacacagatccaaaccatatcgttgtgcttattggccatctgtatattataagtttttttgcaaagtgcctattcaagatttttgctcttttttaagttttggattttgaatttctttggaaaacaaaaaagcccactgagattttgattgcaactcttgttttaaatcagtttggtgaagattaatgtgttgattatgttgagcttccaattcataaatacgatatgtttcttgatttattttggtctttaattactcctagcagagttttagtttgcagtgtacatattttactaagaattttataactgaatgctaatataaatggtatttttaaatttcttgttggttgctaatacatagaaatacaattaatttttgtatattggacttatgtcctgtggctttgctatactcacttattagttctagtagagttcttaggaattttttcataatgggtcctgttatagttgtagagttcacaggattgtcttcacagtggatcatatcttcagcaaataaaaatagttttactttttcctttccaaatagaaaagtggcctcgttggcctcagcggtggagctctcgncng

SEQ ID NO: 274206 - DNA, 5575 bp, Homo sapiens
  misc_feature (5572)..(5572): n is a, c, g, or t
  misc_feature (5574)..(5574): n is a, c, g, or t
cgcgccggagcgggacacgcatgcgccggtctggacccggcacccagtaacggactcgagctcctcccaccggaagtgggcagccgcgcagcgggaagagccggccgaagcgtggcggccacagactgtgggtaccgggtccgagggactcgcgcttttctctccgtgccatggcgccagcgaaagccacgaacgtggtgcggctgctactaggctccacagcgctgtggctttcgcagctcggctccgggacggtcgccgcgtccaagtcggtgactgcccacttggccgcgaagtggcccgagaccccgctgctgctggaggcaagtgaatttatggcagaagaaagtaatgaaaaattttggcagtttttggaaactgtgcaagaattagcaatttataagcaaacagaatcagattattcttattacaacttaatcctgaagaaagctggacagtttctagacaatttacacatcaaccttttaaagtttgctttctctataagggcatactccccagctattcagatgtttcagcagattgcagctgatgagccaccaccagatggttgtaatgcatttgtggttattcataagaagcacacctgtaaaattaatgagattaaaaagctgctgaagaaagctgcttcaaggactagaccttatctatttaaaggagatcacaaatttcctacaaacaaagagaacttaccagtggtgattctctatgccgaaatgggtactagaacatttagtgcatttcacaaagtattgtctgaaaaagctcaaaatgaggaaattctgtatgttcttcgccattatattcagaaaccaagctcacggaaaatgtacttatctgggtatggtgtggagctagcaattaagagtacagaatacaaagcactggatgatacccaagttaaaactgtgactaatactactgtagaggatgagactgaaacaaatgaagttcaaggatttctctttgggaaactaaaagaaatatattcagatcttagagataatctgacagcattccaaaaatacctgattgagagtaacaaacaaatgatgcctttgaaagtctgggaactacaagatcttagttttcaagcagcttctcaaataatgtccgctccagtttatgattccattaaattaatgaaagacatttcacagaacttccccataaaagccagatctctaaccagaattgctgtaaatcaacatatgagagaagaaataaaggaaaatcaaaaggatcttcaagttagatttaaaattcagccaggcgatgctcgtctatttataaatggccttcgtgttgatatggatgtttatgacgcttttagtattttggatatgctgaaattagaaggaaaaatgatgaatggccttcgcaatcttgggatcaatggggaagatatgagcaaatttttaaaattaaattcacacatttgggaatatacttatgtattagatattcgacattcttctataatgtggattaatgacttagaaaatgatgatttgtatattacatggcctacaagttgccagaaacttctgaagccagtatttcctggaagtgtaccttccataaggcgcaattttcataatttggttctgtttattgatccggcccaagaatataccttggattttataaaacttgctgatgttttctattctcacgaagttcctcttagaattggttttgtgttcattcttaatacagatgatgaagttgatggagcaaatgatgctggagttgctctctggcgagctttcaactatattgcagaagaatttgatatatcagaagcatttatttctatagtacacatgtaccaaaaagtgaagaaggatcaaaatatactcactgtggacaatgtgaagagtgttctccaaaatacatttcctcatgctaatatttgggatattttgggaattcattctaaatatgatgaagaaagaaaggctggagcaagcttttataagatgactggcctgggtcctttgcctcaagctctttataatggtgaaccctttaaacatgaagagatgaatattaaagaactaaaaatggctgttcttcaaagaatgatggatgcatctgtatatttacaaagagaagtttttttgggcacattaaatgatcgcacgaatgcaattgattttctaatggataggaataatgttgtaccccgtataaatactttgattttgcgtactaaccagcagtacctcaatttaatatctacatcagtaactgctgatgttgaagatttctctactttctttttcttggattcacaagataagagtgctgtaattgcaaagaacatgtattatttaacccaagacgatgagagtataatttctgcagtcactctctggattattgcagattttgataagccttctgggagaaaacttctttttaatgcattaaagcacatgaaaacaagtgttcatagtcggttggggattatttataatcctacatcaaaaataaatgaagagaacacagctatttctagaggaattttggcagcttttcttacacagaagaacatgtttttgagaagctttcttgggcaactggcaaaggaagaaattgctacagctatttactctggagataaaattaaaacattccttattgaggggatggataagaatgcttttgagaaaaaatataatactgttggagtgaatatttttcgaactcaccagttgttctgtcaagatgtacttaaattacgtcctggagaaatgggtattgtcagcaatgggagattcttaggacctttagatgaagatttttatgcagaagatttttacttgttggaaaagataacatttagtaatttaggagagaaaattaaaggcattgttgaaaatatgggaatcaacgcaaataacatgagtgactttattatgaaagttgatgcccttatgtcctctgtgcctaagcgtgcatctcgatatgatgtcacatttcttagggagaatcacagtgttataaagacgaatcctcaagagaatgatatgttcttcaatgtcattgctattgttgatccattaacaagagaagcacagaaaatggcacagttgttggttgtacttggcaagattatcaacatgaagataaagttgttcatgaactgtaggggcaggctttcagaagcccctttagaaagcttttaccgttttgttctggaaccagaactgatgtcaggggctaatgacgtttcttctcttggaccagtggcaaaatttttggatattcctgaatcacccctcctaatcctcaacatgattactccagaaggctggttggttgaaacagtgcacagcaactgtgaccttgataatattcacttaaaggatactgagaaaactgttacagcagaatatgaactagaatacttactactggaaggacaatgctttgataaagtgacagaacagcctcctcggggtctgcagttcacactaggcacaaaaaataaacctgctgtggttgatacaatagtgatggcacatcatgggtattttcaattaaaagcaaacccaggtgcttggatactgaggttacaccaaggaaaatctgaagatatttatcaaatagttgggcatgaaggaactgactctcaagcagacctagaagatatcattgttgtattaaacagcttcaaaagcaagatactcaaagtaaaagtgaaaaaagaaacagacaaaattaaggaagatatccttaccgatgaagatgaaaaaacaaaaggactgtgggattccattaaaagtttcacagtaagcttgcataaagaaaacaaaaaggaaaaagatgtcctaaacattttttcagttgcttctggtcatttatatgaacgttttttaagaattatgatgctttctgttttgcgtaacaccaaaacaccagtgaaattctggttgctaaaaaattatctctcaccgacatttaaagaagtaattcctcacatggctaaagagtatggattccgatatgaactagttcaatataggtggccccgttggcttcgtcaacagactgaaagacagaggattatttggggttacaaaattcttttccttgatgttcttttcccactagcagtggacaaaatcatttttgttgatgctgaccagattgtgagacatgatctaaaagaacttcgagatttcgatctggatggagctccttatgggtatactccattttgtgatagccgcagggaaatggatggatatcgtttctggaaaacaggatactgggcatcacatcttttaagacggaaataccatatcagtgctttatatgtagtggatctcaagaagttcaggagaattggagcaggtgacaggctcaggagccagtatcaagctctcagtcaagatccaaacagtctttcaaacctagatcaggatctccccaataatatgatttaccaagtcgccattaagtctcttcctcaagactggctgtggtgtgaaacctggtgtgatgatgaatccaaacaaagagccaaaacaattgatctgtgcaataatcccaaaacaaaagaatccaaactaaaagctgctgccagaattgtcccagaatgggtggagtatgatgctgagataagacaactattagatcatcttgaaaacaagaagcaagatacaagctctacaagaagcatggcagcatctgcttctggggaagcctcaaggagcttttattcatggtggaaggcaaagcaggagcaggtgtcttacattggaggaacaggaccacgagagagaaggggaaggtgccacacacttttaaacaaccagatctcacactaactcactcactatcacaagaagagcaccgagggaatgctgctaacccattcatgaggactctgcccccgtggtccagttacctcctaccagggaattataccctcccacctccaacactggggatgagatttggtgaggacacagatccaaaccatatcgttgtgcttattggccatctgtatattataagtttttttgcaaagtgcctattcaagatttttgctcttttttaagttttggattttgaatttctttggaaaacaaaaaagcccactgagattttgattgcaactcttgttttaaatcagtttggtgaagattaatgtgttgattatgttgagcttccaattcataaatacgatatgtttcttgatttattttggtctttaattactcctagcagagttttagtttgcagtgtacatattttactaagaattttataactgaatgctaatataaatggtatttttaaatttcttgttggttgctaatacatagaaatacaattaatttttgtatattggacttatgtcctgtggctttgctatactcacttattagttctagtagagttcttaggaattttttcataatgggtcctgttatagttgtagagttcacaggattgtcttcacagtggatcatatcttcagcaaataaaaataatagaaaagtggcctcgttggcctcagcggtggagctctcgncng

SEQ ID NO: 274207 - DNA, 977 bp, Homo sapiens
caaacatccattaacccagatgccagcaatctttacttagagagctctgagcatgcagaaatgggaaaatattcatggatcattgtttccaatggggagatgaaaattcacctcagaatccagagagcattgtggtgaccaatatgaacagtaattgcaggcataatgtgagcaatagaggcagatagaggtagtgaggctgtccattgtggggactattgaatggtaggtttctatgcctccttcttcatccttgttcccaggggtagagtctaggagagatgtaggtatattccagtgcatggattcattcatgacacaagatgattggatcaccttaggtattttaagctttaaagtgtagagaaatctcagatttgcatatgttttatgatctgtttacagtctaactgatgtcttacttcattcagcttctttccttctgactctaaatttcatacgtctatgattaaatcacaattttctgtaggatgatctccccaataatatgatttaccaagtcgccattaagtctcttcctcaagactggctgtggtgtgaaacctggtgtgatgatgaatccaaacaaagagccaaaacaattgatctgtgcaataatcccaaaacaaaagaatccaaactaaaagctgctgccagaattgtcccagaatgggtggagtatgatgctgagataagacaactattagatcatcttgaaaacaagaagcaagatacaattttgacacatgatgaactctagcactggtgtatatgagaaggaaggcgaaagcatgacaggaaacctgccgcctgctggggaagtctggagcccctgctgagacgatttggaagtctcgttaagatcagtgacatattctttaattttaaaaaattgtaattatttaaaacagttatttaatgtattgaatgagtttaagttatataataaatgaccattgagtatttaaaaaaaaaat

SEQ ID NO: 274208 - DNA, 2166 bp, Homo sapiens
cgcgccggagcgggacacgcatgcgccggtctggacccggcacccagtaacggactcgagctcctcccaccggaagtgggcagccgcgcagcgggaagagccggccgaagcgtggcggccacagactgtgggtaccgggtccgagggactcgcgcttttctctccgtgccatggcgccagcgaaagccacgaacgtggtgcggctgctactaggctccacagcgctgtggctttcgcagctcggctccgggacggtcgccgcgtccaagtcggtgactgcccacttggccgcgaagtggcccgagaccccgctgctgctggaggcaagtgaatttatggcagaagaaagtaatgaaaaattttggcagtttttggaaactgtgcaagaattagcaatttataagcaaacagaatcagattattcttattacaacttaatcctgaagaaagctggacagtttctagacaatttacacatcaaccttttaaagtttgctttctctataagggcatactccccagctattcagatgtttcagcagattgcagctgatgagccaccaccagatggttgtaatgcatttgtggttattcataagaagcacacctgtaaaattaatgagattaaaaagctgctgaagaaagctgcttcaaggactagaccttatctatttaaaggagatcacaaatttcctacaaacaaagagaacttaccagtggtgattctctatgccgaaatgggtactagaacatttagtgcatttcacaaagtattgtctgaaaaagctcaaaatgaggaaattctgtatgttcttcgccattatattcagaaaccaagctcacggaaaatgtacttatctgggtatggtgtggagctagcaattaagagtacagaatacaaagcactggatgatacccaagttaaaactgtgactaatactactgtagaggatgagactgaaacaaatgaagttcaaggatttctctttgggaaactaaaagaaatatattcagatcttagagataatctgacagcattccaaaaatacctgattgagagtaacaaacaaatgatgcctttgaaagtctgggaactacaagatcctgttaagactattgcatgtttcattgataaatgtttaatggaaacatcaaatggaggacatgcagttttacaaaatcttagttttcaagcagcttctcaaataatgtccgctccagtttatgattccattaaattaatgaaagacatttcacagaacttccccataaaagccagattaagaatgaatatattgatatgcctctttcagtcaactttaaatgtcaagaatttgagaagtcgtcatttatataataaaacatgaaatatatatgggtgtgtataaatgtcatatctgtttagccataatattttaattaatggccgttataaaaattattagatcaaatacaaataaagtaaaataactttagtcttgatcagacagttgattagctctattgatgctaagtcagtataactgttcagaggttctgatgcaaaactctgctgttaatctgtaattaagaaaaaattataaaatatgctaacattgcttaatggctaaattgtaggcttgagcatatctctaaaaccacttggtagacaatctgtaaatgtttgttgaaatgaaatatttgctaaataaatgaaaaatttgccttattaaaaaaaaaaaaaaaaaaaaaaaaaaaaaaaaaaaaaaaaaaaaaaaaaaaaaaaaaaaaaaaaaaaaaaaataaaaaaaaaaacaaaaaaaaaaatataactaaaaaatcacaaaattatcctctcaacaacatctctactcaaatattctttacacccttctacccacactattatttctcttcccacacttttattcttccttcccaatcttgcctttctttgctaacacaccctctttttgcgggcgtttttaccactcatgggcgcccgttcttaagagaactacctccccctctttgtccgatcgtgcctatcaacaactacgtgctctccactaagcgctctttcccacacattgtgctccccctcatttgcgtgcatttcatcactcttccgcgctattcattcttttacaacaccttcgcgccatatattctggatccccccctccc

SEQ ID NO: 274209 - DNA, 2330 bp, Homo sapiens
cgcgccggagcgggacacgcatgcgccggtctggacccggcacccagtaacggactcgagctcctcccaccggaagtgggcagccgcgcagcgggaagagccggccgaagcgtggcggccacagactgtgggtaccgggtccgagggactcgcgcttttctctccgtgccatggcgccagcgaaagccacgaacgtggtgcggctgctactaggctccacagcgctgtggctttcgcagctcggctccgggacggtcgccgcgtccaagtcggtgactgcccacttggccgcgaagtggcccgagaccccgctgctgctggaggcaagtgaatttatggcagaagaaagtaatgaaaaattttggcagtttttggaaactgtgcaagaattagcaatttataagcaaacagaatcagattattcttattacaacttaatcctgaagaaagctggacagtttctagacaatttacacatcaaccttttaaagtttgctttctctataagggcatactccccagctattcagatgtttcagcagattgcagctgatgagccaccaccagatggttgtaatgcatttgtggttattcataagaagcacacctgtaaaattaatgagattaaaaagctgctgaagaaagctgcttcaaggactagaccttatctatttaaaggagatcacaaatttcctacaaacaaagagaacttaccagtggtgattctctatgccgaaatgggtactagaacatttagtgcatttcacaaagtattgtctgaaaaagctcaaaatgaggaaattctgtatgttcttcgccattatattcagaaaccaagctcacggaaaatgtacttatctgggtatggtgtggagctagcaattaagagtacagaatacaaagcactggatgatacccaagttaaaactgtgactaatactactgtagaggatgagactgaaacaaatgaagttcaaggatttctctttgggaaactaaaagaaatatattcagatcttagagataatctgacagcattccaaaaatacctgattgagagtaacaaacaaatgatgcctttgaaagtctgggaactacaagatcttagttttcaagcagcttctcaaataatgtccgctccagtttatgattccattaaattaatgaaagacatttcacagaacttccccataaaagccagatctctaaccagaattgctgtaaatcaacatatgagagaagaaataaaggaaaatcaaaaggatcttcaagttagatttaaaattcagccaggcgatgctcgtctatttataaatggccttcgtgttgatatggatgtttatgacgcttttagtattttggatatgctgaaattagaaggaaaaatgatgaatggccttcgcaatcttgggatcaatggggaagatatgagcaaatttttaaaattaaattcacacatttgggaatatacttatgtattagatattcgacattcttctataatgtggattaatgacttagaaaatgatgatttgtatattacatggcctacaagttgccagaaacttctgaagccagtatttcctggaagtgtaccttccataaggcgcaattttcataatttggttctgtttattgatccggcccaagaatataccttggattttataaaacttgctgatgttttctattctcacgaagttcctcttagaattggttttgtgttcattcttaatacagatgatgaagttgatggagcaaatgatgctggagttgctctctggcgagctttcaactatattgcagaagaatttgatatatcagaagcatttatttctatagtacacatgtaccaaaaagtgaagaaggatcaaaatatactcactgtggacaatgtgaagagtgttctccaaaatacatttcctcatgctaatatttgggatattttgggaattcattctaaatatgatgaagaaagaaaggtaagttgggacattatgttaagtggagtaggccaggcacagaaagacaaacaccacatgatctctactcatgtagaatctttaaaaaaagtcagactcacagaaacagagtaaaatgggggttaccagaggctggggatggcagaattggggagatattggtcaaaggatacaaaatttcagttagactagagaaataagttcaagagatctattgtacatggtggtgactgtagttaatgacatgttttatacttgaaattactaagtacattttaaggattctcaccacaaaatatgagaagtatttgagtaatctgagggggggagccttagagtcgaccgcat

SEQ ID NO: 274210 - DNA, 1314 bp, Homo sapiens
ccggtgcatgcaatgcaagttaccacgtattatgagaatttgctatataacacaactttgatgcaattgtattctggttagggatgacagagtataaaattagcaacaagtaaaatatgagttagcttatactaaagagataaaatatgtgacaagtcgcagtgcatgggcaacaatggtgttttactgagaggaattggagagcagtctactagcttagcataccttcctaagcatagaatgattgctatgcctcttattgtcccaaacactattttgtacatttattcatcatacagattacagaatcttcaatatatgtattctttaattttgaaagtaaataaatagtacatggttggctacaagataccaaggattttttggtggtaccttgaaataaaggagtttgtttccttatttacagattaagaatgaatatattgatatgcctctttcagtcaactttaaatgtcaagaatttgagaagtcgtcatttatataataaaacatgaaatatatatgggtgtgtataaatgtcatatctgtttagccataatattttaattaatggccgttataaaaattattagatcaaatacaaataaagtaaaataactttagtcttgatcagacagttgattagctctattgatgctaagtcagtataactgttcagaggttctgatgcaaaactctgctgttaatctgtaattaagaaaaaattataaaatatgctaacattgcttaatggctaaattgtaggcttgagcatatctctaaaaccacttggtagacaatctgtaaatgtttgttgaaatgaaatatttgctaaataaatgaaaaatttgccttattaaaaaaaaaaaaaaaaaaaaaaaaaaaaaaaaaaaaaaaaaaaaaaaaaaaaaaaaaaaaaaaaaaaaaaaataaaaaaaaaaacaaaaaaaaaaatataactaaaaaatcacaaaattatcctctcaacaacatctctactcaaatattctttacacccttctacccacactattatttctcttcccacacttttattcttccttcccaatcttgcctttctttgctaacacaccctctttttgcgggcgtttttaccactcatgggcgcccgttcttaagagaactacctccccctctttgtccgatcgtgcctatcaacaactacgtgctctccactaagcgctctttcccacacattgtgctccccctcatttgcgtgcatttcatcactcttccgcgctattcattcttttacaacaccttcgcgccatatattctggatccccccctccc

SEQ ID NO: 274211 - DNA, 404 bp, Homo sapiens
tactttcctttaggcaatgtttggaaaggacagataaagttagcaaaatggatgttttttcctatggcatataaaaatgtggcggtgttccattttcttatgtttattattcaaacaatcatattttgtttaacactctgatattttttaactgaataggctggagcaagcttttataagatgactggcctgggtcctttgcctcaagctctttataatggtgaaccctttaaacatgaagagatgaatattaaagaactaaaaatggctgttcttcaaagaatgatggatgcatctgtatatttacaaagagaagtttttttggtaggtaagcatttataagaaaatacatgatgaatatttataaatgatgtttttattaaaaacttattttaatgacagaa

SEQ ID NO: 274212 - DNA, 731 bp, Homo sapiens
gaaagtcaaatctcttaaatccttagtctttatgttctaatttctcatcaagcctgtatcctttctattacatatatctgtttcgttacttctccctttacctatatcatttgttatctaacagctttagaatcttcactgacatgttgcctatgtggagatggggactatcaaaattagtaattcttcctctacttcttactatccagggaaatgaaaagaaagtatttattcgtaggtagccaagaacttccaaatcccaaaagaatcaggacaccaccaacgttgttgtaaggtcaccactttgtatttgcagatcaaggttctagtaattattttccttgttcttcaatactaaggaaatttagatactatgaaaaaaagtcactttaggcaaagggcaagcagcataaccctgggacattgaaatcaactgtttggattaaaatcttgcctgtgctgtgagtttctgtgtgaccttaatctctctgtacctaaactgcaaaagtactatttcagcagggcgttgtaaggatcaagtgagataatgaacataaagttttaatatagtacctggtacatagtaaatacataataaatattagctattaatattatttaatatcaaacatgggaatttctttccaataggtacttggcaagattatcaacatgaagataaagttgttcatgaactgtaggggcaggctttcagaagcccctttagaaag

SEQ ID NO: 274213 - DNA, 4991 bp, Homo sapiens
cgcgccggagcgggacacgcatgcgccggtctggacccggcacccagtaacggactcgagctcctcccaccggaagtgggcagccgcgcagcgggaagagccggccgaagcgtggcggccacagactgtgggtaccgggtccgagggactcgcgcttttctctccgtgccatggcgccagcgaaagccacgaacgtggtgcggctgctactaggctccacagcgctgtggctttcgcagctcggctccgggacggtcgccgcgtccaagtcggtgactgcccacttggccgcgaagtggcccgagaccccgctgctgctggaggcaagtgaatttatggcagaagaaagtaatgaaaaattttggcagtttttggaaactgtgcaagaattagcaatttataagcaaacagaatcagattattcttattacaacttaatcctgaagaaagctggacagtttctagacaatttacacatcaaccttttaaagtttgctttctctataagggcatactccccagctattcagatgtttcagcagattgcagctgatgagccaccaccagatggttgtaatgcatttgtggttattcataagaagcacacctgtaaaattaatgagattaaaaagctgctgaagaaagctgcttcaaggactagaccttatctatttaaaggagatcacaaatttcctacaaacaaagagaacttaccagtggtgattctctatgccgaaatgggtactagaacatttagtgcatttcacaaagtattgtctgaaaaagctcaaaatgaggaaattctgtatgttcttcgccattatattcagaaaccaagctcacggaaaatgtacttatctgggtatggtgtggagctagcaattaagagtacagaatacaaagcactggatgatacccaagttaaaactgtgactaatactactgtagaggatgagactgaaacaaatgaagttcaaggatttctctttgggaaactaaaagaaatatattcagatcttagagataatctgacagcattccaaaaatacctgattgagagtaacaaacaaatgatgcctttgaaagtctgggaactacaagatcttagttttcaagcagcttctcaaataatgtccgctccagtttatgattccattaaattaatgaaagacatttcacagaacttccccataaaagccagatctctaaccagaattgctgtaaatcaacatatgagagaagaaataaaggaaaatcaaaaggatcttcaagttagatttaaaattcagccaggcgatgctcgtctatttataaatggccttcgtgttgatatggatgtttatgacgcttttagtattttggatatgctgaaattagaaggaaaaatgatgaatggccttcgcaatcttgggatcaatggggaagatatgagcaaatttttaaaattaaattcacacatttgggaatatacttatgtattagatattcgacattcttctataatgtggattaatgacttagaaaatgatgatttgtatattacatggcctacaagttgccagaaacttctgaagccagtatttcctggaagtgtaccttccataaggcgcaattttcataatttggttctgtttattgatccggcccaagaatataccttggattttataaaacttgctgatgttttctattctcacgaagttcctcttagaattggttttgtgttcattcttaatacagatgatgaagttgatggagcaaatgatgctggagttgctctctggcgagctttcaactatattgcagaagaatttgatatatcagaagcatttatttctatagtacacatgtaccaaaaagtgaagaaggatcaaaatatactcactgtggacaatgtgaagagtgttctccaaaatacatttcctcatgctaatatttgggatattttgggaattcattctaaatatgatgaagaaagaaaggctggagcaagcttttataagatgactggcctgggtcctttgcctcaagctctttataatggtgaaccctttaaacatgaagagatgaatattaaagaactaaaaatggctgttcttcaaagaatgatggatgcatctgtatatttacaaagagaagtttttttgggcacattaaatgatcgcacgaatgcaattgattttctaatggataggaataatgttgtaccccgtataaatactttgattttgcgtactaaccagcagtacctcaatttaatatctacatcagtaactgctgatgttgaagatttctctactttctttttcttggattcacaagataagagtgctgtaattgcaaagaacatgtattatttaacccaagacgatgagagtataatttctgcagtcactctctggattattgcagattttgataagccttctgggagaaaacttctttttaatgcattaaagcacatgaaaacaagtgttcatagtcggttggggattatttataatcctacatcaaaaataaatgaagagaacacagctatttctagaggaattttggcagcttttcttacacagaagaacatgtttttgagaagctttcttgggcaactggcaaaggaagaaattgctacagctatttactctggagataaaattaaaacattccttattgaggggatggataagaatgcttttgagaaaaaatataatactgttggagtgaatatttttcgaactcaccagttgttctgtcaagatgtacttaaattacgtcctggagaaatgggtattgtcagcaatgggagattcttaggacctttagatgaagatttttatgcagaagatttttacttgttggaaaagataacatttagtaatttaggagagaaaattaaaggcattgttgaaaatatgggaatcaacgcaaataacatgagtgactttattatgaaagttgatgcccttatgtcctctgtgcctaagcgtgcatctcgatatgatgtcacatttcttagggagaatcacagtgttataaagacgaatcctcaagagaatgatatgttcttcaatgtcattgctattgttgatccattaacaagagaagcacagaaaatggcacagttgttggttgtacttggcaagattatcaacatgaagataaagttgttcatgaactgtaggggcaggctttcagaagcccctttagaaagaggggacaaaaatataccctttctcttctttgtggatcagaatcactgtcattcattatgagccattcttattgatgggaatattcagttctccttcatgtgtcattgggcagaaaacaggtggcaaaatttttggatattcctgaatcacccctcctaatcctcaacatgattactccagaaggctggttggttgaaacagtgcacagcaactgtgaccttgataatattcacttaaaggatactgagaaaactgttacagcagaatatgaactagaatacttactactggaaggacaatgctttgataaagtgacagaacagcctcctcggggtctgcagttcacactaggcacaaaaaataaacctgctgtggttgatacaatagtgatggcacatcatgggtattttcaattaaaagcaaacccaggtgcttggatactgaggttacaccaaggaaaatctgaagatatttatcaaatagttgggcatgaaggaactgactctcaagcagacctagaagatatcattgttgtattaaacagcttcaaaagcaagatactcaaagtaaaagtgaaaaaagaaacagacaaaattaaggaagatatccttaccgatgaagatgaaaaaacaaaaggactgtgggattccattaaaagtttcacagtaagcttgcataaagaaaacaaaaaggaaaaagatgtcctaaacattttttcagttgcttctggtcatttatatgaacgttttttaagaattatgatgctttctgttttgcgtaacaccaaaacaccagtgaaattctggttgctaaaaaattatctctcaccgacatttaaagaagtaattcctcacatggctaaagagtatggattccgatatgaactagttcaatataggtggccccgttggcttcgtcaacagactgaaagacagaggattatttggggttacaaaattcttttccttgatgttcttttcccactagcagtggacaaaatcatttttgttgatgctgaccagattgtgagacatgatctaaaagaacttcgagatttcgatctggatggagctccttatgggtatactccattttgtgatagccgcagggaaatggatggatatcgtttctggaaaacaggatactgggcatcacatcttttaagacggaaataccatatcagtgctttatatgtagtggatctcaagaagttcaggagaattggagcaggtgacaggctcaggagccagtatcaagctctcagtcaagatccaaacagtctttcaaacctagatcaggatctccccaataatatgatttaccaagtcgccattaagtctcttcctcaagactggctgtggtgtgaaacctggtgtgatgatgaatccaaacaaagagccaaaacaattgatctgtgcaataatcccaaaacaaaagaatccaaactaaaagctgctgccagaattgtcccagaatgggtggagtatgatgctgagataagacaactattagatcatcttgaaaacaagaagcaagatacaattttgacacatgatgaactctagcactggtgtatatgagaaggaaggcgaaagcatgacaggaaacctgccgcctgctggggaagtctggagcccctgctgagacgatttggaagtctcgttaagatcagtgacatattctttaattttaaaaaattgtaattatttaaaacagttatttaatgtattgaatgagtttaagttatataataaatgaccattgagtatttaaaaaaaaaat

SEQ ID NO: 274214 - DNA, 4823 bp, Homo sapiens
cgcgccggagcgggacacgcatgcgccggtctggacccggcacccagtaacggactcgagctcctcccaccggaagtgggcagccgcgcagcgggaagagccggccgaagcgtggcggccacagactgtgggtaccgggtccgagggactcgcgcttttctctccgtgccatggcgccagcgaaagccacgaacgtggtgcggctgctactaggctccacagcgctgtggctttcgcagctcggctccgggacggtcgccgcgtccaagtcggtgactgcccacttggccgcgaagtggcccgagaccccgctgctgctggaggcaagtgaatttatggcagaagaaagtaatgaaaaattttggcagtttttggaaactgtgcaagaattagcaatttataagcaaacagaatcagattattcttattacaacttaatcctgaagaaagctggacagtttctagacaatttacacatcaaccttttaaagtttgctttctctataagggcatactccccagctattcagatgtttcagcagattgcagctgatgagccaccaccagatggttgtaatgcatttgtggttattcataagaagcacacctgtaaaattaatgagattaaaaagctgctgaagaaagctgcttcaaggactagaccttatctatttaaaggagatcacaaatttcctacaaacaaagagaacttaccagtggtgattctctatgccgaaatgggtactagaacatttagtgcatttcacaaagtattgtctgaaaaagctcaaaatgaggaaattctgtatgttcttcgccattatattcagaaaccaagctcacggaaaatgtacttatctgggtatggtgtggagctagcaattaagagtacagaatacaaagcactggatgatacccaagttaaaactgtgactaatactactgtagaggatgagactgaaacaaatgaagttcaaggatttctctttgggaaactaaaagaaatatattcagatcttagagataatctgacagcattccaaaaatacctgattgagagtaacaaacaaatgatgcctttgaaagtctgggaactacaagatcttagttttcaagcagcttctcaaataatgtccgctccagtttatgattccattaaattaatgaaagacatttcacagaacttccccataaaagccagatctctaaccagaattgctgtaaatcaacatatgagagaagaaataaaggaaaatcaaaaggatcttcaagttagatttaaaattcagccaggcgatgctcgtctatttataaatggccttcgtgttgatatggatgtttatgacgcttttagtattttggatatgctgaaattagaaggaaaaatgatgaatggccttcgcaatcttgggatcaatggggaagatatgagcaaatttttaaaattaaattcacacatttgggaatatacttatgtattagatattcgacattcttctataatgtggattaatgacttagaaaatgatgatttgtatattacatggcctacaagttgccagaaacttctgaagccagtatttcctggaagtgtaccttccataaggcgcaattttcataatttggttctgtttattgatccggcccaagaatataccttggattttataaaacttgctgatgttttctattctcacgaagttcctcttagaattggttttgtgttcattcttaatacagatgatgaagttgatggagcaaatgatgctggagttgctctctggcgagctttcaactatattgcagaagaatttgatatatcagaagcatttatttctatagtacacatgtaccaaaaagtgaagaaggatcaaaatatactcactgtggacaatgtgaagagtgttctccaaaatacatttcctcatgctaatatttgggatattttgggaattcattctaaatatgatgaagaaagaaaggctggagcaagcttttataagatgactggcctgggtcctttgcctcaagctctttataatggtgaaccctttaaacatgaagagatgaatattaaagaactaaaaatggctgttcttcaaagaatgatggatgcatctgtatatttacaaagagaagtttttttgggcacattaaatgatcgcacgaatgcaattgattttctaatggataggaataatgttgtaccccgtataaatactttgattttgcgtactaaccagcagtacctcaatttaatatctacatcagtaactgctgatgttgaagatttctctactttctttttcttggattcacaagataagagtgctgtaattgcaaagaacatgtattatttaacccaagacgatgagagtataatttctgcagtcactctctggattattgcagattttgataagccttctgggagaaaacttctttttaatgcattaaagcacatgaaaacaagtgttcatagtcggttggggattatttataatcctacatcaaaaataaatgaagagaacacagctatttctagaggaattttggcagcttttcttacacagaagaacatgtttttgagaagctttcttgggcaactggcaaaggaagaaattgctacagctatttactctggagataaaattaaaacattccttattgaggggatggataagaatgcttttgagaaaaaatataatactgttggagtgaatatttttcgaactcaccagttgttctgtcaagatgtacttaaattacgtcctggagaaatgggtattgtcagcaatgggagattcttaggacctttagatgaagatttttatgcagaagatttttacttgttggaaaagataacatttagtaatttaggagagaaaattaaaggcattgttgaaaatatgggaatcaacgcaaataacatgagtgactttattatgaaagttgatgcccttatgtcctctgtgcctaagcgtgcatctcgatatgatgtcacatttcttagggagaatcacagtgttataaagacgaatcctcaagagaatgatatgttcttcaatgtcattgctattgttgatccattaacaagagaagcacagaaaatggcacagttgttggttgtacttggcaagattatcaacatgaagataaagttgttcatgaactgtaggggcaggctttcagaagcccctttagaaagcttttaccgttttgttctggaaccagaactgatgtcaggggctaatgacgtttcttctcttggaccagtggcaaaatttttggatattcctgaatcacccctcctaatcctcaacatgattactccagaaggctggttggttgaaacagtgcacagcaactgtgaccttgataatattcacttaaaggatactgagaaaactgttacagcagaatatgaactagaatacttactactggaaggacaatgctttgataaagtgacagaacagcctcctcggggtctgcagttcacactaggcacaaaaaataaacctgctgtggttgatacaatagtgatggcacatcatgggtattttcaattaaaagcaaacccaggtgcttggatactgaggttacaccaaggaaaatctgaagatatttatcaaatagttgggcatgaaggaactgactctcaagcagacctagaagatatcattgttgtattaaacagcttcaaaagcaagatactcaaagtaaaagtgaaaaaagaaacagacaaaattaaggaagatatccttaccgatgaagatgaaaaaacaaaaggactgtgggattccattaaaagtttcacagtaagcttgcataaagaaaacaaaaaggaaaaagatgtcctaaacattttttcagttgcttctggtcatttatatgaacgttttttaagaattatgatgctttctgttttgcgtaacaccaaaacaccagtgaaattctggttgctaaaaaattatctctcaccgacatttaaagaagtaattcctcacatggctaaagagtatggattccgatatgaactagttcaatataggtggccccgttggcttcgtcaacagactgaaagacagaggattatttggggttacaaaattcttttccttgatgttcttttcccactagcagtggacaaaatcatttttgttgatgctgaccagattgtgagacatgatctaaaagaacttcgagatttcgatctggatggagctccttatgggtatactccattttgtgatagccgcagggaaatggatggatatcgtttctggaaaacaggatactgggcatcacatcttttaagacggaaataccatatcaggatctccccaataatatgatttaccaagtcgccattaagtctcttcctcaagactggctgtggtgtgaaacctggtgtgatgatgaatccaaacaaagagccaaaacaattgatctgtgcaataatcccaaaacaaaagaatccaaactaaaagctgctgccagaattgtcccagaatgggtggagtatgatgctgagataagacaactattagatcatcttgaaaacaagaagcaagatacaattttgacacatgatgaactctagcactggtgtatatgagaaggaaggcgaaagcatgacaggaaacctgccgcctgctggggaagtctggagcccctgctgagacgatttggaagtctcgttaagatcagtgacatattctttaattttaaaaaattgtaattatttaaaacagttatttaatgtattgaatgagtttaagttatataataaatgaccattgagtatttaaaaaaaaaat

SEQ ID NO: 274215 - DNA, 4350 bp, Homo sapiens
  misc_feature (4091)..(4091): n is a, c, g, or t
  misc_feature (4093)..(4093): n is a, c, g, or t
  misc_feature (4098)..(4098): n is a, c, g, or t
  misc_feature (4107)..(4107): n is a, c, g, or t
  misc_feature (4116)..(4116): n is a, c, g, or t
  misc_feature (4122)..(4122): n is a, c, g, or t
  misc_feature (4125)..(4125): n is a, c, g, or t
  misc_feature (4127)..(4127): n is a, c, g, or t
  misc_feature (4131)..(4131): n is a, c, g, or t
  misc_feature (4138)..(4138): n is a, c, g, or t
  misc_feature (4142)..(4142): n is a, c, g, or t
  misc_feature (4149)..(4149): n is a, c, g, or t
  misc_feature (4152)..(4152): n is a, c, g, or t
  misc_feature (4158)..(4159): n is a, c, g, or t
  misc_feature (4166)..(4166): n is a, c, g, or t
  misc_feature (4171)..(4171): n is a, c, g, or t
  misc_feature (4174)..(4175): n is a, c, g, or t
  misc_feature (4183)..(4183): n is a, c, g, or t
  misc_feature (4187)..(4187): n is a, c, g, or t
  misc_feature (4207)..(4207): n is a, c, g, or t
  misc_feature (4211)..(4211): n is a, c, g, or t
  misc_feature (4213)..(4213): n is a, c, g, or t
  misc_feature (4215)..(4215): n is a, c, g, or t
  misc_feature (4224)..(4225): n is a, c, g, or t
  misc_feature (4227)..(4227): n is a, c, g, or t
  misc_feature (4234)..(4237): n is a, c, g, or t
  misc_feature (4244)..(4244): n is a, c, g, or t
  misc_feature (4247)..(4247): n is a, c, g, or t
  misc_feature (4252)..(4252): n is a, c, g, or t
  misc_feature (4260)..(4262): n is a, c, g, or t
  misc_feature (4268)..(4268): n is a, c, g, or t
  misc_feature (4270)..(4271): n is a, c, g, or t
  misc_feature (4277)..(4277): n is a, c, g, or t
  misc_feature (4279)..(4279): n is a, c, g, or t
  misc_feature (4290)..(4290): n is a, c, g, or t
  misc_feature (4305)..(4307): n is a, c, g, or t
  misc_feature (4326)..(4326): n is a, c, g, or t
  misc_feature (4332)..(4333): n is a, c, g, or t
  misc_feature (4337)..(4338): n is a, c, g, or t
  misc_feature (4345)..(4345): n is a, c, g, or t
cgcgccggagcgggacacgcatgcgccggtctggacccggcacccagtaacggactcgagctcctcccaccggaagtgggcagccgcgcagcgggaagagccggccgaagcgtggcggccacagactgtgggtaccgggtccgagggactcgcgcttttctctccgtgccatggcgccagcgaaagccacgaacgtggtgcggctgctactaggctccacagcgctgtggctttcgcagctcggctccgggacggtcgccgcgtccaagtcggtgactgcccacttggccgcgaagtggcccgagaccccgctgctgctggaggcaagtgaatttatggcagaagaaagtaatgaaaaattttggcagtttttggaaactgtgcaagaattagcaatttataagcaaacagaatcagattattcttattacaacttaatcctgaagaaagctggacagtttctagacaatttacacatcaaccttttaaagtttgctttctctataagggcatactccccagctattcagatgtttcagcagattgcagctgatgagccaccaccagatggttgtaatgcatttgtggttattcataagaagcacacctgtaaaattaatgagattaaaaagctgctgaagaaagctgcttcaaggactagaccttatctatttaaaggagatcacaaatttcctacaaacaaagagaacttaccagtggtgattctctatgccgaaatgggtactagaacatttagtgcatttcacaaagtattgtctgaaaaagctcaaaatgaggaaattctgtatgttcttcgccattatattcagaaaccaagctcacggaaaatgtacttatctgggtatggtgtggagctagcaattaagagtacagaatacaaagcactggatgatacccaagttaaaactgtgactaatactactgtagaggatgagactgaaacaaatgaagttcaaggatttctctttgggaaactaaaagaaatatattcagatcttagagataatctgacagcattccaaaaatacctgattgagagtaacaaacaaatgatgcctttgaaagtctgggaactacaagatcttagttttcaagcagcttctcaaataatgtccgctccagtttatgattccattaaattaatgaaagacatttcacagaacttccccataaaagccagatctctaaccagaattgctgtaaatcaacatatgagagaagaaataaaggaaaatcaaaaggatcttcaagttagatttaaaattcagccaggcgatgctcgtctatttataaatggccttcgtgttgatatggatgtttatgacgcttttagtattttggatatgctgaaattagaaggaaaaatgatgaatggccttcgcaatcttgggatcaatggggaagatatgagcaaatttttaaaattaaattcacacatttgggaatatacttatgtattagatattcgacattcttctataatgtggattaatgacttagaaaatgatgatttgtatattacatggcctacaagttgccagaaacttctgaagccagtatttcctggaagtgtaccttccataaggcgcaattttcataatttggttctgtttattgatccggcccaagaatataccttggattttataaaacttgctgatgttttctattctcacgaagttcctcttagaattggttttgtgttcattcttaatacagatgatgaagttgatggagcaaatgatgctggagttgctctctggcgagctttcaactatattgcagaagaatttgatatatcagaagcatttatttctatagtacacatgtaccaaaaagtgaagaaggatcaaaatatactcactgtggacaatgtgaagagtgttctccaaaatacatttcctcatgctaatatttgggatattttgggaattcattctaaatatgatgaagaaagaaaggctggagcaagcttttataagatgactggcctgggtcctttgcctcaagctctttataatggtgaaccctttaaacatgaagagatgaatattaaagaactaaaaatggctgttcttcaaagaatgatggatgcatctgtatatttacaaagagaagtttttttgggcacattaaatgatcgcacgaatgcaattgattttctaatggataggaataatgttgtaccccgtataaatactttgattttgcgtactaaccagcagtacctcaatttaatatctacatcagtaactgctgatgttgaagatttctctactttctttttcttggattcacaagataagagtgctgtaattgcaaagaacatgtattatttaacccaagacgatgagagtataatttctgcagtcactctctggattattgcagattttgataagccttctgggagaaaacttctttttaatgcattaaagcacatgaaaacaagtgttcatagtcggttggggattatttataatcctacatcaaaaataaatgaagagaacacagctatttctagaggaattttggcagcttttcttacacagaagaacatgtttttgagaagctttcttgggcaactggcaaaggaagaaattgctacagctatttactctggagataaaattaaaacattccttattgaggggatggataagaatgcttttgagaaaaaatataatactgttggagtgaatatttttcgaactcaccagttgttctgtcaagatgtacttaaattacgtcctggagaaatgggtattgtcagcaatgggagattcttaggacctttagatgaagatttttatgcagaagatttttacttgttggaaaagataacatttagtaatttaggagagaaaattaaaggcattgttgaaaatatgggaatcaacgcaaataacatgagtgactttattatgaaagttgatgcccttatgtcctctgtgcctaagcgtgcatctcgatatgatgtcacatttcttagggagaatcacagtgttataaagacgaatcctcaagagaatgatatgttcttcaatgtcattgctattgttgatccattaacaagagaagcacagaaaatggcacagttgttggttgtacttggcaagattatcaacatgaagataaagttgttcatgaactgtaggggcaggctttcagaagcccctttagaaagcttttaccgttttgttctggaaccagaactgatgtcaggggctaatgacgtttcttctcttggaccagtggcaaaatttttggatattcctgaatcacccctcctaatcctcaacatgattactccagaaggctggttggttgaaacagtgcacagcaactgtgaccttgataatattcacttaaaggatactgagaaaactgttacagcagaatatgaactagaatacttactactggaaggacaatgctttgataaagtgacagaacagcctcctcggggtctgcagttcacactaggcacaaaaaataaacctgctgtggttgatacaatagtgatggcacatcatgtaagtattatttaattgatggtgtttaatttgatgttttggtgaattctctgttttcctaagagtaaaatgaaataatctttattctgctgttgctgaacagtttgcagaaaacaaaattgaatctttgaataagataaataaaaaatggggaaaatcatactttaataatttttgacaggttattgtaaaatctctttacttggaattgatttatagaatttattcattctacagttaataaatactttcttagatcactcgtgtattcatgagcaattcgatggtttttagtcatattactcaatgattatttttttctcatcttaaaaggggtattttcaattaaaagcaaacccaggtgcttggatactgaggttacaccaaggaaaatctgaagatatttatcaaatagttgggtgagttatgcaggctgcttttaaatttttacacataaatacgtttttagtgtaatacaaccaagagaatcaaaacaacaattaaaatgttaagattggcctggcgcagtggctnangcctntaatcccancactttggnaggccnagncnggcngatcacnaggncaggagntcnagaccnncctggcnaacanggnnaaaccccntctntactaaaaatacaaaaattngccngncntggtggcgnncncctgtannnncagctantcnggagnctgaggcnnnagaatngnntgaacncnggaggcggagnttgcagtgagcagannncaccactgcactccagccnggacanngagnnagactcngtctc

SEQ ID NO: 274216 - DNA, 1206 bp, Homo sapiens
  misc_feature (1203)..(1203): n is a, c, g, or t
  misc_feature (1205)..(1205): n is a, c, g, or t
tacgctggagtcgtagctatattaagtgtagagataagagaggggagggggcttagtatgacccgatctccccaataatatgatttaccaagtcgccattaagtctcttcctcaagactggctgtggtgtgaaacctggtgtgatgatgaatccaaacaaagagccaaaacaattgatctgtgcaataatcccaaaacaaaagaatccaaactaaaagctgctgccagaattgtcccagaatgggtggagtatgatgctgagataagacaactattagatcatcttgaaaacaagaagcaagatacaagctctacaagaagcatggcagcatctgcttctggggaagcctcaaggagcttttattcatggtggaaggcaaagcaggagcaggtgtcttacattggaggaacaggaccacgagagagaaggggaaggtgccacacacttttaaacaaccagatctcacactaactcactcactatcacaagaagagcaccgagggaatgctgctaacccattcatgaggactctgcccccgtggtccagttacctcctaccagggaattataccctcccacctccaacactggggatgagatttggtgaggacacagatccaaaccatatcgttgtgcttattggccatctgtatattataagtttttttgcaaagtgcctattcaagatttttgctcttttttaagttttggattttgaatttctttggaaaacaaaaaagcccactgagattttgattgcaactcttgttttaaatcagtttggtgaagattaatgtgttgattatgttgagcttccaattcataaatacgatatgtttcttgatttattttggtctttaattactcctagcagagttttagtttgcagtgtacatattttactaagaattttataactgaatgctaatataaatggtatttttaaatttcttgttggttgctaatacatagaaatacaattaatttttgtatattggacttatgtcctgtggctttgctatactcacttattagttctagtagagttcttaggaattttttcataatgggtcctgttatagttgtagagttcacaggattgtcttcacagtggatcatatcttcagcaaataaaaatagttttactttttcctttccaaatagaaaagtggcctcgttggcctcagcggtggagctctcgncng

SEQ ID NO: 274217 - DNA, 369 bp, Homo sapiens
atacatatctagaagtggaattgcctgagcatatggtaactatgtttaactgaggagctaccaaacttttccaaggcaactgtggcagttttacattcccaggagtaatgtatgaaggttctcattctccatattcttgctaacacttatccatcttttttatatagccatcgtagggagcgagaagttgtgtctcactgtggtttgttttgcatttccatagtcctcagcctgtttttatatagcttgaaaactaagaatgctttttacatgttttaattgttgaaaaaaatgaaagcaaaatattttatgacacatgaaaattatctgaaatctaacagtgtctataaagttttattggaatacagc

SEQ ID NO: 274218 - DNA, 442 bp, Homo sapiens
agctactatctccacttcttgattattccatcttctctttgctacttctcttccaatcttaagtattgtgatttgcagtttttgtcttcctcttgctgtattctttgactttatgtctgtgtcattagtgtggatgtttagattcgcattttaaaaattcctactggttgttctgcaggctcattaaacttgccttttccaaaacaacttgttctttttaccacctgtatctgtgataccatcctataaaatagacttgatatctgttatagtgctgttgtccatctggctgccacaggtaaacgttaacttcagtaacttccttatttcctcccactatcagtttttcttattttcttattattattattattgttttcgagatgaagttttgctccagcctggcaacagagtgagactccgtctcaaaaaaaaacaaaag

SEQ ID NO: 274219 - DNA, 135 bp, Homo sapiens
ggacaccctattgaaccattggtgctgggataactggcaagccacatgtaggagaattaaactggatcctcatttctcaccttatgcagaaaactcaagatggatcgaagacttaaagataagacctgaaactgt

SEQ ID NO: 274220 - DNA, 402 bp, Homo sapiens
gtcaagttatgtgcataaaatggaaaagcatatattattacagtgataaaagagtttctttctaggtgatgttattatggactgattttattttcctccttatattttgcatatctcgtaaactctccactataagcagaaaataaggttggagaaaataagaattgaagagctaaatttttttttaacaccaagtgatagaaaactctaaaaatcccattgaagataggatcatagacaaatagtccctgatgcctgtgctgggatagtcacacacagctgcctcacctctgcccccatggtgaggatcccagtggtcagggacagtgacccatttggaacatgagcagttgggtcaaatccacaaataactgttttaaacagcagtcattttatttgaaa

SEQ ID NO: 274221 - DNA, 411 bp, Homo sapiens
taaactgttctgttgagggatatgacagtcttagattctttccttagttacttaaatttagttagtgatgcttttatgttaaaaattaaaagtggccccagcttctaaaccagagaatcagtgctacttattcagggtttgggtaaggggatttattaggcttgttacacagtgtttgaatagtgcttttgtcctccagcttctgttgtacaactcataaactccagcaatccttttgtaacatggttggtcttttgcctttcagatacactgtgcatcatcagtggattgtttaccatattgtatttgctcccatgtttaaatattgctttagatacagtactttggatattgagttgtgacttgtttcttctgctgtttcatagtatacaaaggtgactggcttaagga

SEQ ID NO: 274222 - DNA, 370 bp, Homo sapiens
actcataggaccactctggtgaattgttgaatagattgtgtgttatctgccacacttcaagtactagcatgcattaaaatccctatccctttgccctccaatgtaaaatgatatgaattctgtggcttacacatagctattttttttttttttttttggcctgcatagataaggcaattccgtaaggctgtgttaccattctcctaaagggcctccctgtggggccacagtacatcttgcctaatttctttttaacaatatttatttctgtggtcaagaagaagataaggtaccttagaagtagtcactgttctatctcaatttggatatgcttgttgaagaactcttacaaccacttatttctgggaaa

SEQ ID NO: 274223 - DNA, 229 bp, Homo sapiens
ccagactgttaacttcaggtaacttaagggtaggtatgaccttgcttctcagatcaaatcattagggtctttccttgctgtggttctgtgaggggtgaagagtttaaacaatgacaaaatattttgcaagctaaagagctgaagacaacttaggtgtgtgaggaagggcaggtcagatgagcagacgggaatcctaggacgtgttgcctgcaggacgcggtgcaccctg

SEQ ID NO: 274224 - DNA, 283 bp, Homo sapiens
ttttttgtagatgactaattgaagatgtagctcattgggatcctaaacagatggcccctgacttacttacagtggttggacttatgatttttcaactttaggattgtgtaaaagcaataaacattcaatagacactgtattttaagtacctatacaaccattccgtttttcactttcagtataagcagtcaataaattatataataaattcaacactttattataaagtaggctttgtgttagctgattttgcccagctgtaagctaatgtaaatgttcagaa

SEQ ID NO: 274225 - DNA, 280 bp, Homo sapiens
tggacccagctcacccagtacctgtttctctcaacctcttaggaaatctgaacaggtatgcagcaaccacctccggacaaggccttttcaaagtataattttcaaacatgtaaaaaagatgactcatatatatcatgaacacatatcaaagatctactacgcatcaattcagaaaaagagtgggaactctgattcatggatcattctgagaagctgggtacatgtatttcatgtatttgtaagcattcttttgttttgttttgtttttgagacagggtct

SEQ ID NO: 274226 - DNA, 511 bp, Homo sapiens
ccacaccaatcagtcaatctcacacgcatacacaggagcatatttctgtactgatgcataatgaatgcactcacacacacacacacacgccagggggctcccagcactcttctcccagggttcaggactttgtggagtcagcccgtgcagctatttacctctgttgccctgattgcaggtagactgtcaatcccagaagttgctaggtgctgaggcaggaaaaggaggaggtttcttttagcaggtgctctcctctagcaggtagtgttctatctcttttgcccctggtgatgtcaaaagattcttctgttagcaacctgtgatactgacctgcaactctaggcaccagtcaagtcagccctcaactccccctacctattctccccaactgaaatcaaattgacatccaggtctgtcttggccagggggcttccattggggaaaaaaaatgggacagtgaacctcacctattgaataaaccaaattagtaattagtgacaaaaccaaaaaa

SEQ ID NO: 274227 - DNA, 263 bp, Homo sapiens
agataatggagaacatataggtccagtccatgttgattctgtaggtggcactggagaagtgtagctattaagggacagagctgagagcagaatccaggtttccccaatgccttctctacactgcctcctggcagaaaagaccctgcccctccctaataccccctttccacagccttctgtttcaggagcagcccttccttccactgccatacctctgccccctccaccatccaggaccgtgggaccctgcagctcactagtag

SEQ ID NO: 274228 - DNA, 280 bp, Homo sapiens
ttgagacagcgtctcactctgtcacccaggctggaatgcagtggcatgatcataactcattgcagccttacctcccaggcccaagtgcttctcccatttcagcttcctgagtagctaggaccacaggcacaagccaccttgcctggctaattttttttagaggggattggggtaggggagagacaaggtctcactatgttacccaggctggtcagactcctgggctcaagtgatcctcccgtctcagcctctcagaagtgctgggatgacaggtatgatc

SEQ ID NO: 274229 - DNA, 159 bp, Homo sapiens
cgctccagcactggagtgtgcttaaggtgaaagaataaagaattcagggacaaaaaaccttaaactgaaatccctgtttctcagatgcttgaaggcagcatgctcgttaagagtcatcaccaatccctaatctcaagtaatcagggacacaaacactgc

SEQ ID NO: 274230 - DNA, 415 bp, Homo sapiens
tgggagtcaaagcaaatattgatacatgagctataaaacaccatagaagaccttgagttcaaaactctgtagaatagatttgctgtagaagttgggagcagccttctaggacactggactatgtgtttctgatagctagctaaagaaaaatgaagagcaactggtttgacccacattgattgggatccagagacattgaacgatggtgaggcactgtaagctggtgttgaaattgatgctgggaagaagagtacagtattccccttaccaccttatccatgatttcagttacccatggtcatccgtggtctcataatatcaaatgaaaaattccagaaattgacaattcatatgctttaaattttatgccatcctctgtaatgtgaagaaatctgacatagtcctgctccaccca

SEQ ID NO: 274231 - DNA, 189 bp, Homo sapiens
agccagactatctcaattaaaaacaaataaataaatacatgaagcaacgatccaatcaatcaaaccaacaaattctggaaaggtagagaagagaagggctgacccagtggtgagttcctggggtggtttgatggtttgttctttggcctcctatataccctgtcttatctgttagagcagagtctacaa

SEQ ID NO: 274232 - DNA, 387 bp, Homo sapiens
ccctttatctttcaacactgaaattccttttaccttgtcactggtaccaaggcccttaccaaaattactcacatgttattttgcaaacctctagttattttctccatctttctagcactgatttattcccccattttgctgtcagattgttttttcaattccttcaatttcttttgttggatcatcattgctacctgattgtgcctatatgtgtgtatatatacgtgtgtgtgtgtatatatatacatatatatgtgtgtgtgttttaagtgtcaatatctatgtttacatatgcttatgtatacatgacaggaggggaaggcttttgctgatttaaagtgaaagtaaggcaaaaataaactttttgcttaaagtggagcagtagca

SEQ ID NO: 274233 - DNA, 247 bp, Homo sapiens
cccccgggttccctaaaatccagtcttctatagttgataggcattcacgcacacacagacatttctagacacagaggtatgttaaaaagactgctcctggcaggagtgcttctctatgtgacctgaatatgttttcacatcctgccctcagacaagtccactggagaatataaaaatgctattcgtctgtcttaaaatttcacttcatgtgactcaactatttttaatctacttcaaatattttgta

SEQ ID NO: 274234 - DNA, 414 bp, Homo sapiens
acaattacaatagcaacatcaaaggtcactgatcacaggtcacagtatcagatataatagtgaaaaagtgtgaactattgtgagaattaccaaaatgtgacacagatacaaagagagcatatggttttggaaaaatggtactgatagaccctcaatgcagggttgccacaaaccatgaacctgtaaaaaacacgtatctgtgaagtgcaataaaatgaagtatgcctgtatgaaatatttagtattactcaaagttcgtctactacatggcattctctctaatagtctctcatagtctaatttcccactgtggatatggataaaaaaatacttcatactgtaaaaaagtaagtaaacaagtcagtgaaatgatagtaataaagatggccttccatatgagacttatttctaaaa

SEQ ID NO: 274235 - DNA, 393 bp, Homo sapiens
tctctaaagtgataatgaagatccttaaaatattataaacaaactaggtgaccctggttatttaatattcaattatatatattaagcaaaattcattcacttagaaattttaattaagttaagatatagccagctgggtgcagtggctcatgcctgtaatcccagcactttgggagtctgaggcagactgcttgagcctaggagtttaagaccagcctggacaacgtggtgaaataccatctctacaaaaaatgcaaaacttagccagacacagtggcacatgcctatagtcccagctactggggaggctgaggtgggaggatggcttgagcctggaaggtcaaggcagcggtgagccatgattgcacaactgcactctagtctgggtgacag

SEQ ID NO: 274236 - DNA, 342 bp, Homo sapiens
gaaatcataaagatattaagtataagcatggatttctctgtagagattatctgtactggcgagtctgtgattaggaaatgtcagtttttgtttgttttgcccaagtgtatttcctagatttggtctttttcttgaacaagagtgctaagcagaatctctgattctatattgaaatccaatttttgatttctttgcacaggtgacttattctctattctagattagccctaacagattgatttttttttttaacccatccacctgcctttatttcttctgtggaatgtctgtctctgaatatgatcattttaaaattaaggtttttttttacttttaagaagt

SEQ ID NO: 274237 - DNA, 412 bp, Homo sapiens
ccttaactcacttctgagccatgagatttgggcagggtgcttaaattctccagtttttagtgtcttcttctgaacaatcgtgtcgatcaccactgcctcagagacttgatttacagatgaaatgagggccgggtgcagtgtttcacgcatgtaatcccagcagtttgggaggccaaggcaggtggatcacctgaggccaggagttcgagaccagcctgactaacatgatgagactccatttctactaaaaatacgaaaaattagccaggtgtggaggtgcatgtctgtaatcccagctactcaggaggctgaggcaagataattgcttgaactcgggagttggaggttgcagtaagccgagattgtgccattttgcactccagcttgggcaacaagagcaaaactccatctc

SEQ ID NO: 274238 - DNA, 516 bp, Homo sapiens
taggaatgcctctcctaactgcatcttgctcaagctatatatgactagcaagtttaattagtatttaaaagatcaaatccctttataaaaaggcctactccaaaaatatattttcttatggcaaataaaatataattgatgtacatttattcagtgttttaattatttttattatgtattccttctgcatttgtttgtgtatgaatctaatgatttgccattagaagactggaagcatgtctgtccaaatttctttgtggctcacccacctaaagctatagatcaggatgacatttattatggcagtaatgaagaacaattagcatttaccatatacttgtttccttcacttttatgtcatatgtgtattacctttaaaaactatttctattttatttgtcaacatattcagtagaaattcatatgactgaatcctataaaccattttaaaaggttaacattttcttgaaaatagtacttttaaaagaaataaatagaatttgaaattatacctgt

SEQ ID NO: 274239 - DNA, 453 bp, Homo sapiens
ctcaaaaccataaaagaataaatttatatcatttgaagccactaagtgtgtggtactagatacagcagccaccggaaatgattacagcttcttattcagatttcaggctgcctggtgtaaagtagtcttacccacaacacctgttttcatttcttgctagccctcattattactggaaatgatcacatttctttcttagtttattgcgtgtctccactcgccagcacaccaggctcctggagggcaaagatctggttttgcccacttttttatcccagtacctagaacagtgcctagtaaattgtgggttctcaataaatctttgctacgtgagactgggaacggtagctcacgcctataattccagcactttgggaggctgaggcaggcagatcacctgaggtcaggagttcgagaccatccaggccaacatggtgaaaccctgtctctact

SEQ ID NO: 274240 - DNA, 392 bp, Homo sapiens
tcctggactcaagcaatccacccacctcggcctccctaagtgctgggattataggcgtgagccacctcaccaggcctctgtcctagcagtttcttatcagaagttttcagctcaggccaggtgcagtggcttatgcctgtaatcctagtactttgggaggccagggcaggaggattgctgtgctcaggagtttgaaacagcctgggcaacatagtgagaacttgtctctctttaaataagtcttaaaataagttttcagctcagctttttgaggactattctttgactgcatattatttttaatagtgatttataattcctaaacattttcatttacttttctgactataaaagtaatgtgtaatcattgtagaaaatgtaataaagcaaaa

SEQ ID NO: 274241 - DNA, 692 bp, Homo sapiens
ttccaaaaagaagcctcagccatttccaaggagatacgtcttgtgctgctgggagagcttacactatagtctgaacttctacagagccttttcctactgtaaacctcactcaaaaatgacagccttccatttcacaagaatcagagtcttgctatgttgcccacgtggtatcaactcctggcctcaagtgatcttcctgcctcagcttaccaaagtgttgggattacagatgtgagccacagtgcccagtctgtgtgtgtttttataattggaagtacatgacatcttttacacaatatgcaaatgcatattgaggaaggagggagagcaactatgtctaaaagtaatcacaataagtcttgacccattaactgtacagatcaaaatccacaccaattttagattcagagaacactatgtctttttaaaaatctatttagaaactacttacagtattttttagaaaatgcacaggaacccctgttaagaaataaaatattccttgcaatagtttgctgagaatgatggtttccagcttgatccatgtccctatacctaatgttaaatgacgagttactgggtgcagcacaccaatatggcacatgtatacatatgtaactaacctgcacgttgtgcacgtgtaccctaaaacttaaagtataataaaataaataaataaataaaatattcct

SEQ ID NO: 274242 - DNA, 819 bp, Homo sapiens
aaagaagcctcagcaatctccaaggaggtatgaagttggatcacctctgtccatttcactttgctgatatgaggatatattgagagagagagagtgcatgtgtgtgtgcatatgtgtgtgtgtgtgtccagaccaacaccaggcataatactacaacaagatacgtcttgtgctgctgggagagcttacactatagtctgaacttctacagagccttttcctactgtaaacctcactcaaaaatgacagccttccatttcacaagaatcagagtcttgctatgttgcccacgtggtatcaactcctggcctcaagtgatcttcctgcctcagcttaccaaagtgttgggattacagatgtgagccacagtgcccagtctgtgtgtgtttttataattggaagtacatgacatcttttacacaatatgcaaatgcatattgaggaaggagggagagcaactatgtctaaaagtaatcacaataagtcttgacccattaactgtacagatcaaaatccacaccaattttagattcagagaacactatgtctttttaaaaatctatttagaaactacttacagtattttttagaaaatgcacaggaacccctgttaagaaataaaatattccttgcaatagtttgctgagaatgatggtttccagcttgatccatgtccctatacctaatgttaaatgacgagttactgggtgcagcacaccaatatggcacatgtatacatatgtaactaacctgcacgttgtgcacgtgtaccctaaaacttaaagtataataaaataaataaataaataaaatattcct

SEQ ID NO: 274243 - DNA, 342 bp, Homo sapiens
ggccaatctgcaaggatataattgaaatgaacaacactattaatcaactttatctaattgatatttatacagaaagaagcctcagcaatctccaaggaggtatgaagttggatcacctctgtccatttcactttgctgatatgaggatatattgagagagagagagtgcatgtgtgtgtgcatatgtgtgtgtgtgtgtccagaccaacaccaggcataatactacaacaaggtatgacttgagtgtatatttatttaatctgaatctttaatatattcacctttacttattgttaaaaaaggtactcttctggccgggcgcggtggctcacgcctgtaatc

SEQ ID NO: 274244 - DNA, 788 bp, Homo sapiens
ggagttttgctctgttgaccaggctggagtgcagtggcatgatctcggctcaccttctgtgactgtctggcaaggtcagaggcatcagggaaggtaaaatactgaaactatatttttaaaaataaaagtattcccttttgagtgtgaattaggaatcaatgccccttctcactacttttgtgaaaaaaatcacagctcctgcagcaagtctatgcctgggtaacaaccaacccacaaaatccaagaggaggtccccctctcccgcctctgtgaggcttgaggagcagtatgtatctgggccagcctggtcctcagagtgtggaattaacacctttcctctagcaactgtttgtgctgctgagaacagcacagactctctggcagcctggttctctccagagggaagcctgtgaagcagaagaaacatatggcatctgcactcagggcgcccagttccatccggccttgctataaaatgactttgcctttccttttttaaaattacaaaaataattcaaccaatacataaacatatgaagtgaatcacggagggccttcctgcgatatctttttttgcctaccatttgtcatggaatgggtaaaggggaccacagagggaagagacgctgccccttcgcagggccatggcagtcccctgggctgcgtctccacggtgcttcctgtgaaacgctgttaccacgggcaccgcactggagaccatgaaagggaagagtttgacatctcagctgtctttgctataaatagaaataaataaaccttaactaagg

SEQ ID NO: 274245 - DNA, 411 bp, Homo sapiens
tgagagatataagatactgcatctagaggataagagtaaaatgatatgaaaaatgaccaaatagagaataagaaactcttgggggataaatgaaatgaaagctaaacttcatattcaataaaatgattttaggccgggcatggtggctcacgcctgtaatcccagcactttgggaggaagaggcaggtggatcacttgatgtcaggagtttgagaccagcctggccaacgtggtgaaaccctgtctctactaaaaatacaaaaattagctgggtgtggtggcgcacgcctgtaatcccagctactcaggaggcttaggcagaatcacttgaacctgggaagtggaggttgcagtgagccaagattgtatcactgcactccagcctgggcgatggagtgagactgtgtctca

SEQ ID NO: 274246 - DNA, 452 bp, Homo sapiens
ttttttttgtactgtaaggagcaaggaggttcatagtctggcttctgggaactgatccaaagttccatccatgttccatcttctagggcagacctcttagaacctgtctccttctgtgagacagctgttgtgcaaacgttaaagcctctggtataggccgcctgttactaaaaaatcagaggacattcctgggaagtaaggatcagaaattggaaaggggaattttgagttttggttttaatatgccacttaagtattgaggctagtaggacacactcagagaaatgaatagaaagttaacaggtcccagcagcagaggtcacatgtaatatcaaaactgcccatgcatctatctcaggctgaacatctaacacttgaaaagggtctaggtatcacagagaaccatagggatttgtacaccaataagagggagaaaagttatcttcatatgt

SEQ ID NO: 274247 - DNA, 196 bp, Homo sapiens
tggatgggtcatagttaaattagccatttacttcagaaactgcagaatatccaggtgagctcacgcaaaaagtggaggggaaggaagagattctggatgtggagtgggaggcgtgattgataatttaatttgctctttttggtgaagaggtgggagtattttcagtagtacctggaatattgcattatgttaagtg

SEQ ID NO: 274248 - DNA, 615 bp, Homo sapiens
tagtgagcttgcacctaaaagtcctagttctgctctttgtagtctcctagaatatgtctgaagtcctttctgcatgaaacctctgaaataatacatgttcattttcaaaattttgtaaaacagtcaggtataaagaagaaaataaaattacctatacccccatctgccagagataaaggatattaatggtctttatccttcctatataaatccgtctgtctctatctgtccatctagaatttttcacaaatttggggtcatgaggtgtgtacaaagtggtatgtttgcagaataggagaatcaaaaggagagactggaaagagataagggccgtgaggccaggctcatgtagggccctgtaagccacaggtgagaaggtaggctttgattctaagtgcaatggggagccattggagaagttaaagaaagggaataccacaatgaaattcatgttttgcacagcccactcccactctcttcccacaacggaggcaggaaggcagttaggggcagttacagtcgtcagagtgagagatgaagggatgagaaattgagaggtggacggaagtggcaaaatgtagaggacttgctactggattggctattgggatgtaa

SEQ ID NO: 274249 - DNA, 682 bp, Homo sapiens
tcaacatcgagaaccccaaccaggtggcacagacaaccaaaaaggtcacacaactgtatctggatgggccaaaggagctttcgaggagagaacgagaagagattgagaagcagaaggcaaaagagcgttacatgaaaatgcacttggccgggaagacagagcaagccaaggctgacctggcccgctggccatcatccggaaacagcgggaggaggctgcccggaagaaggaagaggaaaggaaagcaaaagatgatgccacattgtcaggaaaacgaatgcagtcgctctccctgtataagtaaccgcgacccatgggaggagatgccggggacctgggccgcgctgccaggacctctgctgtgtctcgcccaccctgtgccctggcgccgccgcaacagcccctcgtggccaggagccccccatgcctggggcctcctcttcattatggcttgtccctggtcagtcctgtctgatcgaggcctcgcctctctgcccctccctgcccagttcctacccacctggctaaggccagtgcccatttttaaccctacccattgatcatttcaagaaacctctgtttactgtgtggcacccaggcaaaacatgttccacaagttcaacttgtatatttggcagattaaacttgacattatcgtaaaaaaataaaaataaaaaatata

SEQ ID NO: 274250 - DNA, 446 bp, Homo sapiens
tttagaattcagagcccttgctggggggtgcctgggagatggggtaagaagagctttcatttttctggtagatagcatgtaagggggtggttgtcccaggaggcagctgctgacaggtttgctacacccagccccggactgtgttgcctaggtgctcattcagagaggggctgtcatctgggagcctgtgcccctgggtcctcgagggttatggcttgtccctggtcagtcctgtctgatcgaggcctcgcctctctgcccctccctgcccagttcctacccacctggctaaggccagtgcccatttttaaccctacccattgatcatttcaagaaacctctgtttactgtgtggcacccaggcaaaacatgttccacaagttcaacttgtatatttggcagattaaacttgacattatcgtaaaaaaataaaaataaaaaatata

SEQ ID NO: 274251 - DNA, 444 bp, Homo sapiens
tcagctatttcaaagaagaaggactttgaagtgttgaggtaggagcctgtatcatctctttgctggtttgcagttgctgtgttccaccagcaagtagcaattgggactaaattaccagcattcaaggaatgtgctcacatatttcagagctgttgagaaacatttggctggacaaagtcgagttcaaacaagctataaaccaaaccagggtttggtttaggacatccccccagagtgagttccttggtgccgcacctcagctggtggggtgggcagggagtgttgtattagttttagcttccagagccaatcacagtttcaccatctgcctctcccacatccctggcaggcaggctgaggacagcacccacttaaatggtacctagcccattataaatgcaaacctttttatttccttgtaaataaatctctgcttctttccaa

SEQ ID NO: 274252 - DNA, 298 bp, Homo sapiens
ggcggcatttgagtgtggggttaaagatgggtaggagttcatccgtgagcagtgggtaagaaggaggaggtgctttaagtggtggatccacacaaagagggtatgtgccaaacctatgtgtgccaatgccagtggccatgtagaatgctggagatgggtcaggacagttaggctgggacctgggtgtcaagggccttgactatcatgctaagaaattggactttattcttgagcacaataaagagccactgatggctttaagcagaaatcaacatggtcaaggtggcaagaaaagaag

SEQ ID NO: 274253 - DNA, 473 bp, Homo sapiens
cagaatttgtcttattctgatgtaggatgaccaaaacatctggagaaacaaattgggacccagaagccacttgctccacatctgcagttacaaggcagaacaaatttgccagaaccaagctacagatggggaaactgaggcctggagtaaccagtcatattgcttccatgctgggaactctccaatgacatatcgcacaatacagagccaacctcaagttccccaccatagaccacaaggacttgcaagttctaaccttgcccaatctcccttatacgccctcagtccatgtgcctctgtgatgatggattgggtccttcttggcttcctccaaaggggcagaactgctctggaaggttcctcatggcattggcaatgatcttattctatgctgcttaaagagattaaattgactttgctcttgttacataattaatggttaagaataaaattctgaacattttcaaggaaac

SEQ ID NO: 274254 - DNA, 354 bp, Homo sapiens
ctaaaaaaaaaaaaaaaaaaagtcgaaactatgtagtgtctagagtatactcttagggctatctgattctgatttgataggagctaatttacaactctataaattgtaaaagctggtagcaagacaaaacggtttttgtctataaacaatgacattcttgtctatgcaaattcaacccaatagactttgaattgactttcctccccaaggttggaagaatgtaccgtctatactttcatttcagtcgtcttgatttataaatatgtctggtttttgagttcccctttgaactatctgtaacatcttactggttccttcattacagaatgaaataaaatatttaacacgtgttca

SEQ ID NO: 274255 - DNA, 214 bp, Homo sapiens
ttttttttgtagagacggggtctcactgtgttgcccaggctggtctcgaactcctggcctcaggtgatccacctgcctcagcctcccaaagtgctagggttacaggccacctgtcattctcaagtgagccaccatgctcggcctcccttctcttctcatcccatgggagaaagaaaagacacacaaggcctttccatgagcagcagacaaactg

SEQ ID NO: 274256 - DNA, 574 bp, Homo sapiens
tgaatttcttaagtctttgggtagctacagtaactcatatcaaatgcaaaaacagaagtggttatatctattgaatgttgactaattctctacagattttagatattgtttaaaacaacatatgaaaatgtgtttcctactaaaataataacagatgacatttattgtatgcttaacatgtatcaggtcaggcactgtacatttaactttcaaaataattgttatccttttcttcttgtgatgagtaattaatacagtggtatggtagaactggcatagagagagacaaatagaacaataaagtagaaggattagaacccagagacagatccacacatatatagggctatagctcacaacaaagagagcattgtagatcagcaggaaaaggacagaccattcaataatggtgccaggagagttagttctccatatacggtgtgggtaacaagaaaaagaaggaaattggatcccatcctcacacaatatataagaatacattccaaatggaagtaaggtcttaaacatgaaaggcaaaatgctaaagcttttagaagacaatataaagaaagga

SEQ ID NO: 274257 - DNA, 275 bp, Homo sapiens
aagaaaattgaagattggggtggtggaggcagtagggagatgggattgggcacctcccccgtgctggggcctggatttttgtaaataaatttcccaagcgtttctttccacctggagggaaagggggggacgcccccagtgagattcaaatcacgcatctctactcctctgcgtgagtgcgtgtgtacatgtgcactccccaccctgctcccttcccagagggattgctgtgaaatttttttggtggcaaataaagataaatttcattctgttca

SEQ ID NO: 274258 - DNA, 475 bp, Homo sapiens
ggattgctggagcattgccccagagcactgtccctggagcagacagctcacccgcagtaatggagagaaggtggcacagaggggcaaaggcaggcagacggatgcgtgagggggcggcacctgtggaggttctgttttggtgacttgttttctcaatcaaagaataaacaaggcacttacccaagagtaaatgaagggagaaccccagtttctttaaaaaaaaagaagtgtgtaatcccaacactttagaaggccgaggcgggaggattgcctgagcctaggaattcgagaccagcctgggtaacatagtgagaccccgtctctacaacaagttttaaaaattagttgggcatggtgatacacacctgtagtcacagctattcagtaggctgaggtgggaggattgcttgagccaaggaggtcaagactgcagtgagctgtgattgcaccactgtcagagtgagtccctgtctca

SEQ ID NO: 274259 - DNA, 158 bp, Homo sapiens
tgtactcatccctcaagaagagtttgttgactatgattaaattccaaggaccagtgggggaagtctggaaacccaggaatctccatcaggaatctggggctctgtccagctccccgaaggaaactgcgggtcagatgttttgatttttttttttcttt

SEQ ID NO: 274260 - DNA, 277 bp, Homo sapiens
attttagtgctaccatgggaggaaggagaaagaatgactaaatggttcataaaaccaaacaaaccctgaaggttcacgccattctgcccagtgggccctgtggaacttcgtggggcttgtggtttaggcttcagagctttggggcttctggggtttctgtctatattattcctgcctggatgacatagtgaggtcttcactgctggagaagggagggctggtgggccagaggggagaccctgcagaggtgtgcagtgtccttctctgctgttcatct

SEQ ID NO: 274261 - DNA, 348 bp, Homo sapiens
ctaggctcctaatgttctaccactaatagaagccatgtattggcaaacttgtacaaaagagaaccagacttcaccaagaactagaatctgcaatagtaacatgagtcagcaagagaaaaactttcttatctgggaattacgagatttatccttagagctggaaaaggctgacctgagtatgaggagctcattagttacatctcttggacaaaaccatctacttggcaccggtagttaaatctgagcaatttggtgggacctccatctttggaaagaaaagccacagataaaagcattaagaaaataaaaagtatatttttacctgcaaatggtttgaaagagagttca

SEQ ID NO: 274262 - DNA, 153 bp, Homo sapiens
cagctgcactcattgcctgtactgccctggccgacttgaagatgttgccctccattccacgacttgctatggtttgatctgcagttccgtactattagcctttctaagtcttgcatgaaataaagccagatgagttttgttaacccttcacaa

SEQ ID NO: 274263 - DNA, 406 bp, Homo sapiens
acaaagaggagctggtaccattccttctgaaactattccaatcaatagaaaaagagggaatcctccctaactcattttatgaggccagcatcatcctgataccaaagcctggcagagacctctgcccttcttgccagccatatagtggagtcagcattgcaaccacaacgcagatgcaaagtcaattcataccctctcacacacaactacacacctccagctcaagaactgatagcagactattggacatccaggctaatgttctcctttcaatgtcttccttagggaccaatagtgtaggttggggaatctctcccacattgatggccattttatttttatttttaaaatttttttccaactttattaaggtataattggcaattaaaaatcatatataattaaa

SEQ ID NO: 274264 - DNA, 223 bp, Homo sapiens
gagaagaactaagttatgcaaatcaatgcacccatcaatcgagcatctcaagatctcaataaacaggaggcaacgggaacaccttaaagagggcaataaaggagtgcaatttagttgtattctgtgttgcaacagagaagagcctcgggatcatcaaaacccaaatctggccgggaacagtggctcatgcctggaatcccagcactttgggaggccgagacgg

SEQ ID NO: 274265 - DNA, 690 bp, Homo sapiens
cattaaaaaaaatacacacacacacatatatatacaaaacaacaaatacatatatatacaaaataaacaaaaacagtatttcagcagagcaattctaactgaaaacaatttcagagctacagatgccgccaaaatttttggccttaagtgtacaaatagggcctagattaaagaaagtaatttcccagtctcaggcactagagaaagagaaagaaattgtttaacaagacactgaaagtcaagacagacggtaaggtgggaaattggcagtcagtctaagggaaagccgagggattgcaagttaagtgcagatggagctcagatctgttgctcccaggaaacagtcttcccaattgtctagaatggttaaaaaacaaaaacaaaaaaaacagtatatcaggaaaatggggagggcaaagcatgaagggagttgtttgaatttatttttgatttaaggcataggtcagggaagtagtcctgaaatcaaaaaggaactggcgggcttcactgcttagtgaactcactcaacacccttctctgtggctggtctctgatcactcttccactttgcccaaggaccatcttgctgaatacagaaaactcaagttctttaaagacagcaactattactgtagattctatggcctcatcgtctgtccctagcagagtttaaggcacactataggtggt

SEQ ID NO: 274266 - DNA, 340 bp, Homo sapiens
aaataggccaggctatgatagccaatgtgtgaggtgctatggtttcatcttctttacagagggtttggagtttactcatctttctgttttccatagtgtctactacagcattgtaactaacagttttgtttccaattctagaggcagctgttgtaaagtgggatgataacagccttattggattagtgttgaactagacacattaccaccttgaaggaagaccacagaagggtgctttctgcatcaccttactctccccttggcctcagtatccatatgaactcttctcattaattcttttgaccttcctgtcttttgatttcgaccttcctgcctttct

SEQ ID NO: 274267 - DNA, 401 bp, Homo sapiens
gcaatgcatttacaatctgccttactccacaagtctataggcctttttatcttttatccccactgtctggtagaatacctgatacaaagcaaagggagatcagagccaggtgcgttggctcacacttgtaattcaagcactttgagagggtgagatgggcagatcatttgaggtcagcagttcaagaccagcctggccaaaatggtgacaccccgtctctactaaaaatacaaaaaaaaaaaaaaaaattagccaggcatagtggcaggtgcctgtagtcccagctacttgggaggctgagtcaggagaactacttaagtccaggagatggaggatgcagtaagccaagatcacgccactgcactccagcctgggcaacggagtgagactttgcctcaaag

SEQ ID NO: 274268 - DNA, 619 bp, Homo sapiens
ttcagcacaaatatatctatgtgatacttcagaaatatcaaatatatttatgtgatacttcagattttttgcctggctacccacaatgctagtgcattgtattaagtctaaaaggataatcattttgcatttaagtaccttgttgacattcaagattgtcttgtccacatgtatgtaggagtgaccaccatcttttgctgcacttggctatttaattgattttgtgggcactgtcaactatgcttagtcttcagtaaagaccttcccataaagagcgagctttgaacagcatgttatcaaattttcccagttgttttctgagattatataattttaagctgagatttgtatagggagtcagtaaagcatcaagctctgaagcccagctgcctggatttgaatcatggctctcctacttataacttttaaatcttgggcaagtgagttaccctctgtgccttcatttcctcatgtaaaatgagagtaataacagtaccttttacataaggtcagtgtaaggattcaatgagttttcatgtaaaacatttaaaatgatacttggcatgtaggaggtattcaaagaataataaagataacaatttgctgctattgccattac

SEQ ID NO: 274269 - DNA, 153 bp, Homo sapiens
tatcacacagagcaatttatttaagtgcattttcttctaacgtgttttttccttaatgcaaatgtaaaattttgcattctactttttcttttcttttggcttgatctcatagcatgtttccatgccattacatatatttgaccccacttcatt

SEQ ID NO: 274270 - DNA, 729 bp, Homo sapiens
cacaatggccagggtggcctcagctcagggcctctgtgacatcaccaagggcctggcaccaggtgcccagtcttccagttgcgagggcaagcaaacccgtcatgagcaactcccttccccatctctgctcaccatgtggacgctgaaatcgtccctggtcctgcttctgtgcctcacctgcagctatgcctttatgttctcttctctgagacagaaaactagcgaaccccaggggaaggtgccgtgtggagagcactttcggattcggcagaacctaccagagcacacccaaggctggcttgggagcaaatggctctggcttttgtttgctgttgtgccgtttgtgatactgaagtgtcaaagagacagtgagaagaataaggagcagagtcctcctggccttcgaggcttcccatttcgcactccactaaagaaaaatcaaaatgcttctctttacaaagactgtgtattcaataccttaaacgaacttgaagtggagcttttgaaatttgtgtccgaagtgcagaatcttaaaggtgccatggcaacaggcagtggcagtaacctcaagcttcgaaggtcagagatgcctgcagatccataccatgtcacaatctgtaaaatatggggagaagaaagctctagctgaatggatttgtgtgtcaggagagaaaaaagttgagtgttgacaaactgtatgcaaactaataaaactattctgaagaaaag

SEQ ID NO: 274271 - DNA, 760 bp, Homo sapiens
cacaatggccagggtggcctcagctcagggcctctgtgacatcaccaagggcctggcaccaggtgcccagtcttccagttgcgagggcaagcaaacccgtcatgagcaactcccttccccatctctgctcaccatgtggacgctgaaatcgtccctggtcctgcttctgtgcctcacctgcagctatgcctttatgttctcttctctgagacagaaaactagcgaaccccaggggaaggtgccgtgtggagagcactttcggattcggcagaacctaccagagcacacccaaggctggcttgggagcaaatggctctggcttttgtttgctgttgtgccgtttgtgatactgaagtgtcaaagagacagtgagaagaataaggagcagagtcctcctggccttcgaggcttcccatttcgcactccactaaagaaaaatcaaaatgcttctctttacaaagactgtgtattcaataccttaaacgaacttgaagtggagcttttgaaatttgtgtccgaagtgcagaatcttaaaggtgccatggcaacaggcagtggcagtaacctcaagcttcgaaggtcagagatgcctgcagatccataccatgtcacaatctgtaaaatatggggagaagaaagctctagctgaatggatttgtgtgtcaggagagaaaaaagttgagtgttgacgggcgtgtgttctaagagaatacaactatggtgcccaagctaaagagtaaagatctgtggcggccagact

SEQ ID NO: 274272 - DNA, 575 bp, Homo sapiens
  misc_feature (469)..(469): n is a, c, g, or t
  misc_feature (474)..(474): n is a, c, g, or t
  misc_feature (491)..(491): n is a, c, g, or t
  misc_feature (496)..(496): n is a, c, g, or t
  misc_feature (530)..(530): n is a, c, g, or t
  misc_feature (539)..(539): n is a, c, g, or t
  misc_feature (563)..(563): n is a, c, g, or t
tgtgccaataaaactttatttacaaaaacaggtggagggccaaatttggccatagtctgccagtgcctgcactcgagcactgctagaaccatcttttcttaaatgagcccaactgtcttggaactgtgtcaaaaccagcaaagtccatgatattattgaccttgaatatctttcttgacaggagcagagtcctcctggccttcgaggcttcccatttcgcactccactaaagaaaaatcaaaatgcttctctttacaaagactgtgtattcaataccttaaacgaacttgaagtggagcttttgaaatttgtgtccgaagtgcagaatcttaaaggtgccatggcaacaggcagtggcagtaacctcaagcttcgaaggtcagagatgcctgcagatccataccatgtcacaatcttttgtaatctttcccttgagtggggggggagctgggaaaacaatgactttgtnttacntaaaaaccccatagtanccccnaaaacttccctggcaacccttgaaaaaggactgngttaaccantttaactggggaagggcctttttnggcattttgaac

SEQ ID NO: 274273 - DNA, 1540 bp, Homo sapiens
  misc_feature (1151)..(1152): n is a, c, g, or t
  misc_feature (1230)..(1230): n is a, c, g, or t
cacaatggccagggtggcctcagctcagggcctctgtgacatcaccaagggcctggcaccaggtgcccagtcttccagttgcgagggcaagcaaacccgtcatgagcaactcccttccccatctctgctcaccatgtggacgctgaaatcgtccctggtcctgcttctgtgcctcacctgcagctatgcctttatgttctcttctctgagacagaaaactagcgaaccccaggggaaggtgccgtgtggagagcactttcggattcggcagaacctaccagagcacacccaaggctggcttgggagcaaatggctctggcttttgtttgctgttgtgccgtttgtgatactgaagtgtcaaagagacagtgagaagaataaggtaaggatggctccattttttttacaccatattgattcaatctcaggagtctcagggaaacggatgttctagtgagtctaggcggcaccgttgggtataatgaaccgacctcatggtcctgggcaaagctggcaaattcacttcctgatgtatccttagtgaagacaatagtccccacatccacagatattgggacaaacagtggaagatgacctctagtttcttggctcaaagttcttctggttagatggattttttcaaatgtaggatagattcaagaactcagccgggcgcagtggttcatgctgtaatcccatcactttgggaggccagggcaggtggattgcctgaggtcgggagtttgagaacagcctggccaacacggtgaaaccccatctctactaaaaatacaaaaattagctgggcatggcggcgtgtgtctgtaatcccagctactcgggaggctgaggcagaagaatggcttgaaccctggaggcagaggttgtggtgagctgagatcacactactgcactcctgcatgggcgactgagactctgtctcaaaataaagaacttatggtgtgttttagaaggtcaaaattatattattcacagggccaaattcactgttcccttgctttttacatttttcctagtgtttgacttactgaaaattcctgagctaaatggaaatgatatcatcccaacaaaatatgaaacttctgtaaggagataaaggtgtaggccgggcacagtggctcatgcctgtnntcccagaactttgggaggccgagacgggcagatcacttgaggtcaggagattgagaccagcctggccaacatggtganacctcgtctttactaaaaatacagaaattaggccaggcgcggtggctcacccctgtaatcctagcactttgggaggctgaggcgggtgaatcacgaggtcaggagttcgagaccagctgggcaacatggtgaaaccctgtctctactaaaaatacaaaacctagctgggcgtagtggcgggcgcctgtaatcccagctactcgggaggctgaggcaggagaatcacttgaaccctggaggcagaggtggtagtgagccgagatggagccactgcactccagcccaggtgacagagtgagactctgtctca

SEQ ID NO: 274274 - DNA, 468 bp, Homo sapiens
ggcacccctttgggtcgatttgtgcagctcgatttcattaagtgactggtgtgagttgtgataaagacaattccgtttaggtttccaagctgcgtcctgggcctggagactgagacagagatccacggactgcagtgcaggcagcccaccccagctccgagtcatataaggtaacccagacaaccacctacgaatttaaagctcctataagttgccctttctgcatccgaagtgtgatatttgaaagttaaaaacgttatcttacatacatagatcttaaaacgtatcttacaccacaacctactcacagatgcaaaggcagtggtcatggtcttccattgcttggggtcctggggccgggtttgaggctgaatgtcagggtttcctttgccataacctcattctgcaccacgtgctgtcagccaggcagccaatgtggacttggaggctggcatctgctgggcactg

SEQ ID NO: 274275 - DNA, 1232 bp, Homo sapiens
gccctccccgcccagccgcctccccgtcgaccacccagggctggggcgagccaggctgcctttcgaacttgggggcttctcctcttgtctcccactggtgctctggccgtgaatccatccaggcgccaggagatgacaatccggtaccaaggccggcagtacaggctgaggatggcatttctccaaaaggtttccaagctgcgtcctgggcctggagactgagacagagatccacggactgcagtgcaggcagcccaccccagctccgagtcatataaggttgaaatatcagtaaaaaacatgcagaaccaaagatggggaccaaaatccaaagccagagggtcctggaaatcagagggtcttacaacataacaggcagtacaggccatggctcaggctaggcgtggaacagactgcagttctcttctacaaatcaatctagactggacagacagaactccaagggaggaaagaaaaatgaatctgatgttacttcttgaaaccacattttctgaagtcaccatttttatgtatctatcaactcatcatttttatgtatatatcaatatgattttatgatcttattttttcctactaatgtgatgaattaccttgattgattttagaatattaaatcacttttgtattcctggaataaaccctagatggatgcttgattttttctaattccttagcaaaaatgctaatattttatttaggattttgcatctatattcacaagtgaggatttttttcctctcctgacaccaaccaattctccaacacaaactgagtgtcctacaattcaatttaattctgacactacccagagttagcattagcctccacagatttaaggcctcagccctacaagactgtcccaatcagactccagttgcaagtcctgggccacccatacttctgggcaactggttacaaattgggggttcttatgaccacctcccacaggcttgacaatttgctagaatgattagtggaaagcaagaaagtgcttaacttaatattactggtttattacaaaggatacaattcaggaagagccaaatggaagtgatgcatggagcaaggcaagggagaatgagcacagagctttcctaccctctccaggcacaccactctcccagcaccttgatgtgttcaccaacctggaagctctctgaaccccatcatttagaggttttaatggaagtttcattacataggcatgactt

SEQ ID NO: 274276 - DNA, 225 bp, Homo sapiens
tctctgttcttaacatgctctttttttctgccttcttaaatgtatggaatatagttaaaataactttcaatgttcttatctgctaattctatattttttgtcctgggtctgtttctgttgtagaattttttgcctcatggtttgtattttcctgccttttgtgtgcctagtaattttttattggatgctagacattgtagagtttaccttgttgagtgctagcta

SEQ ID NO: 274277 - DNA, 505 bp, Homo sapiens
ggtcaggttttccttttaaaaggaatgttgaaatatattctttcgaacaagagaagttcaccttatttgtgtttctcctgcttaattgcaatccttaaggaaagtgatttttcagtgcctaagcacagagctggaagctcaataaatgttagttttgttggtttatacgtgaaattgattctcaagtaatagttaagctcagaaaacatataaacaaggctttttgggagagacttcagggtcccatttaacctacatctcctaatattctattcatagaggaaactgatgcctcatggtctctgagtacatctatcccaccattcagttcttctttgggtttcctgtactaatcattgcagttatccttttcctgcaccttacttccttgggctttttgtttaaattaaccagctacctatctccttttcaagtagttacatactatttcttacccttataagacaaatttattaagtatattacacgcttgtacttggatgag

SEQ ID NO: 274278 - DNA, 1263 bp, Homo sapiens
tggactaatacatttgccatctcaaaacacctttattctactttcctgacttgagtggagaagcgagttcagggtagcttggaactgtgaagagtttttgcttcttctctcttgtgcacaagaatataaaatgcttggagccttctccttggacatatattttataaggtttatgtgtttgtattccattttgaatctatattactgcatttgacattcaaccagtttttaaccttaagaataatgagagagttctgaaaagataagcttaataataataacttacttagttgcttacagtcacttttacataaattatctcactgttctattcaggagaattcagtgaaataggaaagatatgtaatatccattttatagataagaaagccacacttagaacacttgtcccaatttacagaacagaaactcgggctttctgtagcatgagaatcagccaggagaactttgtatccccaacaagatgttatagatgttttttgatttgcaatttagataaaatactttgcagcttggaatccatagatttcagtttttctgttgtccaaatgtgaaaagaatttaaatgatgtattggattaagcacagaacatttcaacatgtaatgaaatagattttttttaaggtttttcacatatacctttttttaattgtcagataaaatcatcttaccaattatttatttaagtgagtacaggaggttgcttatactgtttagaataaagttaccatttataggctaaggataaagtaaaggagaccacagtctacaacacagcatgtgaattggatggttaaatttattagcatacaaatttctaaaggcggcaacagagagctgcattaactgcaaaataagctttttttcactgctgttgttgaagcatttataagaaaatttaaagctcagtggactgaaataaattgtgcacattttttcacacatcttgattgacatttctaacaaacttttgctactatgtgacaatatattgctctgctaccagcatagtacactcgaatataacattttcattatttaccctccacttaacattttccaaaatgtcagattgccaagtgtggtggtgtgcacctgttgtcccagcttactcaggaggctgaggcagaaggatcactagagcccaggagttcgaggatgtattgctccatgatggcgcctgtggatagtcactgcacctcagcctggacaatacagcaagacaccatcttttaaaaacc

SEQ ID NO: 274279 - DNA, 831 bp, Homo sapiens
tggactaatacatttgccatctcaaaacacctttattctactttcctgacttgagtggagaagcgagttcagggtagcttggaactgtgaagagtttttgcttcttctctcttgtgcacaagaatataaaatgcttggagccttctccttggacatatattttataaggtttatgtgtttgtattccattttgaatctatattactgcatttgacattcaaccagtttttaaccttaagaataatgagagagttctgaaaagataagcttaataataataacttacttagttgcttacagtcacttttacataaattatctcactgttctattcaggagaattcagtgaaataggaaagatatgtaatatccattttatagataagaaagccacacttagaacacttgtcccaatttacagaacagaaactcgggctttctgtagcatgagaatcagccaggagaactttgtatccccaacaagatgttatagatgttttttgatttgcaatttagataaaatactttgcagcttggaatccatagatttcagtttttctgttgtccaaatgtgaaaagaatttaaatgatgtattggattaagcacagaacatttcaacatgtaatgaaatagattttttttaaggtttttcacatatacctttttttaattgtcagataaaatcatcttaccaattatttatttaagtgagtacaggaggttgccgcctttagaaatttgtatgctaataaatttaaccatccaattcacatgctgtgttgtagactgtggtctcctttactttatccttagcctataaatggtaactt

SEQ ID NO: 274280 - DNA, 482 bp, Homo sapiens
ttagtttggtacctctgttacagttattaactgtagttcatacttcacaacagggctcattttttagtaccttttatgggttttgacaagtgtgtaatgacatgtatctaccattacactatcatacagagtagtttcattgtcctcaaaatgccctgtgctttaattcattctcctttcctccctcctctgaatcactgatgtttttaccctctccatagttttgcttttgccaaactgtcatatagttggaatcacacagcatataacttttcagattgtcttctttcacttaataatatgcacttaggtttcctccatgtctaaatgtggcttaatagcgcatttctttttatcgctgaatatttttcattgtatggatgtaccacagttttgttcatccattcacctattgaaagacatcttggttgcttacaagttttggcaattgtgaataaagctgctataaacattcatgtgca

SEQ ID NO: 274281 - DNA, 296 bp, Homo sapiens
gtgggaactctctccacccatcactttacaagtggtgaggtaggattggaacgtgatggcccaatgtatttaggagaggttgggttaaacaaagtataaacagcttccttattgcaggactttaagagtttttaatatacattgtgactgccccaaaaagggacagttacagcagattttcctagactactttattcccaaatccttttttattcaaagagcagtttccagcactagacagagtttatcgaaatcagtcgaagtgccatggctcagcctgtaatcccaggactttg

SEQ ID NO: 274282 - DNA, 378 bp, Homo sapiens
ggtcttggaagaagacaggaagatgaggaaaagtttggatcagtgtagagacttgtcaaatagttgtaattaaaaaggtgacagaaggatggacagtgatcaccaggcttagaaggtctcacatgaaaatgaggagcttgctgggaactggagccaaggtcacttttgttttttccttagcaaagaacgttgctgcacgatgcccttaacgtggagacgtgtgaaattttgaacatcagggtgataatttagagtgtatctggtggaaggaaattttaggcagcaaagcttaagaggtgtcctgtctgtgtcgaacagcctgtggtcgtatatgtgaccagagaaatgacctcatggtgaaacatatttaaaagtttg

SEQ ID NO: 274283 - DNA, 406 bp, Homo sapiens
gagagagatatgaactagagatataggctggagtgtcattaacatcatgggaacctctagattcaataaaagcccatgggaagaaggtgcagagagctaggagagaaaagagttgaggccagagccttgcaatggtctgctacaaacatcagtttaaaaatgaatgtataattgcaaaccacgatgagtgctataatgaagaggaacctggtgcttgttagagaatataacaaggaaccagaccccatctgggaatcaggcagggcttcctaaggcagtaatgtttaagctgaaagctgaagggtgagtagaagttacacagaatgtctgacatccacagtaaatgccagcttatttaaacatcaggctgagctaaaaggaattcaaaaggtaaacccaatgcttc

SEQ ID NO: 274284 - DNA, 469 bp, Homo sapiens
taaatataaatagacatccaaggaccaccaggcatttgagtacatttggcacaacagaagagaaaggccaagtgaattaacaacaaaataaaaaataaacaataacaacaaaaacagcctgtggaagaaatagaaaaaatttagggaactgtgaaggtcttttgttagtatactcaaaataatctggccaggcatagtggctcacacctctaatcccagcactttgggaggctgaggagggcagatcgcttgaggccaggagttcaagaccagcctggccaacatggcaaaacctcatctctactaaaaatacaaaagttagctggtcacggtggctcacacctgtagtcccagctacttgggaggctaaagtatgagaatcgcttgagcccgggaggcagaggttgcaatgagccaacatcccatcaatgcattccagcctgggcgacagagcgagaccctgtctaaa

SEQ ID NO: 274285 - DNA, 475 bp, Homo sapiens
tttttttaattgagttatttatgcactaacatttaccaaatgggagagttcacataaatacctggattcttggcctgtctttgaaaaatggaagcatgggagtcctggacctgcattcctacatagctgtaatagaccagggccaagaagcagctgcctgctttccaccacacctgtgctccacagagtggcccgtgaccaagcactcttcatgcattacattaccggccatgcccctgcagccttctaagactgcaaccccatctttcatcttctatgattcaggaaagaagggagggaactggaaccttttccagggtcttggagccaggcagagccttgtccttgggctggagctaagacttcctttttttgtttgttttgttgtgttttttttttttgagacggagtctcactctgtcacccaggctggagtgcagtggcgtgatctcggctcactgcaacctccgcctcc

SEQ ID NO: 274286 - DNA, 378 bp, Homo sapiens
gtgagaacatgcggaagactgcacccaactttcaacgccaaatgcaagccccaggtggttttacttgttcttctgaccagctagttcccatgcataagtttgattaatttgctagaacagcacacagaactcaggaatgaccaaccaaatggaacagaagcataaggcctgggagaagggacatgaagcttccatggcctctccaggcacgcctgccctccaggaatttccacgtgctagctatcccagaagctcctgaacccagtcttttagagtttttatggaaattccatttatacaggaatggttgattaggcattggccattagtaatcagctcaacctcagtccctctcaattacaactgtagctaaagaga

SEQ ID NO: 274287 - DNA, 389 bp, Homo sapiens
ccacagtcacaaatttttatttaccatctgctattcccacggtggcaaatgcagaggtagaagtagatgtttggcaggtcacctctcagtgtagtctctgtccctatgtctcaaagatgcagagctgcctcagaaaagggcactggaaccacagaactgattccagttgattgtaatgaatgcagaccccacattcagattacatatggaaaacaacgaagctttattagtactaggctcattcctgggaacataagggggaggggtggagatgcagttcacatactaacccaattaactttcaaatggttttgctgaaaccaggagccaattagaaagaacgtgacatttgcaaaactctgaaatagttgaatagcaactgtgtttac

SEQ ID NO: 274288 - DNA, 569 bp, Homo sapiens
cagtacatgacatagtcactaagttaaattgcactttacgtggcttctattatatcacaattgttttttacttgctcctattatttctcaaaatgtagtcttcagaggaatagcataatatagtgagaagaacactagactagaagtagattcttccactgggcttcttaatacagcagtttctaaccaatcacacacttctctaactttgcgttctttacccatcaaatggaaatgatactactaccttccctcctgtttcctcatggagagcatagaaataaaattaggatatcatgagtataaagggcaaagcaaacagattgtatcattatcatctttttgtcattttggcaagttatctcagtctaattttgtattaaacattctctcacagtaaaagggaccatctgcccttacctctgaagataaactcttgacaagaacagcaagacctctgtgaaaatatgaaaatgacttttatgtatggcagattaacattttttctctccttaccaactctttacttatgctatttttatttaccaaataaaattccatgaaataat

SEQ ID NO: 274289 - DNA, 460 bp, Homo sapiens
gatgtgtgggagggggtggaaggtggcataaaaacgtgaaagtttacagaagttttattcataagcaccaaaacttgaaagcaaccaagctatgtccttcagtaggtgagtagatacataaactgtggtacatccagacaactaaatatcactcagcgctaagaagaaatgagctatcaagccgcaaaatgatacggagtaaacttaaatacatattacaaagtgcaggaagccagtctgaaaaggctacatactctatgattccaactatgtgacattcttgaaaaggcaaaactatggggacagtaaaaagaacagtaattgccacgggtttgggggaaggagaggtgaataggcaaaacatagagagttttttgtttgctttttgtttttgagaaagggtcccactttgtggtccaggctggagtgcactggtgcaatcttggctcactgtagcctc

SEQ ID NO: 274290 - DNA, 217 bp, Homo sapiens
cctgcctcagcctctcaagtagctgggaccacaggtgcatgccaccacacctggctagttttttactttttagagatggggtcttgattgttgcccaggctagataatgcatttttgacattaaatccccccaaaatggtgttgcatccctcccagagcatcctatcgtggggtttatgatactgacctgtcttttactggtgatgacggtcatgat

SEQ ID NO: 274291 - DNA, 347 bp, Homo sapiens
aaagccactagacagcaacttttaagactccaccctggggttccccactccaggggtcaccagaattctgaggcaggcactctgctgtgtcccctgaggcccacagcagccccagggtctgggggactcagggaggacctcctagcatcctgacctcctccagccctggttgcagcccacagacccagatcaatatggccttaatggtgtggctcccagggattaagcagccaaggccagagacctgaatgggtttagaggctgagaagggatttaatcaaggtagccctccatacagttcctcctgacaccctcctctcctgtttccagtccctggagatgacaaa

SEQ ID NO: 274292 - DNA, 419 bp, Homo sapiens
gatccccaaattcatatgttgaagtcccaactccaaatgtatttggaggtgggcctttcagacgtaattgagtttagatgacgtcatgagggtggagcccccatgatgacactaagtccttctaagaaaaggaagagagtctgagccctcctctacaccatgtgagggcacagagagagagcagccatcaacaagctgagagaggaggactgagaatgaaacctacctcgccagaaccttgtcatatcccttcccggtttccaaacgagtgagaaatcaatttctgttgtgtaagctactcagtgtatgaaactttgttatggcagccagagcagattaatgcatgcttcttggactttgtttttaactcaatatgaaaaacatatgttttaataaaaaaattaccccattcatctgta

SEQ ID NO: 274293 - DNA, 317 bp, Homo sapiens
aatgtacagtcaactgtatattttgtgtttcaggaaactgttaatgacttgggctttggaagtagctgttgtaatgaagaagtccgaaacatatgcacctttattctgtcttccgtctttccataaattttgcaaaggccttttagccgacagtaagactctggttttttttttctattttgtttatcagtccttaaaagggtctttggtaatgggagatggtcatgaatcgagctcttttcctgacctgaagatgtgtaatcctcattttaatgacagatacacagtcttgattttttttcattcttagtattaga

SEQ ID NO: 274294 - DNA, 291 bp, Homo sapiens
ttgagacacttaacctcccggcctccaggagcctggagcctgtcctccctgggctctgagctttgtgcagattaactgcctgctgattacagagagctatataaatgctaagtggagtggagatagggcgatcctgggggacgggagcccgtggtccaggctcccagctgtctgcagaggcagagaggctccatctgccatgcccacccctttcccctaccctgccccaggcacgttgcaggtcatccacaggagagagagcctccaggaacaatggaaacttccctagag

SEQ ID NO: 274295 - DNA, 592 bp, Homo sapiens
caccatgtcccgctgcgcccgctgctgctggccctggcccttgcctccgtgccttgcgcccaggcgcctgccccgcctccgccgacctcaagcactcggacgggacgcgcacttgcgccaagctctatgacaagagcgacccctactatgagaactgctgcgggggcgccgagctgtcgctggagtcgggcgcagacctgccctacctgccctccaactgggccaacaccgcctcctcacttgtggtggccccgcgctgcgagctcaccgtgtggtcccggcaaggcaaggcgggcaagacgcacaagttctctgccggcacctacccgcgcctggaggagtaccgccggggcatcttaggagactggtccaacgctatctccgcgctctactgcaggtgcagctgatgcattgctggtctctcatctgcagcttccacagagtgccaagcccctcactcagcccatccctgggctctgctccggggccccaagacccaggaggaggagcgttctgcctgccccctcccacctcccctgcaatacagcctttgtgcagttgtaaaaaacaacaaacaacaaaacaaacaggg

SEQ ID NO: 274296 - DNA, 664 bp, Homo sapiens
cccagactccccagcccccacccagtctcaggcttctagaactcaccagactctgggtctctgagagcccctggaaggaattcttgattacatttcaggtgcagctgatgcattgctggtctctcatctgcagcttccacagagtgccaagcccctcactcagcccatccctgggctctgctccggggccccaagacccaggaggaggagcgttctgcctgccccctcccacctcccctgcaatacagcctttgtgcagttgtcttgaaaaaaaaaaaaaaatcaatacaagaaaaaaaacaaaaacaaaacaattttgacaacaaacaaaacaaaaaaaaaaagggggggcgcggcgcaaaaaagtgactcctccccaacgggaaggggccccaacagagtgaggcgagcccccagcaccgtttttctgtagaccaaacaagaggtggcgcccccccaagtaggagagggccggcgtatatatagacaacgcaaagaggaagcagcggcggcacgacgtggtactatacaacagcgggtctggtcgcgtggggaggacaacacgtggcgtacgaccgtggagaactcatctggggagagcgaccgagcacacataacttcctgggggggtgagacaacaacattggtgacaacaacatcacca

SEQ ID NO: 274297 - DNA, 562 bp, Homo sapiens
caccatgtcccgctgcgcccgctgctgctggccctggcccttgcctccgtgccttgcgcccaggcgcctgccccgcctccgccgacctcaagcactcggacgggacgcgcacttgcgccaagctctatgacaagagcgacccctactatgagaactgctgcgggggcgccgagctgtcgctggagtcgggcgcagacctgccctacctgccctccaactgggccaacaccgcctcctcacttgtggtggccccgcgctgcgagctcaccgtgtggtcccggcaaggcaaggcgggcaagacgcacaagttctctgccggcacctacccgcgcctggaggagtaccgccggggcatcttaggagactggtccaacgctatctccgcgctctactgcaggtgcagctgatgcattgctggtctctcatctgcagcttccacagagtgccaagcccctcactcagcccatccctgggctctgctccggggccccaagacccaggaggaggagcgttctgcctgccccctcccacctcccctgcaatacagcctttgtgcagttgt

SEQ ID NO: 274298 - DNA, 1563 bp, Homo sapiens
cccacgcgtccgctgaggaacagacgttccctggcggccctggcgccttcaaacccagacatgctgctgctgctgctgctgctgcccctgctctgggggacaaaggggatggagggagacagacaatatggggatggttacttgctgcaagtgcaggagctggtgacggtgcaggagggcctgtgtgtccatgtgccctgctccttctcctacccccaggatggctggactgactctgacccagttcatggctactggttccgggcaggagacagaccataccaagacgctccagtggccacaaacaacccagacagagaagtgcaggcagagacccagggccgattccaactccttggggacatttggagcaacgactgctccctgagcatcagagacgccaggaagagggataaggggtcatatttctttcggctagagagaggaagcatgaaatggagttacaaatcacagttgaattacaaaactaagcagctgtctgtgtttgtgacagaccctccttggaacttgaccatgactgtcttccaaggagatgccacagcatccacagccctgggaaatggctcatctctttcagtccttgagggccagtctctgcgcctggtctgtgctgtcaacagcaatccccctgccaggctgagctggacccgggggagcctgaccctgtgcccctcacggtcctcaaaccctgggctgctggagctgcctcgagtgcacgtgagggatgaaggggaattcacctgccgagctcagaacgctcagggctcccagcacatttccctgagcctctccctgcagaatgagggcacaggcacctcaagacctgtatcacaagtgacactggcagcagtcgggggagctggagccacagccctggccttcctgtccttctgcatcatcttcatcatagtgaggtcctgcaggaagaaatcggcaaggccagcagcgggcgtgggggatacaggcatggaagatgcaaaggccatcaggggctcggcctctcagggacccctgactgaatcctggaaagatggcaaccccctgaagaagcctcccccagctgttgccccctcgtcaggggaggaaggagagctccattatgcaaccctcagcttccataaagtgaagcctcaggacccgcagggacaggaggccactgacagtgaatactcggagatcaagatccacaagcgagaaactgcagagactcaggcctgtttgaggaatcacaacccctccagcaaagaagtcagaggctgattctcacagaacaagaaccctctagagccccatgctatgcagtaggtcaccagggctccctcctcctgtctaaccaaaacttggaccaatgtctcccctttccccggctaccagggacccatccctgcctctagcttctactacccaccattctcctctcgacctctctgaggttgactattttagattccacatagagatgaggtcatgtggtacttgcctctctgtgtgtggctcattttacacaaaaaaatatcccctaggttcatccatgttctctca

SEQ ID NO: 274299 - DNA, 2890 bp, Homo sapiens
cccacgcgtccgctgaggaacagacgttccctggcggccctggcgccttcaaacccagacatgctgctgctgctgctgctgctgcccctgctctgggggacaaaggggatggagggagacagacaatatggggatggttacttgctgcaagtgcaggagctggtgacggtgcaggagggcctgtgtgtccatgtgccctgctccttctcctacccccaggatggctggactgactctgacccagttcatggctactggttccgggcaggagacagaccataccaagacgctccagtggccacaaacaacccagacagagaagtgcaggcagagacccagggccgattccaactccttggggacatttggagcaacgactgctccctgagcatcagagacgccaggaagagggataaggggtcatatttctttcggctagagagaggaagcatgaaatggagttacaaatcacagttgaattacaaaactaagcagctgtctgtgtttgtgacagccctgacccataggcctgacatcctcatcctagggaccctagagtctggccactccaggaacctgacctgctctgtgccctgggcctgtaagcaggggacaccccccatgatctcctggattggggcctccgtgtcctccccgggccccactactgcccgctcctcagtgctcacccttaccccaaagccccaggaccacggcaccagcctcacctgtcaggtgaccttgcctgggacaggtgtgaccacgaccagtaccgtccgcctcgatgtgtcctaccctccttggaacttgaccatgactgtcttccaaggagatgccacagcatccacagccctgggaaatggctcatctctttcagtccttgagggccagtctctgcgcctggtctgtgctgtcaacagcaatccccctgccaggctgagctggacccgggggagcctgaccctgtgcccctcacggtcctcaaaccctgggctgctggagctgcctcgagtgcacgtgagggatgaaggggaattcacctgccgagctcagaacgctcagggctcccagcacatttccctgagcctctccctgcagaatgagggcacaggcacctcaagacctgtatcacaagtgacactggcagcagtcgggggagctggagccacagccctggccttcctgtccttctgcatcatcttcatcatagtgaggtcctgcaggaagaaatcggcaaggccagcagcgggcgtgggggatacaggcatggaagatgcaaaggccatcaggggctcggcctctcaggtgagtgatgtgggcttctccacaccgagcatccagcctggacacctctgacaggattggcccccaggatcgctctctttggtatggccaaagtcacttcctcgtctcctcctccttcccacaggccggcttctacaggactcccccatcttgctgacagcatggcagtccctacccccaatttttcccaggccaggcactgagtaggagttatctcctctctgtcctccttttcttctctatagccccgattcaccatctctcctccatttttcctccccaagaatagctggcatctcttctccctggccccagccatcctgacccctctcattatttttcctattggcgggacctgatttctttgaccggcttgtcatccttacgccactaacctgtgagcttccccaggtcaggtatcatgtctcaattaaggccctgtaattctctctcatttactctcgttttgcccgttgtatcataatttacatgtagatactcatttcttatttttatttttttctcgaggcagaatcttgctctgtcacctaggctggagtgcagtggggcaatctcggctcactgcaacctctgcctcccaggttcaagcaattctcctgcctcagcctcccaagtagccgggattgcaggcgcgcgccaccaggccaggctaatttttgtatttttagtagagacggggtttcaccgtgtcggccagctggtctcgaactcctgacctcgtgatccgcccgcctcagcctcccaaagtgttaggattaggggcatgagccaccgcacccagcttgcattgaatattttcaaggagctaaaagaagattttaaatggtctcacaaaaacagataaatatttgcacagatgggtgtgctaatcattgtgccttgatggttccacgatgtatccgggtgtggaaatctcactgggtctctctcaaggccactcggctactcaggacagggctggaatttaaagcctgtccgattctgaggtctcttctctcatctagcactgagtcaagcaatcagcaggctgggcaccccttagccataagttttcaggaaataaattccttgagggcattgacttttacaaaagagggagcagcaatggcctagagtctcaggaacaagacaggtgcactgaggagatgaaggccgggaccccctgcccaacctgtatggcgggtctgtacttattttgtttacccccaatttaaaacgtttttttttattgcaggttgtttgtttgatatggtttggctgtgtccccacccaaatcttatctagaattgtaatcagaattataatccccatgtgttgggggagggacctggtgggaggtgataggatcatgggggtggttcccccatgctgttctgatagtgagtgagttatcacgagatctgatggttttgtaagtggtggtttcccctgctcttctctcttgcctgccaccatgtaagatgtgcctggttccccttccgccatgattgtaagtttcctgaggcctcccccgccatgtggaactgtgagtcaattacacctctttcatttataaattactcag

SEQ ID NO: 274300 - DNA, 458 bp, Homo sapiens
gatgtttgtctgtccagtgtgtagtcctgtcagtttggggagactgcctgagatggtgccggggacacctggctggacttaaggaaagcatcagggatgcctggatgtgacagtcagtgttggttttctgcacagtaagaaaagttgagagctcaaatgattaacctgcaactatggagttaagttgagtcttctaatactatcttcctctcttctgcctgctttgaatctgttgctactaagctgttggtgctgaggtaagactcattatttatggtctaactgaaatataaacattggaaactcatttgaaactgaaggaaacaacgggtaaaagaggttttttaaaacaaactgtcatagagactgctttacccaaattttggtccacaactttccttagattatctattggggtaaacaaaatttagccatgtgaacaggttccaattttgtac

SEQ ID NO: 274301 - DNA, 253 bp, Homo sapiens
cctgctcccacctgccttttgctctgctatcgggcagatggcattgtctctgctttgcaactgatgaaataggaactctggcttctgggctaggctgagagggtgcttgctgctgccattccgggcccaggtgagacattcggtcatgagcatctgtagctcttgcctgagcctctgagcctgccagggcagagcagaagcaaatgcatgaaggcccctcccccaggggctgctcttagccagtgactgatga

SEQ ID NO: 274302 - DNA, 618 bp, Homo sapiens
acagacattcatacattgttcatgagagtgtaaaatgggacagctcctataaagaataggcaatagctaataaaattttatgtgtagtgggctgggcgtggtggctcacgcctgtaatcccagcactttgggaggccaaggcgggtggatcatctcaggacaggagctcgagaccagcctggccaacatggtgaaaccccgtctctactaaaaatacaaaaattagctgggtgtggtggcaggcacctgtaatcccagctactcaggaggctgaggcggaagaatcacttgaactcaggaggcagaggttgcaatgagccgagatcgcgccattgtactccagcttaggcaacgagcaaaactccatctcaaaaaaaaaaaaatttatgcgtagctactctttgagccagcaatcccacttctgggaattttctctgaggaaaacgccatatgcacagagttattggatgtggcattataatagcaaattactcaaaataatctaaatgtccttccaaggaaaccatttgaataaacattgtgcaatccctatcatggaatactatgcagctacatagaaataaataattaaaaacaagctctctatgttctaatatg

SEQ ID NO: 274303 - DNA, 374 bp, Homo sapiens
gcttttcctgactccgcgttgcaggaggtcacccgagtctgtcttgtgacacccactgtcgttctgacagagccacgtggtgctgggactgaaggagaggggagtgggtaacaaaggagagtagagggagaaccacagcaaggaggaagcctaggaagttgggggtgctagagagtgggaacaaaggagatgtaacagggaaaagggaatttaacagggaagagggattttaacagggagagcagacagggagctcagatgggggaaaagaggcaggaatacgtggcggctggggacaatgggaaagtttggggagaaagagcaacaagaggtgaaataaatttcgaagcattgggcagaatagacataaaaga

SEQ ID NO: 274304 - DNA, 290 bp, Homo sapiens
gcttttcctgactccgcgttgcaggaggtcacccgagtctgtcttgtgacacccactgtcgttccttcccaaatttttactccactggaaaatgtgctcttccgggaggtgggcatcgtattcctcccctttcctcctgaatgtgtgggtgagagggatcaggagaggaaaagagggggagcgacgggacagaaagaaaaactggggagaaaagaatgagtacacggcaaaatggatgataatttaggtactggcaaagagagcaagagtgcaagaggacgcatggagaa

SEQ ID NO: 274305 - DNA, 542 bp, Homo sapiens
caggcccacgaacctgaacagaacgcgagccggggccgcgggcgcgccggcctcctttcagtgcgcccgcctcgcctccagacgtgccgtctcgccagctgcctcagcagcgctcggactcagcgggactctgccccgactcggtgccggagcttctgtcctttgcgctccgccccctagggacaagacctccccagagcgctttccgaaacagacacagcgctgctcacacacacacacacacacacacacacacacaatgccccgcgcggtgcccgctcgcccgcccacccgccctcggtttcgatgcgcccggagcgatcctccttccctctcctcgggggagggtgggtcacttcgcggcgctcggtgaacgccgaggaaaggggaagccgcgagccgcctacgggcagcgggcgcggggctggtcccgggtcacagagggagccgcagggttggcagcgaagcgcggggcgtttctgagcggcgggcgcagggaggtcgcaggtcaagccggagggtgggtccgctctcgcggccgc

SEQ ID NO: 274306 - DNA, 403 bp, Homo sapiens
ttttttcttttgagaagtctcactctgtcgctcaggctggagtgcagtggcgcaatctcggctgcctgcaagctctgcctcctgggttcatgctattctcctgcctcagcctccctaggagctgagactgcaggcgcccaccaccacgcctagctaatttttttgtattttttagtagagacggggtttcaccgtgttagctaggatggtctcaatctcctgacctcgtgatccacccgtctcggcctcccaaagtgctgggattaagggcgtgagccgccgtgcctggcctcaattttcttaaatagacaaaatacttgaatacatatttttccaagaatacatgaaaatggtaattgagtacataaaagatgataaaattaattagtcatcattaaaatgc

SEQ ID NO: 274307 - DNA, 399 bp, Homo sapiens
actttggtgagactctggtgagcaccggcctctactccagtccccggccaggcagacctcagccccagaaaccctcctgagttacaaattaggaaaccgaagcccaggccaggcatgtggctcaagcctgtaatcccagcactttgggaggccgaggcaggtagatcacttaaggtcaggagtttaagaccggcctggccaacgtggttaaaccccgtctctacttaaaatacaaaaattagccagatgtggtggcgtgtgactgtaatcccagctactggggaggcagaggcaggaaaattgcttgaaaacgggaggtggaagttgcagtgagccgagatcacactactgcactccagcctgggcaacagagtgagactacatctcaaaaaaaaaaaa

SEQ ID NO: 274308 - DNA, 216 bp, Homo sapiens
ttgagttgtttccacattattgctattgtgtataaataactctacaatgagtagtcttatgcttgtattgttttatatttgtcaagttgtatcttcatagtaaattcctagaagttgcattactgggccaaaagataaataatatatgagcattaggctgggcgcggtggctcacgcctgtaatcccagcactttgggaggtcgaggcgggtggat

SEQ ID NO: 274309 - DNA, 442 bp, Homo sapiens
atacaatacatgattattaactatatttacctagctgtgctaaagatcaccagaacttatttctcctaactgaaattttgtacccttttgcaaacatttcccctttccctgctcacaccaccccactttcccagcctctggtaatcaccattctactctctacttctatgagtttggctgtgttagattccacatacatgatattatgtgatatttgtctttctgtgcctggttcatttcacgcagcattatgtcctctagactcatctatgttgtttgtaataatagaattgcattcattgtaaagacgaatagtatttcattgtgtatatataccacattcaagaaatccatttatctattgatggacacttagtttatttccatatcttggctattgtgaataatgctgcaataaacatcagagtgcagatatcttttc

SEQ ID NO: 274310 - DNA, 294 bp, Homo sapiens
  misc_feature (61)..(61): n is a, c, g, or t
tgaaatgggttaatataaattatatctgttttctcattgggcgtaaatgcagaacttccancctcaagcagccaccccctgattttacagtttttgggggttcattttgtttggggctcttttctgatggctgttctgttcaaaaccaatctattctggccactgttaaaggtttatactctctgtgaataaagtaggaatatgctagcagtacgaaagagattttgtaaaactgttaatgctaattacaaatggtgcttctagtaaataaagctggcctccttaaaactcaaa

SEQ ID NO: 274311 - DNA, 386 bp, Homo sapiens
gagagggagtctcgttctgttgcccaggctggagtgcagtggtgtgatctcagctcactgcagcctccgcttctggagttcaagtgattctcctgcctcagcctcccaagttgctgggattacaggcatctgccgccacgcccggctaattttgtatttttagtagaggcaggatttcacgttggccaggctgctctcagtctcccaaagtgccaggattacgggtgcgagccaccatgcttggcctaaaatttttctaaaataaaaactttttaaccaaagaaaaaaagaaaatcacccacttccctcacactgcattcctgcaaagacaaaatgccccgtatgcggtgattgcttccctccccaattctgagcagatgctgctc

SEQ ID NO: 274312 - DNA, 408 bp, Homo sapiens
atggacagtcactgccaggagaggcccctgcgtgtcctgggaacctgggattcagtgcgtgctcagagacgttttaggagtgcaagatttaccataggcttggcgatgtcttttgtttatttttaagttaactgaaacaacccaggaactggatttcttcaaatttaccaatttatactttaatttgggaaaaggaaaagccctcaaaaataaatttaattagtcaatctataattatgatacgaataagttccacttaaatataatattcccagcataataatttgttgagtaaatcaaatcgttgatacatcttagtgttcctaaagttaggaaatcatctaagcttcataaaaagaaagcatttcacgtatttaaattttccccatggcctccatgactttttca

SEQ ID NO: 274313 - DNA, 388 bp, Homo sapiens
tcaatgcttctccctacacatgcttccctcagctttgtagagcaactctggaaatcattcatgaaggatacgtagaaaaggcttctcagctggacacggtgcctcacacttgtaatcccagcactttaggaggccaaggtgggcaaatcatgtgggtcaggagttcaagaccagcctggccagcatggtgaaacgccattgtctactaaaaatacaaaaattagctgggcgtggtggcgggcacctgtaatcccagctactcgggaggcaaaggcaggagaatcgctgaaaaaccgcttgaaccttggaggtggaagttgcagtgagccgagaccacgccactgcactccagcatgggcaacagagtgagactccatctcaaaaacaa

SEQ ID NO: 274314 - DNA, 713 bp, Homo sapiens
aaaaggggtgagatgaatagatggagtacagtggatattttaagacaataaaactattttgtataatgcaataatggatacatgtcatgtcatcatgcatttgtcaaaatccacagagtgtaaaacagaaaacatgaattcgaatgcaaactttagattttagttaataacttttctatattagttcattaagagtaacaaatatgccacactaatgtaaggtgttaataatagaggagaagctgggtgtggggagaggatatatgggaactctgtatgttccgctcaatgtttatgtaaactcgatactcatctaaaaaataagtcatattaaatatcccagtgatgactatcaaaagtagaatagatttaaaaattatactatgttcatataattgaatatagtactatgcagcaattaaaataaataaattctgatgttaaatgtcatcaccatgatggtaatcacaaaaagaagctatagaatatacacaaaggaaataaaaagttaaaatattttactaaaaaaaattaacccaatacataagaagaaaataatgtagaaaatgtaaaataaaaagacgtaaggtatacagaaaacaaatagcaaaatgacagaaatctacctatgaataattattttaaatgtaaatggattgaactatcaaattaaaaggcagagatcagcaaaacagactaaaaaacatgatgca

SEQ ID NO: 274315 - DNA, 187 bp, Homo sapiens
catacgactatcatcaactgcatattttcccaggcttcttgcctttagttaatcaagtaatcactttgaaatcacaggagttggtttggttgtcattagcaaattggattgctacctaaaagcaacatctctctcctctcagactttttttttttttcattaattctgccactgtactagcctcatc

SEQ ID NO: 274316 - DNA, 520 bp, Homo sapiens
gttttgaagattaaatcagataacatgtcaaatatttaatactttgctgctattcttactgtgtgaatatgtacaatatgatacctgtttgtaggcagctgatattttgtgttactgtttgcattaatttaacattaatgggtaaagatggcaggtgaaaactcctaaacatctgggggccgaaatggcagtggactccttactgaaaacaaggagataaagtgaaactctgcatactgaacaatgagctagcttcttgccttatttcgtctctgagaactgacagctcagttcctactacctgagatagatttctctccagaaaaactgacccatcctgaagaaaaacctttaaaaaacaatgctgggggtgtgaggctgaggaaaatgttttgctgttcccttacctataatgaagctcaccactgaaaatatgaaggatcctgagataattacggccaagcttctaacttgaaagactatgaccaaaccaaacagcaaaaaggaacttaaaggaaat

SEQ ID NO: 274317 - DNA, 574 bp, Homo sapiens
gttttgaagattaaatcagataacatgtcaaatatttaatactttgctgctattcttactgtgtgaatatgtacaatatgatacctgtttgtaggcagctgatattttgtgttactgtttgcattaatttaacattaatgggtaaagatggcaggtgaaaactcctaaacatctgggggccgaaatggcagtggactccttactgaaaacaaggagataaagtgaaactctgcatactgaacaatgagctagcttcttgccttatttcgtctctgagaactgacagctcagttcctactacctgagatagatttctctccagaaaaactgacccatcctgaagaaaaacctttaaaaaacaatgctgggggtgtgaggctgaggaaaatgttttgctgttcccttacctataatgaagctcaccactgaaaagtcctacccatgtacacagagatgttccagatagctttctctgtgtctctcaaatatgaaggatcctgagataattacggccaagcttctaacttgaaagactatgaccaaaccaaacagcaaaaaggaacttaaaggaaat

SEQ ID NO: 274318 - DNA, 408 bp, Homo sapiens
tagtgttaagtcccttagttttattgagaaacattttcttacatggtagagtgaaagcttttcattcaatgctacatctaaaattcacaatttcaaactgcgcttaatctgtaagcaaagtcccagctcctctaactctaatgtatgtttcttcaacaaaaggctaccttaatataagcagcatggagactcttttgatttatccagtgggtaaaatctgaaagcttttggaggcaaaaggatttcatataacaagtagcaaatctcttgtctcagaggcctgaagaggcaagtcagagaatcagtggttctttaatttttgaatgtaatgaaaaatgtaggtgaagatctctctccagtaaacactgattagatacgtgaataaaagcacctaaattattctgttcc

SEQ ID NO: 274319 - DNA, 480 bp, Homo sapiens
ttctttcctgcaccaggttctatggagaattggttgcatggtttctcgtgctgtgggcatcagggacttcaggtgaaggtatttagctgtggctttgtgcaaacctcagaactgtgtcctccaagggcctggggtatttggcaggcgctgtctcttgctgcctttgctgctgtatgacagacaaaatagaagccacctggaggcaacttcctcacccatcgacaagctcaccagccttcatgcctgtcctttggagcttccctgcagacagtggcagccaccttcctcgggaaccaccttcctgggcctctccttcagtcaagctgcacagcagcattttctacacttgctctggcggcatcctcactgtcatgcactagcggttgttggtgaggttcttcaggctgcagatggagacatgggaagggctggactggctccccttctcactgtggctgggcagggtagggggtaccccgg

SEQ ID NO: 274320 - DNA, 1196 bp, Homo sapiens
attcgaaacactgtccctgcgagttctttaagttccctgcaatctgtacacaagagaaagagggagagagagagggagagagacagagagagcagggatcaggtaaaggagtggggctgctgcagccattcagacctcaggagctggaaaattgccaaggatgcagaaggaaatgaagatgatcaaagacgaggatgtgcatttcgacttggctgtagagaagaccccctcctttccccactgcctgcagccagtggcttctcggggaaaggctccccaaagacaccccttcccggaagctctccgagggccattttcccagtttcggtatgaacctcccccaggagacctagatgggttccccggggtcttcgaaggagcagggtctaggaaacggaagagcatgcccacaaagatgccctataaccaccctgcagaagaagtcaccctcgccctccactcagaggagaacaaaaaccacggccttcccaacctccctttgctgttcccgcagcccccgcgccccaagtatgactctcagatgatcgacctgtgcaacgtgggcttccaattctaccgcagcctggaacactttgggggcaagcccgtcaagcaggaacccattaagcccagcgccgtgtggccccagccaacgcccactccattcctgcccacgccctacccctactaccccaaagtccacccgggcctcatgttccccttcttcgtgccctcgtcctcgcccttccccttcagccggcacaccttcctgcccaagcagcccccggaacctctgctgccccggaaagccgagccccaggagagcgaggagaccaagcagaaggtggagagggtggacgtgaacgtgcagatcgatgacagctactacgtggacgtgggcggctcgcagaagcgctggcagtgccccacctgcgagaagtcctacacctccaagtacaacctggtcacccacatcctgggccacagtgggatcaagccgcacgcgtgcacgcactgcgggaagctcttcaagcagctcagccacctgcatacccacatgctgacccaccagggcacgcggccccacaagtgccaggtgtgccacaaggccttcacccagaccagccacctgaagcgccacatgatgcagcacagcgaggtgaagccgcacaactgccgcgtgtgcggccgcggct

SEQ ID NO: 274321 - DNA, 436 bp, Homo sapiens
tctctttcttaagtcattcgaaacactgtccctgcgagttctttaagttccctgcaatctgtacacaagagaaagagggagagagagagggagagagacagagagagcagggatcaggtaaaggagtggggctgctgcagccattcagacctcaggagctggtaagttacccatgcaatcatttctgcttccttttcaaggttcctgggtggatactgctgtgggcatcttcaacagaaaataccttactgggagtagtccttaaccaaagggtataagtgatagatggcccagaatttcagctaatacttttttttggtaagagaatactgatgctttgcagaactaaggctggcaaaactagaaatagaattacattgggactaaagaggacactgcgttaaatctgaattttggcacagatcatgtggctggg

SEQ ID NO: 274322 - DNA, 214 bp, Homo sapiens
cctcacggtggcctgttgatgcccaactcatgcctctggcaccctgcccagaggcgtgagtccctgcctcacaccgacccctcccacgctgaggaaggtcggcatgagccccttgcctcacaccggcccctcccacgctgagagaggtcggcgtgagccccttgcctcacaccggcccctcccatgctgaccccttgcctcacaccggcccctc

SEQ ID NO: 274323 - DNA, 1267 bp, Homo sapiens
agactcataaagtataagcttttagtgtctgaactttgtatctattttgaatgtacagaagcctttttgttggcttgtttctcatgtaatcctttcaagaattaaataagaattgtacttgagtcatttctgaataaaaaatgcattatatacctgtcaaaagccaggtgacaagaggtgacaagtagttacttaaaggtaacgactaaaactttggaaaaatatcagtattacagaaaatacagacaagttacataagtattttcatgtaagaagccaagtgtctgaatataaattattttccaactttggtttctctgatatttagttcacactcacttaatcaagttctcatttagatgtacttaaaaatctgatgaataacaatgagaagatatcataaatagcactatatgatcatttaataatattttatcaagaaatgacaatctcctgagtattcaaaaacataaatctttgcttttcaactttaagtatctgtcagccttccaaatactgaatagctaacagcataatgtggtcaaactaaagtgaaagagaataatattcaaatatctctcttatttaaaacacacaatacacataaaataatatgtctggctatctgcaaatatcttactaaaaaataaaaacccttaaccttttattttaatatagtttaatgaattatgttgagattgtagccttgggaaattttctcttgatggaaaaatattaaagcatttataaaaataaaatcccaacacagcaatgaacataagcaacatttaacacactaatctactggaaaaatattttttaagtcacatgaatatgtaaaagtcaagcagatattatgaatataggcaaacaaattttggtttatcaaatggataaaaaaaattttataaaaatgggctctctattggaaagtcccaactctacttcccaataaatccaatttgtaaagatagcaagaaaacttcaataataactttggtgacaataaaaaaagaactatatgaccatttggatatagtagaaaccaaaaggaatattctataatgaaaaacaaggagttagaaatgcagtataagttacggggctctgtaggaaagagaaccatggatattaaaattaagagcggggccaggcatggtggctcatgcctgtaatcccagcactttggaaggccgaggtgggcggatcacctgaggccaggagtttgagaccggcctggccaacatggtgaaaccccgtctctacc

SEQ ID NO: 274324 - DNA, 417 bp, Homo sapiens
gcttccctgaccagaggtcgttttgagtttccttctctggaatttgaccactgagcagagacacataggagagaagatgtgaatgctgagtcatcaatcagcatcactgggaagaaaaagcctctcagtttcttctgctgggactcccggagctggagtattttctgctcttcctaaggcctgaatctcaccttgtcacccaggctggagtgcaatggcataatctcagctcactgcaacctctgtctcccaggctcaaatgattctcctgcctcagcctcctgagtagctgggattacaggcgcccatggactaccagctttttaagtagactttttagccaaaggccaagggaaactaccctcttgctactggggttcaaattgattaaaatggtttgctttgaaaaaagttgaa

SEQ ID NO: 274325 - DNA, 384 bp, Homo sapiens
gcttccctgaccagaggtcgttttgagtttccttctctggaatttgaccactgagcagagacacataggagagaagatgtgaatgctgagtcatcaatcagcatcactgggaagaaaaagcctctcagtttcttctgctgggactcccggagctggagtattttctgctcttcctaaggcctggtaattcagctctttgtgagactgtgagctttaccatacccttccagtagcaaccttcttcttttttaagttcattgcggggaatagggagtgatggctgatggacatagggtttctttttggggtgacaaaaatcttctaaaattaagtggtgatgatggttgcacaattttgaatatactaaaaaccgtgaattctaaa

SEQ ID NO: 274326 - DNA, 405 bp, Homo sapiens
gcctccacatctctacggccctggaacctggtgttccaatgaaaccctgcaggaaaatccaaactcagccaagggttctcacccaccccaagccacgtcccatccagagcagctgtcaaaggaagcacttggagacccacccctgctggcctcactctctcctcaggggagctcctaccccaaccaccccaccctgctggaccttggcactgtccacaccaggctgacagtgttccggcggtgctgactgtgggtgccccgggcagggtctgactttttatctccccagcgcagggtgtgacccagggatgagaaaacccagaacaggacttgctgtgtgcagaggcaggtggttcacatgcattccccatttctcacctcccagctctgagtcccaggggcagt

SEQ ID NO: 274327 - DNA, 389 bp, Homo sapiens
tgtggtgcctcccacggcagaagccttggccgtgggtgaactggtgtgtgcagtggctctgctggccagctcccggctgtggccatggtgactctggcatcactccctcttggcagcactgggccccctcccccagcatttcaggatgtgtgtgatggcagggaaactcaaaatttccatgagccactgagaaattctagaaacagcctgtacttgtggactttcctttttcttcctctgccacagggaagagtgggaatgttatttttggtgggattatcagctggttgaccttctcagggatgtggaaagggaggctgcctgcccgcccgggcctctctcccactgcctgcctttgtgtcccccaccccacctcactttatgtttta

SEQ ID NO: 274328 - DNA, 376 bp, Homo sapiens
tgtggtgcctcccacggcagaagccttggccgtgggtgaactggtgtgtgcagtggctctgctggccagctcccggctgtggccatggtgactctggcatcactccctcttggcagcactgggccccctcccccagcatttcaggatgtgtgtgatggcagggaaactcaaaatttccatgagccactgagaaattctagaaacagcctgtacttgtggactttcctttttcttcctctgccacagggaagagtgggaatgttatttttggtgggggacacaaaggcaggcagtgggagagagggccgggcgggcaggcaagctccctttccacatccctgagaaggttcaccagctgataatcgcaccgtcgacg

SEQ ID NO: 274329 - DNA, 195 bp, Homo sapiens
atggaatatgttttagccaacagctacctgtacttaaaaacaaaaccccaaaaacctgctcatttgattttcagtaagagtctattaaaaattcttaaatcagaaaccaggtagtaaacaatttctgtaaaagccgattttcaagtggagacattttgacctggagctagtgaattcaatgaaaaaaacaaaaaa

SEQ ID NO: 274330 - DNA, 205 bp, Homo sapiens
cctgtgacataagcactgcctgaccagccttaaaaatccctccatgctgtggtacatccatacaatggaatactacttggcactgacagcggccacactgttgaactgcaaatccactgcgctaagtgaaagaagccagactcgaagactgcatatggtatgatccctctatgtaacactccagaaaatacaaaatgatgccagc

SEQ ID NO: 274331 - DNA, 455 bp, Homo sapiens
tacgctatatctcaaaatgcagcaacagtgatggccccaccagcaactgcagggcaaacaatgctcaggaattctgttgagattttttgaggtgtgtgtttagggagtgagtgactgcaggggaaggaatcccagagtctcgaaagtggttatggaggagtccgtgtttttggccttggtccctgtgccagggctggtttgctaagcaaaacttctagtggcattggcattcctacaaaaggcacttgttccaaatcctcccattgttactgccattttgctaagaatttctgtactttgtaatttagggctctgtttatcttgtatctctggagtttggctttgctagaatactgtgagaaaattcagtaaaacattatccagcagtttaagttttccagaggacctctggggatgaattgctttgtacaataaatggaaagtcttgctttacc

SEQ ID NO: 274332 - DNA, 394 bp, Homo sapiens
cctcgtgattctcccgcctcggcctcccagagtgctgggattacaggcgtgagccaccgcgcccggccagaacccgtacttttaaacactacaccatactacctctttaatgagaatcatcacattaaaattctgttgtggagctgggcatggaggtatgtgcctgtagtcctagctactcagtaggctcaggcaagaggatcacttgagcccaggaagttcaggctgcagtgagatacgattatgccactgcactccagctgggtgacagagtgaaatgctgtctctaaaaataaataaattaattaaattctgttacagaaagcgggggaggttgtctgtgtagtgtagaattttttttttcccctagaagatggggattatagattttgcc

SEQ ID NO: 274333 - DNA, 173 bp, Homo sapiens
tttttttttgagacggagtagtctcgccctgcactccagctgggtgacagagtgaaatgctgtctctaaaaataaataaattaattaaattctgttacagaaagcgggggaggttgtctgtgtagtgtagaattttttttttcccctagaagatggggattatagattttgcc

SEQ ID NO: 274334 - DNA, 391 bp, Homo sapiens
gagatcctgtctcaaaaaaaaaaacaaaaccaaaacaacaacaacaacaacatgcgaactttggtctcctacccatctctaacaaatggtggggcttactatgagcagagaggggcttatcatagagtaacggttcagagcaagggctttggggtcagacttgggcttgagtgccagcttcacagtcaactgtgacctgagaaaagggaagagtgagcccttcccagctgtttcagagaataatggtagaatagtagcctgcacatggctaagtgctcagtaaacaacaagtcttattattaggtattccctggggccatatgttttatttcagctaaatgctgatattcgtagaatcatgtagaagaatgtgtaggtataaaggaatgta

SEQ ID NO: 274335 - DNA, 749 bp, Homo sapiens
tcctttccccatccaaaacctctgtccctgcatcccccagcctctccactgcctctgcccactgcctgaagaccctggggatgaggaaggaggctcctctgagcagcaagagatggcagacttgctgcgtggctcaggggagcatgccctgaatctagcagagaagggtttaggtcccagaaatgaccagaacgcctacttctgccctggttaatttagccctaactctcatctgctggagagtcagctcccaaactgttctttcttgtaggcagaggatatgtgtgtgtgtattacatgggactgtctagaggttccatttcccaatagggtgggttgcctttccttgtcttaattaggcctaactgttccagagcagaggccatgatttagtggaccatgaatgattgagattttgcctgtgtactatcaatgccacttgaacccaagcattcactttaatacttactgagcatctcccatgtgcaaggtcctggaactacagggataagacagggtccatgccgtctcaaggcatttacggtttaaaaagacctttgtaattactaacgaaaatgcaaagcagaaagcagtctgtaataaagattaaaataatgccgtgggagcaaagaggaagggataatgaattctgattggggacagtgggaaaggctttatgcaagaagcaatgaggatggccttgacaaatgaggatttttggttttggaaaatggatgcagagaagtttt

SEQ ID NO: 274336 - DNA, 625 bp, Homo sapiens
tcctttccccatccaaaacctctgtccctgcatcccccagcctctccactgcctctgcccactgcctgaagaccctggggatgaggaaggaggctcctctgagcagcaagagatggcagacttgctgcgtggctcaggggagcatgccctgaatctagcagagaagggtttaggtcccagaaatgaccagaacgcctacttctgccctggttaatttagccctaactctcatctgctggagagtcagctcccaaactgttctttcttgtaggcagaggatatgtgtgtgtgtattacatgggactgtctagaggttccatttcccaatagggtgggttgcctttccttgtcttaattaggcctaactgttccagagcagaggccatgatttagtggaccatgaatgattgagattttgcctgtgtactatcaatgccacttgaacccaagcattcactttaatacttactgagcatctcccatgtgcaaggtcctggaactacagggataagacagggtccatgccgtctcaaggcatttacggtttaaaaagacctttgtaattactaacgaaaatgcaaagcagaaagcagtctgtaataaagattaaaataatgccgtggga

SEQ ID NO: 274337 - DNA, 324 bp, Homo sapiens
gaccccaccccagtgctgctgggccctgtgggcactcacagagcagtccttgctggcctgactcatattcctgagtctcaggggttcctgtgccaccagagaacgaactccccaactgtcagtcactcagctcagtgcctgtatcttaaattgggcacctttagcaaaagtgcagtgtggaactgtgtatcctgctgccccagcccaggacctagcacagagccgggtactgtgccataataagccttggtaaaggctgctgtaggcttcacagtacagatggcagggctgtgcccgggctgcaggctcccatttaccagatgt

SEQ ID NO: 274338 - DNA, 297 bp, Homo sapiens
agctgggcgtggtggtgcatgcctgtagtcccagctacttgggaggctgaggttggaggattgtttcagcccaggaggcagaggttgcagtgagcctgggcaacagagcaagatcctgtcttgaaaagaaaaaaaaattagaaggcagagaagcaaatctgtctggggatcctggaggccagtccccagggccagtccctcgtggcagccaaaggggtggtgtctgcattctataaacaaacacccacaggtgtgcatggaaagccagagccaaatgacaaacacagctgggacaat

SEQ ID NO: 274339 - DNA, 529 bp, Homo sapiens
gctgcagtcatgtgctcaccactggagccaatcagtatcatcagccccaccttaccatatggccaaagagcagaagaggggtgattccccacggaaaaattgggatgccgttaccaaaaaaaaggggagaaattgtaagtgggcaaaccgaaacaattggaatttaattgaaagcatttttttttgtagatcaattttcgtgttcttaaagaagtcttgatttaaagcttaagcaatatttataagaatattatgactacgtttcaaataagaaacagtattaaataagttgactcaaatataatgtttgctgttgaaaataaaaaaccatagctactcaatgtaaacaatgtaattcaaatacttctttcacttaaaacatgtaaagtgaatcttactgagattctttccttggtaaagctattttattattatggaaggtagcaaatacagggaaaaatattttggaatgaaatgacataaaacccattggcaatttgtttttgtttttgtgtttggaaaaaagaaa

SEQ ID NO: 274340 - DNA, 244 bp, Homo sapiens
aaaattatgttcatgaatatgcaatacaaaaaggtaatttgtatcattaacaacgttaagtggggagggtagagatgtaaaaaagtagagttttaatacatggctgaagttaggctgtttttagtttcaaatagattgttagaactttaagatgttttatgtaattgcaatggtaaccacaaagaaaacatttatagaataatacacaaagggaaatgagaagggagtgaaaacatgtcagtac

SEQ ID NO: 274341 - DNA, 262 bp, Homo sapiens
gccactatccccggctaattttgtatttttggtagagacagggtttctccatgttggtcaggctggtctctaactcccgacctcaggtgatctgcccgcctcggcctcccaaaatgctgggattacaggcatgagccactgcgcctggcctgctcttcccattttcttttgtctttcttactaacctagtcaatcccccactactccaagtcccgttatagttaataattctttgtattaaactttcactgttgaaatcatt

SEQ ID NO: 274342 - DNA, 301 bp, Homo sapiens
gcgttttcaatcgctcacctgcagagccgccagattctggccaatctcggcttttttccctctcactgtgggttcttcagagccccatggtttagacacaacggtggattctcttgtgccccaattaccacatgcgtcatggggagaagagcttgaaccccccagagggtcaggtccagggacttgagcatccatggattttggtgcctgaggagagtcctggaaccaatcccccatggatactgagggacaactgtaatcttttttggaataaggaattaaaaatttccccaaaatgctt

SEQ ID NO: 274343 - DNA, 380 bp, Homo sapiens
caagcgtcataatgctacaaaaggcatgcaaagtgcaatgggagaacagaatatgcacactcagtttcctctgaaatgtcaggaaaagctacctagaaacgaagataggatttaaatttggatttagtaaatgaatagaacttggacaaacagggcatggagagatttacatatcatatttacgagtttcaaatttatcttataggcaaagagagacgtggaaattttaagcaatttggagggtagaagaaggctgatgtggtcggatttacatttaaacctctgtggttgttgtgtgaaagtagatttcacaaaatccgggatggattcagggagaagggttaaaggaccatttagctaatcctggcaaaaaaaaaaaa

SEQ ID NO: 274344 - DNA, 259 bp, Homo sapiens
accccatgcactctgagcccagatcatggcttcaggtcatgtgtgaccacagccccctgcctgcctggctgaggcgaagtctgtctcctctggctcacacttcgtccgtctgtaaaatagagatagcactatttggccccctcatggacacagaactgctgtgtggatggtgtgggacgattgtgggaaatggctttttagcaagtgttaatgggtcgcagcctgccgacatagcatttaaactgttttcaataatcag

SEQ ID NO: 274345 - DNA, 299 bp, Homo sapiens
taaactaaagagcttctgcacagcaaaagaaactaccatcagagtgaacaggcaacctacagaatgggagaaaatttttgcaacctactcatctgacaaagggctaatatccagaatctacaatgaactcaaacaaatttacaagaaaaaaacaaacaaccccatcaaaaagtgggcgaaggatatgaacagacacttctcatactgtagcgttttgcactttcccaagcaatgtatgaaagttccagtagtttcacatcctccccaatacttggtatatgttatcagttttgtcattt

SEQ ID NO: 274346 - DNA, 516 bp, Homo sapiens
gccatgataccgttgttgaattcataaaaccttcttaaatataaagtagatacagttctaagatagggaggttcttaactagttaaatagttgttggaaaagtgcaccttggtggaaataaaacagagccttgactttgccagagtccatcattgactccaaatatgtagcaacacctgtgtgttctaaaactacgtcaagtggtggggagaagttggggtaaaataaattagattttgaaatggaataaagaaaaaataatggtagaacactgtaaggtgaagacagacatatagtagatgctagttacagactggactctgaacttccttgcaaatgattcagaaaagaatatatgagaaattgcctttaaattataaagctttacacaaatgttcattagtattaattgtactatgaaaatttcaaaaggagttaaaactccaggagtttatggttttgtagtcccgagtataaagctgtgttctcaaattttcttttctttctttttttttt

SEQ ID NO: 274347 - DNA, 238 bp, Homo sapiens
ttttttttttttgcttctttctgtggatctgtttggaaatgtaacattttaaagcccttcttggctggaggattttttatggtaaacataaaacgttcattgaaacattaaacattttacagctgtttttcagcacataaattttcatagacatccaccccctcactgccacaccccctcatagatttcttcttttcctcctccttctcctcctccctcttcctcctctttttccccc

SEQ ID NO: 274348 - DNA, 221 bp, Homo sapiens
taattcaagtatactacttagagtatttcacttactccaggataagctttcaaatttatagctaaactgagccttgctgcagaatcaactagattactctctccaaaggaatttttttccaactggattcaatttcttattttaaatgtttgaacattctgaaaaacataggccgtgaggcttggctcttgttttaacataaagttaaaagaaaaatcact

SEQ ID NO: 274349 - DNA, 251 bp, Homo sapiens
ccgattccatgggggctgtcacttcccttataccagttgcttagctccaggatggcagaggccactcctttttcatctttctattctcagagttgacctaaaaataggtgtttgtcaagtggcctaaatggattacccaccccagctcctgtagttcctgccacatgggacaccatgagaatcttcttttctagctctgtgccaggaaagcttttgctgcctccgaagacctgggaagttttctccttggg

SEQ ID NO: 274350 - DNA, 405 bp, Homo sapiens
caccccaaagtcaagacgtagaactcattccacctccttcacccgaggctgctttcccaaacgtcttcccagtcccaccttctgtttttttgttgttgttgttgttgttgtttgtttttgagacagagtcttgcttgttgcccaggctggagtgcagtggcgtgatctcggctcactgcaacctctgcctcccaggttcaagcgattctcctgcctcagcctcctgagtagctgggattacaggcgtgagccactgtgcccggcctccacatagatgtcggataggtgttctgaacttatgccagagctgaactccacctgatccagaaacggctgccgtccacctgctcagaccatacctcagaactgttgctggctcctccttttccctcatgccccacattt

SEQ ID NO: 274351 - DNA, 301 bp, Homo sapiens
ctatcttcctgcctcagcctcccaaagtgctgggattacaggtgtgagccactgtgcctggcctcttggtgactctttgcaagggcattgctggctggctgatatggcctgcagcctctgcctgtaaccatcagagcgatactctcattatcggcaaggtgggacccaccctggcccaagagacagggcctgttattccactgtatggaggagaagctgaggcttagggaaggcagatgacttggcaaggtcataaagacagcaagctgcaggaccagctcattctaaggcatgaaccccc

SEQ ID NO: 274352 - DNA, 429 bp, Homo sapiens
ttttttttgagacagaatctcactctgttgcccaggctggagggcagtggagtgatcttggctcactgcaacctctgcctcctgggttcaagtgattctcctgcctcagcctcccgactagctgggattacaggtgcccgccaccacgtctggctaatttttgtatttttagtagagacagggtttcaccatgttggtcaggctggtgtcaaactcctgacctcatgtgattcgcctgccttggccttgcaaagtgctgggattacaggcatgagccactgagccaggctgaaaacaactttttatgtggttcagttttctcatctataaaatagggataacactaaaacatacttgtattatcacagtaatggttatttaattaaaaatgggaagcattgtatgaaatacattccaataaatgttgaa

SEQ ID NO: 274353 - DNA, 391 bp, Homo sapiens
gaaatgaccccagaataagcttcttgatttgtaaaattctatgtcattgactcaagtttgtatggcatctcaaaatataaatatagacatctcagataatatatttgaaatagcaaattcctgttagaaaagaatagtacttaactagataagaataacaggtcaccattatttgaattgtctcctattaatttttgttctgttgtgttactcatgttttacttatgggggatatacataacttctgctgttttcagaattattgtatgcagtcagtatgagaatgcaattttagtttccttgatgctttctcacacctctattactagaaataagaatacagtaatattggcaaagaaaattgaccagttcaataaatttttttagtaaa

SEQ ID NO: 274354 - DNA, 154 bp, Homo sapiens
tcctctgtgtatgactctgggtataaatagaacagtaataaattggttttggaaaaatgtggtacacattggaaaagatgaaggctagcgcctggtacactttggattaaaatacgtatcaaacttccatattatccccttctgtcgtcttctc

SEQ ID NO: 274355 - DNA, 900 bp, Homo sapiens
tgtgtacctgtgcagtgttctggggcacggtttataagcagcgggggagttagcctaccgtacatggggaaaagttagccttgtttgcctgggaaataccaagataatctgggctgcacgtttctaaggaattaatggctctgttgacttggtctttgggaaatttgcatatacacttctggtagatgtctcttcccctccctgctccccaaaagaaagggtctccctctgttgcccaggctggagtggagtacagtggcatgatcatggctcactgcagcctctaactcctgggctcaagtgatcctcccaccctagccttctgagtagctgggactacaggcgcaggcacctatgcctgggtaatttttatttttgtttttgtagagacagagtctcactgtgttgcccaggctggtctccgaactcctggcttcaagtcatcctcctgcctctcttttctcctcttaaaaaatactgtcttaaaaaggaaaacctccaaatacctttactggtttttaaaatttcaaatgctatgtaatatttctgataaaatttcagatgtaatcggagtggtcatcatgagtggccagaagctcctgaagtcctaagtgacctagagatgggccctgttgaccccgcagcatctgctaagcgtgtggcttttgtgcagctccctggagagctggagtgcagtagccacagcccccacaccagcagcaggaactgaagagtggctttctcgaaacacaaccatgttgcctttcacttaatttgtttgatccaaataattattttctcgggagaatttataaacgataacttgtctctttcaaaagtgtcagaggggccgggcacggtggctgacgcctgtaattccagcactttgggaggccgagg

SEQ ID NO: 274356 - DNA, 593 bp, Homo sapiens
tggctgcatagccaagggaatttagggttggaatgacacaggcctgagtggaaattcaagagctgtcatttcctagcaccatgaagttgggcaagtcacttaacctctaagaggctcagctctatcactttatctaagtggggcctgacacttgggtagtactcaataagaaaatttcctttctcatgaggtggctgctcagggagagatggtcaggacagaatatctacccaaggttgagaagacagaggagaaaccagggcacatcctggagaaggcagcttcaggagtgggtcctggggtctggggtggggtgggagacgttttcgatgttgtttaatgggcggtagtgggaccaaggagagttccagtcacttggaaaacaggactgcagagtggaggcaagagccatagaaaagagagaaagccctagaaggggctaggagggccatcttctgccacttcactcatctgtggatcaccaggtctacccacagttttacaaatttcactccagttctgccctaacttattacatatcagggcctttcactcattatctcaaaaatgacatatagagatctttgcctgtg

SEQ ID NO: 274357 - DNA, 539 bp, Homo sapiens
tggctgcatagccaagggaatttagggttggaatgacacaggcctgagtggaaattcaagagctgtcatttcctagcaccatgaagttgggcaagtcacttaacctctaagaggctcagctctatcactttatctaagtggggcctgacacttgggtagtactcaataagaaaatttcctttctcatgaggtggctgctcagggagagatggtcaggacagaatatctacccaaggttgagaagacagaggagaaaccagggcacatcctggacgatgttgtttaatgggcggtagtgggaccaaggagagttccagtcacttggaaaacaggactgcagagtggaggcaagagccatagaaaagagagaaagccctagaaggggctaggagggccatcttctgccacttcactcatctgtggatcaccaggtctacccacagttttacaaatttcactccagttctgccctaacttattacatatcagggcctttcactcattatctcaaaaatgacatatagagatctttgcctgtg

SEQ ID NO: 274358 - DNA, 304 bp, Homo sapiens
ttacttgaaaccaaactgactcatgagaaaaagaaaaaggatcagagggttgcaactttcagccccacccactgacctctaaaaaattggggaaagagcctgggaaacatggcaaaaccccatctctacaaaaaatgcaaaattagtcgggtggggtggtatgtgcctgtagtcccagctactcaggaggctgaagctggaggatctgcttgagcccaggaagcagaggttatggtgagccaagatggtgccactgcacttaagcctgggcaacagagccagaccctgtctccaaaaaaaaaaa

SEQ ID NO: 274359 - DNA, 432 bp, Homo sapiens
ctctctgttgcctcctgggctcaagcaatcctcttctctcagcctcccaagtagctgagactacaggtgcatgcctgtagtagatatagcatcttgctctgttgcccagactggtcttgaactcttggtcacaagcgatcctcttgccttggcctctcaaagtgctggaattacacgcgtgagccattgagcccaaccagataagatgatctttaagggcccttcccatggtaccataatccaagtcagcgagactgtggctatagcaagtttaacataaccagatacgctagtattatgggctgcatggtgtgccccccacccctaattcatgtattgaagccatgaccctccagaccttagaggtgaccttattggaaccagagtctttacagaggtgatcaagttaaaatgaggtcactagaggccagg

SEQ ID NO: 274360 - DNA, 402 bp, Homo sapiens
cacatcgcttacaattagaattatgcagctcttcagcaagcagccatcgcttctctttcaacgaattagctccatatttcagccgccctgtcttctcgctcttatcggctccagcgactcggcggtgacatttcatctttgacagaccttctctattttcactccaatgtgataaaacttttatggaaccacaactaagaaatgaagttttcccaaggatgatggaaacagagccgcacattagcctgaggaccgttttatttacgcttggatccaacagcttctcccaccctcctctcccctttctctggcaggggaaatcgaacgtgcttcccctccctccgcctcgagttttatttagtgatttaattttacttagttttaaagtttgacctgagaagt

SEQ ID NO: 274361 - DNA, 753 bp, Homo sapiens
ctcgtcgtggtgagcgcagccactcaggctggtcctgggggtggggctgtaggggaaagtgctaaagtgcacctggcctgacattctttatgaaatttagaattgttgaagaactataacatttcagtagggttcaaggtggtcccaaaagttatataaaagattagtttttactataaacccttgtcttttactcagatcctagcatcccttttcacatggtttctccatgtatataacagaatcaagaaacaaattttaattaaacaatctgtaacagaatcaagaaacaaatacattttaattaaacaatctatatggaacaaacattcccaaattctaagaataaatttttctttaagtaaaaaaaaaaaaaaaaaaaaaaaaaaaaaaaaaaaaaaaaaaaaaacaaacaaaagacaaaaaaaaaaagcaagagaaccagaaaaaaagaaaataaagaagagtgaaccactcaaaccgaagcacggcagcgagctgggaacggcccgcgcgtatgagaagaaaggccgcgaatactgtgacaaaacaaaaagaggagtaccccggacgccgacgaacgagcggagacacagcccgaccgccgtgaccacagatactgccgcgttttgtgtatagtgacacgaggaggcaaacaacgcgaaccgactagcacagatagttcatggaacgagatgcacacaacgtgcagcgagcaagtagcaaacatacgcaacacaaggaaatacaaag

SEQ ID NO: 274362 - DNA, 698 bp, Homo sapiens
caggaggttgaagtgagaggatcgcttgagccccagtgttggagacggaagtgtcattacaccactgcactccagcctgggggatagagagagaccctgtctcaaaaacaaacaactaagacatgattaagttatgtgcatgattttgttagacagttcaagtttgtgtgaaaggaatagagttgtgctactccaggctgctgtggaactctgataaagattatgcttctcttttaagtagagaactgctttatgaagccttgaatttaggttccagagtttctgaatgaaaatgagaaaactgcaacattcttttgcttttctgtacccaatataaatcagatactttctactgacctctcagaaaactcagagtcacctcctgataccatcagggtcttgcagaagccatttgtcaacaaatatttgctaagaagtgaattcatgttcccaggtaatgagagaaatgcctcctccctatatcctaagcatactgaggccaaatttggcaacaaaaggggaaatttgcctgaaatacatgcttttatgcaatgtttgctatttcacagattaatcattaaattagaaccaccaataatagcatgctagtataatccaaactagtttcactaatgatttaaagggaatgttagaataatggtgttatattgtccttaatattgcagagttgacattga

SEQ ID NO: 274363 - DNA, 3258 bp, Homo sapiens
aggcggggcgcgggcggaggcggggcgcggagaagtggcggaggtggaagcggaggcgtacccgcccctggggacgtcattggtggcggaggcaatggccggcaaccagctgtaagcgaggcacggaagacatatgcttgtgagacaaaggtgtctctgaaactatggatggtacaagaacttcacttgacattgaagagtactcggatactgaggtacagaaaaaccaagtactaactctggaagaatggcaagacaagtgggtgaacggcaagactgcttttcatcaggaacaaggacatcagctattaaagaagcatttagatactttccttaaaggcaagagtggactgagggtattttttcctctttgcggaaaagcggttgagatgaaatggtttgcagaccggggacacagtgtagttggtgtggaaatcagtgaacttgggatacaagaattttttacagagcagaatctttcttactcagaagaaccaatcaccgaaattcctggaaccaaagtatttaagagttcttcggggaacatttcattgtactgttgcagtatttttgatcttcccaggacaaatattggcaaatttgacatgatttgggatagaggagcattagttgccattaatccaggtgatcgcaaatgctatgcagatacaatgttttccctcctgggaaagaagtttcagtatctcctgtgtgttctttcttatgatccaactaaacatccaggtccaccattttatgttccacatgctgaaattgaaaggttgtttggtaaaatatgcaatatacgttgtcttgagaaggttgatgcttttgaagaacgacataaaagttggggaattgactgtctttttgaaaagttatatctacttacagaaaagtaaatgagacatagataaaataaaatcacactgacatgtttttgaggaattgaaaattatgctaaagcctgaaaatgtaatggatgaatttttaaaattgtttataaatcatatgatagatctttactaaaaatggctttttagtaaagccatttactttttctaaaaaagttttagaagaaaaagatgtaactaaacttttaaagtagctcctttggagaggagattatgatgtgaaagattatgcctatgtgtcttgcagattgcaagatattttaccaatcagcatgtgttacctgtacaattaaaaaaatatttcaaaatgcaatgcatattaaatataatacacacagaaaaactggcatttattttgttttatttttttgagatggagtttcgttcttgttgcccaacctggagtgcaatggtgcaatctcagctcactgcaacctctgcctcccaggttcaggtgattctcctgcctcagcctcctgagtagctgggattacaggtgtgcgccaccacgcccagctaattttttgtatttttagtagagacagggtttcaccatgttggtcaggctgatctcgagctcctgacctcaggtgatctacccacctcggcctcccaaagtgctgggattacaggcgtgagccactgcacctggcctgacattctttatgaaatttagaattgttgaagaactataacatttcagtagggttcaaggtggtcccaaaagttatataaaagattagtttttactataaacccttgtcttttactcagatcctagcatcccttttcacatggtttctccatgtatataacagaatcaagaaacaaattttaattaaacaatctgtaacagaatcaagaaacaaatacattttaattaaacaatctatatggaacaaacattcccaaattctaagaataaatttttctttaagttttctctgagtttggcaattgttgttttttataatttaatctgtttaaatcatcaggtcttataaaatataatgtacttagagctggattcatggctgtttattatgaaaggttagatttctcagttcttctttaaccacattttgttatatcagacagtcctctataactctgtactacccaacaactaaatggtttagattgtttagctcatgttaataggatggttgtgtattataaaaaacgagttacgtgtgtgtgtgcacgcatgcacgcacatgtgctggcttaaaggttgttaatgcaaggtttggggtcccctttaacactggtgaaagctacggtactctccccagagatatgtcttgtcagcctctctagttccccttggcctgcatgtacaaacttctaccctagaagctctctgccatcgatgtattctaatagatttgtaaggctattaatttgaagcaactccttgctcacagtgattcttgcttctctgagacctgctcccagtcgatactgtgggcttcagaagccatgactccccaactctgcctgtatcaccggttgaatggacaactaacccgagctggaccaacacaattctctccagagacttttgattttacttttatgtagagacagggtctcactttgttgcccacgctgatgttgaacttgacgtgaggcctcaagcagtcctcctgtcttggccacccaaagtgctaggattacaggtatgagccattgcgctggccctcttcataggcttttggacttgggaatagaaaagcaaccccgtctctactaaaaatacaaaaaaattggccaggcgtggtggcgcgtgcctgtaatcccagctacttgggaggctgaggcaggagaatcacttgaacctgggaggcggaggttgcagtgagctgagatcatgccactgcacgccagcctgggcaacagagcaagactctgtctcaaaagaaagaaaaagaaaagaaaaaaaagaaaggcaagttgactgctgaaaggggaatctgtgtacgcctgggagctgtggggcagccacattccagcacatggatctgagaaacagaacgctgatctgcagaaagagatgagaaccaaagagaggccacctgcgtcctgggtccattttcatcctccctgaagcccagctgcccagggtggggagaaacaccctgtgtccatgggatagagtcctttccgcttgcagttgtgcccaaagaatcttaaatacaaatgagatatccttaggtagttgatcttttatgtaatatgtgtcttcactggggaatactgacttcctaaaatctcaagatggaagatataccacatgtaaattattttagagcaattaaattgttttcaggattttccaaaa

SEQ ID NO: 274364 - DNA, 3238 bp, Homo sapiens
  misc_feature (4)..(4): n is a, c, g, or t
  misc_feature (10)..(10): n is a, c, g, or t
  misc_feature (44)..(44): n is a, c, g, or t
aganactccntgctctaaaagctgcggaaatccaactgaacccncttgcaactgcgtcattggtggcggaggcaatggccggcaaccagctgtaagcgaggcacggaagacatatgcttgtgagacaaaggtgtctctgaaactatggatggtacaagaacttcacttgacattgaagagtactcggatactgaggtacagaaaaaccaagtactaactctggaagaatggcaagacaagtgggtgaacggcaagactgcttttcatcaggaacaaggacatcagctattaaagaagcatttagatactttccttaaaggcaagagtggactgagggtattttttcctctttgcggaaaagcggttgagatgaaatggtttgcagaccggggacacagtgtagttggtgtggaaatcagtgaacttgggatacaagaattttttacagagcagaatctttcttactcagaagaaccaatcaccgaaattcctggaaccaaagtatttaagagttcttcggggaacatttcattgtactgttgcagtatttttgatcttcccaggacaaatattggcaaatttgacatgatttgggatagaggagcattagttgccattaatccaggtgatcgcaaatgctatgcagatacaatgttttccctcctgggaaagaagtttcagtatctcctgtgtgttctttcttatgatccaactaaacatccaggtccaccattttatgttccacatgctgaaattgaaaggttgtttggtaaaatatgcaatatacgttgtcttgagaaggttgatgcttttgaagaacgacataaaagttggggaattgactgtctttttgaaaagttatatctacttacagaaaagtaaatgagacatagataaaataaaatcacactgacatgtttttgaggaattgaaaattatgctaaagcctgaaaatgtaatggatgaatttttaaaattgtttataaatcatatgatagatctttactaaaaatggctttttagtaaagccatttactttttctaaaaaagttttagaagaaaaagatgtaactaaacttttaaagtagctcctttggagaggagattatgatgtgaaagattatgcctatgtgtcttgcagattgcaagatattttaccaatcagcatgtgttacctgtacaattaaaaaaatatttcaaaatgcaatgcatattaaatataatacacacagaaaaactggcatttattttgttttatttttttgagatggagtttcgttcttgttgcccaacctggagtgcaatggtgcaatctcagctcactgcaacctctgcctcccaggttcaggtgattctcctgcctcagcctcctgagtagctgggattacaggtgtgcgccaccacgcccagctaattttttgtatttttagtagagacagggtttcaccatgttggtcaggctgatctcgagctcctgacctcaggtgatctacccacctcggcctcccaaagtgctgggattacaggcgtgagccactgcacctggcctgacattctttatgaaatttagaattgttgaagaactataacatttcagtagggttcaaggtggtcccaaaagttatataaaagattagtttttactataaacccttgtcttttactcagatcctagcatcccttttcacatggtttctccatgtatataacagaatcaagaaacaaattttaattaaacaatctgtaacagaatcaagaaacaaatacattttaattaaacaatctatatggaacaaacattcccaaattctaagaataaatttttctttaagttttctctgagtttggcaattgttgttttttataatttaatctgtttaaatcatcaggtcttataaaatataatgtacttagagctggattcatggctgtttattatgaaaggttagatttctcagttcttctttaaccacattttgttatatcagacagtcctctataactctgtactacccaacaactaaatggtttagattgtttagctcatgttaataggatggttgtgtattataaaaaacgagttacgtgtgtgtgtgcacgcatgcacgcacatgtgctggcttaaaggttgttaatgcaaggtttggggtcccctttaacactggtgaaagctacggtactctccccagagatatgtcttgtcagcctctctagttccccttggcctgcatgtacaaacttctaccctagaagctctctgccatcgatgtattctaatagatttgtaaggctattaatttgaagcaactccttgctcacagtgattcttgcttctctgagacctgctcccagtcgatactgtgggcttcagaagccatgactccccaactctgcctgtatcaccggttgaatggacaactaacccgagctggaccaacacaattctctccagagacttttgattttacttttatgtagagacagggtctcactttgttgcccacgctgatgttgaacttgacgtgaggcctcaagcagtcctcctgtcttggccacccaaagtgctaggattacaggtatgagccattgcgctggccctcttcataggcttttggacttgggaatagaaaagcaaccccgtctctactaaaaatacaaaaaaattggccaggcgtggtggcgcgtgcctgtaatcccagctacttgggaggctgaggcaggagaatcacttgaacctgggaggcggaggttgcagtgagctgagatcatgccactgcacgccagcctgggcaacagagcaagactctgtctcaaaagaaagaaaaagaaaagaaaaaaaagaaaggcaagttgactgctgaaaggggaatctgtgtacgcctgggagctgtggggcagccacattccagcacatggatctgagaaacagaacgctgatctgcagaaagagatgagaaccaaagagaggccacctgcgtcctgggtccattttcatcctccctgaagcccagctgcccagggtggggagaaacaccctgtgtccatgggatagagtcctttccgcttgcagttgtgcccaaagaatcttaaatacaaatgagatatccttaggtagttgatcttttatgtaatatgtgtcttcactggggaatactgacttcctaaaatctcaagatggaagatataccacatgtaaattattttagagcaattaaattgttttcaggattttccaaaa

SEQ ID NO: 274365 - DNA, 1794 bp, Homo sapiens
aggcggggcgcgggcggaggcggggcgcggagaagtggcggaggtggaagcggaggcgtacccgcccctggggacgtcattggtggcggaggcaatggccggcaaccagctgtaagcgaggcacggaagacatatgcttgtgagacaaaggtgtctctgaaactatggatggtacaagaacttcacttgacattgaagagtactcggatactgaggtacagaaaaaccaagtactaactctggaagaatggcaagacaagtgggtgaacggcaagactgcttttcatcaggaacaaggacatcagctattaaagaagcatttagatactttccttaaaggcaagagtggactgagggtattttttcctctttgcggaaaagcggttgagatgaaatggtttgcagaccggggacacagtgtagttggtgtggaaatcagtgaacttgggatacaagaattttttacagagcagaatctttcttactcagaagaaccaatcaccgaaattcctggaaccaaagtatttaagagttcttcggggaacatttcattgtactgttgcagtatttttgatcttcccaggacaaatattggcaaatttgacatgatttgggatagaggagcattagttgccattaatccaggtgatcgcaaatgctatgcagatacaatgttttccctcctgggaaagaagtttcagtatctcctgtgtgttctttcttatgatccaactaaacatccaggtccaccattttatgttccacatgctgaaattgaaaggttgtttggtaaaatatgcaatatacgttgtcttgagaaggttgatgcttttgaagaacgacataaaagttggggaattgactgtctttttgaaaagttatatctacttacagaaaagtaaatgagacatagataaaataaaatcacactgacatgtttttgaggaattgaaaattatgctaaagcctgaaaatgtaatggatgaatttttaaaattgtttataaatcatatgatagatctttactaaaaatggctttttagtaaagccatttactttttctaaaaaagttttagaagaaaaagatgtaactaaacttttaaagtagctcctttggagaggagattatgatgtgaaagattatgcctatgtgtcttgcagattgcaagatattttaccaatcagcatgtgttacctgtacaattaaaaaaatatttcaaaatgcaatgcatattaaatataatacacacagaaaaactggcatttattttgttttatttttttgagatggagtttcgttcttggttgcagtgagctgagatcatgccactgcacgccagcctgggcaacagagcaagactctgtctcaaaagaaagaaaaagaaaagaaaaaaaagaaaggcaagttgactgctgaaaggggaatctgtgtacgcctgggagctgtggggcagccacattccagcacatggatctgagaaacagaacgctgatctgcagaaagagatgagaaccaaagagaggccacctgcgtcctgggtccattttcatcctccctgaagcccagctgcccagggtggggagaaacaccctgtgtccatgggatagagtcctttccgcttgcagttgtgcccaaagaatcttaaatacaaatgagatatccttaggtagttgatcttttatgtaatatgtgtcttcactggggaatactgacttcctaaaatctcaagatggaagatataccacatgtaaattattttagagcaattaaattgttttcaggattttccaaaa

SEQ ID NO: 274366 - DNA, 1644 bp, Homo sapiens
aggcggggcgcgggcggaggcggggcgcggagaagtggcggaggtggaagcggaggcgtacccgcccctggggacgtcattggtggcggaggcaatggccggcaaccagctgtaagcgaggcacggaagacatatgcttgtgagacaaaggtgtctctgaaactatggatggtacaagaacttcacttgacattgaagagtactcggatactgaggtacagaaaaaccaagtactaactctggaagaatggcaagacaagtgggtgaacggcaagactgcttttcatcaggaacaaggacatcagctattaaagaagcatttagatactttccttaaaggcaagagtggactgagggtattttttcctctttgcggaaaagcggttgagatgaaatggtttgcagaccggggacacagtgtagttggtgtggaaatcagtgaacttgggatacaagaattttttacagagcagaatctttcttactcagaagaaccaatcaccgaaattcctggaaccaaagtatttaagagttcttcggggaacatttcattgtactgttgcagtatttttgatcttcccaggacaaatattggcaaatttgacatgatttgggatagaggagcattagttgccattaatccaggtgatcgcaaatgctatgcagatacaatgttttccctcctgggaaagaagtttcagtatctcctgtgtgttctttcttatgatccaactaaacatccaggtccaccattttatgttccacatgctgaaattgaaaggttgtttggtaaaatatgcaatatacgttgtcttgagaaggttgatgcttttgaagaacgacataaaagttggggaattgactgtctttttgaaaagttatatctacttacagaaaagtaaatgagacatagataaaataaaatcacactgacatgtttttgaggaattgaaaattatgctaaagcctgaaaatgtaatggatgaatttttaaaattgtttataaatcatatgatagatctttactaaaaatggctttttagtaaagccatttactttttctaaaaaagttttagaagaaaaagatgtaactaaacttttaaagtagctcctttggagaggagattatgatgtgaaagattatgcctatgtgtgttgcagtgagctgagatcatgccactgcacgccagcctgggcaacagagcaagactctgtctcaaaagaaagaaaaagaaaagaaaaaaaagaaaggcaagttgactgctgaaaggggaatctgtgtacgcctgggagctgtggggcagccacattccagcacatggatctgagaaacagaacgctgatctgcagaaagagatgagaaccaaagagaggccacctgcgtcctgggtccattttcatcctccctgaagcccagctgcccagggtggggagaaacaccctgtgtccatgggatagagtcctttccgcttgcagttgtgcccaaagaatcttaaatacaaatgagatatccttaggtagttgatcttttatgtaatatgtgtcttcactggggaatactgacttcctaaaatctcaagatggaagatataccacatgtaaattattttagagcaattaaattgttttcaggattttccaaaa

SEQ ID NO: 274367 - DNA, 3592 bp, Homo sapiens
caggaggttgaagtgagaggatcgcttgagccccagtgttggagacggaagtgtcattacaccactgcactccagcctgggggatagagagagaccctgtctcaaaaacaaacaactaagacatgattaagttatgtgcatgattttgttagacagttcaagtttgtgtgaaaggaatagagttgtgctactccaggctgctgtggaactctgataaagattatgcttctcttttaagtagagaactgctttatgaagccttgaatttaggttccagagtttctgaatgaaaatgagaaaactgcaacattcttttgcttttctgtacccaatataaatcagatactttctactgacctctcagaaaactcagagtcacctcctgataccatcagggtcttgcagaagccatttgtcaacaaatatttgctaagaagtgaattcatgttcccaggcacggaagacatatgcttgtgagacaaaggtgtctctgaaactatggatggtacaagaacttcacttgacattgaagagtactcggatactgaggtacagaaaaaccaagtactaactctggaagaatggcaagacaagtgggtgaacggcaagactgcttttcatcaggaacaaggacatcagctattaaagaagcatttagatactttccttaaaggcaagagtggactgagggtattttttcctctttgcggaaaagcggttgagatgaaatggtttgcagaccggggacacagtgtagttggtgtggaaatcagtgaacttgggatacaagaattttttacagagcagaatctttcttactcagaagaaccaatcaccgaaattcctggaaccaaagtatttaagagttcttcggggaacatttcattgtactgttgcagtatttttgatcttcccaggacaaatattggcaaatttgacatgatttgggatagaggagcattagttgccattaatccaggtgatcgcaaatgctatgcagatacaatgttttccctcctgggaaagaagtttcagtatctcctgtgtgttctttcttatgatccaactaaacatccaggtccaccattttatgttccacatgctgaaattgaaaggttgtttggtaaaatatgcaatatacgttgtcttgagaaggttgatgcttttgaagaacgacataaaagttggggaattgactgtctttttgaaaagttatatctacttacagaaaagtaaatgagacatagataaaataaaatcacactgacatgtttttgaggaattgaaaattatgctaaagcctgaaaatgtaatggatgaatttttaaaattgtttataaatcatatgatagatctttactaaaaatggctttttagtaaagccatttactttttctaaaaaagttttagaagaaaaagatgtaactaaacttttaaagtagctcctttggagaggagattatgatgtgaaagattatgcctatgtgtcttgcagattgcaagatattttaccaatcagcatgtgttacctgtacaattaaaaaaatatttcaaaatgcaatgcatattaaatataatacacacagaaaaactggcatttattttgttttatttttttgagatggagtttcgttcttgttgcccaacctggagtgcaatggtgcaatctcagctcactgcaacctctgcctcccaggttcaggtgattctcctgcctcagcctcctgagtagctgggattacaggtgtgcgccaccacgcccagctaattttttgtatttttagtagagacagggtttcaccatgttggtcaggctgatctcgagctcctgacctcaggtgatctacccacctcggcctcccaaagtgctgggattacaggcgtgagccactgcacctggcctgacattctttatgaaatttagaattgttgaagaactataacatttcagtagggttcaaggtggtcccaaaagttatataaaagattagtttttactataaacccttgtcttttactcagatcctagcatcccttttcacatggtttctccatgtatataacagaatcaagaaacaaattttaattaaacaatctgtaacagaatcaagaaacaaatacattttaattaaacaatctatatggaacaaacattcccaaattctaagaataaatttttctttaagttttctctgagtttggcaattgttgttttttataatttaatctgtttaaatcatcaggtcttataaaatataatgtacttagagctggattcatggctgtttattatgaaaggttagatttctcagttcttctttaaccacattttgttatatcagacagtcctctataactctgtactacccaacaactaaatggtttagattgtttagctcatgttaataggatggttgtgtattataaaaaacgagttacgtgtgtgtgtgcacgcatgcacgcacatgtgctggcttaaaggttgttaatgcaaggtttggggtcccctttaacactggtgaaagctacggtactctccccagagatatgtcttgtcagcctctctagttccccttggcctgcatgtacaaacttctaccctagaagctctctgccatcgatgtattctaatagatttgtaaggctattaatttgaagcaactccttgctcacagtgattcttgcttctctgagacctgctcccagtcgatactgtgggcttcagaagccatgactccccaactctgcctgtatcaccggttgaatggacaactaacccgagctggaccaacacaattctctccagagacttttgattttacttttatgtagagacagggtctcactttgttgcccacgctgatgttgaacttgacgtgaggcctcaagcagtcctcctgtcttggccacccaaagtgctaggattacaggtatgagccattgcgctggccctcttcataggcttttggacttgggaatagaaaagcaaccccgtctctactaaaaatacaaaaaaattggccaggcgtggtggcgcgtgcctgtaatcccagctacttgggaggctgaggcaggagaatcacttgaacctgggaggcggaggttgcagtgagctgagatcatgccactgcacgccagcctgggcaacagagcaagactctgtctcaaaagaaagaaaaagaaaagaaaaaaaagaaaggcaagttgactgctgaaaggggaatctgtgtacgcctgggagctgtggggcagccacattccagcacatggatctgagaaacagaacgctgatctgcagaaagagatgagaaccaaagagaggccacctgcgtcctgggtccattttcatcctccctgaagcccagctgcccagggtggggagaaacaccctgtgtccatgggatagagtcctttccgcttgcagttgtgcccaaagaatcttaaatacaaatgagatatccttaggtagttgatcttttatgtaatatgtgtcttcactggggaatactgacttcctaaaatctcaagatggaagatataccacatgtaaattattttagagcaattaaattgttttcaggattttccaaaa

SEQ ID NO: 274368 - DNA, 3207 bp, Homo sapiens
aggcggggcgcgggcggaggcggggcgcggagaagtggcggaggtggaagcggaggcgtacccgcccctggggacgtcattggtggcggaggcaatggccggcaaccagctgtaagcgaggcacggaagacatatgcttgtgagacaaaggtgtctctgaaactatggatggtacaagaacttcacttgacattgaagagtactcggatactgaggtacagaaaaaccaagtactaactctggaagaatggcaagacaagtgggtgaacggcaagactgcttttcatcaggaacaaggacatcagctattaaagaagcatttagatactttccttaaaggcaagagtggactgagggtattttttcctctttgcggaaaagcggttgagatgaaatggtttgcagaccggggacacagtgtagttggtgtggaaatcagtgaacttgggatacaagaattttttacagagcagaatctttcttactcagaagaaccaatcaccgaaattcctggaaccaaagtatttaagagttcttcggggaacatttcattgtactgttgcagtatttttgatcttcccaggacaaatattggcaaatttgacatctatgcagatacaatgttttccctcctgggaaagaagtttcagtatctcctgtgtgttctttcttatgatccaactaaacatccaggtccaccattttatgttccacatgctgaaattgaaaggttgtttggtaaaatatgcaatatacgttgtcttgagaaggttgatgcttttgaagaacgacataaaagttggggaattgactgtctttttgaaaagttatatctacttacagaaaagtaaatgagacatagataaaataaaatcacactgacatgtttttgaggaattgaaaattatgctaaagcctgaaaatgtaatggatgaatttttaaaattgtttataaatcatatgatagatctttactaaaaatggctttttagtaaagccatttactttttctaaaaaagttttagaagaaaaagatgtaactaaacttttaaagtagctcctttggagaggagattatgatgtgaaagattatgcctatgtgtcttgcagattgcaagatattttaccaatcagcatgtgttacctgtacaattaaaaaaatatttcaaaatgcaatgcatattaaatataatacacacagaaaaactggcatttattttgttttatttttttgagatggagtttcgttcttgttgcccaacctggagtgcaatggtgcaatctcagctcactgcaacctctgcctcccaggttcaggtgattctcctgcctcagcctcctgagtagctgggattacaggtgtgcgccaccacgcccagctaattttttgtatttttagtagagacagggtttcaccatgttggtcaggctgatctcgagctcctgacctcaggtgatctacccacctcggcctcccaaagtgctgggattacaggcgtgagccactgcacctggcctgacattctttatgaaatttagaattgttgaagaactataacatttcagtagggttcaaggtggtcccaaaagttatataaaagattagtttttactataaacccttgtcttttactcagatcctagcatcccttttcacatggtttctccatgtatataacagaatcaagaaacaaattttaattaaacaatctgtaacagaatcaagaaacaaatacattttaattaaacaatctatatggaacaaacattcccaaattctaagaataaatttttctttaagttttctctgagtttggcaattgttgttttttataatttaatctgtttaaatcatcaggtcttataaaatataatgtacttagagctggattcatggctgtttattatgaaaggttagatttctcagttcttctttaaccacattttgttatatcagacagtcctctataactctgtactacccaacaactaaatggtttagattgtttagctcatgttaataggatggttgtgtattataaaaaacgagttacgtgtgtgtgtgcacgcatgcacgcacatgtgctggcttaaaggttgttaatgcaaggtttggggtcccctttaacactggtgaaagctacggtactctccccagagatatgtcttgtcagcctctctagttccccttggcctgcatgtacaaacttctaccctagaagctctctgccatcgatgtattctaatagatttgtaaggctattaatttgaagcaactccttgctcacagtgattcttgcttctctgagacctgctcccagtcgatactgtgggcttcagaagccatgactccccaactctgcctgtatcaccggttgaatggacaactaacccgagctggaccaacacaattctctccagagacttttgattttacttttatgtagagacagggtctcactttgttgcccacgctgatgttgaacttgacgtgaggcctcaagcagtcctcctgtcttggccacccaaagtgctaggattacaggtatgagccattgcgctggccctcttcataggcttttggacttgggaatagaaaagcaaccccgtctctactaaaaatacaaaaaaattggccaggcgtggtggcgcgtgcctgtaatcccagctacttgggaggctgaggcaggagaatcacttgaacctgggaggcggaggttgcagtgagctgagatcatgccactgcacgccagcctgggcaacagagcaagactctgtctcaaaagaaagaaaaagaaaagaaaaaaaagaaaggcaagttgactgctgaaaggggaatctgtgtacgcctgggagctgtggggcagccacattccagcacatggatctgagaaacagaacgctgatctgcagaaagagatgagaaccaaagagaggccacctgcgtcctgggtccattttcatcctccctgaagcccagctgcccagggtggggagaaacaccctgtgtccatgggatagagtcctttccgcttgcagttgtgcccaaagaatcttaaatacaaatgagatatccttaggtagttgatcttttatgtaatatgtgtcttcactggggaatactgacttcctaaaatctcaagatggaagatataccacatgtaaattattttagagcaattaaattgttttcaggattttccaaaa

SEQ ID NO: 274369 - DNA, 3204 bp, Homo sapiens
aggcggggcgcgggcggaggcggggcgcggagaagtggcggaggtggaagcggaggcgtacccgcccctggggacgtcattggtggcggaggcaatggccggcaaccagctgtaagcgaggcacggaagacatatgcttgtgagacaaaggtgtctctgaaactatggatggtacaagaacttcacttgacattgaagagtactcggatactgaggtacagaaaaaccaagtactaactctggaagaatggcaagacaagtgggtgaacggcaagactgcttttcatcaggaacaaggacatcagctattaaagaagcatttagatactttccttaaaggcaagagtggactgagggtattttttcctctttgcggggaaatcagtgaacttgggatacaagaattttttacagagcagaatctttcttactcagaagaaccaatcaccgaaattcctggaaccaaagtatttaagagttcttcggggaacatttcattgtactgttgcagtatttttgatcttcccaggacaaatattggcaaatttgacatgatttgggatagaggagcattagttgccattaatccaggtgatcgcaaatgctatgcagatacaatgttttccctcctgggaaagaagtttcagtatctcctgtgtgttctttcttatgatccaactaaacatccaggtccaccattttatgttccacatgctgaaattgaaaggttgtttggtaaaatatgcaatatacgttgtcttgagaaggttgatgcttttgaagaacgacataaaagttggggaattgactgtctttttgaaaagttatatctacttacagaaaagtaaatgagacatagataaaataaaatcacactgacatgtttttgaggaattgaaaattatgctaaagcctgaaaatgtaatggatgaatttttaaaattgtttataaatcatatgatagatctttactaaaaatggctttttagtaaagccatttactttttctaaaaaagttttagaagaaaaagatgtaactaaacttttaaagtagctcctttggagaggagattatgatgtgaaagattatgcctatgtgtcttgcagattgcaagatattttaccaatcagcatgtgttacctgtacaattaaaaaaatatttcaaaatgcaatgcatattaaatataatacacacagaaaaactggcatttattttgttttatttttttgagatggagtttcgttcttgttgcccaacctggagtgcaatggtgcaatctcagctcactgcaacctctgcctcccaggttcaggtgattctcctgcctcagcctcctgagtagctgggattacaggtgtgcgccaccacgcccagctaattttttgtatttttagtagagacagggtttcaccatgttggtcaggctgatctcgagctcctgacctcaggtgatctacccacctcggcctcccaaagtgctgggattacaggcgtgagccactgcacctggcctgacattctttatgaaatttagaattgttgaagaactataacatttcagtagggttcaaggtggtcccaaaagttatataaaagattagtttttactataaacccttgtcttttactcagatcctagcatcccttttcacatggtttctccatgtatataacagaatcaagaaacaaattttaattaaacaatctgtaacagaatcaagaaacaaatacattttaattaaacaatctatatggaacaaacattcccaaattctaagaataaatttttctttaagttttctctgagtttggcaattgttgttttttataatttaatctgtttaaatcatcaggtcttataaaatataatgtacttagagctggattcatggctgtttattatgaaaggttagatttctcagttcttctttaaccacattttgttatatcagacagtcctctataactctgtactacccaacaactaaatggtttagattgtttagctcatgttaataggatggttgtgtattataaaaaacgagttacgtgtgtgtgtgcacgcatgcacgcacatgtgctggcttaaaggttgttaatgcaaggtttggggtcccctttaacactggtgaaagctacggtactctccccagagatatgtcttgtcagcctctctagttccccttggcctgcatgtacaaacttctaccctagaagctctctgccatcgatgtattctaatagatttgtaaggctattaatttgaagcaactccttgctcacagtgattcttgcttctctgagacctgctcccagtcgatactgtgggcttcagaagccatgactccccaactctgcctgtatcaccggttgaatggacaactaacccgagctggaccaacacaattctctccagagacttttgattttacttttatgtagagacagggtctcactttgttgcccacgctgatgttgaacttgacgtgaggcctcaagcagtcctcctgtcttggccacccaaagtgctaggattacaggtatgagccattgcgctggccctcttcataggcttttggacttgggaatagaaaagcaaccccgtctctactaaaaatacaaaaaaattggccaggcgtggtggcgcgtgcctgtaatcccagctacttgggaggctgaggcaggagaatcacttgaacctgggaggcggaggttgcagtgagctgagatcatgccactgcacgccagcctgggcaacagagcaagactctgtctcaaaagaaagaaaaagaaaagaaaaaaaagaaaggcaagttgactgctgaaaggggaatctgtgtacgcctgggagctgtggggcagccacattccagcacatggatctgagaaacagaacgctgatctgcagaaagagatgagaaccaaagagaggccacctgcgtcctgggtccattttcatcctccctgaagcccagctgcccagggtggggagaaacaccctgtgtccatgggatagagtcctttccgcttgcagttgtgcccaaagaatcttaaatacaaatgagatatccttaggtagttgatcttttatgtaatatgtgtcttcactggggaatactgacttcctaaaatctcaagatggaagatataccacatgtaaattattttagagcaattaaattgttttcaggattttccaaaa

SEQ ID NO: 274370 - DNA, 2171 bp, Homo sapiens
caagagatattacagcacgcacctcgttttatttcagttacgctggcctagcgtttacagctctagttacttgccctgtgtctacaacaaagaggttccgggcgtagccctcgtcggataactccgagctcaaaatacgagacctctgccttctagtatcgtgtcctagtgcttagtcacttggctccctgagatcagttaaactgtttcttaacctgtgcacagggacagcagcacctgtcctgcacacctccgctctagggcatagtacatgccagactcctgttggagagaattgaattagaggcatagaagaaagttccctggacacgaagccaggagatctgtgttctaagcccagactcactgtcaccttaggctagtgcctccctctctgagccacagcttccttgggcggatttaagggaactaggcacgtttaatatattgagagagctgctgggaacatttgcacctggcctgacattctttatgaaatttagaattgttgaagaactataacatttcagtagggttcaaggtggtcccaaaagttatataaaagattagtttttactataaacccttgtcttttactcagatcctagcatcccttttcacatggtttctccatgtatataacagaatcaagaaacaaattttaattaaacaatctgtaacagaatcaagaaacaaatacattttaattaaacaatctatatggaacaaacattcccaaattctaagaataaatttttctttaagttttctctgagtttggcaattgttgttttttataatttaatctgtttaaatcatcaggtcttataaaatataatgtacttagagctggattcatggctgtttattatgaaaggttagatttctcagttcttctttaaccacattttgttatatcagacagtcctctataactctgtactacccaacaactaaatggtttagattgtttagctcatgttaataggatggttgtgtattataaaaaacgagttacgtgtgtgtgtgcacgcatgcacgcacatgtgctggcttaaaggttgttaatgcaaggtttggggtcccctttaacactggtgaaagctacggtactctccccagagatatgtcttgtcagcctctctagttccccttggcctgcatgtacaaacttctaccctagaagctctctgccatcgatgtattctaatagatttgtaaggctattaatttgaagcaactccttgctcacagtgattcttgcttctctgagacctgctcccagtcgatactgtgggcttcagaagccatgactccccaactctgcctgtatcaccggttgaatggacaactaacccgagctggaccaacacaattctctccagagacttttgattttacttttatgtagagacagggtctcactttgttgcccacgctgatgttgaacttgacgtgaggcctcaagcagtcctcctgtcttggccacccaaagtgctaggattacaggtatgagccattgcgctggccctcttcataggcttttggacttgggaatagaaaagcaaccccgtctctactaaaaatacaaaaaaattggccaggcgtggtggcgcgtgcctgtaatcccagctacttgggaggctgaggcaggagaatcacttgaacctgggaggcggaggttgcagtgagctgagatcatgccactgcacgccagcctgggcaacagagcaagactctgtctcaaaagaaagaaaaagaaaagaaaaaaaagaaaggcaagttgactgctgaaaggggaatctgtgtacgcctgggagctgtggggcagccacattccagcacatggatctgagaaacagaacgctgatctgcagaaagagatgagaaccaaagagaggccacctgcgtcctgggtccattttcatcctccctgaagcccagctgcccagggtggggagaaacaccctgtgtccatgggatagagtcctttccgcttgcagttgtgcccaaagaatcttaaatacaaatgagatatccttaggtagttgatcttttatgtaatatgtgtcttcactggggaatactgacttcctaaaatctcaagatggaagatataccacatgtaaattattttagagcaattaaattgttttcaggattttccaaaa

SEQ ID NO: 274371 - DNA, 1797 bp, Homo sapiens
attggggggaacctgagactgaccatcacattggtgaggaagtcctccacctggatgagagtttggaataactaggagactctttaaacctacttctgcacctggcctgacattctttatgaaatttagaattgttgaagaactataacatttcagtagggttcaaggtggtcccaaaagttatataaaagattagtttttactataaacccttgtcttttactcagatcctagcatcccttttcacatggtttctccatgtatataacagaatcaagaaacaaattttaattaaacaatctgtaacagaatcaagaaacaaatacattttaattaaacaatctatatggaacaaacattcccaaattctaagaataaatttttctttaagttttctctgagtttggcaattgttgttttttataatttaatctgtttaaatcatcaggtcttataaaatataatgtacttagagctggattcatggctgtttattatgaaaggttagatttctcagttcttctttaaccacattttgttatatcagacagtcctctataactctgtactacccaacaactaaatggtttagattgtttagctcatgttaataggatggttgtgtattataaaaaacgagttacgtgtgtgtgtgcacgcatgcacgcacatgtgctggcttaaaggttgttaatgcaaggtttggggtcccctttaacactggtgaaagctacggtactctccccagagatatgtcttgtcagcctctctagttccccttggcctgcatgtacaaacttctaccctagaagctctctgccatcgatgtattctaatagatttgtaaggctattaatttgaagcaactccttgctcacagtgattcttgcttctctgagacctgctcccagtcgatactgtgggcttcagaagccatgactccccaactctgcctgtatcaccggttgaatggacaactaacccgagctggaccaacacaattctctccagagacttttgattttacttttatgtagagacagggtctcactttgttgcccacgctgatgttgaacttgacgtgaggcctcaagcagtcctcctgtcttggccacccaaagtgctaggattacaggtatgagccattgcgctggccctcttcataggcttttggacttgggaatagaaaagcaaccccgtctctactaaaaatacaaaaaaattggccaggcgtggtggcgcgtgcctgtaatcccagctacttgggaggctgaggcaggagaatcacttgaacctgggaggcggaggttgcagtgagctgagatcatgccactgcacgccagcctgggcaacagagcaagactctgtctcaaaagaaagaaaaagaaaagaaaaaaaagaaaggcaagttgactgctgaaaggggaatctgtgtacgcctgggagctgtggggcagccacattccagcacatggatctgagaaacagaacgctgatctgcagaaagagatgagaaccaaagagaggccacctgcgtcctgggtccattttcatcctccctgaagcccagctgcccagggtggggagaaacaccctgtgtccatgggatagagtcctttccgcttgcagttgtgcccaaagaatcttaaatacaaatgagatatccttaggtagttgatcttttatgtaatatgtgtcttcactggggaatactgacttcctaaaatctcaagatggaagatataccacatgtaaattattttagagcaattaaattgttttcaggattttccaaaa

SEQ ID NO: 274372 - DNA, 1788 bp, Homo sapiens
tgtgaagtatttgggtatctaaacatagaaaatgttcaataaagatacaatataacagataaaaatgggattacaggcgtgagccactgcacctggcctgacattctttatgaaatttagaattgttgaagaactataacatttcagtagggttcaaggtggtcccaaaagttatataaaagattagtttttactataaacccttgtcttttactcagatcctagcatcccttttcacatggtttctccatgtatataacagaatcaagaaacaaattttaattaaacaatctgtaacagaatcaagaaacaaatacattttaattaaacaatctatatggaacaaacattcccaaattctaagaataaatttttctttaagttttctctgagtttggcaattgttgttttttataatttaatctgtttaaatcatcaggtcttataaaatataatgtacttagagctggattcatggctgtttattatgaaaggttagatttctcagttcttctttaaccacattttgttatatcagacagtcctctataactctgtactacccaacaactaaatggtttagattgtttagctcatgttaataggatggttgtgtattataaaaaacgagttacgtgtgtgtgtgcacgcatgcacgcacatgtgctggcttaaaggttgttaatgcaaggtttggggtcccctttaacactggtgaaagctacggtactctccccagagatatgtcttgtcagcctctctagttccccttggcctgcatgtacaaacttctaccctagaagctctctgccatcgatgtattctaatagatttgtaaggctattaatttgaagcaactccttgctcacagtgattcttgcttctctgagacctgctcccagtcgatactgtgggcttcagaagccatgactccccaactctgcctgtatcaccggttgaatggacaactaacccgagctggaccaacacaattctctccagagacttttgattttacttttatgtagagacagggtctcactttgttgcccacgctgatgttgaacttgacgtgaggcctcaagcagtcctcctgtcttggccacccaaagtgctaggattacaggtatgagccattgcgctggccctcttcataggcttttggacttgggaatagaaaagcaaccccgtctctactaaaaatacaaaaaaattggccaggcgtggtggcgcgtgcctgtaatcccagctacttgggaggctgaggcaggagaatcacttgaacctgggaggcggaggttgcagtgagctgagatcatgccactgcacgccagcctgggcaacagagcaagactctgtctcaaaagaaagaaaaagaaaagaaaaaaaagaaaggcaagttgactgctgaaaggggaatctgtgtacgcctgggagctgtggggcagccacattccagcacatggatctgagaaacagaacgctgatctgcagaaagagatgagaaccaaagagaggccacctgcgtcctgggtccattttcatcctccctgaagcccagctgcccagggtggggagaaacaccctgtgtccatgggatagagtcctttccgcttgcagttgtgcccaaagaatcttaaatacaaatgagatatccttaggtagttgatcttttatgtaatatgtgtcttcactggggaatactgacttcctaaaatctcaagatggaagatataccacatgtaaattattttagagcaattaaattgttttcaggattttccaaaa

SEQ ID NO: 274373 - DNA, 1164 bp, Homo sapiens
aggcggggcgcgggcggaggcggggcgcggagaagtggcggaggtggaagcggaggcgtacccgcccctggggacgtcattggtggcggaggcaatggccggcaaccagctgtaagcgaggcacggaagacatatgcttgtgagacaaaggtgtctctgaaactatggatggtacaagaacttcacttgacattgaagagtactcggatactgaggtacagaaaaaccaagtactaactctggaagaatggcaagacaagtgggtgaacggcaagactgcttttcatcaggaacaaggacatcagctattaaagaagcatttagatactttccttaaaggcaagagtggactgagggtattttttcctctttgcggaaaagcggttgagatgaaatggtttgcagaccggggacacagtgtagttggtgtggaaatcagtgaacttgggatacaagaattttttacagagcagaatctttcttactcagaagaaccaatcaccgaaattcctggaaccaaagtatttaagagttcttcggggaacatttcattgtactgttgcagtatttttgatcttcccaggacaaatattggcaaatttgacatgatttgggatagaggagcattagttgccattaatccaggtgatcgcaaatggtccaccattttatgttccacatgctgaaattgaaaggttgtttggtaaaatatgcaatatacgttgtcttgagaaggttgatgcttttgaagaacgacataaaagttggggaattgactgtctttttgaaaagttatatctacttacagaaaagtaaatgagacatagataaaataaaatcacactgacatgtttttgaggaattgaaaattatgctaaagcctgaaaatgtaatggatgaatttttaaaattgtttataaatcatatgatagatctttactaaaaatggctttttagtaaagccatttactttttctaaaaaagttttagaagaaaaagatgtaactaaacttttaaagtagctcctttggagaggagattatgatgtgaaagattatgcctatgtgtcttgcagattgcaagatattttaccaatcagcatgtgttacctgtacaattaaaaaaatatttcaaaatgcaatgcatattaaatataatacacac

SEQ ID NO: 274374 - DNA, 429 bp, Homo sapiens
  misc_feature (4)..(4): n is a, c, g, or t
  misc_feature (10)..(10): n is a, c, g, or t
  misc_feature (44)..(44): n is a, c, g, or t
aganactccntgctctaaaagctgcggaaatccaactgaacccncttgcaactgcgtcattggtggcggaggcaatggccggcaaccagctgtaagcgaggcacggaagacatatgcttgtgagacaaaggtgtctctgaaactatggatggtacaagaacttcacttgacattgaagagtactcggatactgaggtacagaaaaaccaagtactaactctggaagaatggcaagacaagtgggtgaacggcaagactgcttttcatcaggaacaaggacatcagctattaaagaagcatttagatactttccttaaaggcaagagtggactgagggtattttttcctctttgcggaaaagcggttgagatgaaatggtttgcagaccggggacacgtgtagaaatgacacgggatctccttgaatcga

SEQ ID NO: 274375 - DNA, 330 bp, Homo sapiens
ttgcaaatattttccacgtaggcacggaagacatatgcttgtgagacaaaggtgtctctgaaactatggatggtacaagaacttcacttgacattgaagagtactcggatactgaggtacagaaaaaccaagtactaactctggaagaatggcaagacaagtgggtgaacggcaagactgcttttcatcaggaacaaggacatcagctattaaagaagcatttagatactttccttaaaggcaagagtggactgagggtattttttcctctttgcggtgagctgagatcatgccactgcacgcaagcctgggcaacagagcaagactctg

SEQ ID NO: 274376 - DNA, 1250 bp, Homo sapiens
aggcggggcgcgggcggaggcggggcgcggagaagtggcggaggtggaagcggaggcgtacccgcccctggggacgtcattggtggcggaggcaatggccggcaaccagctgtaagcgaggcacggaagacatatgcttgtgagacaaaggtgtctctgaaactatggatggtacaagaacttcacttgacattgaagagtactcggatactgaggtacagaaaaaccaagtactaactctggaagaatggcaagacaagtgggtgaacggcaagactgcttttcatcaggaacaaggacatcagctattaaagaagcatttagatactttccttaaaggcaagagtggactgagggtattttttcctctttgcggaaaagcggttgagatgaaatggtttgcagaccggggacacagtgtagttggtgtggaaatcagtgaacttgggatacaagaattttttacagagcagaatctttcttactcagaagaaccaatcaccgaaattcctggaaccaaagtatttaagagttcttcggggaacatttcattgtactgttgcagtatttttgatcttcccaggacaaatattggcaaatttgacatgatttgggatagaggagcattagttgccattaatccaggtgatcgcaaatgctatgcagatacaatgttttccctcctgggaaagaagtttcagtatctcctgtgtgttctttcttatgatccaactaaacatccaggtccaccattttatgttccacatgctgaaattgaaaggttgtttggtaaaatatgcaatatacgttgtcttgagaaggttgatgcttttgaagaacgacataaaagttggggaattgactgtctttttgaaaagttatatctacttacagaaaagtaaatgagacatagataaaataaaatcacactgacatgtttttgaggaattgaaaattatgctaaagcctgaaaatgtaatggatgaatttttaaaattgtttataaatcatatgatagatctttactaaaaatggctttttagtaaagccatttactttttctaaaaaagttttagaagaaaaagatgtaactaaacttttaaagtagctcctttggagaggagattatgatgtgaaagattatgcctatgtgtcttgcagattgcaagatattttaccaatcagcatgtgttacctgtacaattaaaaaaatatttcaaaatgcaatgcatattaaatataatacacac

SEQ ID NO: 274377 - DNA, 1768 bp, Homo sapiens
aggcggggcgcgggcggaggcggggcgcggagaagtggcggaggtggaagcggaggcgtacccgcccctggggacgtcattggtggcggaggcaatggccggcaaccagctgtaagcgaggcacggaagacatatgcttgtgagacaaaggtgtctctgaaactatggatggtacaagaacttcacttgacattgaagagtactcggatactgaggtacagaaaaaccaagtactaactctggaagaatggcaagacaagtgggtgaacggcaagactgcttttcatcaggaacaaggacatcagctattaaagaagcatttagatactttccttaaaggcaagagtggactgagggtattttttcctctttgcggaaaagcggttgagatgaaatggtttgcagaccggggacacagtgtagttggtgtggaaatcagtgaacttgggatacaagaattttttacagagcagaatctttcttactcagaagaaccaatcaccgaaattcctggaaccaaagtatttaagagttcttcggggaacatttcattgtactgttgcagtatttttgatcttcccaggacaaatattggcaaatttgacatgatttgggatagaggagcattagttgccattaatccaggtgatcgcaaatgctatgcagatacaatgttttccctcctgggaaagaagtttcagtatctcctgtgtgttctttcttatgatccaactaaacatccaggtccaccattttatgttccacatgctgaaattgaaaggttgtttggtaaaatatgcaatatacgttgtcttgagaaggttgatgcttttgaagaacgacataaaagttggggaattgactgtctttttgaaaagttatatctacttacagaaaagtaaatgagacatagataaaataaaatcacactgacatgtttttgaggaattgaaaattatgctaaagcctgaaaatgtaatggatgaatttttaaaattgtttataaatcatatgatagatctttactaaaaatggctttttagtaaagccatttactttttctaaaaaagttttagaagaaaaagatgtaactaaacttttaaagtagctcctttggagaggagattatgatgtgaaagattatgcctatgtgtcttgcagattgcaagatattttaccaatcagcatgtgttacctgtacaattaaaaaaatatttcaaaatgcaatgcatattaaatataatacacacagaaaaactggcatttattttgttttatttttttgagatggagtttcgttcttgtgcacgccagcctgggcaacagagcaagactctgtctcaaaagaaagaaaaagaaaagaaaaaaaagaaaggcaagttgactgctgaaaggggaatctgtgtacgcctgggagctgtggggcagccacattccagcacatggatctgagaaacagaacgctgatctgcagaaagagatgagaaccaaagagaggccacctgcgtcctgggtccattttcatcctccctgaagcccagctgcccagggtggggagaaacaccctgtgtccatgggatagagtcctttccgcttgcagttgtgcccaaagaatcttaaatacaaatgagatatccttaggtagttgatcttttatgtaatatgtgtcttcactggggaatactgacttcctaaaatctcaagatggaagatataccacatgtaaattattttagagcaattaaattgttttcaggattttccaaaa

SEQ ID NO: 274378 - DNA, 1975 bp, Homo sapiens
aggcggggcgcgggcggaggcggggcgcggagaagtggcggaggtggaagcggaggcgtacccgcccctggggacgtcattggtggcggaggcaatggccggcaaccagctgtaagcgaggcacggaagacatatgcttgtgagacaaaggtgtctctgaaactatggatggtacaagaacttcacttgacattgaagagtactcggatactgaggtacagaaaaaccaagtactaactctggaagaatggcaagacaagtgggtgaacggcaagactgcttttcatcaggaacaaggacatcagctattaaagaagcatttagatactttccttaaaggcaagagtggactgagggtattttttcctctttgcggaaaagcggttgagatgaaatggtttgcagaccggggacacagtgtagttggtgtggaaatcagtgaacttgggatacaagaattttttacagagcagaatctttcttactcagaagaaccaatcaccgaaattcctggaaccaaagtatttaagagttcttcggggaacatttcattgtactgttgcagtatttttgatcttcccaggacaaatattggcaaatttgacatgatttgggatagaggagcattagttgccattaatccaggtgatcgcaaatgctatgcagatacaatgttttccctcctgggaaagaagtttcagtatctcctgtgtgttctttcttatgatccaactaaacatccaggtccaccattttatgttccacatgctgaaattgaaaggttgtttggtaaaatatgcaatatacgttgtcttgagaaggttgatgcttttgaagaacgacataaaagttggggaattgactgtctttttgaaaagttatatctacttacagaaaagtaaatgagacatagataaaataaaatcacactgacatgtttttgaggaattgaaaattatgctaaagcctgaaaatgtaatggatgaatttttaaaattgtttataaatcatatgatagatctttactaaaaatggctttttagtaaagccatttactttttctaaaaaagttttagaagaaaaagatgtaactaaacttttaaagtagctcctttggagaggagattatgatgtgaaagattatgcctatgtgtcttgcagattgcaagatattttaccaatcagcatgtgttacctgtacaattaaaaaaatatttcaaaatgcaatgcatattaaatataatacacacagaaaaactggcatttattttgttttatttttttgagatggagtttcgttcttggttgcagtgagctgagatcatgccactgcacgccagcctgggcaacagagcaagactctgtctcaaaagaaagaaaaagaaaagaaaaaaaagaaaggcaagttgactgctgaaaggggaatctgtgtacgcctgggagctgtggggcagccacattccagcacatggatctgagaaacagaacgctgatctgcagaaagagatgagaaccaaagagaggccacctgcgtcctgggtccattttcatcctccctgaagcccagctgcccagggtggggagaaacaccctgtgtccatgggatagagtcctttccgcttgcagttgtgcccaaagaatcttaaatacaaatgagatatccttaggtagttgatcttttatgtaatatgtgtcttcactggggaatactgacttcctaaaatctcaagatggaagatataccacatgtaaattattttagagcaattaaattgttttcaggattttccaaaacaaaacaaaacaaggggggacgacataaaattccccaaagggccaaactaaaaggacccgatttgtaacaggggcccaaagggggggaaaaaaacaaacggcgccatcacactgggatggaaaagaacatcactcagaagaacaatcggggacacacgacaaccacaaacaaccaagcaac

SEQ ID NO: 274379 - DNA, 3172 bp, Homo sapiens
aggcggggcgcgggcggaggcggggcgcggagaagtggcggaggtggaagcggaggcgtacccgcccctggggacgtcattggtggcggaggcaatggccggcaaccagctgtaagcgaggcacggaagacatatgcttgtgagacaaaggtgtctctgaaactatggatggtacaagaacttcacttgacattgaagagtactcggatactgaggtacagaaaaaccaagtactaactctggaagaatggcaagacaagtgggtgaacggcaagactgcttttcatcaggaacaaggacatcagctattaaagaagcatttagatactttccttaaaggcaagagtggactgagggtattttttcctctttgcggaaaagcggttgagatgaaatggtttgcagaccggggacacagtgtagttggtgtggaaatcagtgaacttgggatacaagaattttttacagagcagaatctttcttactcagaagaaccaatcaccgaaattcctggaaccaaagtatttaagagttcttcggggaacatttcattgtactgttgcagtatttttgatcttcccaggacaaatattggcaaatttgacatgatttgggatagaggagcattagttgccattaatccaggtgatcgcaaatggtccaccattttatgttccacatgctgaaattgaaaggttgtttggtaaaatatgcaatatacgttgtcttgagaaggttgatgcttttgaagaacgacataaaagttggggaattgactgtctttttgaaaagttatatctacttacagaaaagtaaatgagacatagataaaataaaatcacactgacatgtttttgaggaattgaaaattatgctaaagcctgaaaatgtaatggatgaatttttaaaattgtttataaatcatatgatagatctttactaaaaatggctttttagtaaagccatttactttttctaaaaaagttttagaagaaaaagatgtaactaaacttttaaagtagctcctttggagaggagattatgatgtgaaagattatgcctatgtgtcttgcagattgcaagatattttaccaatcagcatgtgttacctgtacaattaaaaaaatatttcaaaatgcaatgcatattaaatataatacacacagaaaaactggcatttattttgttttatttttttgagatggagtttcgttcttgttgcccaacctggagtgcaatggtgcaatctcagctcactgcaacctctgcctcccaggttcaggtgattctcctgcctcagcctcctgagtagctgggattacaggtgtgcgccaccacgcccagctaattttttgtatttttagtagagacagggtttcaccatgttggtcaggctgatctcgagctcctgacctcaggtgatctacccacctcggcctcccaaagtgctgggattacaggcgtgagccactgcacctggcctgacattctttatgaaatttagaattgttgaagaactataacatttcagtagggttcaaggtggtcccaaaagttatataaaagattagtttttactataaacccttgtcttttactcagatcctagcatcccttttcacatggtttctccatgtatataacagaatcaagaaacaaattttaattaaacaatctgtaacagaatcaagaaacaaatacattttaattaaacaatctatatggaacaaacattcccaaattctaagaataaatttttctttaagttttctctgagtttggcaattgttgttttttataatttaatctgtttaaatcatcaggtcttataaaatataatgtacttagagctggattcatggctgtttattatgaaaggttagatttctcagttcttctttaaccacattttgttatatcagacagtcctctataactctgtactacccaacaactaaatggtttagattgtttagctcatgttaataggatggttgtgtattataaaaaacgagttacgtgtgtgtgtgcacgcatgcacgcacatgtgctggcttaaaggttgttaatgcaaggtttggggtcccctttaacactggtgaaagctacggtactctccccagagatatgtcttgtcagcctctctagttccccttggcctgcatgtacaaacttctaccctagaagctctctgccatcgatgtattctaatagatttgtaaggctattaatttgaagcaactccttgctcacagtgattcttgcttctctgagacctgctcccagtcgatactgtgggcttcagaagccatgactccccaactctgcctgtatcaccggttgaatggacaactaacccgagctggaccaacacaattctctccagagacttttgattttacttttatgtagagacagggtctcactttgttgcccacgctgatgttgaacttgacgtgaggcctcaagcagtcctcctgtcttggccacccaaagtgctaggattacaggtatgagccattgcgctggccctcttcataggcttttggacttgggaatagaaaagcaaccccgtctctactaaaaatacaaaaaaattggccaggcgtggtggcgcgtgcctgtaatcccagctacttgggaggctgaggcaggagaatcacttgaacctgggaggcggaggttgcagtgagctgagatcatgccactgcacgccagcctgggcaacagagcaagactctgtctcaaaagaaagaaaaagaaaagaaaaaaaagaaaggcaagttgactgctgaaaggggaatctgtgtacgcctgggagctgtggggcagccacattccagcacatggatctgagaaacagaacgctgatctgcagaaagagatgagaaccaaagagaggccacctgcgtcctgggtccattttcatcctccctgaagcccagctgcccagggtggggagaaacaccctgtgtccatgggatagagtcctttccgcttgcagttgtgcccaaagaatcttaaatacaaatgagatatccttaggtagttgatcttttatgtaatatgtgtcttcactggggaatactgacttcctaaaatctcaagatggaagatataccacatgtaaattattttagagcaattaaattgttttcaggattttccaaaa

SEQ ID NO: 274380 - DNA, 870 bp, Homo sapiens
  misc_feature (768)..(768): n is a, c, g, or t
  misc_feature (772)..(772): n is a, c, g, or t
  misc_feature (777)..(777): n is a, c, g, or t
aggcggggcgcgggcggaggcggggcgcggagaagtggcggaggtggaagcggaggcgtacccgcccctggggacgtcattggtggcggaggcaatggccggcaaccagctgtaagcgaggcacggaagacatatgcttgtgagacaaaggtgtctctgaaactatggatggtacaagaacttcacttgacattgaagagtactcggatactgaggtacagaaaaaccaagtactaactctggaagaatggcaagacaagtgggtgaacggcaagactgcttttcatcaggaacaaggacatcagctattaaagaagcatttagatactttccttaaaggcaagagtggactgagggtattttttcctctttgcggaaaagcggttgagatgaaatggtttgcagaccggggacacagtgtagttggtgtggaaatcagtgaacttgggatacaagaattttttacagagcagaatctttcttactcagaagaaccaatcaccgaaattcctggaaccaaagtatttaagagttcttcggggaacatttcattgtactgttgcagtatttttgatcttcccaggacaaatattggcaaatttgacatgatttgggatagaggagcattagttgccattaatccaggtgatcgcaaatgctatgcagatacaatgttttccctcctgggaaagaagtttcagtatctcctgtgtgttctttcttatgatccaactaaacatccagccccatttatgttccacaggtganttgnaggtngttggccaattgccctcgtggctggaaggtggggctttgagaaacactaattgggaagcgcgggttggacgcttttctccccgagtggcacca

SEQ ID NO: 274381 - DNA, 1077 bp, Homo sapiens
  misc_feature (4)..(4): n is a, c, g, or t
  misc_feature (10)..(10): n is a, c, g, or t
  misc_feature (44)..(44): n is a, c, g, or t
aganactccntgctctaaaagctgcggaaatccaactgaacccncttgcaactgcgtcattggtggcggaggcaatggccggcaaccagctgtaagcgaggcacggaagacatatgcttgtgagacaaaggtgtctctgaaactatggatggtacaagaacttcacttgacattgaagagtactcggatactgaggtacagaaaaaccaagtactaactctggaagaatggcaagacaagtgggtgaacggcaagactgcttttcatcaggaacaaggacatcagctattaaagaagcatttagatactttccttaaaggcaagagtggactgagggtattttttcctctttgcggaaaagcggttgagatgaaatggtatgagcagataaacattaacagaattatcttgtcttaatgatgaattctttgggtgatttaacaggatgtgagttttaaaactccattttcaggaaatacacagaaattccttatttttctattagtgatgggtatataattggaaataatattctcaaacagtaagaaacaacagaaacaggtatgaagtctttctggattgagttttgaaattaaaaaatcagtttggagccaatggggggagaaaaaacagccttcccttttacattttctggatccttgtatgtggttcagtttttgtaggtggtttaggaatttagctaagttaatttttagatatttgaaatggtggtggacagagaaattcaaaatgaattacagctttttggcaggacaatgttcatagtccacagttcagctcaaccttcccctcccaccagggaacacaggagtttctgttatcgtgaatcattgttataaaaccagtgattaagaaagtatttcttgtgagtaattctctacaaagagaattcactttaacaagccacttttactatgagttaccctaaagtcacctcgacatcattctctatactgaactctcttgtaatgataatatacagatacaatcatacctgccaagatatgcatttatttataagcttgaatgttgagaactttgaccactgagcaggaa

SEQ ID NO: 274382 - DNA, 484 bp, Homo sapiens
cctttgagcgtccctacctcacctcccgagtagctgggatacaggtgcgtgccaccatgcctggctaattttgtatgtttagtagagacaggtttcgccgtgttggtcaggctgctctcgaactcctgacctcgtgatccacctgcctcgggctctcaaagtgttgggattacaggcatgtgccaccaggcatggctaatttttgtatttttagtggagacagggtttcactctattaggctggtctggaactcccgacctcaggtgatccacgtgcctttgtctcccaaagtgctgggattacaggcatgagtgacggtgcccagccattcgtgacatgtttatacaaatataactttagcaaatatttagcataactatcaaaattacaaatcatattaaatttgtataaatgtatgcaatttttggaacacgcatatcaacaacatacccataaatataactgagatgagatctaatgtca

SEQ ID NO: 274383 - DNA, 596 bp, Homo sapiens
ctattggcctcatagaaagattttggaagtattttctcctgcatttttcagaaaagtatgttggtgctgttgctttaggaccttcagacctggatggggacgtatgataaggatcctggttctcaggccttctggtctgcactgtagctatacctccagctttcctgtgctgtcagtttggagacagcaggtcatgagacttcactgcattcataattatgtgagccagtttgtcatggtaaatatgtatgtatgcatgtatgtatccatccatccatcctgttgattctgtttctctggagaacgctgattaaaacacctctctgccttcagaacctttttctttcctctgacgtattaatactttgaattttatagagagatattacatgagcagatgtggcaacattattgaatataaaatggttaattttgctgcatcacccaattttcttactctgataaaaactataatgtaagaaatgagataataattataagtgattatgacaagtgtaataataacatcacttttatggggaaataaggaaaagcaataatttataatgaaataaaaactaatgatcaacatacct

SEQ ID NO: 274384 - DNA, 697 bp, Homo sapiens
atcctggctcactgcgatctcctaccaggttcaagaacagcctggccaacaagagctgagaacccactctatcaacattaaacagcggcagttcctgtaagtttttaagggttattggaagatgactttacttgtcttcatacagtttcacctaaattatgttggtgctgttgctttaggaccttcagacctggatggggacgtatgataaggatcctggttctcaggccttctggtctgcactgtagctatacctccagctttcctgtgctgtcagtttggagacagcaggtcatgagacttcactgcattcataattatgtgagccagtttgtcatggtaaatatgtatgtatgcatgtatgtatccatccatccatcctgttgattctgtttctctggagaacgctgattaaaacacctctctgccttcagaacctttttctttcctctgacgtattaatactttgaattttatagagagatattacatgagcagatgtggcaacattattgaatataaaatggttaattttgctgcatcacccaattttcttactctgataaaaactataatgtaagaaatgagataataattataagtgattatgacaagtgtaataataacatcacttttatggggaaataaggaaaagcaataatttataatgaaataaaaactaatgatcaacatacct

SEQ ID NO: 274385 - DNA, 942 bp, Homo sapiens
cattttaaaaaactgatatatattctttaataagtgatttatctttgcatatatattttatatcaatcacatttagagtaagaatcacagttattaatgctttatgtgtaacaactgaatcatcagctcctgaaataagtattaatgatattctcatttcagaggtgaggaaacttaggacagataagcaaaataatcaaattaggctgggcacagtggctcatgcctgtaatcccagcactttgggaggccgaggcggggggatcacctgaggtcaggaattcgagaccagcctgatcaacatggtgaaaccccgtctctactaaaaatacaaaaattagctgggtgtgatggcgggcgcctgtaatcccagctattcgggaggctgaggcaggagaattgcttgagcctgggaggcggatgttgcagttagccgagttcccaccattgcactccagtctcagtgacagagcgggactccatctctctctctctctctctctctctttctctctctctctctctctctctctctctatatatatatatatatatatatatatatatatatatatatttagaaaatgggtagaactatgaagagacatttcactgaagcagttatactgagataaataggcacataaaaagatttccaacatcaccatccatcaaatctcagatctcagcatattctgctttaaaagactcatcttgtcacatttcagtaagaggcagaatcgagatttgaatccatgttgtctggttgcaaagacaaagcttttaatgatgatgctacagtaacaatgctagttatttttgtcctttactcaccatctatacctattttgttagtatctcttgtaatttttaaatggtttatcttcatatatcattgtgattgtggtaactttgtattaaatctatatttttatagatcaa

SEQ ID NO: 274386 - DNA, 299 bp, Homo sapiens
tcaatttcaaattccttgtgcagacaatctaattggcccagaggaagtaggcattgcttctaatgtaatcagcctgtgtgtgtggtgggcgtagggatgaggtggggggtgagggaggcacagaggacatggggctgcccagtggcaggaggagaggatctgcaggagacaaaataagaaggaaatagcagcatctctagcccaaccagcaactcccaggagccacctgtggctggtggaatacaactctctgtctctgacttagaggatttggtggtaatttttaaacacctgctttc

SEQ ID NO: 274387 - DNA, 238 bp, Homo sapiens
gagagtgagaccctgtctcaaaaagaaaaaaaaaaacaacacaaaaaatccttgcaatttgccttaagtaaagtttgcaagcttttattttgtgtctgaaggagtttacgctctgaattcttcaacagggcgtcaaggtagcagctttctgcattgactggtgattatccttttctgatatgttttaagacccttaacacttttaatttttttaattaccatttgtagtattagacta

SEQ ID NO: 274388 - DNA, 905 bp, Homo sapiens
atcaaagagctgttctttttagttgtgggtcaggcagttaagtcggagtagggtaggtgcttggaggtagagagtgagtagaagcatacttggtccttgagccagagggtgaacaaaactgggccccgttccttcagagggtgaccagcagacagaccgagggaagctgcagaccgtgggcacaaatccaatccaggctccccagggacagctggggtggggaagcataggagagggtgtgtgtgtgtgtgtgtgtgtgagagagagagagagagagtatgggaatgagaataactgtgtctgtagtggtaataagtgtgggcactggtgggatattgaagattctctgtcccagagccccagatcgatagcagagagaggaaggagacattaacaggaaggctgtgggagtctaaatgaggtgtgtctctatgcaaagtaggcacaggagtgaggggggctgattgttgttctgtttcagccaatttcctcactgttctgctcataaggggaaagtacagctggaatcaggactgcagtctacagttaacatatgaatagaaggaaattggccaagggtcattggtgtgtgtgataggaaagggggtttgttaaggagtgagttgtgggaatgggaaggtgtaggctaagaggcacggggccaaaaggtatgggcctgaggtgtaaggggagagtctgggagaggcggacctttgtagcttaagtctcttggttgccggaaggagagtacgatagacaagaactggatcccaactggagaggctagactggtggctggctgtgcccgttcatacattctcaattccagtaatgtaaaatcaatttttaaaaattgcatttgttaaaagaaaaaacatgacaatatttaaaagctaaagaaaaaa

SEQ ID NO: 274389 - DNA, 486 bp, Homo sapiens
agatgatcagcaaaggctaggagagaaaaaaacaggagatgctacacacaatatataatcatgggatttaggaaatcccctattaaagaacagatcccaaactcagtgaaacctgaagaaaaaaaggccagttttatgcgtcaacaagagacataactaaaataaaacaacacaggaaagttgaaaataagggatgggctggatacagtgagcaaatgctaatcaaaagaaacagaattggccgggtgtggtggctcacactagtgatcccagagcttagggggctgaggcaggaggatggcttgaggccaggagttcgagaccagcctgggcaacatggtgagacccccatctgaaaaaaattcgtaaaagataaaccaggtatggtggtgtgcacttgtagtcccagctgttcaggaggctgatgcgggagggtagcttgagctgcactcctagacaacagagcaagaacccgtctcttaaata

SEQ ID NO: 274390 - DNA, 1176 bp, Homo sapiens
acagaatcagaatcagtgagacggctttccatggtaacctgtatttgtatactttgaaaaatgactgttcctttttgtgtggttttgggtggtcaatttgcgcgggaatgaattgtagaggtgacgttacccatctgtgtgaatataaacaaaaaacctgattttattaacggcaaactttaaaaaacgaggtatgagtttttttttttttccttttcgagacattgttctacacatttattactagattggacattatatttaagcattttcataaatgtctatttgatgcttattttaatgcataattttctccccctcaaaggcaaaaagaaactaattgtcattcatcagtgttgccccccaaacctactgacctagcccctccaccccacccagtacttttacaatgtgttattaaagaccactgaacagctggagatccaggggtctccttcaatgcgtaatcccatccagaaggaaggaaaaaaaaagaaatctctttaagtcacgtgaaaatgccacgtttcttaatcttgcagagctgacaggcaaaaatgctatgctgttcatgaccttgtgcaggattgaaatataattccgcaacatgctgcgacctagtattccgtaagacacatcgagcttagggtgatatagttatggagaaatcttacctatgtttgttggataagggtatgatgacttagcctgggctcagaggcctgacagaaatgaaataatttatgctttggtcactaaattacaatccaaaggttaagatttggggagtgaaagatggtagagcatttgcttgctaattactccactacttgggagcagtatgtttgtttctgtgctaattagtttagaactgtacttcatgccctagaattaagaaaaactctaaagctgagatgaatctcctgcagggaagcagggatttagaagcacaggctgcaaggttggcctctcgccctccggtttctccgcctgcatgagagggtgggactgaacgctaaggtgaaaagcttctgttccgtttcgtttccctcttcattttctgttgctttattcttctcttattctcccctattcattataggggaggcttctgataaatgtgtagaatattagaaacttgataataaatatacacattcaaagcagcagtacgaa

SEQ ID NO: 274391 - DNA, 316 bp, Homo sapiens
tcttaaggtctttaagaaacataagtttaattcaggaaataatgacaacaccatattgttagatttataacacatagatcccatatatatgtacataaatacatatgacaaagcaggtgggaggaagcggagctatatggagcaatgtggttacgttccactggaattcagtcggtgttcacctcagtgagtgttcactgtggtgagttcaagatgcatgttgtaatctctagaggaatcactgaaataataaagcacacagataaagtatcaacaggagaactaaaacgtgtattagtctgcttgggcttctgta

SEQ ID NO: 274392 - DNA, 543 bp, Homo sapiens
cagagtttggaagaaataacaatgaagcgagccaaaatgttaattccctctttcgtttttgttatctcctttctttcttctctttaatctctattaagatctctaaaaatatggaagattttacttttcaaaggagaagacattgcatttccctttccttatgggtattatcaatttctctctgcctttatacaggcataccttggaggtgttgtgggtttttttccagaccaccaaaataaagtgagtcacactagtttttggtttcccagtgcatataaaagttatgtttacattatactgtgtctattaagtgtgcaatagaattatgtctctctatctctatctctatctctctctctctataaatataaattaaggtataaatatatagatatatatgtcttaattttaaaatacttgctgagtgtagtggttcacatcagtaatctcagctactcaggaggctgtggcgggaggatctcttgaggctagtagtgcaacaccagcttgagcaatagtgagacctcctctcttaaaaaa

SEQ ID NO: 274393 - DNA, 198 bp, Homo sapiens
tactgggagcatttgaccccgaattgaggattcattggaagcaagtgttttatagaaaattggaacgacacctttattaagcttcgtagataaaacttattaaatgtttatcaaaagtttattcatagcaattctgtatggtttttaattagcccagatttattagagtaattccagaaattcccttcagtatttcta

SEQ ID NO: 274394 - DNA, 403 bp, Homo sapiens
gtggggaaatctggcagataccatcttgttttcaagtaatcaaagttaaccgcattaataatggtacattcagcctgggcaacatagtgagaccttgtctttgcaaaacaaaaatcttttaaattagacaggcatggtggtgcatgcctgtagtctcaactagtcagaaggctgaggcaggaggattccttgagtcgaggaggtagaggctgcagtgagccaggattgtgctgctgcactctagcctgggtgacagagtgagatgctatctctaaaaacaaacaaacaaaaacaaaggtacaaactgacagcaggttcttcctggtgtgatataccaaaaaggaaacatcattatacagtattattgccaaaagtgctgaatgaaattaagagaatataacca

SEQ ID NO: 274395 - DNA, 556 bp, Homo sapiens
gtggccgcgtcttcttcctggaggcggccagatcgcgcgacctccaggcagtgctcctgcttggcagcacccacctgcctctgcttgagaaagcacaaactgccctctggggaagcagccagctggggagtgctctcggcctgtgaccccgggagggctgggtaggtggccacatgtcctgccccggctctgggtgtggctggtggcagagggtctatgagggaagggcaggacaaaggcaacccctaaggctaatctgaaatttagggctggggcgtggtggctaagcctgtgatcccagcactttgggaggccgaggcgggtggatcacgaggtcaggagatcgagtccatcctggctaacatggtgaaaccccgtctctactaaaaatacaaaaaattagccaggtgtggtggcggacacctgtagtcccggctactcgggaggctaaggcaggagaatggtgtgaacccgggaggcggagcttgcagtgagccgagatagcgccactgcactccagcctgggagacagagcaagactctgtctcaaaaaaaa

SEQ ID NO: 274396 - DNA, 364 bp, Homo sapiens
caatctaatcacataaatccttaaaatcagtacagatgtggcaaagcgaaagtcagagagatcaagataatgagaggaacaatttgacaaggaatgcaggttgccatagggaaccaagagcggctcctgactgacagccagcaaggaaatggagacctcagccacacagccgcaaggagttgaattctgtcaacaacctaaataaaactgaaagcacactcttccccagaggtaccagacaaaagctcaggtaagctgacaccttgatttcacccttatgagacctggaacagaggaaccagtcaactcttgctggacttctgacctacagaactgtgacataataaacttgagttgttttaag

SEQ ID NO: 274397 - DNA, 256 bp, Homo sapiens
ggtattgccattggcaggaatgtcttttttccttggccttctggcaaactcttcttctagaaccatcctttgagaccccacactacctcatgtgccccctattctcagtaatgatttccctaacaaccacctcccccataaaagaacaggactcggccaggcagggtggctcacgcctgtaatcccagcactttgggaggccgaggcaggtggatcacaagaggttaggagattgagaccatcctggctaacacag

SEQ ID NO: 274398 - DNA, 451 bp, Homo sapiens
ctctttcagcttgctctctgcactgatgctctctgcatgatacatatggtgcattttgaatacatactgcaaagaaaataacagcttctccaccagcttaatgcaaacacaagcctttgcataccaaatgacctgacaggcatatagccatgtaaatgtactcccatagcatattttcctgtttgaattcttctctactaaaacttcatgcataattctccattcaatacacctaatttatctttcttgctccatttttcctcaactgctgaaaaaatagtcaagtagaaaacgacccacgtcatgaatttccttaggagattgggatatcctatatgataacttgcacagaagttaatatttttttcttactgacatggccatatcatgtatctgacactactcttatagtttaaatcaaaataataaaaatacctgtagcaaatttaat

SEQ ID NO: 274399 - DNA, 285 bp, Homo sapiens
ttacaagtatgagagatataacccaaccacgttagtgaagccaagtaagaactacttaagtttagtgaatagtctaagaacgccaattaaaagacagagattgccagaatggataacaagcaagacccaataatatgttgtctataaaaaactcaatttaaatattaagacacgggtaaatcaaaagtgaaaagtgaaagggttggagcaaggtaggttggaggttggtgcaaaagtaattgcggttttgcaaatggcattgaaagtaatgtaatgaaattgaaa

SEQ ID NO: 274400 - DNA, 312 bp, Homo sapiens
gactccaggttggtgcacttcaatgccaagtactaaccacacaattacaggatgccaccaaaaccttgatatggggctgctgcatcctaattaaaaaaacagttaatagacattattttttagaacagttctaggtttacagaaaacttgagtggataatacagagagttctcctaggctcccctgtcctccagcacacaattttccctactagtatgttgtattagtgtggtccattcattacaattgatgaaccactgttgatacgtcattatcaactaaagtccatagtttacattagaggtcattctt

SEQ ID NO: 274401 - DNA, 491 bp, Homo sapiens
acattttgtgactattttatcacatgttcaaattccaaagcaaaataataatactgcatttttaccacagtctgtgttttctaagttaatatcttattacacacacaagaacccagcagcagctcagccaaaagttaaaactttgatgatgatgacagatgtaactgctgtgggcttctgggaaaacatgaatgatgtatgttagccaaggaggtagtgtggtaaacacagggatgcaacagccatcgatgccactggagaaagacaaaagtgatgccctgttggccatacccaggattggcacgtgataccttaaaattgatcctttaggcttaatggcatggcagttaaagaatatgataattggccgggcatggtgactcatgcctgtaattccagcactttgggaggccgaggcaggcggatcacgaggtcaggagtttgaaaccagcctggccaacatggtgaaaccccgtctctactaaaaatac

SEQ ID NO: 274402 - DNA, 466 bp, Homo sapiens
acggagctgagatgtatagtccagtccttgaagatcaacctggactccatgagaaatctgaaggccagcttggagaacagcctgagggaggtcgaggcccgctatgccttgcagagggagcagctcaacgggatcctgctgcacctggagtcagagctggcacagacccgggcagagggacagtgccaggctcaagagtacaaggccctgctgaacatcaaggtcaagctggaggctgagagcactgcctactgctgcctgctggaggatggcaaggacttcaatcttggtgatgccctggacagcagcaactccatgcaaaccatccaaaagaccaccacccgccggatagtggatggcaaagtggtgtctgaccaacgacaccaaagttctgagacattaagccagcagaagcagggtacactttggggagcaggaggccaataaaaagttcagaggtcaaaaa

SEQ ID NO: 274403 - DNA, 353 bp, Homo sapiens
cactgtatccatttataattgggtaaatcttgagtaaaaagaaagattatattacactcgtaaatcaataactattttacattttggaaaaagcaacaaacaccaaggataagaattaagtgttgtttctacatactacagataattttcaagacacagaatgtaaggcctggaaaatgagggcagaaggccttgtttatttgtctatacccaatgtttagttctttgtaggtactcaataaatacttgctgagtaaatgtcgaatgagtctacttatctacttttagaactgcaaagctttcagcttcaacagagaaaagagtacatcaatatggcgagggcttccccaaaa

SEQ ID NO: 274404 - DNA, 1575 bp, Homo sapiens
  misc_feature (524)..(524): n is a, c, g, or t
  misc_feature (1052)..(1052): n is a, c, g, or t
  misc_feature (1429)..(1429): n is a, c, g, or t
  misc_feature (1503)..(1503): n is a, c, g, or t
  misc_feature (1514)..(1514): n is a, c, g, or t
cattttaaaaagaaacttctccaaaactacattagatatttatatctcacatgtctttagattccattttcctaagctgggtttgggtggatcactctggtaatatgagatgggccatgttctgcatcttgaagttagagtttggccaatttaggctacatctggagggggtgatctcattctcattctgcttctgggaatggtgtactagtgtggggatgtgcttgtggtaaatggagaagagcaagaaactccaatgtggaagccatctcaaagacgtatacaaaatttactaatttccagttcatcaaagcaaattacatgagtgagctcagattccaaggtcaaggtagtcaccctgcctatggcaggaggacactgcaagataatatatcaaaggatgagggagtcaagagtatttacaaaacagctgaatagtttaattaaataattaatatttaaacattaaatagacttgagagtaactttaccaaaggcctaagcatgagaaatatgtttgatanatattattctggtctgaaaaccctgagtgggaaaacagaactaattccacctggatgaccttctggaaactcattttttcatttttttaaattaaaagaaaataattccttccaaccccaatgggtttaagtgtgtgtttttgtgtttatgagcttgttaacaataaagtcatataaaagtattggttagcagcaacctgattttaaggcgtattggccttcttgtggttcccaagaaaaccttggatgattttgataaaaggtttgggttctgtatatttaaatctagcattaaaaaataaatccatatttatacgatcctaggtatgaccaagctcttttaacagtttagacatttactgtatgacatatgtattgggttttaaaatttccctatgaaacaactgaaaatgctgaatacaaattatggagaggttaaacaaggaaaaacattgcaaaacaatgaaaaagaatatgtctttttttgcatactagcaaacgggaattcacctttcacttcaacatcanttttaaaaatttcagcgtatagcaagaacagacagtggaataggattcaatttcagctattttgggaataagaaaattttccataaatgcagcattgaactcatccattagcatatgctggtgcttttctgttgacattagtcaaataatttagaagcacaaagaatattattacacatttaggaatgaagtgtatatccaatttaaggtctagatattaaaggaatcacaatctgtgttattaggcctgcatttttcctttctttttgtctcttcagacatgttaaaatttctacttatcattttgtcaactctgtgtgtttgcattcgttcttggaaatttgtctccacaaaaatgttaaaattagcaggcttgntggtgcatgcctgtagttccagttacttggcaagctgaggcaggaaggcaagagtatcacttgtgtccaggagntcaagactacngcgaggtatgattgtgccactgcactccagcttgggtgagagagcaagagcctgtctcaga

SEQ ID NO: 274405 - DNA, 368 bp, Homo sapiens
tcattgataaggaaaaattgtatctatttatggtgtacagtatgatgttttgatatatgtataccttatggaatggctaagtcaagctggttaacatgggcattacttcacatatttatcatttttttgtggtaagaacacttaaaatctacccttagcaatgttcaaatgtacagtgtactgttattcactataatcactgtaatgtataatatcttgaacttatttctcctgtcttactgaaattttgtgtcctttgacagatatctccctggttccctcacccctcagcctctagtaaccaccattttactctttttctgtgagtttgacttttttagatcccacaaataagtaaaatcatgggg

SEQ ID NO: 274406 - DNA, 387 bp, Homo sapiens
gaaagggggagagactgtatcaagggtctagcacagatgataactagagttgagcattaaattaaatgctaagcctcctgcaaccaaagcaaacagggaagtaactcattttttcaggagatacagcttttttctacattaatttctatgaggtatcaatcacatagtttttttatttccttacataaagcccactgaataacttgacaggatcctaacacttgacaggtggtttttgctaaagttacaaaaccaatttttgctattgaaagttaatagtaaaatttgtggcatgggggttaactgtaactcagctaaagctttttaaaggtttaagtttacaaatacttggtgatatagctagatatatagtaaaattacttagag

SEQ ID NO: 274407 - DNA, 538 bp, Homo sapiens
ggaggccaaggcaggagaatcgcttgaacctgggaggcggaggttgcagtgagccaagattgcagcattgcactccagcctgggcaacaagagtgaaactctgtctcaaggttaaaaaaaaaaaaaaaaaaaaaaaaaatctaagtcccaagcatgtatggtggaattgaccagtgtttaataaatatcttctgaaatactagacagaattggttgcagactatgaaataatttccatgtctttatttcaacaactgcaatttttattgtctttttaggatttccaattccatgtgtgtccctctcttcctgccttaactgtgtctcatttccttataatgtgctctctgattactgagcattttctgcgtattttcatatgcaaaaactaattacccatctaataattatttagtggtttcagatacagacgtactataatagagtcatagatacatggaaacatttaaaatacattcaaaaccaagatgagactagccatgatttgagtaacaagcatctttaaaataatgttaaa

SEQ ID NO: 274408 - DNA, 378 bp, Homo sapiens
ggagaggctaagtgacttgcctgggacctccaagccaggtctcccgaggcccacaggggctcccatgcaggagcgggagtgccccccaggccttcagagcccactgtgtctcctgctcatggcatgtcttgtaaaggggggtggaggacggctgtgtttgcagactaagaatctgaggcgcagaggctgccctggttcattcaggccatacgcttcgctaggccagaaggaccccagggaagctggggagccagtctcgtgggcagttgtcagatgaattctgtaggggatcgatggtcctaggcggctaaggggtgagtgcaggtgcatggtgcattctggaacctgcaagctcagaccccaacaggacagagggca

SEQ ID NO: 274409 - DNA, 162 bp, Homo sapiens
tgaattcaacaacaggagtttatttcccccaagctctggagactggaagtccaagatcaaggtgtgagcaggtttggtttctccggcgccttccttccttggctggtagacagccatcttcccgctgtgcccgcacgtggtcttttccctgtgcacacccct

SEQ ID NO: 274410 - DNA, 294 bp, Homo sapiens
acaggggaggcttcctggaagaggcaggaatatagaagcacggaatcttggcgtgggaagggatctcaaagatcaccttgtacagccctctctgagtcatgggtcacctctcctgcaagctctcttctcccaggaagggctgaggacatacttcctccatggacctggtgactgcttgctgtacacctgcccccagtcatgcaggctatggggatgatcttccaggagtacccagcctagccctgggcaggtgagagcgggctaggagtaggtgaaggagctcatcacccaccc

SEQ ID NO: 274411 - DNA, 455 bp, Homo sapiens
tgccatatgaagaaacaatgagaagaggtcagtctgcaaactggaagagagccctcaccagaacttgaccaagctgacattctgatctcagccttccaaaactgtgagaagtaaattcctgttgttcataagccacccaatttatggcactttgttaatcgcagcctgtactaagacaggagcaccatgaattgacttgaaacatgtgggatacagcctttatttaagctgttattgaaaaagcaagagagaacttaagccacactgtgacagagactgtcacaagccgtggagggagcaggagcggtagactggcaagctataagcactgacatctacttttcctctccagaggggctctgccaggaagttcccaacccttcctactaaagcttctccttctctgacatatcccaaatcaacttggacttctctatccccatgccctcctttaa

SEQ ID NO: 274412 - DNA, 757 bp, Homo sapiens
ttctgcatgtctggggaggcctcaggaaacttacagtcatggcagaagatgaaggggaagtgaggcacatcttacatgatggcaggagagagagtgtccaggagaaacagccacttttagaactatcagaactcatgagaactccctcactatcatgagaatagtgtgggagaaactgtgcccacgccaatcacctcctaccaggtccctccctcaacacatggagattacagttcgacatgagatttgggtagggacacagagccaaaccatatcaaatggccaggttaattggtaaatgtcgtatcttctgactgctccactgactgactgttctcctatgtctccctctcctggatctccctattccctgagacacaacaatattgaaattttaggcgaattcacaaccctgcagtggcctttatgtatttaagtgaaagacagagttgaacgcctctcactttcagtcagaagctaggtggctcacgcctgtaatcccagcactttcagaggccaagtggggcggatcacttgaggtcaggagttcaagaccagcgtggtcaacatagtgaaaacacctctctacttaaaaaaaaaaaaaatacaaaaattagctgggcgtagtagtgtatgcctgtagtcccagctacttgggaggctgaagcaggagaatcacttgaacctgggaggcggaggttgtagtgagctaagatggcgccattgcactccagcctgggcgacagagcaagactct

SEQ ID NO: 274413 - DNA, 353 bp, Homo sapiens
ctcccagagtgctgggattacagatgtgagccaccgcccctggccagagcttcattcctctttacggctcagcagtgtctcactgtacggatgggccttggcttgtcaatgcactcatccgtggatgcgcatccgggtctatccacctctcggctcctgtgagcacaacgctgtgtgtacattgcgcgtctgtttgaatccctgctctaggggaatgtacctagcgtggagttttggagactgtggtaatcctatgttgagtcttgtgagaagtggagggaccctttctttgtttgttattatttttaaatttttttccaaactctcttctctctgaaattaaaatgtgttca

SEQ ID NO: 274414 - DNA, 292 bp, Homo sapiens
cctcagatcctttttttggaagaaaaagaaagaaatggaagacagactggccagcagggggagagagagggagggagggcatatcagagaattcaatatgctgcgttttaaccagatacttttcttcctctcccacaaggcatcagagtagagactgcctttcatctctctctcccttgtgtaatagcacagtgtctggcagataactgttgcttgctaattattagaaggaagaaagggagggagaataaaagccagcatcagcatgtgatcttcctaagtgcgacagatg

SEQ ID NO: 274415 - DNA, 353 bp, Homo sapiens
atcaactccacgaagggctgtgaaaccatatctgcccgtttcctttcccgagagcctctctctagtggcaagccagtagctaatctacaccggagaagttacgacccttgtcttttgcagttaatggcagcctgtttgttttctgcacctctcttttccttttggggaacacagggctgaaaggtaacaagatccaacagggctctaatcattatataaactgtctactgaagaggtccctctacctccaccaaatttctcattaggtggccacagttgagagccaacagtctctggcaacaattttgaataactattcatattaaagaggctttttacaaaagggataaact

SEQ ID NO: 274416 - DNA, 329 bp, Homo sapiens
tgggaggctgaataatgcctccccgaagatagccatgtcctaatccctgaaatctgtgaatgttaccttgtggcataaaaaaaggatctttacagatgtaattaagaatcttgagatgggcagagtctcctggatgaccaagagcttcaccatatcccagtccgatcccactacttccctgatggaaacccttcagtgggctcctggcatgtttcccagaaggtcccagatctctggcatcactctctgtggtttgaacttgctttctttcaagattcacctgtaattttattctgcttttcactataaactgtagactatagttacac

SEQ ID NO: 274417 - DNA, 215 bp, Homo sapiens
gtcaaggatgactctccaatttctaacatgagtgtctagccagatcacactacagtcaagtaagataaggatacaggaggagagaggagtaggtctgatggagggaagatcatcagtggttgtggtgagtataagatggatgtgggacttccaagtggagacatctaacatgcaactggatatgtaaactggaagcttgagggaaaggccgggag

SEQ ID NO: 274418 - DNA, 283 bp, Homo sapiens
ctatgggcctgggacctgggtctggggtctcagaggaagcgagggtttgaggagaggaagggaagtgagcttggagaagggacactgggaagaggagcaacagggcttggaagagggctgggagtctggggtgacagggtctggctgcagtctgggaagtggccaccagagggcgactcaggcctggctcaacagcccccagggccgggctccaggctggctccacgacgttgggctcctggtcccagaacctggctctccctcaagccccactctcaggccc

SEQ ID NO: 274419 - DNA, 364 bp, Homo sapiens
gaattaacatgccactccctgcctgtgactgcctttttttgcagctgtttttaaagaatgtattcaaattaatccataaagtacagttgtccctcatatctatggggtatttgttccaggacccccaaggataccaaaatccagggatactcaagttcctcatatagaatggtgtagagtttgcatatcctatgcacaccctcctgtatactttaaatcatctctaaattacttataatacctagtacaatgttaatgctatgtaaatggttgttataaggtattttttaatttgtgttatttttattgttgtattatttatttatatattttttggaaactgggtgacaaactgagatcctgt

SEQ ID NO: 274420 - DNA, 443 bp, Homo sapiens
aaacacccacaaacttacgaggatcacagaaaacacccctacaccaacttatagccaatctattcaacctgcattgttagcaggtcacctctcctggatctctgcctgtagtgcccaattaagaatggaaggaggagatttttcagcttttgaagtctgcataccttcaaggaaattcttcaaaaacagccaagacattttaagatgaggagctacagaacagggtacatgccccacagtcttcaatactttttattattgtttcaagaaaactggataaattcattctgaacatcacagacttgaaagtcattgttaccatgcctttgagaatgcctatagttatcattgccatcatctcaaaggagaagaattctttaactcttattgtatatgcaattttgaataaaaaaatcaagttgcattgttattgaaattaaaga

SEQ ID NO: 274421 - DNA, 401 bp, Homo sapiens
tatttaaaattaaaagagaaggaatggtgcttggccacacccccccccccccccggtcaaagttggtagagaaagaaaatgggtttgcccgggttttaaaggaaaaaaaaaaaaagaaaaaagaaaaaggcctcttttaagaaaaagaaaaaaagaccccccaattccttatcccccccctttgttgatcattccacatagaattttagatggttggccaattagaaggttagatttctattcttttctttcttaactgaaattattccagacttgaatgctgctattaaatgttcaactccaaatttaaaaatctctaaataggcagcgtggtggcttattcctgtaatcccagcactttgggaggccaaggctggtggattatatgagcccaggagttt

SEQ ID NO: 274422 - DNA, 435 bp, Homo sapiens
aattctctcccctgcctcttaaaacacactgcactgaaaccttggggagaggagaggacttgctttgttcttactgtagcctcagtgtttggcacctaggaggtgcccatttgctaagggaaatggtctctggtcacaacatttttatcagcctatcaatatatgcccttgttttatgtgtgtttctgtttaaagatgccttatttaatatatattgttgattcattaacattgaactgatggccaacagcactctaaattacacctaaacaaagcccatctaacagtcatattttctctataaggcacatcacagccttcttgcacttaggaacactggacagcattttggctacgctcagggccattttaagcagcaaattcaccaacaaaacacaaaaatgggaaaaacgtagcactaaatagacctcaaag

SEQ ID NO: 274423 - DNA, 518 bp, Homo sapiens
taagacagagtttcactgtgtggcccaggctggagtgcagtggcgatctcggctcactgcaacctccgtctcccagttcaagcaattctttcacctcagctccctgagtagtccagcgcctgggactacaggcacgtgccaccacgcctggctgtttttgtattttttcatagagaggtggtttcaccatcttggccaggctggtctcaaactcctgacccgaagtgatctgcttgcctctgccttccaaagtgctgggattacaggtgtgagccaccatgcctggccccataccagttattctttcatttactgttacttctttcttctgtatatttactgaatttcctgctctcttttcctcttcgcctaactaaattctttccattgtttcattctcaccttacttgctgaagaatctctaaatctgtgaatgcatttggaggggtataacccaattgagtgttctgccactgtggaccctgctcctccaagttatcccttctgtcgtcttctcc

SEQ ID NO: 274424 - DNA, 503 bp, Homo sapiens
gggagcttcatttccatccttttttcttcttccctattcccctccctcaccttataggtatcaattttgaaaaaaatgttatagattatcctaccattgttttttcaatatcagcaaatatttagtcttctttttttttttttaaaaaaataggtttttcactatggtttatttcactcactccattttttgtgtatcttttggtagttagaaaggtttgtatttgggttctaatgcttatactcagccttcacatagcattcccactcccctcttgtttggtctttgttggttccaaatatgaggagtaattgaaatgagctaggagcctcttcctccccgtccatagcactggttttgaaccaatgaccttcgtactctttgggaacatttccagatctctggaatgaatgcattttgtgtagagacacatgcatggtccacaactgattaggatgcagatgcagtaagttaacttaggatcacttgaaataagtaaaaaa

SEQ ID NO: 274425 - DNA, 934 bp, Homo sapiens
tttgttatgtactcggcactaaagcaccttcaatggacttaataaaaacacattttttaaagttaaggctactttgatttaccccacattatctatccttaaattctagacttcttggtagtattgccgaaaaaatagagtaatacccatgaaattgaaagaaaattctttcagtcacccaaagctcaatttacatctgtctctcccataaagtaatctcattctggatcgcctataacttggaacctacaatataaaggagtctctcataagacatttactttcttgtggaaattaatctttttccatatgcagaagaaatacatacagattagttctagcacaaggagagggtcaaaatggccaggcgcaaaagacgtatgtgaaattcaaggtattagtcaagaaagcctccagtgagaaaaaagggctcgacatcagaagaatagcccatcactatagaaagttaaatattcggagctccaaattcacatagggggaaatagcattgctctatcctcatatatgacacaggagagaatgttacagcttgagtcttgtcatgcttacaattcaaagatgaataaacaaacaacacatagtgaaatcaaagttaaatgaagcaagtatgacaccttaagaataagaattaaactgaatgtgcatgtcatcatacttctgaaactgactttggtcagagaggaaaacttataaggaagaactcaagaagatgaaaggtagcatggaatctaaaacacaagagacagaaagtgtaattaggaaaaagatagagatgtaattctgacaagtaaaaaaaaaaaaactcttgctgaaataaattagaatatttgataaaaatgtaaataaaacttttaaaaatcttctcacagaagcctataggaatatacctgccattgtggatcttagccttaaa

SEQ ID NO: 274426 - DNA, 406 bp, Homo sapiens
caaaaatacaaaaaaaaattagccaggcatggtggcgtgcaactgtagtcccagctactcaggaggctgaggtgggaggattacttgagcccaagaggaggaggctgcagtgagtcaacattgcaccactgcactccagcctgggcaacagagtgtgaccccatctcaaaaaaaaaaaaaaaaaggagagagggtgagaaagtaaaagagagctgaactcgcccttttataacaaacccactctagcgataacaacattaatcattcactgcaccctcatggcctaattgtcacaggacagactccaaaattgggcttcatcttggaaggccacacggatttttggctttgtgcaggaaggaattcaagagcaagccgacagagtgaagtgaaagcaagtttatta

SEQ ID NO: 274427 - DNA, 583 bp, Homo sapiens
gggagaacatgaaaaaatgttgacaaaataagtcaagtaattaacaaggtactttccaagcccttaacagagaagctgccatcatggtcaggtgtaattatggatttagaaaattcatccttcattgagaaaaaaaaaacaacactcctaaaggaaatgagagcttcggccttgctgggcatcgggaaatcactacaaggagaggcttaactcacgcaggctccctgaaagcacagagggagctaaagaaaaataattcgaggtgtctgcaagcgagaagcacagtcctccaccgttcgcacctgcccgctgaatcaaaggctttgaatactagaggctctttaccttctaatggaaacacattctcaacttctgtatggattagatctcacgacgcttgcatattccttcaagcatacatgagtataaaatcatgtgcaaaaaataaagtctcacttttcttgatatgcagccagtgttgtcacacgatggccaggtagaagtttccttctaaaaccacttttacttgagagcaaagaccaaaatgattcttgaaataatttaatgccttacccaagcagac

SEQ ID NO: 274428 - DNA, 217 bp, Homo sapiens
ggccctaagaagctgtccttccctcccaggcatagccacgcgtatcgggagctgagagcagggaggggttgggggttgaggagagggcaggtacagaggctccaggcatagagcagacacagggcaggggaagaagcacagagctcacgcagggctaggggacccaggtgtgaaggagaggccagaaggatgtccttggggatcagccagtagctca

SEQ ID NO: 274429 - DNA, 270 bp, Homo sapiens
aacatggtgaaaccctgtctctactaaaaatataaaaattagccgggcgtggtggcggctacctgtaatcccagctactcgggaggctgaggcaggagaatcgcttgaacccaggaggcggaggttgctgtgagctgagatcacgccactgcactccagcctgggcgtcatagcaagactctttctctaaataaataaattaattctgtctttctgcagtttttctgatatttggcaagtactggaaattattattttccttaagacccc

SEQ ID NO: 274430 - DNA, 491 bp, Homo sapiens
attccctgaggtagtcctggggctcttaagagattacagttcttaaaacctggaaagtgacaccagagaggtagatcttagttcccaaaattaaagttactttctagggcataaaaccttttcagaattcagattaaattttatttattttttcttttttctgtaaccttatatttgaggggaaaattttgttttcaacttttgcatatatctaatttaacatttgggaaaactgtaaatgggccaaagtttctccctttatatgattttccagatttttaccactttcttagtgccacttgatgctaggcattgtctattggagactcactggtacgtaactgcaggttttaccatggaactacatatacacatgtcttggaattgagggttagggtttccagaaggacttagttgtcctgtgcttttgtctgccccatgccaaagaccactaagaacagttttgtaagtgaaacttgggtctacacgtt

SEQ ID NO: 274431 - DNA, 322 bp, Homo sapiens
cttctgagcaaaaggcattgacagtttgattcacagatatttgcataacagacagtcttggaaagataaagatagtgactccctgcaaagagatttggagctgcctcttcctgagatattccagggtaacagagctagagaccgtgccctttattccctgaagatttgcttacattctccagggaggggccaggcacgatggcacacacatgtaatctcagcactttgggaggccaaggcgggaggatcgcttgaggccaggagtttgagaccaccctgggcaacatagtgagaccgcacctctacttttatttaaaaaaaa

SEQ ID NO: 274432 - DNA, 421 bp, Homo sapiens
gaaagagaggcagagtgacaggctgcacacgtggccaagcgcaactcaccaaaatgtttccccgggacaggctggcagcgtagatgtgagcagggggctcagctgagcccggcttccgagcagtgctgggactaggccactgttttattagcaggatcaggaggtgattgtgccagttaggccggttcttctcctgcagtccccacgatctgcgtgcctgggcagcttagcaccgtaaatccaccgctgctggctggcagagcagtgcccaggcggccccgggagagtcagcaaatgtatgctcatttttctcttattataaaatggccatatcattgcagagccatggggtggaaagttaaaagcatcaatctcccttagtgttcaactggataataaatgggtctagctatgctgttta

SEQ ID NO: 274433 - DNA, 422 bp, Homo sapiens
agcctccttggggtctgtaatgacaacaccttgtagcctgtaactagctctaagcccagaacagaagctaagacatttgcaccctcaaaacacatccttgagctcagagctcagagaccctactgggtctgggtagggatgtgtgaagcaccacagtggccatccacagggaaacagagagagtaacactggaggccgggagccacaagagcaagcgccttgctattggaggaaacaggagataaactgagttcacacttgaatctctaaactcctgatagtaaattttgttttgatttataccatgcagttcttagcatcagacttaactctcctacctgactcagaacattttgatttacaaattggaaaataaatgggtttgcacatcctgggcctgtcttgcaaaccactccaataaa

SEQ ID NO: 274434 - DNA, 321 bp, Homo sapiens
ggttacactttagcaagcatttatagcttgtttgtccaacagaatgttgaagatctttttgagttctaagatttaccatgggacgggcgcggtggctagctcctgtaatcccagcactttgggaggccaaggtaggcggatcacctgaggtcaggagttctagaccaatctggccaacatggtgaaaccctctctctactaaagatacaaaaattagctgggcatgatggcaggtgcctgtaatcccagctgttctggaggctgaggcaggagaatcgcctgaacccaggagacagaggttgcagtgagctgagattgcac

SEQ ID NO: 274435 - DNA, 512 bp, Homo sapiens
gaagaaaatatgattttcaaagttgccacattacatatttttaaatagctactttttaacaaaaagtcattagatatgcaaagaaacaagaaagtaagtctcactcacagagagaaacaatgcagtcaacagaaactgcatctcaggaggcccaaacagtagattcaaagtaaaaatattgttgttaatattttaaattttattaatattcctaataaaaagttatttagaacagttatttgaaatatgttcaaacaactacatataatcatgtctaaatataaaacataaaaatttagaaagaaacaatatcaacaaagagataaaatttgaaaacaaataaaaattgtggagtccaaaagtacaataactgaaataaaatattcgctagtaggggtctatagcagatgtgatctggcagacgaaataattagtaaactaaaaatgtgttgattatccacttaacggaagaacaggaaaaaaaagaaaaatgaacagtctcagatctcaga

SEQ ID NO: 274436 - DNA, 391 bp, Homo sapiens
ggttattatcgaaaagttttctgtcttgctgtttggctaaccttctcttttcctggtcctttggctagagacatcaggcttgttttggactttctttgtctgtatccattggcattctgtgcatctaccttctccagctccagcacagtttgggatataagaggcaataaagaaacccagggaattcactgctatgtcattctttgggtcctgagattcctagtagtctgcattcttctttccacctttatatataaggtccatgattttcagttgtactttgcagaaggaatagggaaatgtacttctccatttttctcaaagcagatgtccctaatgtatattcagcccatttatttggaagtctctttaattctgcccctccgctgca

SEQ ID NO: 274437 - DNA, 380 bp, Homo sapiens
cgtccaagtctgagctctgatcatcctgaagaatcaaagtatcatcatcccttggctggcaagatgaactccaacatcaaaacacttgaaacagtagtatttttacacaatttgcccactgcctctacatctcacttagtccttgcagtaacatttggatgatgaggtaacttatccagaagcacaaagcctaaagaatgacagagcttggactcctgagaagttcagctactgcccgccttatgataaccaaaagaaagcggccgggcgcagtggctcaactcctgtaatcccagcactttgggaggccgaggcgtgcgaatcacaaggtcaggagtccgagaccagcctggccaacacagggaaaccccgtctctact

SEQ ID NO: 274438 - DNA, 449 bp, Homo sapiens
aaataagctaacgggggggctatcacagttcagagaatcttgatagctcagattcatagactggggagaagaagacaaggtatgccaggtttgggggcaaagttgacaaaatactgaagtattagcatggtatttatgggtaggtgtgaaagactcaacttgaagaagctgagcctctctggttggagacaatgctggatggaaaggctggggcaaattatggagtctcttcctcattgaggcagggctttctttcattaaagtaaggttaaagtactaaacatattaactcattttaagtcccactgtttcagttcttttttttttctttatgtgtaaaatagaattcaactcaaaacaaaataatgtttcccgtgaagagagtttggtccaagatactgtcagttaaaatcgtaacatatcattaaatggcagctatcactaataac

SEQ ID NO: 274439 - DNA, 161 bp, Homo sapiens
tgaacccttactctgtattccactgcaaccctattattcattttatatgagtcaaacgttgcctagggtcactagtaagtgatagtggatttgagcctcagcacgtctcagatgtcaagaaacttgggtgtggaagtgattccccaaagtattctcctagt

SEQ ID NO: 274440 - DNA, 410 bp, Homo sapiens
caatcactacagtggccactgctgtatattatgaaacagttttaggaaatatggcatgcaatacaaggtggaaagaaaaaccaggtctgttacctggattcaacaaaatcctaagctagcaggctcaactgatattgcaaaaaccgacttgcaaacagtgctgtcttcctcgtcagtgtgtttccaggacagtttcttgataaaccaagttagtggttgaagaaaggaagaacaagctaaggagttatggaggcacaggtctcttgatttggagcaggagtcattggaagaggtcaattgtcaaacggcagcctgatctggtcgcaggctgtcctaggattcagcctgaatgtattgtcatccatcacagggaaagcccaataaatccttcctccttgagcatttgtaac

SEQ ID NO: 274441 - DNA, 222 bp, Homo sapiens
cctatctttctaacatttgggtccactaaggactaacttgcctttaactcgaggctgtagataagttggttataatgggagtagtcttcaatttttgagtccagaaaaagacagcatacaagtttctgctatcattagtgctcaatctgaatgaattacccacactggagggatattaatgctttaagtcatcatcctttcggcttaaaaaaaaaaaatact

SEQ ID NO: 274442 - DNA, 435 bp, Homo sapiens
aagtgaagtccacttaggtcgttttctatctacccatcaacagttaggatctgctgggcttctaccatggacacagcatgttgccaagtgtctgggaaagacaagaatttttttaaattgcattttagataaacaatcacttagcattccagtgacatctattgtcttaagggaagaaaggatctgactgggtctccagaaagcctggaacaaagaagcaagagattctgtgatttctgctttctgaaataaaaacagaaaacaggcgtttaactgggctgccagttaccatctcagaaaggagtcaagaattattccagggccataagtgtaatagcttttcaagaccctgcaacctttgtgacttttgtatgtttgtctttttgtttaaccctatttccacgtggtgattagaaataaaatccttaaaataaa

SEQ ID NO: 274443 - DNA, 420 bp, Homo sapiens
tcaccagatgcgcccccttgaccttggacctcctagcttcaaaaactgtcatacaagacactctgtcttgctctcttgaattgcctgctctggtggaagccagccagcttctgccatgtcatgagaacactcatgcagccctgggaagagtccacgtggtgaggaactgaggcctcctgccaacagccaagtgaaagcaccatcctggaagaggaccctccagccctcattaagtctgtcaagccttgagatgaatgaaccaacactatgaatgtaacttcacgagaggctctgagccagaaccactcagctaagccacagtaactgtgaaataatcatgtattactgttttaggccagcaagttttgagagaatttattatgtggtaatagataactaatacagttgtgcttgttatgt

SEQ ID NO: 274444 - DNA, 655 bp, Homo sapiens
tttgatctcagactgctgtgctagcaatcatcgagactccgtgagggtaggaccctcccagccaggtgccggatataatctcgtggtgcgccgtttttttaagccggtccgaaaagcgcaatattcgggtgggagtgacctgattttccagtgagatgaacccggtacctcagatggaaatgcagaaatcacccgtcttctgtgtcgctcacgctgggagctgtagaccggagctgttcctattcggacatcttggctcctccccaagagttctggagtctgagaagtcaaggatcggggtgctggcctattcagttcctggtaagggctgtcttcctggcttgcagttgaactacttcttgctgtgtcttcacaagcctgccctgccctccctcctgtgcctataaagactccagactcggtagagggaagagaagcagcttgactggacagaggtgacttgacttcagagggatggcaggactttggaggagagacaacttgactttggagagactgcttgacttcagggaagagctgacctgagacagctgaactttgggggaagattacctgcctgtcctgtcccctctccagctctcctctccactagagccatttccattgctaaataaaattctccacttccaccatc

SEQ ID NO: 274445 - DNA, 615 bp, Homo sapiens
tttgatctcagactgctgtgctagcaatcatcgagactccgtgagggtaggaccctcccagccaggtgccggatataatctcgtggtgcgccgtttttttaagccggtccgaaaagcgcaatattcgggtgggagtgacctgattttccagtgagatgaacccggtacctcagatggaaatgcagaaatcacccgtcttctgtgtcgctcacgctgggagctgtagaccggagctgttcctattcggacatcttggctcctccccaagagttctggagtctgagaagtcaaggatcggggtgctggcctattcagttcctggtaagggctgtcttcctggcttgcagttgaactacttcttgctgtgtcttcacaagcatgcccccatcctgtgccgataagaactccagaccccaaactcagctcatacacacacggaagagagaagcatctgaacatcaagaagagaagaagctgctggacatcagaaactgtgaaaggagaggagtttggctgagctccaggggaagactgcctgcacattctatccccttttcagttccccatcctgctgtcagccacatttaccactcaataaaatcttcacattcacca

SEQ ID NO: 274446 - DNA, 566 bp, Homo sapiens
gcttcggctcgcgcacggtgcgcgcacccactgacctgcgcccactgtctggcactccctagtgagatgaacccggtacctcagatggaaatgcagaaatcacccgtcttctgtgtcgctcacgctgggagctgtagaccggagctgttcctattcggacatcttggctcctccccaagagttctggagtctgagaagtcaaggatcggggtgctggcctattcagttcctggtaagggctgtcttcctggcttgcagttgaactacttcttgctgtgtcttcacaagcctgccctgccctccctcctgtgcctataaagactccagactcggtagagggaagagaagcagcttgactggacagaggtgacttgacttcagagggatggcaggactttggaggagagacaacttgactttggagagactgcttgacttcagggaagagctgacctgagacagctgaactttgggggaagattacctgcctgtcctgtcccctctccagctctcctctccactagagccatttccattgctaaataaaattctccacttccaccatc

SEQ ID NO: 274447 - DNA, 378 bp, Homo sapiens
tgagattccaggcagttgcaggccaatgaaagtcacagaaagcacccttccaattcatttgcttcaggaggctaaggaaataacctatttcctcttccctcttttctatctggtttttctgatgtgttcccagatcctcaaagaaagattcagagatccatgaaatcttaatatgcctgtttgaagccaggaaaaataaataacagtatgccagtatttcagactgggaagagagtgtatcaatacttgagggggaatttggttcagtcctgaaaattactaagtctttcttccctacttaacagggaagtaatgtcaaatggttgaaatttgcacggaattctactagcctggagggtgctcctgaagtaatcttac

SEQ ID NO: 274448 - DNA, 361 bp, Homo sapiens
ctctagttgaggcaaggaggggatgttacagaagtctgcatggctgagacaacattttgcttggaggatgaatgggagttactcaggtgaagaagagggagaagggaattctaagcagaaggagcagcatgagcaaaggcaaggaggtaggaagtacatgcttcaagcatgaaagaaaacatgcttttggaatctacattagtagcttttggcaaacagacaggtactagctgcagtatggcttctcagcctttagaacccaacacgtgattttgaatccagcatgcatgtttcctggggctttgaccttccttaagatacttaatctctctcagactcatttttactatctttactcatc

SEQ ID NO: 274449 - DNA, 460 bp, Homo sapiens
tgaatagtactacccgtgctggtcctcttgctatgacggcaattactgggtatttatcccaacaaaagtagatacagtagatgtcttgtaaaacaatagtgctgtgtctcaatctatgccactaggttttaaagaattgcaaaggtagaatgaacaactatttcataccaataagcagtcaaaaaataaacatacaccggatggtgtcatggaggtctccctggtcagcattctcccctcctgtctagcttgaagatataacagggctaagcttagagatgggggaggcattaataaaggtgatttcttataaagtagtaacttcccaccctgaagatatattgctggaaacagggaagtgtttataatgaacctatatctgaaagcagagaaacccatgcatcatgagtgttaagaaagaaatcaatacaactcttctatttcaaggatgaagaatcat

SEQ ID NO: 274450 - DNA, 387 bp, Homo sapiens
cttggtggaagagatcacccaggtgaaataaaaagagaaactcacacaactgctcagcagccttcacaccataatgctcaatttagtcccttaaagagtacacgactcagcacagtggctcccacttataatcacagcattttcagaggccaaggagggaggatcacttgaggccaggagttccagatcagcctgggtaacatagtgaggctctacctctgccacccagctaatatatatattagctggcatgcacctgtaatcccagctatttgagaagctgagatggaggatcacttgaacccaagagttcgaggctgcagtgagctatgattgcaccagcctgggcaacagagggagacgctgtccccactccatttaaaaaaa

SEQ ID NO: 274451 - DNA, 277 bp, Homo sapiens
attcatattacagttgaaaggggatgcattattatatacatgtataactaatggaatactagctactgtaacagataaactttaaaatctctgtaacttcgctaagaatttttttttttttttgagacaacttctcactctgtcacccaagctggagtgcagctgtgcaatcatagctcactgcagccttgatcttctggactcagatgatcctcccacctcagcctcctgagtagctgggactacaggcacgtgccaccatgcccagttaactttt

SEQ ID NO: 274452 - DNA, 380 bp, Homo sapiens
catcacgccttttcctcattcaccaagtattcactgagtgccgagagctctcctaagccgcagacacagcagtgagccactttttgcaggagttctgccatcgggagcttacattccagtgtcaggaaggctgacatctgacaaaattaaccggttctccacagctcagtgccctggacgtgtcaaggtacccattggaaagacagaaagatgaaggcaaagagaatgttctgctggttctttttctaggtttaataattggaaaatcatgagctacttcccatgaagtcttctcccaaactcacccccgaggacaggcctttgcagggagctacctgactcccattctcacccacgtatccagctcctgtagttggtga

SEQ ID NO: 274453 - DNA, 390 bp, Homo sapiens
gacaccccaactctcagcttctcctctgggagggagagagaagagtggggcatgtggacaatatcccagctttttggaaggctgcctgagagattgctatctgtcttgcctgacttggggctagcatactttggatgctgctgagaacaacaaaaacagggaggcttgctgccataaaactagagaacgtgcaatgtgtattagtctgttttcacactactataaagaactccctgagactgggtaatttataaagaaagaggtttaattgactcacagttctgcaggctgtacagtccttgagaaacttacaatcatggcagaagacaaaggggaagcaggtacattttacatggctggagaaggaggaggagagtgaaggaggagatg

SEQ ID NO: 274454 - DNA, 334 bp, Homo sapiens
agagaatggcactcagggagcccgagacacccacactgcaggtacagggggctcctgccaaaggcctgaggcccagagaagctttgctggagcaggagctccatgacagttctgaaaacagcagctgctggagctttgcacccaaggagttccagaggtggcacaggctgggagtcccaacccactgggcagaaaggcctcactgaacaccccagcctccagtgggccccccggaagccctgtcttaggagtgggtctactctgcacccacccaaggtcagttgactgactccttgacaggagaaaacaacccacgctttttgcaaagattgca

SEQ ID NO: 274455 - DNA, 473 bp, Homo sapiens
tctgaattagtgttcaagtatgtttgtagagtgagacttagaccctggccttgtgctggtcttgtccttgggtatatactggctgataactagtgagccggatttagtggacttcattcctaggcagcatatttgcatatgctcctaaagtctgcaaatgatataactcctgatggaaccttagatgcagttttgtcaggacctagtggtccaccctgtctggcatggctttaccttggctcccaccaatgctgcatttgtctcaagtctctgccatgcagtgtggatagctctgagccagccagctgcctcttgtgcccttttctatggattcccctttgctcctgaacatagaaagtcccatatcatgattgctgtaagaacagttaccttctcattctttcctcaggggtatgcggaaacctttgggtttactcaaggatgcttttcccccgctgtgggaaaataggaaa

SEQ ID NO: 274456 - DNA, 458 bp, Homo sapiens
gctccttatcagcaccatagatttttaactatggacctgaacagattgggataaaaggaaacacaactgtaccaccaaactctcattctttttaatcataaaagtacttaattcagaaactttaggggaaacaaattcttttctttcccagaatcagaattgcactgacattgtggcccaacatgtgacttgagctcaagtatacactaaagtgaaaagctattgtcaatatttagcggaacgctatgccatgtcggaggcagtatcagcttcctaataccaaaagaaaattcacgtatcacagggctactgagaagaagtaacgtgcagccccagagggcacagatttctgctttatgtaaatcagagcctgtcacggcatgcatgattcactgctcagggtgtactctcctgtgacgaatgagtcccgcttaatttggcagtgattatgcgggttg

SEQ ID NO: 274457 - DNA, 274 bp, Homo sapiens
caaactcctgggctaaatcgattgtctcacctcagcctctcaagtttgttatgaaggttatatgttaggaagggtcccaggaggtagacccacacagatgggatttgggcataggtttggtttcccagggggcagtgctgagctctttgccagtgggaaatgggatgctggtgatttccagtaggtgacctcacagtgactcaagctaccacttactgttgattgtgacgaaatgccagctgaggcacatgccttgggagctaagtggttgctg

SEQ ID NO: 274458 - DNA, 311 bp, Homo sapiens
gacaacacacagctacaaagccaatttttttcttccacaaaatctatacagacttcaccatagaaggatgtatggtcttgttaaggactcaagcctcccacctaagaaacaaggacagtctcatcatgttgcactggcaaaaatgtccgctgattgtgaacgttcagcaaaaacagagatgcatgtgggcttgagcaatacagtatgatatggaaaaaaccattttatctcacacaacctcattcatcattgttgactgtttacaaattattgtgaaatgctttacataaataaaattgttttgcctgtct

SEQ ID NO: 274459 - DNA, 452 bp, Homo sapiens
gttcatatgctgtgtggttggtgactatctgattctatggaggctaaccaaagcctagactgagtgtggatgagaccctcaactggggagtgatggggatatcaaaggacatgctgggtgagaggagctgactgtcatgtagggagtgaaccactgcccccagcagagatacagttcggttttaagaaaaaaggcaaggccaggcgcggtggctcacgcctgcaatcccaacacttttggaggtcaagaggtcgacaccatccttgacaacatggtgaacccggtctctactaaaaatacaaaaattagttgggcatcgtgcctgtagtcccagcttctcggaaggctgacgcaggagaatcacttgaacccggaaggtggaggttgcagtgagccgagatcacatcactgcactccagcctggtgacagtgagactccacctcaaaaaaaa

SEQ ID NO: 274460 - DNA, 490 bp, Homo sapiens
gtggagaggaagagatgttaaggatgctccccagttttctggcttacttcactcatttgatgtcattcactaagagctcctagtcacatggaggaggaggcttggatacattacatttccagtggatttgaagatgttaaatctacagtcagatctatgggtcttcagcacagaagaggtgtttggtctaggggtttccttaggaaagaatggggagagaagaatgggaggtgataaaaagatggattggacaccatctctccctttaggcaactcaaaatctatttgtatttgttgttagaggaagaaaagaaaaaagaaataacaaatagtagaaggaaaaatatttttaaaggaaatataaaagtgctgggattacaggcgtgaccaccacatccagccagtaattgtctttttatgatttgcttatttcacctagcatgatgtcctcaagagtcatccatgttgtagcatatggcaggctgtcctt

SEQ ID NO: 274461 - DNA, 551 bp, Homo sapiens
cagtgtctattaattagactttcatttctattgacaatggggcctacaggccttgcactgaggtggacacagaccttttgtggtgccctgttgatcctggttctgctcgtggaaaattaggcctgattgccctatgaaggccccttctctagtttccctctctcacctgctaagtctccattcttcctctaactgctttaaataggtcagctgagtttcattcttacagtcatcaggcctttggtgaaggcatctgtgctcttgctgaagtctgcaacatttcccaacatgcaggccaagggcccttctctttcggtctgaccacttgtctgttcatgcatgcatgctttcattcattcagaaaatgtgtcaagaaaagagcacatgatttggaggcagacgtaattcagtggtgtgccggagtgggatatttccagcttgcaaaagcggattgctaaatttgtaagtgttttgcagctggtttttaaacatatattaaaaatgaaattgtagaaaattgcaattaaataaattatatcaaaaacagaaaa

SEQ ID NO: 274462 - DNA, 425 bp, Homo sapiens
gcctattgcagagactgaaaaatcagatactggtttaaccttcatcctctgcagcaagtaatgctcatggacttagcctagccaatgagacacaagaggaattcttctgggaggcttctaaataaagaatgttagtccctgataaaaggagagaggcactaaagcagaatgctctctgtctcactaccctggcccaactttacctcttgcctttgctgtgtgatgacttgacatcgagttctgatagccatcttggatcactagcaacaagcccaagaacaaaaagccagcccactgaggatggtgaaaaggaaaaatgtagagcctgggtatttgaaaacatctttacggcattaaaccaatcctgggactttctacctttggacttcatgttaggtaatatgcgacatctttatgtattcagc

SEQ ID NO: 274463 - DNA, 414 bp, Homo sapiens
aactagagcccaaagagatagcaacagattgaaagaagaggagatacaagccccgtccttgcttctgaccctttgccacacagatatgccttggacactggaactctatgaatggactttaaaatctgtacttaaatcttttattttttaagtattcttttttgttactcaagttaagttggctggtgggtaacgttccatgctacccaacataatttcctaattgccaatagtttcttccatattagagacaaaattagacttaccactgaaattatcaccattctgacaagtatttttgaaaatatcacttatattcttatttttatagattaagccaaagcagaaagtgaaaaatgcaagctggttggatacctttattggcaataaaataaagtagagttctaattaagc

SEQ ID NO: 274464 - DNA, 437 bp, Homo sapiens
atttcatcatcatgtagataatcactgtcatcagtttggtaaaagcaacactttcaaccaattcagaattgatcatatgtatctgcatccaaatgatacctctcttcttatctaaagtgtctgagtcagctttgcttactgctgaacgcatgagattgagttcaatccctgaccatagtgaattttctacatatgctttgaggagacatggttagtgtccctaactggagaggttagctgccaaaagaagagaggacaactgtttatctgagacagaagttaagaaggcaaggataggtgtcatagagtcattctcacaatggggtccccagaccagcaacattggcatcacctgggaatttattagaaatgcaaattcttgttccacgccaaacctagtgaatcagaaactctgtggggcagggctcagccatctg

SEQ ID NO: 274465 - DNA, 155 bp, Homo sapiens
atttttcaaaagcactcttactcatctctacttatgaatacaattaattagttgcagaatgttagatagagtggcagtccttggacaggctgagtgacagctgctagaagacagtaggaggcaataagtagacaattcatgtgtatatacttgag

SEQ ID NO: 274466 - DNA, 456 bp, Homo sapiens
ggttggaccctacatctagttactcaggaggctgaggcaggaaggttgaagttgagcccaggaggttgaggctgcagtgagccatgattgtggcactgcactgaagcctgggtgatagagtgagaccttgtctcaaacagcaacaaacaaataccatctttgggtatattaatcagatggggggagtcacactgacatcagttggcacccactggttagtgtgtgccaggcagggagactgggctgttttcagtaaactgatcacagcagtgagctgtgatcgtgccactgtactccagcctgggtgacagagtgagaccttatttccaaaaaaaagagaaggcattggagttcagcttgtggttttgacagagaaataataggataaattaatgaaacaaaaaagttaacagtagaggattaataaaactaagttttttttttctaatttctttt

SEQ ID NO: 274467 - DNA, 377 bp, Homo sapiens
aggacagtgggatagcttcagcaaggataaatacttcaaaattcagtggcagctaaggccccaaaagcagaaagctggttaagacagactagtgtaatgccaaatgtataggtctaagatccaactttgtcactttgcggccctaagaaactaccccatcagggccgctatcttctcacttatgagagtaaggcctgaattagggatttggctctaaaattttacagttttatggtcacagtgacactaataatcaaaagtttcaataaagatatgcaggtcgggcccagtggctcatgcctgtaatcccaacactttgggaggccgaggcgggtggatcacctgactttaggagtttgagaccatcctggccaaca

SEQ ID NO: 274468 - DNA, 410 bp, Homo sapiens
tcaagaattactttcttaacatagttacatgttagtccccaaattttcagtcgttgagtctttaatcctccgtgtctctaaatcatgtacctaagaaagtaaatttaatttttgaaaaggggtaaaataaatattttataaacgtttgccaaatgattaccacatgtcttatctggggaaagtacctttagacatgagaaatgttttaattccttctcttcaaagtctttctgtttcttggtttttagtggtcagtctgacatgttgttctgtaggctgcatttaaagcttttgagccaggcacaggaaggaatcctgaagatagttcaggcaagcatatgttttcccatttttatccaaagcattgccattttttagagtttattccattaagtaaagtaatatacacc

SEQ ID NO: 274469 - DNA, 439 bp, Homo sapiens
agtaatcaatcaactaatcataattccaaagggtgagataatgttcccacagtgtatcattagtgtgatgagtttatctctttaaagcctcacaacctgctgatatgctgtggtttttcttggtcctatctctttatcttttaccacctctgatctctttaaacccaccctgtttccattttcctccccgcccattgtttcctcatttttccttaacacttcttccttagattaacctttaaatacaaatggaaataataatcggattattttttgtaaggaaaccacctttctgtttcattattcataactagaataatgaaataaagctgtttatagaaatgcatctagaacatgagacaaaattgatatagaccaaacattgttcttgaatagtggtatcaaatataaaattataaataaaatcttaaaagacaaa

SEQ ID NO: 274470 - DNA, 331 bp, Homo sapiens
aaaaagcaacattaagatgtatcatttcttagactgtagaattctttagccctaggagtttggaggtgaggtggagactgcctgtgatcagtgagttaccatctgtttttctccacactttatggcacagaacttgcattgctaccctgatttttttttttttcctccagaggatttctggaccagaagtataaattgccttatggatgggtaggccctatttgtcccagtacaattggggatggggaagaggatgggatgggaagtaagaacagaaccccaagagcctccccaccctctttgatcccctcctcctctacaggccttctgc

SEQ ID NO: 274471 - DNA, 306 bp, Homo sapiens
caaggacaaaaaaaagtcagaaatcgattctaagatgataaattatataaaaatttaaactcaaattggctgggaagaagataaactgtaaagtgataatcttcaaatattaaaaactcttcattgtacacttttctggatccagttgattttggcttacatgctgtttaatttatactctgccgttaattaaagatactgcagttttattcattaactagggaatagttactttatttattatatacaataaatgtaaattacactctgaggtaacaagataataaagataagtatgtaattcag

SEQ ID NO: 274472 - DNA, 423 bp, Homo sapiens
attcctgaaaagcctggagactgcagggtggtgtctcactatgttgcccagactgttttctaaccctggcctcaagcaaatttcccacctccttctcccaaaatgctgggattacaagtgtgagccactgtacccagcctacttaggaggacatttactattcacttactgatttgcatcaaattattgattggtggtgtttcagaaggtggaagctctgccagccccacatacagcctgagtgagacatgccattcatttgttaagcagctgagggtttgtaactgcttgtgactgcggcatgtccaagaatgttttgtctgatgcacgacaatgagtgaatatataatgattcaacaagagccatagagttttaaaatgtgttacattttataggaaatacagttacttagacttataaaa

SEQ ID NO: 274473 - DNA, 177 bp, Homo sapiens
gatcgcgctactgcactccagccacggcaacagagtgagacttaagggaaccctttccccacccccattcacctgactcctcaactgcaccctacactgtcacatcccacctctccgtgtctcctcgatctaacctctaatagctgggcaccccacctctccttttaataacccctc

SEQ ID NO: 274474 - DNA, 272 bp, Homo sapiens
tgcgccattgcactccagcctgggcgacagagcaagactccgtctccagaaaaaaaaaaaaaaaaggtaaattcatgactcagggttaactagttcataaaatattacaaatttatctggctaaaccaaagatttttaagtcaataaacattgattatatatctattgtgtgtaaaatagcatgttaggcaatgttgatatacttctgaaatattaaagattaattgaaaatgaaagattaaatttatttgctttctacacttgatatcgac

SEQ ID NO: 274475 - DNA, 520 bp, Homo sapiens
ttattgggaccagtatttcagatttcagatgttttcaagttctacaatatttgcatatacatgatgagatatcttggtatcttgagataccaagtccaaatatgaaatttattttcatatacaccttatacacattgcccaaaggtaattttatacaatatttttaataattttgtggatgaaacaaagtgtgtgtattgaaccatcagaaagcaaaagtgttactatcttagccacccatgtggataatctgtggtttggcatcagtgttactcctgactctgaatttacatactactgttaagcaatcattttctaacacttatttacacgtagatatatttagcaaaaaataagacatatcagtgaaaagataatgtattcagggtagtggagcagcacaatagcatcaccagaatacctgtatgttatcactattaaccaaaaaagtatctgcagtcctttttgacattttcaacaatatctttataccacacagcagagaataagcaaaaaaaaa

SEQ ID NO: 274476 - DNA, 406 bp, Homo sapiens
tgattaaaagctggggttaccaatgcgcgtggcacagttagaagctatctagcaaaaatgagcacatctgaaggacccgccccccctttttttggccccccttgggggggaaaaaaaaatttttttttttttttaaaaccccccaaattttgaaaaccctttaaaacccttgggtttttttaaagaagcgccaatcattttctaacacttatttacacgtagatatatttagcaaaaaataagacatatcagtgaaaagataatgtattcagggtagtggagcagcacaatagcatcaccagaatacctgtatgttatcactattaaccaaaaaagtatctgcagtcctttttgacattttcaacaatatctttataccacacagcagagaataagcaaaaaaaaa

SEQ ID NO: 274477 - DNA, 259 bp, Homo sapiens
gatcattacttgctggcagttataatcatgtcacagctaatatatctactgttttatttttaaaacagtacatatcacatgagctcagggcattaccatatcaattaatactctaagagttgtgtgtgtgtgtgtgtgtgtgtgtgtgtgtgttcaaaagaaaacacttagcagtcactacaactgggttaaaacacttttccttctagaataatttaaaacacaatctgtgactcagaagcagaaaagacagagattt

SEQ ID NO: 274478 - DNA, 291 bp, Homo sapiens
tcatccactcctgcatctggttggtctttattgagcacctactatatgcagaaggggaggccgaggtgggaggatcattggatctcaggagttcgagatcagcatgggccacgtagcgcgactccatctctacaaataaataaaaaattagctgggcattggcggctgtagccccagctactcaggaggctgaggcaggaggatagcttgaacccgggaggcggaggttgcagtgagctgagatcgcaccactgtactccgacctgggtgacagagcgagactctgtctca

SEQ ID NO: 274479 - DNA, 389 bp, Homo sapiens
tgcactccagcctgggtgatggagtgagtctgtctccaaaaaaaaaataaataaataaaagtcggagaggagagcgatgaaatcaagtcgaggaagaggaatgtttattgctttatgattttggaaaacatttattgtacaaaatatggcaaataacacaaaagtatagattagtgaatgagtttttacaaatccaatgcttatgtaaccaacaccaaaaaaatagaatatagttgaccctttaataatgtgggtttgaactgtgcgggtccactttagttatacccaaactttttggaataaatacattggaaaattttttggagatttgtgtgacactttgacaaaacttgcagatgaaccacatagcctagaaacatcaaaaaaat

SEQ ID NO: 274480 - DNA, 424 bp, Homo sapiens
ctggggtcctatgagaattgttttttcatcatccctatgccttttgcattgtatctctctgttcacatcaacatttgtcactgttctctgcctttcatatcggacacattcagcttaatgataaattaaaacttaatagagaagggtaaaaagtaatattagaccacaaggtatcctgtagaatctttgttctccaaaggctgtatagctatctgttcatatgcttatagaataaattgcacaatgtcagagtagacaatactactgttgcttcagtaacatgctcacagagtgcaagaatgtaagtcaaaagacaggtgaaactgaacttttgaaatatatcccaattgcttttaattgtacctctccaaaaatgtaaatatagttaaaagatttttttaaaaaaaccaaaaaagggcggccg

SEQ ID NO: 274481 - DNA, 228 bp, Homo sapiens
tgtgacagggagcattcctagtacacacaggcgttgactttaagaccaaaatctgtaggcctttaccctgcatatcacaccaactcagactcaacatctctaatccacgctctctaactccttacccaccccaccactccaatcaagccaataccttccctggtctgccctaggccactcactttccaattgctcctctcacttttctcctcttagagtcccccttta

SEQ ID NO: 274482 - DNA, 486 bp, Homo sapiens
agaaattggatccattcctcaaaaacattccagtgatccattcctttcatatccctgcgaaatgatttgtactcagaacagttgtgtgtgtgcacaagcatatgcagcacattaagaatgccaaatctgaatttttcagtggtctgaagtggaaacttctcatagagcagccatatgttttctaggattgcattaatcttaccttttaggcaaacaatatagtgcattttgtctatgttttaccacatacaacaaatactgaaccctttcttattcctgtatctatgaatgaatatggaaagacttatctgaaaggcatatcaaggattttttttttttattagcttacttggccaggcgtggtggctcacttctgtaatcccagcactttgggaggctaaggtgggtggatcacttgaggtcaggagtttgaaactagcctggccaacatggcaaaaccccgtctctactaaaaaaaaaaaaaaa

SEQ ID NO: 274483 - DNA, 391 bp, Homo sapiens
ggtcctccctgcgacagcggaacggaaacacgtcagggcctgaggaaaggccccagtttaataattctcatcagcacttacgagaatcagacacacttggccgggcgtggtggttcacgcctgtaataccagcactttgagaggccaaggcgggcagatcacctgaggtcagtagttcgagaccagcctggccaacatggtgaaaccccatctctattaaaaatacaaaaattagccaggcgtggtggcgcgtgcctgtgctcccagctactcaggaagctaaggtaggagagatcgcttgaacccgggaggaggaggttgctgtgagccgagattgcgccactgcactccagcctgggtgacagaacaagactctgtctcaaaaaaaaaa

SEQ ID NO: 274484 - DNA, 438 bp, Homo sapiens
tgaaagtctgtaagagaatagttaggtctccatacccccactccacaagctcagaaatcatccctctttcaccctgctgaagatagaaagttgatgtgctgggaggaaaaaactgaaacagaaaagcaccaacatcaggggcatcagacaaagacggtggtaaaggattgaaaataaaggaggcccaggtcaccaaaaaccaggcttactaactccagctcctagtctccactgtggattaaagaatctttttctagagaaatagaaatctcatctagctacatgatcatcttacagtgaagcccactaattgacaaacgctgtccacaaacacagagcttcccttcagctttttagagcttcacttttattttgaaatcaactttactgataatttacatacaataaaaaacatattaagtttgtaaaaaaaaaaaa

SEQ ID NO: 274485 - DNA, 537 bp, Homo sapiens
ggtttccctgtggcatggaaaaattagtgtgatattattccagaatttggtagcttagaacaacaacatagattatttgtggaatattcggggatttgggattggcttagtcacgtaagtctagctcaggctcccccttgaggttggagtcaagatgccagccagggttgtagtcggaagccttgaatgtggctgaactatctgcttccaaactcataatgatattgacaggcggcctcaattccttactgcatgtaactttccagggctgctgaagtgtcctgaggcatctgacttctcccaaaggcagcaatccaagagagaaagcaaggaggaagctgcagggccattaccacgtggcctctgaagtcagctttgtgccagttagaagtgagttcagctcacactcagagggcaatgagattccatctttggaagggagcgtcgtactgtaaaccattataccagctagtaaatagatacatatctcaaaaaataaatcctccccacaaatatatacacctactatgtacccac

SEQ ID NO: 274486 - DNA, 1903 bp, Homo sapiens
gggctggaacgtgggtctcctgattatctcacccattgtcacatccactatggacctgtgagcttcccgccacgggcaatatgtatgtatagagagaaaggcaggatatcaaggcagaatggagggaggttcagccatgagaacctggtgagtattgacagatgatgtcatcatctacgtggcagaaaagagaagcaatggaaaagctattattttattttattttgcttcagagatggtgtcactctgttgccccagctggaatgcagtgtagtcctgaactcctgggctcaagagatcctcccacctcagcctcctgagtagctgagactacagccatgtaccacgatgcccagctaatttatttctttattcatgtatttatgtatttatttatttatttattttttgagatggagcctcactctgtggccaggctggaatgcagtggcgtgatcactgcaagctctgcctccctggttcatgccattctcctgccttggcctcccaagtagctgggactgcaggcgcccaccaccacgcccggctaatttttgtatttttagtacagacagggtttcaccttgttagccaggatggtctcaatttcctgaccttgtgatccacctgcctcggcctcccaaagtgctgggattacaggcatgagccactgtgcctggcctaattttttatttttagtagacatgaggtctcactgtgctgcccagcctggtcttgaactcctggtctcaagtagtcctcccacctcagcctcccaaaacactgggattacaggtattagctaccacacctggcccaaaaagttattagacccaataagataattcaggaagtccaagaggtcaaaacaagatcaaaatacccaaaccccctaggtttcctacatgctagcaataaccaatcaaaaggatagttgaaaagatcccattcaaattcatcagaaaagtgatagagcatctgggaataaatataacaaatatgcagcaaaaacttgagaaatgattagaaaaaagtcaatattgtattatcaagttgtcagatcttccacccaaattattccagtctcagtaggattcaggaaacttgaaaaagaagttcccaatcttgaatctgagttgcatctagaagaataaatataaaattgctaataatttgttgtgaaaaggatataagtgaagatacgtgggagatacttatagggagatgaatgcagggttggttatgtacattattgtacatttcctaagatcaattaatgtagtatagaagaggtagaagaagggccagaaagatcagtggaacaaaatagaactttatggtacagatggcatttttaatctgtggagaaaggtagattattaagtagtgttgggagaacacatttggaaaataaagacaaacctctacttcacaacataaacaaaaatacagttagattaactatctacatgtagcaattaaaacctaacatgccaggatacaatatacagaacactttaatagtaacctttaattatgggaagagtgagttataaacccagaagtcacaggaaaattttgataaattagactctatgaaaatttaaatctgtatacagcaaaagagatagtaaagaaactaaaagaggctgggcacggtggctcacacttgtaatcccagcactttggagactgaggcaggcaggttgcttgagcccaggagttccacattagcctgggcaacatggtgagaccttatctctacaaataaaaacaaaaattagctgggtgtggtggtgcacacctgtagtcccagctacttgggaggctgaggcaggagaatcgcttgagctcaggaggttgaggctgcagtgagtcgtgatcatgccactgtattccagcc

SEQ ID NO: 274487 - DNA, 1517 bp, Homo sapiens
tgcatacacctataaccagcctggttaattattgtatttttatgtacagacaggggttacaccttgttacgccaggatggtctcaatttcctgaccttgttgatccagctgccttggcctcccaagtagctgggactgcaggcgcccaccaccacgcccggctaatttttgtatttttagtacagacagggtttcaccttgttagccaggatggtctcaatttcctgaccttgtgatccacctgcctcggcctcccaaagtgctgggattacaggcatgagccactgtgcctggcctaattttttatttttagtagacatgaggtctcactgtgctgcccagcctggtcttgaactcctggtctcaagtagtcctcccacctcagcctcccaaaacactgggattacaggtattagctaccacacctggcccaaaaagttattagacccaataagataattcaggaagtccaagaggtcaaaacaagatcaaaatacccaaaccccctaggtttcctacatgctagcaataaccaatcaaaaggatagttgaaaagatcccattcaaattcatcagaaaagtgatagagcatctgggaataaatataacaaatatgcagcaaaaacttgagaaatgattagaaaaaagtcaatattgtattatcaagttgtcagatcttccacccaaattattccagtctcagtaggattcaggaaacttgaaaaagaagttcccaatcttgaatctgagttgcatctagaagaataaatataaaattgctaataatttgttgtgaaaaggatataagtgaagatacgtgggagatacttatagggagatgaatgcagggttggttatgtacattattgtacatttcctaagatcaattaatgtagtatagaagaggtagaagaagggccagaaagatcagtggaacaaaatagaactttatggtacagatggcatttttaatctgtggagaaaggtagattattaagtagtgttgggagaacacatttggaaaataaagacaaacctctacttcacaacataaacaaaaatacagttagattaactatctacatgtagcaattaaaacctaacatgccaggatacaatatacagaacactttaatagtaacctttaattatgggaagagtgagttataaacccagaagtcacaggaaaattttgataaattagactctatgaaaatttaaatctgtatacagcaaaagagatagtaaagaaactaaaagaggctgggcacggtggctcacacttgtaatcccagcactttggagactgaggcaggcaggttgcttgagcccaggagttccacattagcctgggcaacatggtgagaccttatctctacaaataaaaacaaaaattagctgggtgtggtggtgcacacctgtagtcccagctacttgggaggctgaggcaggagaatcgcttgagctcaggaggttgaggctgcagtgagtcgtgatcatgccactgtattccagcc

SEQ ID NO: 274488 - DNA, 278 bp, Homo sapiens
atttacagggacatgtgactggaaacacagggccagatctggcttcaggttcaatttgattcaaccgctctaccaatggcatcaaggatccagtttctctctgtccttcagctctgccttctgcaggattagctttattataatgtcagtggccaaaacgcccaggtttcttacttccccctccaaatccagggggaacaggccatcatacccagagacctctcagtacatcaaagaaacatcttacctagaaactgcaaataaatttttttcccaaa

SEQ ID NO: 274489 - DNA, 417 bp, Homo sapiens
ttttttagacagtgttgctgtgttgcccaggctggagtgcagtggcacaatctcggctcactgcaacgtctgcctcctgggctccagcgattgtcgtgcctcagccccccaagtagctgggattacaggtgcacaccatcatgcctggctaactgtatttttagcagagatggggtttcaccatgttggccagcctgctctcaaactcctggcctcaagcaatccacctgcctcagcctcccacagtgctgggattacaggcctgagccactgcaccaagccccagctccagattgtgagtttcagagccaggctagataggattcagactcagaactgtgagatttctgctgctcaggctgttaaccagtgactcatggttttttttttgtcgacgcggccgcgaatttagtagaa

SEQ ID NO: 274490 - DNA, 413 bp, Homo sapiens
caaatacatatgcaaatacatgcacaagtgcatatacatgagcatgtatccacgcatatcatatacatgtacacatacacatacatacatatacacatatagacatatgcatatacatagacaaaagtatagctgttttggctgaagctccggtctcactcactcaactcacactcaccctctccctcgtctggccttcatagtgacacctaagcaccctcacaaaaagcctaggctctgcccaactccactttaaaaccactgagctttgattcagtcaaaagcttgtcctcaccaaccagcttgccagtgaatctgaaaatgtggacctttgcgtgagtcagtgctttctgacatcaaaatctcttgaaggaaagaggatcgttcccctattttaaagattgaatttggca

SEQ ID NO: 274491 - DNA, 315 bp, Homo sapiens
ttcttccaggaaggacaaaggctgatcatgaaagaagctttggcccttctcagccaggagaaggcactggaggaatctgcttaacaaattcccatgtatttgatatttgccttcccacagttgctgcacctagggactcgaagcctttttcctttgttttgttacttacctaaaaacttactgttctttgttgaagatgcaatataagctggatttctaaaccacccctttgagaaccatgcactccctgggtgtcccccctgcatacatgaaatgcacaccttaataaacttctgtttgattttctcctgttaa

SEQ ID NO: 274492 - DNA, 574 bp, Homo sapiens
ggtcttaaactcctgacctcaagttatctgcccgcctcagtctcccaaagttctgggattacaggcatgagccaccacacccagtctatatttaaatcacttattttatatcacttagctagccaacacataacactttcagtacttttgtcacatatagcattttgttacataatacggtttattatgaatgtatagagtgtttcagagagaagacatttgtgatttttagagttccgtaattgaggtgatactacataatatgccaatttacataactgagaaaattaacagtgtagctgtattggtgagattattgctataaatgatgaagttaggacctctgaccagattcatattatttaagctttttcatttcaccttctttgatattttttacctcctagacatagaattacgtggtcctctctaaaatatgtctgtctactcagtccatatcaggcaatgtgctgtgctctggggataccaaggaaaagatatgttctgccttcaagaaattcccagtctggtagaggtagcaagcaagtacaccaagttacaatccagtgtgata

SEQ ID NO: 274493 - DNA, 464 bp, Homo sapiens
tgcagcacaccaacatggcatatgtatacgtatgtaactaacctgcacgttgtgcacatgtaccctaaaacttaaagtataatttttaaaaagtgataaaaataaaaaaattttaaaaatcacatataaatacttaaaaaaaaaaaagaatagtggtgaaacaaaacaaatagagctttttagtattccctccagttaaactgtcattgccagtattttgttttctatatacatgtaatgattatgtaatgattatattggctattttaataactgaattataaatattttataacattcattactgcttgatcagaaaagtaggggggtgaaggagaggggcactagttgagaaacgacctgttgggtgctatgttcactattttggtgataggttcaatagaagcccaaaccccaggattgcacaatatacccatgtaacatacctgcatatgtaccatctg

SEQ ID NO: 274494 - DNA, 740 bp, Homo sapiens
tatagaaacttaaggagtcttcccattatatttgtgtagcagccccttctctctgtctacctgtcttctgatctttcttaatagaaagatttcagaattaaaatcaggacttatgcagccatcttatctgaatagtaataaatcatgcctatctttatttttagaaatacagtattttctttatgagattaaaattcttgaatgcttggagtagtttgttgaatttactatatttatcataaatgaggccaaagttctgggattacaggcatgagccaccacacccagtctatatttaaatcacttattttatatcacttagctagccaacacatgtaccctaaaacttaaagtataatttttaaaaagtgataaaaataaaaaaattttaaaaatcacatataaatacttaaaaaaaaaaaagaatagtggtgaaacaaaacaaatagagctttttagtattccctccagttaaactgtcattgccagtattttgttttctatatacatgtaatgattatgtaatgattatattggctattttaataactgaattataaatattttataacattcattactgcttgatcagaaaagtaggggggtgaaggagaggggcactagttgagaaacgacctgttgggtgctatgttcactattttggtgataggttcaatagaagcccaaaccccaggattgcacaatatacccatgtaacatacctgcatatgtaccatctg

SEQ ID NO: 274495 - DNA, 484 bp, Homo sapiens
actgtcactttttaatatatccttaatctgtctcagaagctcaagtgtgaaaccagtttttgcacattttgtttgtgaattctgcattttgtttgggccttagctttggcatctttgtgatgaagttcaggatgtggtaccccaacatatggcaccttggcattttgagtatttcaaactaaagagatttgagaaaatgacaaaataaggaaggtctctttgccccttgggggcagtttatgaaacctaccagggattttttgaccttcccctgaggcagacaaaacactcatgtgagaggtacgctccctctacccataggaaagaagcatcttgacctccaaatacagagttgctaaggagaatctgaacaggccttgctaaattagatcataatctttttgctctatcatattgttccagaactctccattcttcatcaaaccttctgtaaaaaaacactcacgtttaatagttactttgg

SEQ ID NO: 274496 - DNA, 458 bp, Homo sapiens
tctgcacttgtaaatgtggagaagtgaaacaccagacttgagaggatgctctgctatctgaacgaggtaatgggaaaatgctcggccagtgttgtaactcaatcttcttatccaacagtgagccccttgggcacccagacccagactcgcccttctagtctcacgtcttgcactctctggcacatctcatgtaggctctgttgcctgtcatgttttccagtccacaaatacccttggcatgctctcatgtctgtacttggtccacattattctaacgtgaatacatgaaacttctaatgacagtgcaatctttctagacaatctctgaaggagaaatgttactagtctgtggtgaatataaaaataggctcatagggaaaaaaaactgtgattgaaggtataattctgcattttcttgggatatacataaatagcaagtagtcattttttacttaaaa

SEQ ID NO: 274497 - DNA, 368 bp, Homo sapiens
gggcagagagggcagggccctggcagcccagggcatctcatgcgtctcactgcctggcccagacatcactgtctttgctcccattggccctagagtccctgccaaagaccgtcagctcttctcatctgttacattccttgagcaggagttggttttctatccctctttatttattctatttactttttatatttgagagttagagtctcaccctgtcacccaggctggagtgcagtggcacgatcatagctcactgcagcctcaaactcctgggctcaagtgatcctcccatctcagcttcccgagtagctgagaccacaggtgtgcaccaccatgcccagctattttttttttttcatttttgcgca

SEQ ID NO: 274498 - DNA, 468 bp, Homo sapiens
tacatggttcagaagaataaaacacactgtgtcataggcagggaagtcattcccactatctgactagccaattacctttcatctttcaagaccatactcaggggtcacatccttcaggaatactttcctgtaacttcctccccaatagagagttgaccttaccttcatggtgaaaaggtaagaaaagactgttaccacagcatttttacaccttatgatacttatttattcactggtttatttctttcactgcattggactatcacgtcttgttcacctttttaatttttaggagtttctaacacaaatatgtgtttaatgaatgcttcttaattttttaaaaaaattatctaaatggcatatgctgatgttctacactgtggttcccaaacagtggtccctatgtctacaagcactatttcagctatacaggtaccatctgaggatgaaaacatccagaaaaaaaaa

SEQ ID NO: 274499 - DNA, 541 bp, Homo sapiens
attttaagtgtgcagttcaccgatttttattatagtcacagaattatgcaaccatcaccaccatctaattttagaatatttcccttaatacaaaaagaaatgtgttgcccatttgcaattattttttcattttcattcagccataggaaaccactaatgtactttcttctatctatagatttgccttttcagtacattttatatcaatggactcatagtatgtggtcttttgtttctgtccttttttcacctaacacaatgtgttttgaggcttattcatccatattataattttattccattgtatggatataccacattttgtttatcacagattacctcttaatatacaataattaaaattttagttcttttaagtcatcctatacttgattctttttttaaaaaaagaaacctgaaaataagtaaatgaatctcttacgagttagacaaaaatgcaatagaataaacccaaagaaatggataattgaaaaaaattaaagcaaaatttaatgaaatcaatgatataatagagaagaac

SEQ ID NO: 274500 - DNA, 376 bp, Homo sapiens
gcaggagttctctatttaccaggactatggtttgaacgcgttttccccaaagtttatgtgttggaaacttgacccccaatgcagcagtgttggaaggtgcctactaggtggtgtctgggtcatgggggtatgaccctcatggatggataaatgccatgactgaggcggtgggctccttataaaagaatgagtttgggtgaaacctcgtctctactgaaaatacaaaaattagctgggtgtggtggcacatacctgtaatcccagctactcgggaggctgaggcagaatagcttgaaccagggagtcggaggttgcagtgagcagagatcgcaccactgcactccagcctgatgacagagcaagactccgtctcaaa

SEQ ID NO: 274501 - DNA, 350 bp, Homo sapiens
ctcagccaaaaccaaacactggctgccacacagcaatggttctcaaacttgagtgcacgtcagaatcatctggaggtcttgctaaaactaagaaagttctgcctgccccctctgcctctccacccccagtttatgatgcagtaggtctggggtggaggttttgcttatctcatacatttccaggggatactgatgctgctggtctagggaccacacttttgagaaccacacccagatggggacacagctccagagtagccagatggtctctaaaaagtcaagctagaaattcacgacttctggattagactataaactccttcagaaaaaaaagcagtcttttgcttctg

SEQ ID NO: 274502 - DNA, 265 bp, Homo sapiens
ctgcagggaaagagcacacgacggccacagcgcagggaaagagcgcacgacggccacagcgcagggaaagagcgcacgacggccacagcgcggggaaagagcgcacgacggccacagcgcggggaaagagcgcacgacggccacagcgcggggaaagagcgcacgacggtcatactgcagggaaagagcgcatgacggtcacagcgcagacaaagagcgcacgatggccacattgcagggaaagagcacacgacggccacagcgc

SEQ ID NO: 274503 - DNA, 277 bp, Homo sapiens
ggacattggaaatacacgataggtaactaactgaagtacaaaattgtgtttaaaacttgcgatttgggattacaggcgtgagccactgcgcccagccaggacggccacttctaatccatattcttttccacagctgcagccacagccatgcagcgtcctttagattctccttcttcttgagtatttttatgtcttgcttatcaccttgtttcattgcaaatggaatagtagcagtcagcatcagtgcacgctttacaattaatgagtgacgatggag

SEQ ID NO: 274504 - DNA, 376 bp, Homo sapiens
gaatgtttgaatatacggataaaaattcggcaaccatgactgaaatctaatagaagctttatttcatatcatttgatctttcttcttctccaattcttttattgtaaaatacacataatataaaatgtatcatcttgatcattttaaagtgtacagttgagtggtgttaagtatgttggtaatgttgtgcagccatcactgccatccatctccagaactcttttcatcttctgaagctgaaactctgtacccattaaacaatagccttcctctcctcctctcccactagcccctggcagttaccattctacttccactgtctatgattttgactattccaagtacctcatgtcgttggaatcatacagtatttgtc

SEQ ID NO: 274505 - DNA, 359 bp, Homo sapiens
gacccccaacagagacaccactcaccccgggcctctatctgtcctgccaacaagatgactctttgtgccctggctgtctctgaggacctgccctgcagacatatgttcccccttttccctgcaaccatgcaccagttctgtctcaggcagccaggagagctccaccattcaatggagctgagaatctcttttccctcactgtctgaatccgtcgtggggaaaaggacctccttcaaagtggttcctcccgattttcatcctcagccctaggatattgtttagagcattgttttcaccttcctagttaggcctacgttatagttaacaattatttataataaattttccctgttcaaatt

SEQ ID NO: 274506 - DNA, 324 bp, Homo sapiens
agaccagaatattgaagcatgtgggggctgcggctgggggcagagtgtcccttccaggacagggaggccgtgggaatttaaacatctaaggctgcctgctcactgggttttcagatgagcaaaggtaaggacaatggacagctccttgggtgtaaatgcagccaaccttgtgaagtcacagaagtgctcagaaatagggaatccagctttgggaggaaaagtaagaccaagacagctggggaaggaagaaaatggcctgaagtgtccagtcactgtggctcacgcctgtaatcccagcactttgggagactgaagcgggcagat

SEQ ID NO: 274507 - DNA, 290 bp, Homo sapiens
tccctgtaagatagtatctgggagacccaggacacactgagggaagtaacgtgtacgcacagagaaggctatgtgtatccaagaggcatgtaagtcttcatactcctatgtatgttcacatgcttacatgcacataggtatgcatgcttgtctgtaattgcctcgatgtgttttgaaagttggcaaggtatgaactgcgactaaaggagagttatggggcgggcgcggtggctcacgcctataatcccagcactttgggaggtcaaggcaggaggactgcccgagctcag

SEQ ID NO: 274508 - DNA, 801 bp, Homo sapiens
gtatttctgtaccttgcatttccactttcaaggtttttctgaagacataaagcaaaaatgtatgcaaaatatgcatgctcactatagcactttttataataacaaagatataattagatattagaagcaatataatatacattatataaattaaattaatattcacatagataacaatttaaataaggcatatgtcattcatatgtgcaatgtatcattcatgtatgtttgtaaatatttagaaaatgtcttgaaaaaagcacatcaatgtgaacagtggtttcctctaatttgtggaatttatggatgaagagaatgaaagttacatatatgcatatatgtaactacagttatacataattatagttgtatataattatatataacatgttaattatattccatatgattatatgataattatatgtatatatttctatattctgatgatctttaaaataatttttaaactttttaagataactatagattcacatgaagttttaagaaatcatacagagcaatccagcatattttctaccaagtttcctccaatggtagtatcttgcaaaactatgctgctacatcaaaaccagtatgctgacattgatacaggtaaaacacagaatatttctgtcctcataaggatctctcatacagctcttatataacacactcacttccttcctgcccccatcgtctccttaacccctggaaattacaaatttgttctttatttctataattttgtcattttgagaatgttacataaataaaagtatacaaaatttaacctttggg

SEQ ID NO: 274509 - DNA, 622 bp, Homo sapiens
ctttgaaaagggggctgggtgcagtggccgacatctgtaatcccagcactttgggaggccaagacaggcgaatcacctgttgtcaggggttggagaccagcctggccaacatggcataaccccatctctactaaaaatacaaaaattagctggacatggtggtgggtgcctgtaatcccagctacttgggaggctgaggcaggagaatcgcttgaacccgggaggcggaggctgcagcaagctgagatcgcaccatggcactccagcctgggcaacagagtgagactccatctaaaaaaagaaagaaaagaaaaaaaaaaaaagagtaagtgggatctgtgtgaggagctggtgtgcagtgttcttggagtaggactgtccccagatggagaaaagccggccaggctgtgccagcctctgcagcctgttttcatctctacagctgtttcgtctcgccagcagagcccagggatggtaccaagtacactgtgagagctgatactggagttggcagatgccctggggcaggcgccatgcagaacacacagaagtggggttagtgaaaaggtcccttcgaattccatttcgtttcccttaaaaaacaaaaacaaaaaagcccata

SEQ ID NO: 274510 - DNA, 2742 bp, Homo sapiens
tgagatggagtcttgctctgtcacctaggcacgatctcagctcactgcaacctccacctcccaggatcaagcagttctcctgcttcagtctcacaaatagctggggttacaggtgtgcactaccacgtatggctaaattttttccttttagtagagacatggttttgccatgttggccaggctggtcttgaattcctgacctcaagtgatctgcccgccttggccttccaaaatgctgcgattatataggcgtgagccaccacgcccagctgggaatgtttttaaattagtattttcacatgccattccactgtctcctagcttaaattgcttctaatgaaaacttggtcatcttcactgtgttatctttagtttttagcattcttgtttgtgatataccactgtgcattttctttatatttatcctgcttagaatttacagaacttctttgacctgaacttgtatctttaatcagttttggaaattttgggctactatattttcaaatactgttttcactctactctcttctctaggaattccaaatataaatatatatatacacatatatacatatatatacacacatatatacgtgtgtatatatacgtgtatatatatacacgtatatatgcacatatatgtgtgtatatgtatgtatatacgtgtatatatatacatacacacacacacacacacacctttcatcaagtcctatgtgtctaacactcttgtacatgtttcagtatgggtagtttttattgacttatcttctggtttcctaatcctatcttctgctgtgtcttatttgttatttttttatgttttttaatttttttttttgagacagagtctcgctctgtcgccaggctgaagtgcagtggcgcaatcttggctcactgcaacctctgtctcccaggttcaggtgattctcctgcctcagcctcccgagtagctgggactacaggcacctgccaccacgcccagctaatttttgtattttcagtagagacggggtttcactatgttggccaggatagtcttgatctcctgacctcatgatccacctgcctcggcctcccaaagtgctgggattataggcgtgtgccatggtgcctggcccttatttgttattaaatcaatttaacaaggtcttaggaaactataattctcagttctagaatctccatataattattttgtgaattccaattctcagctgaaattcaccatgttttcagcatattaatcacagttacttgaaagtttctctgataacttgaattatcaagatcacctatgggtctattcccataattggtattccttctgttttctgattatgtggcaccgtcttttggcagaatggcatttttgcctccgtcatggagccaaaagcttcagatattatcttatataaaggaaagttcaaccttcctactgctggagagataatgtggtggtttaacatttaatcagcatctatgctgagtcaaggctggtttacagtctttaagtaagatttagtctacctgtatgccttagccatccacttttcaaactaaaagacctacatattctgtggagccattacaccagttaccctaaaatccagtgtatgccttctaagactgctgaaaatgccactttttactacatttccagcctcttgtccagcagaagtccagtattcaaccaaagcccaaaggtgaaagcaggccatatgcttgaggcatcccaaatatctgccaaaaactctgctgactttttccatcctactcctagctgctctgaactagattttacactgcatccagaattagcagattccctaggggcaaaacacaactacaaagctacctgccttatgagattcttacctctccagagacatacccgcagttggttctctttgattctctggtgcattcaaagagatgactatttgatcgggctatttagttgttttagctaaaagcactaatctactgccagctgtcccaccctacctgcaaacaggtgctttccatgtactactttaagtgattcaataaatgtcacaaattcaaggccaaagccactttttcacttatgtaccatttttgttaaaggcttatcaagacactctttatgcacaaaactaaatgccattgatcataataaaaacatgcatataatcaattcattccccaagaaatatcctatttcactgaatctaataggccgatacttgtaaaaacaatttatgtactaataaaaaagaaactagactgaaatcaggcagtctaagaattcccaaataaagctgggacactaaatggtaatcagcaactataagacacattatgtaatttcaagtaaaaaaaaaagactgtgatgaggtgtctaaggaacaccttcaaataaagcttagacaccaacccattctcacagttaaaatgagaaataaaccacaccttgcagatagaaaaaattcttgtttcaatactgccactgggtataaggaaaaaaagcatcctccaagaattaaatgataagctaggattcagtccggttcagaggcctgaattcatgctacctatgtggtctaaaaaggctcaagcagagtatttaagttaaagttaaatggcactcccaagtgactagtaaacaagcaaattcaaatctttgaaagaattcaaattctgtcagcccaacagcaaatttaagatacatttttatttcagagatgttaaaatacc

SEQ ID NO: 274511 - DNA, 508 bp, Homo sapiens
atttgtttcatggtttataagaaggagtcacctgtgttcccatcagtcagtcatattcaatttcttctagggacacatgtctcttctcccaggccaggagagttgtgaggcaaggcagggcagaattactgttcagctagagagtatcaaaaatgaagaaatcctccactgccgcttttcttaccgctgctcctcctcagctgtcttccatgtggtattaactctgaaatgagctgggctcacctcagacccaggagaaggaagagggagctgcatgattttaagcaaagtgtcagaagaaaatatgttcttatttagatgtggaagtataatgtgcatatgaatagggaaagagcatttcacgtaaacatgaatttttttaagaatgtaacattttcttaaggttaatcaggaaactgacatataagctaatataattttgagagatagattttagagtagctttcaatgcaaccaacactcaagaaacacacacaggcacaaagag

SEQ ID NO: 274512 - DNA, 148 bp, Homo sapiens
tttttaacaacattagacaagtcctctcaaaggcctcatttcctaaccacgcaacgacaaacacactaaaataaaatgaggtactcacctaccttccacggatatttggaagaataaactttttgttactctaaaacacttcgggtca

SEQ ID NO: 274513 - DNA, 289 bp, Homo sapiens
aggcatttgaaagcaggtacttattcctagctaagctttccttctctaggcctgctttcaggtctttcagccatccctcctattgcttggtttcccagccctgcatccttctaattgccttcttctagacatgttctgatttgttgttctgtttgttctgagctctgaggtacccagaatgaggtgagagactgtcacagcccttgacagagacccatgccaccttttagtgaaattggctgtttcgatagccttaaaagggtcgttcatttatttcaagtttaatcga

SEQ ID NO: 274514 - DNA, 424 bp, Homo sapiens
atcgcttgaacccggaaggcagaggttgcagtgagccgagatcctgccactgtactccagcctggtcaacagagcgagattccatctcaaaaaataaaatagaataaaatcaaataaaattcagagtaagcacacactctgggatgtaagagcccacacaccaaatcccactgctaccatgaccaatggcttggtggctaaagagggtgtaagactgggcatggtggctcacacctgtaatcctagtactttgggaggccaaggtgggaggattgcttgagctcaggagttcgagaccaccctgagcaacatggtgaaactcaatctctacaaaatacacaaaaattagccaggcatggtggcctgggcctgtaatcccagctactcagggagctgagacacgagaatcacttgaacctggaag

SEQ ID NO: 274515 - DNA, 795 bp, Homo sapiens
gacaccccccaccaccccacccacccccccccccctccccccccccaccacccccaccgaccctatacccagcctcaacgccgctaccccgaccgccccctggcggcttggctgcaaactcccgcgcacgaggaataaaattcagagtaagcacacactctgggatgtaagagcccacacaccaaatcccactgctaccatgaccaatggcttggtggctaaagagggtgtaagactgggcatggtggctcacacctgtaatcctagtactttgggaggccaaggtgggaggattgcttgagctcaggagttcgagaccaccctgagcaacatggtgaaactcaatctctacaaaatacacaaaaattagccaggcatgtagctgggattgcaggcgcccaccatgacgccccgctaatttttttgtatttttagtagagatggggtttcgccacattggccaggctggtctcgaactcgtgacctcaggtgacccacccgcctcggcctcccaaagtgctgggattacaggcatgagccaccacacccagtcttagtcatcgtaaaggctggcagcactgtaggaacagacagacctcaataggaaacggggaaacccttcttgcagactttctgtattgctgggtagtgaggggtaaagtatttcccaccttaccccacttaatcctcatctctctggccagagtaggagcaaaacaggaacagagacaggctccagcctgggtgacgaagaaagactccatcaaataaataaataaataagactaatacatg

SEQ ID NO: 274516 - DNA, 322 bp, Homo sapiens
gtgaacctggccagaagacagtgtgttgtgacagatgattgctggtgagggggtaacagtctccaaggtgtagatgttgggggctccagatacggcaggaggggcctggcctctcggaatcccctcagccccatctcatagaaacatgtgctttctacccaggctccatactccggaagggaggcaggaccctgtcactttcttggcctactttggaagttctcagtcaggtatctccaggtgtggcagaggggctttggcctgtagggggtgtggtaatgtgggttttggaggcagaaagcttttcaggaaagccccctgg

SEQ ID NO: 274517 - DNA, 481 bp, Homo sapiens
tgcacagagaggatggtcactgattcagtgaccttaagctggaattttccatcacaagacacatgagataaaggcgagacatatgacaagggatggctggctggtctgcagaggaggcagacacacaggaagggctaagacaggtgagtgaacctaggtcatgccctgtgcctgggtcacactgcaggcctgtcatgccatggtcccagtggtcacaggaggcagacactgttcctccccaatgtattctatctaaattcctccatttaacatttgaaaactccacctaatatgctcagaagccatttctgggactacgagacaatctcctatattgtttgactaacaaacaatgtgcctgaccttcctgggcttgtaagtggtggaacaggactcgaaactaggtcggctccaagcccagtccgtaacaccacccaacgctggtgctctttccatggtgggtgagaaccctggagggacc

SEQ ID NO: 274518 - DNA, 355 bp, Homo sapiens
caaccaaacccaggttcaattgctcatggctccaaagccagactagaaagacaagaggtgatgagaggaaaagcaggtttattcaggagccagcaaactgaggagatggcaaactagtgtcacaaagactatctcaggttcttcaggctggccaaaggagttttaaaggaaaagggacttgggaaactatgtgcaggtcagcatgtcttgttccaatgattatcttaagcaataggcctcctggtggtctgactggcatcagctaaactgcagccagattatagattaactgattacagattaacatttacttccaggggtacgctggggaatgttttacaaccttggttttatc

SEQ ID NO: 274519 - DNA, 282 bp, Homo sapiens
tccttgatatgctgtgatgaaaatggtatttcacttctgtgattgcccccccccccgaaaaattcataaccccactccaattatgaagaaaccagcagagaaatactaatcgaggattattctacaaaatacctgaccagtactactggaaactgacatggtcatcaaaaacaaggaaagtcaaaaactgtcactgcaaagaagagcctaaagagatatgccaactaaatgtaatgtcatatgctggttgggatcctggaaccaaagaaaaagaacatgagg

SEQ ID NO: 274520 - DNA, 220 bp, Homo sapiens
agaggccttccagaacctgagcattgtgtttttctttttcaatactttagtaccttagaaaccagaaagtgataaatgaggagagtaggtatgaagtagaagaggattttgatggccagctcgtaaagtgtagcgttaagtgaaacattgtgatgtgaacaatttggtatttttgaaagtcctaatgctacttgtaccaggtgaaatgtttaaatctctc

SEQ ID NO: 274521 - DNA, 406 bp, Homo sapiens
aacctccagtcaacatgcggtaaaaagccagagcccttagtcacacagccacaaggaaataaattttgccagcaacctgaaggagcctgaaagtgaattcttcctcagtcaaatctcagatgagatcccagccaggctgacaccatgacagcaaacttgcagttttgccttgaattctgacctataactgtcagataatcaatatgtgttgttttaagttgctaaatgtgcagtgatttgttacacagcaatagaagatgaatagacctgctctaaaattcatattctgctacatacttgatgagactcagcacctatcagagagcttccccagaagtgagcagatgctgccatgcttcctgtacagcctgcagaactgtgagtcaaataaaccttttttcttttt

SEQ ID NO: 274522 - DNA, 416 bp, Homo sapiens
ctgcctgactgatctgtggctgtggcaagtggaaaactcccttgaggatgatgcacttcttgatgtttgaggcaggaatgttgatcatgagcaaccatgaagaccaggcccaaagtagggaggggacaacggggatggccagggaaccagccgccatgcttacaggccatgggctagggaaatggccgagtcacagaacacctgcctcctgagcccctgcttatagcaaagaatgaagcatagagccagcagctctggcaaggggcaatggtgagtggggctttaagcttggagaggtcagggatcatgcatgaccccttgttcactcatatggaccaaatgatggcacagagcaagtgctcaatgatgtgcgcccctgagtatctgtcactggaggatgtgatgatggcaccaca

SEQ ID NO: 274523 - DNA, 461 bp, Homo sapiens
tatattctcctactattgattcctttacaactatttcaatttaagaagaaaaatgtcagatagtgtgatatgaatcatgtttgagaaatatttccttgagagtttgactagtgcaacaaaaaatatctgtaagggacaatgaatgttaaaaatggttttattcctgtgctcgagcaaaacctactctttttatgtattctcaattttcagccctagaatgtgttattaacttgaaagaaaaactctcccaaagatctaaaagttatgctgattttttagaaataactaaaggttttcaagactaccaaaatttcaagctacatgggacaattaccaatgtatggtgtgtgaggggaagactgtagtaagtttagatgtcactgaatatttttcactaagggatttaaagcattttatactatacaaaacaataaaatgtctattttattttcaaaaattta

SEQ ID NO: 274524 - DNA, 280 bp, Homo sapiens
caacaattttcatttaaagacattttagactctactgcattaaactgatgcagaaaatttgtctacacagtctcaaagtcccttatggaattcattcagctaattcagagaccagatatggcatacaaattttatatactgatcaatcatacttattagtatatagattacagtggttagaaatattagtctagcagaaactaatatacacactacagtccaaataaaaagaatcctgtcaaataagcttgatgtaaatccacatgaaaatcaaggctgc

SEQ ID NO: 274525 - DNA, 126 bp, Homo sapiens
ctggcagtcaccttgctgaagactgggggttaggagttgcttccctggagctgccctggattgctctttcttggagagattttagtgaaactggttttccatgggttcattgtgcagcgcctttcg

SEQ ID NO: 274526 - DNA, 413 bp, Homo sapiens
acattcattgagctctcattgtctgggtagagtattacacgttgcatactacaaagcaggtgacaaatcaatgccaaataagtacagtcatcttctctagttctcataagactatctccccgccacctatagttagtaccctcaagtcctcctgagctgtgatcagagaataaacatttctcaacaattttaccaacaatttttaatgaaaaggaaaattatacttgtgattctcgtagtgacatttatattacatgttccatttgtgatattctataataagtattatattgagaaagtcaacaagcacctctttacaaaactgttatctgatgtcttcctgcatattaaggatgaatctacagaattagatcaataaggatcaacaaataaatatttttggtcattataat

SEQ ID NO: 274527 - DNA, 197 bp, Homo sapiens
gggtctcactctgtggctcagactggaacgcagtagcgtgatcatggctcaatgcaacctccacctcccagggtaaagccatcttcctacctcaacctccagagtagctgggaattcaggcttgcgacggcacacctgactacattttgcattttttatagagatgggatctcactatgtggtccaggctggtctcg

SEQ ID NO: 274528 - DNA, 1417 bp, Homo sapiens; identical to SEQ ID NO: 21

SEQ ID NO: 274529 - DNA, 227 bp, Homo sapiens
aatgcaggagtcaatgactggtatgtctcagccttgtgccatctgggagggacctggttccatcaggtttcacctcagctcccttatcgtgctgctaagctctgaccccaacgtgagtctccctgccgcagaccacatgggcaatgctgggtctcgagaaggcactttggtgtctgaacaaggtagatctgctggcttctattcccaggccccaccccttccccagg

SEQ ID NO: 274530 - DNA, 503 bp, Homo sapiens
gttcgtaaatttgtctttctaacacatcaggagcctggatttccggctgaaatacaacaccgtgcattctccaatgtatagcctagctttgggtcaaaaatctaggacctgctgcaagaattactacgcactcaagttctctgcacactgagcacgaaggttcattggaaaggagactcttgtgaggccttgaagcacatccattcacacctaataattgtacagatatgaaaagtaacatcagagaagtaaagatttttctaggaggccatttaggttttgctctgtgctttattctatcacattaggctgccttattctctgttacctgcatatctatggtagtattaaaagtaagccattttcagtttgcgttaacaagatggatgtctgaaaaccaaatacaactggaaaattcaatccaagttactgaggtttgactgagatatattgattcttaaaaaacaagataataaactctaaatatccattgaaaaaattta

SEQ ID NO: 274531 - DNA, 395 bp, Homo sapiens
tttttgacagtagcatgaattagtgaaaagtccttgaataatagaatggttttcaaataactcagacaaaatgaataaaatatttatattaaattattgaaggttcttaataaagacatgaattatctgttattagtaaaagaattagctatatgtaagatgatgcttagaaattaccttcaccctagctgcctaaaggaagaaaggcctgtagtccctgggaaataaataaattaatgggaaataatatcttcatctatttgtgtcttaactcctctaagcactatttgatagttttcagtgtagacttaacccatctttcattaaatttattcctagatactcatatcttttgaaagtattgtaaatgtcattaaaaatattttttcattttc

SEQ ID NO: 274532 - DNA, 264 bp, Homo sapiens
aaatctaagccctaagaaaccttgctcgttcactgttctagtgtcttcccattgcctagaacagtctcccatgcccagtagatgccaaggcatttgttgaatcaacgaaatgaagtagaatgaatggataaaaggagtagtgaccagaatgagggagacttcataggcaggaccagcagggcttgctgactaactggattttgagatgagggggctgagagaagtcaaggatgatcccaagtttctggcttggggctgaaggga

SEQ ID NO: 274533 - DNA, 327 bp, Homo sapiens
actctcctcctcgagcaggttaggctggtgcagagggtctccattctactaaggccttgtctggagccagaacacagagggccctggcactgcacactcctctttgcacagaggcagtgcttatacagcaagtggcagatgcacacggggcagaagcccaagtgagttcattctttcgcaaatatttttgtagttatttattaacatactcattaggtgatacattcaggtgtttcaaacattaagaaagcatgaaagtatatggctgggcacgggtcgtcacgcctgtaatcccagcactttgggcggctgaggtgggtggatcac

SEQ ID NO: 274534 - DNA, 720 bp, Homo sapiens
  misc_feature (27)..(27): n is a, c, g, or t
  misc_feature (81)..(81): n is a, c, g, or t
  misc_feature (83)..(83): n is a, c, g, or t
agacctagtcttgaacctctgaagacnacactttgtaatttgttgtttggctaaatgagaagaaatctgtgccaccctggnanggtgtcaaaagaaggaacaaacttgctggatctagtgtacggaaacctgattctgggttcctttgggaaggagcattacgggcctgctcctggaccacctcatatcaccagcaccctctacccaaggtcctggagccaacactggagtaaaagagcacaagagaactccttagaggtggaaggactggcgcatctcatgagagctaagcatgacagatatcaacaggcgggcttcctaggatgatttctcagccaacagtccaagaccttttgttgatttcagccccacttagccaagacctcaagtataaattctgataattatggagaaatcaactgctattttataccgattctgttaaaaaaaaaaagttttgtaactattaaaataattttctgaaaaaaaaagaaaaatataaaaattagctggatgtggaggcacatgcctgtggttccagctaccagggggctgaggcatgagaattcttgaacccaggaggcagaggttgcagtgagccgagatcatgccactgcactcccagtctgggtgacagaggaagattctgtctcttaaaaaaaattaatatatcaatcattttgaattgtaatctttctgtaatgcttccttttaacattt

SEQ ID NO: 274535 - DNA, 648 bp, Homo sapiens
tcgctcacgctgggagctgtagaccggagctgttcctattcggccatcttggctcctcccccctggtttggtcttttccaagtttattggcgtagtgctcctggaccacctcatatcaccagcaccctctacccaaggtcctggagccaacactggagtaaaagagcacaagagaactccttagaggtggaaggactggcgcatctcatgagagctaagcatgacagatatcaacaggcgggcttcctaggatgatttctcagccaacagtccaagaccttttgttgatttcagccccacttagccaagacctcaagtataaattctgataattatggagaaatcaactgctattttataccgattctgttaaaaaaaaaaagttttgtaactattaaaataattttctgaaaaaaaaagaaaaatataaaaattagctggatgtggaggcacatgcctgtggttccagctaccagggggctgaggcatgagaattcttgaacccaggaggcagaggttgcagtgagccgagatcatgccactgcactcccagtctgggtgacagaggaagattctgtctcttaaaaaaaattaatatatcaatcattttgaattgtaatctttctgtaatgcttccttttaacattt

SEQ ID NO: 274536 - DNA, 339 bp, Homo sapiens
tatacagctgtgagcccatcaccatgtgggaggtctgttagctcacttcagcatctttcaagtaccagttctggcctacctgcacattctggtgagtttctctaccaactgctggccactctacaaaccatctctggcctgtgtgctctggtgaattttttcactattggcaatctttagatttttgtggctgctgggccatttccaatgaggactatgtgtctggtggttattgggggctcttctacatttttagttccttcttgtccctatgtattttccttcagccctaaaagtggggcttcctgtatttgctagtttaaacatatcccttacagt

SEQ ID NO: 274537 - DNA, 327 bp, Homo sapiens
tggaaaaccaaatattgtatgttctcacttataagtgggggctaagctatgaagacacaaaggcataagaatgatataatgaactttggggactctgggggaagggtggaaaggggtaagagataaaagactacacattgggtacagtgtatgcagctcgtgtgacaggtgaaccaaagtctcagaaatcatcactaaagaactaatccatgtaaccaaaaaccacctgttccccaaaaacttgaatttttttaattttaatttaatgttaatacttttttcatgtctgtttttcttttaaaaaataataataaaggaagtaccatg

SEQ ID NO: 274538 - DNA, 267 bp, Homo sapiens
gaggcagtctccctctgttgcccagggtggagtgcagtggtgcaatctcagctcactgcaacctctgcatcccgggctcaagggagcagttagtatgattatttagcttctgaaagatactttatatccaaatcatatgaaggcttaatttacattgagcaattaaagattgatcttgaataattcataattcttccacagtagaaataaaatgattcctggctagttattttcttaaaaataaaaaaaatttgaaaacctcaacaa

SEQ ID NO: 274539 - DNA, 128 bp, Homo sapiens
ccagatcctccctccctctagacaccatcgtgtccatccagagcctccctccctctagacaccatcacatccatccagagcctccctccctctagacaccatcacgtccatccagatcctccctccct

SEQ ID NO: 274540 - DNA, 236 bp, Homo sapiens
tttttttttttaggtaagagaaaatctgaaaatgagacgtttcattcacctccatatctttactgctcagacacattggctgatatctgcttggctttacttccagtgctttctctaattgcagaggcatgtgaaggccgtaatctttagaagagccttcaaagccttgcatggtctggccctgcctgtctttccagcctcacccttgtgaccgtctccccttctgtcgtcttctc

SEQ ID NO: 274541 - DNA, 1484 bp, Homo sapiens
gaaaagacctgactttggggccaattttggttgttaaaaggtatggtagactactgtgtagtatttgtacctgaggagcaacaagaagctagaagttgatggagttgctaggcattaggtcaatttctatggaggatggatttggaggggggctgagggagtgtagcaaagaggtaatagccatagcacgtggctgagtattaaactattttaatatttctacaactatttatattgcatggttgagaatctgaaattactgttgatcagaaatttgtataggaggagatccttttctagtttcataagtctgtggtaggggaggagtggtttaagtagttaccactagaagatgattgaccagaagattgaacaggagtagtgtatgccagtagtacagttagggcagggtcaaggtagagactgtggttaaatctttgtggctgaaggtcactcagaggtgagaatttaagacggcaaaggtgttatcaatagttcttttaggaaaaaggaaaaggcttatccttgttttgtgttttgatttgcgaggactggtttaaactttgaagaggcaacctgagagtgtacttgtaccatcagtaatggactaaaaaggattatggtggtgctttattcatacttctcacttacttagggcttaattatgatttccatatgctttgtcaatttcatagtcctttgctcgtacatcctacctaatacatcataactgatttgtgagtatgctaatagtatgctaatgattgattagttcttggctactttgagggtgtatgtgtgtgtatttgcttttgattggactcagaatcttggagagtggagagattctacgatgttttaatccaatccattcacctttccaaagtaggaatacattttttagattatctaacagataaaattatttttcctctgaatacttcccaaaggagctcagttctctcggtgccattgcactgttggaaacactatgggctaggaattctttgttacatcaggtggaaatttaacttcccacaaaatgattccctttgatttggttcttttttctggtatggatggaatacaggtacttgaagtaggaaatctatgaacttgtaacctgttcacaatttaatgaaacacagaaagtgagagtgagcatttagaaattattataggaattttcaggctggaaatggtggctcacacctgtaatcccagcactttgggaggccaaggtgggtggatcatctgaggtcaggagtttgagaccagcctggccaacatggtgaaaccccgtctctactaaaaatgcaaaaattagccgggcatggtggcaggccccggtaatcccagctacttgtgggggactgaggcaggagaatcacttgaccctgggaggtggaggttgcagtgagccgagattgtgccattgcactccagcctggaggacaagagcgagacttcgtcctaaaaaaaaa

SEQ ID NO: 274542 - DNA, 133 bp, Homo sapiens
aaattataaaataaatacttattgaatgtgtcaggctcacagatgccattgtaccataacagaaagcattatgtaggaacgtgaagtttgtcaggtatgtagaaattgagatgcacatttttaaacttttggt

SEQ ID NO: 274543 - DNA, 501 bp, Homo sapiens
ccaaatagagaactagaatgctaatcaaaatgcctaggtaaaactgaaattgcaggaacaggccaatggacgggttcgagaggcattaaatctgacatccagagtaaaatcctagctctgcttctcactagctgtgtgattttgtgtgactttaataactctgagcctgggtttcctcatctatgaggctccttacctcatggaggtagcaagtattaaattaaaaagataatgtgtgagatacatttagcacagttccaaaccatggttggtactcaataaatagaagctatgtggtagctgagttttggtagatgacacgtgcctagggttcactctagttagaagctacaactttatacctggatcactgcccagccctggctggtggacctgagcctctaggctggctgtctgccttggtggagattaacttcactcttgggttgtgctgcagttcaaggtccatatctgagcaggctgagaaagccagggctgaga

SEQ ID NO: 274544 - DNA, 935 bp, Homo sapiens
tctgcctcaactgtggcaagctgggtcttccacgtcaccaagtgtcattttcaccgtgcctgtatggtccgctgttcatcctgttagcggaccccgaaatcaggcaggaaaataaagctcagtgggagggcctcggagcaagacaatcccaccaagatggactcgggttgattaacgtgagtgaacctctgaggaccagaatccagactagtaattctccatcccggctgctcgttagatgcccggaccgacccccccagaccaattcaatcagaacattcggaggggcttgtaaaatctcccggggagattccggtacgaaagccaaagactcagacgcccgttctccacccgcctgcagcggccagcgcgggtccctcttagggaattgaatgcaggccccaggcctcctcctcgagtatcccagtgtgaccgatggccagctcacaaacgcgcagtgggtgcggccgcgccagggcgcagcggagcagagggcccggccgctttcggcctgggaaagaggagccacggcccggagaggcgtcagtgctgggctgcgcctgcggaggtcctcgcaattgctggactcaaccgcgcgcgccccctaccggtcctgcgaaggagccgcagccgccgcgggaggccacaggtgaagcgaagggtgtgtcttacttcagcagccctattcaaaggaaaaaacatgaaaattaaaatcaagttacaattttgtattggcataaaacatatcagcaaataagatgtctgaaaaggagggtatgtcagaagtgctagaggatactattagtcaatttaggaaagaatctagatcacagtcaatgaaggagcctggctttattaaagaaacatcaaatttgataaacgaagcttctgattacctggaagggaaatcttctaaccagatttatgaaacacat

SEQ ID NO: 274545 - DNA, 334 bp, Homo sapiens
caggctcataaagagcacagtaagttctcactctggggctgctgattccactcagaactgacaggccaggccccaggcttcagactgttcctggcttgaatgtaggatttcatcagggactcacccctttccacccagaagcccatctgcctcctgccacaatcaatcatgttgtccagggtacccactctgcttgtgggaggggcacctgcaaggtcacacagagggacccatcggcctccctctcatgctcctcattccccaaagtccagagggggctgaggtgacagggggctggcaggtcagtgctgccccaagcatgggcacaccccac

SEQ ID NO: 274546 - DNA, 288 bp, Homo sapiens
ccagctaatttctgctatgccttttgagtagtacctgaacagtcctgatatggctgtctcagatgcacagcccacaccttgttcatggaagacactcaaataccctttgcttctgcaaactctgggagtgcaaccacctctcctagatccaccaacaaaacagccagcaagcctagatgctatcatgtctgatgtcagatgtggttcagacacaaatctatttgttccccaaactgcacagactgctgaggacagatgtgaagccctctgtctgcctttttaaagtcc

SEQ ID NO: 274547 - DNA, 240 bp, Homo sapiens
ccatctaatacaactgtggaaaggtctatgaaggagacttgatctagattgggaatctcaagtggtaaacctaaggaagcaacttttgagctgagctaggagttaactcggcaagagggaggagaggagagaggaagaagaatgccaggcggcaggaagagcagagtgacttcattggtaagacagcgggcatcctgggaaagagccagccaagtgaggcaggaaggagggccttcttca

SEQ ID NO: 274548 - DNA, 442 bp, Homo sapiens
actggagagaaactacaaagctggaagacatcacagtaattctgacaacacctcaaacttttctaaacataaaataaatcatactggtgaggaactttaaaaatgcgaaaaatgtgacaaaatctttaaatgattgtcacacttgattgtaggtaagataattcttactagaaaaactcttacaagtgtgaagaatgtggcaaaatttttaatgaatactcacaccttattgccaggaaagcatttatacttgagaaaaattgtaccaatataaagactgtgaaaaagccattaatgtctgctcacatcttactcaacatcagagagtacttaaaaaaagtattataaatttaattactgtcaaaaagtatttcagaaaatataagcttttaaagtatttattttgaagacaaacattacaaataaaagagggttgtaatac

SEQ ID NO: 274549 - DNA, 196 bp, Homo sapiens
cccaccccaaccttatcctccactgcttttcagaggagtctggccaacacaaatcctcttgtttgtttgtctgtctgtctgctgctcctagtctctgcctctcccagtctctcagcttccgtttctttcttaaactttctctcagtctctgaggtctcgaaatcacgaggcttcgacccctgtggaccagatgccc

SEQ ID NO: 274550 - DNA, 665 bp, Homo sapiens
tctagaggaacatctgaggctgcgcaatctctaaggaaaagaggtttatttggctcactgctctgtgggctgtacaagaagcatggcaccagcatctgctcctggtgagaggctcaggctgcttccactcatggcagaagcttgctctggctaacaaccactatcatcaaagttgtctgaggaagacctcctgttgctgtgactgacgggactcttggtggaagccctattcccatgtgcccatggctgcagctccccaaggaagcaggacattgttggattctctaagaagctcagaggaagttacttctcactgtggtgccatatgggatttgaagtcgttctactcatgctctgtttttcaataaagctgcttctgcctctgtaaaaaaaaaaaaaaaaaaaaaaaattggcggccgctggggctcctgggcatcctctctggggagctgctggccgcttagcgttgtttgatttttgaccttgacatagtagataggcttgtggtttttttaatttaaagatattaagacttaattcactaaaatttattctaaggggatatttatacttttatacttttttaggtatcgtattttatcagcttacagtttaatgcctaagtttcccctggaaatagcaaataaaattgtgtatttatgaa

SEQ ID NO: 274551 - DNA, 606 bp, Homo sapiens
tctagaggaacatctgaggctgcgcaatctctaaggaaaagaggtttatttggctcactgctctgtgggctgtacaagaagcttgctctggctaacaaccactatcatcaaagttgtctgaggaagacctcctgttgctgtgactgacgggactcttggtggaagccctattcccatgtgcccatggctgcagctccccaaggaagcaggacattgttggattctctaagaagctcagaggaagttacttctcactgtggtgccatatgggatttgaagtcgttctactcatgctctgtttttcaataaagctgcttctgcctctgtaaaaaaaaaaaaaaaaaaaaaaaattggcggccgctggggctcctgggcatcctctctggggagctgctggccgcttagcgttgtttgatttttgaccttgacatagtagataggcttgtggtttttttaatttaaagatattaagacttaattcactaaaatttattctaaggggatatttatacttttatacttttttaggtatcgtattttatcagcttacagtttaatgcctaagtttcccctggaaatagcaaataaaattgtgtatttatgaa

SEQ ID NO: 274552 - DNA, 589 bp, Homo sapiens
attgtggggtatctcatcaaacaaaggaaaatatagggttaacataagattttgctaaagagtggaatttaggtgtgatgtaaatgaaatgatattctatgggctctaagaaagtatggttgtgtataaaaggggtcaacctcagctctgtactgtgaaatggacctatggttcttgtcttagtccattttgtgttgctctagaggaacatctgaggctgcgcaatctctaaggaaaagaggtttatttggctcactgctctgtgggctgtacaagaagcatggcaccagcatctgctcctggtgagaggctcaggctgcttccactcatggcagaaggtgaggggaggtgtaatgtgctaagatcatacggtgagagagaaagcaaggagggaggagggaggcgccaggctctatttaacaaccagctctcttgagaatgaataaagcaagaactcactaactgttccctacccccagggagagcattaatctattcatgagggaccctccctgataacccaaacgtctcccattaggccccacctccgacaccttggtttgagggagacaaacattcaaaccatagc

SEQ ID NO: 274553 - DNA, 452 bp, Homo sapiens
cattgaaaataccaaattattttccacttatctattgttacccacaagccactccaaaacccagtggtttaaaacagctgtttattgttaccaccagtggttctttgggtggactgggctcagcagggtggtttttgctgagggctccggtggttgcagtcagatggcagctggaggtggagcaacctgatgtcgtggttttgcatccacgacagcttctctcagacaagtgatcctagccattactcaaagcacagcctcctggaagagcttgttcttctcacaccatggcttctggcttccaaaaggaattattcctagaccaatctttccaagagggaggggcttctagaaggttagtggcaaagttacttctaccatcttctaagtcaccaaatcagtgtaggactcccacaggctaaaggagattaaaaaaaatgaactctaaatct

SEQ ID NO: 274554 - DNA, 472 bp, Homo sapiens
tggtcagaaagatggttgaaaaatatcctaagtgccatctagtgagaggtgcctgtgcagcgagcagtaaacatggaagcactgagggtcttatgcagaaactaatagaagatacatggccaagagaaaattaaagcttatttacttggtatactagcccaaactctttgccaaagtttgagtaaaaagactattgttttaaaaaatcaaaataaacctaaggaaaataaagatttgctatattggcaatagtaaatcaacctccaaaccctaagaaaagaggcttctaagaaaaggttctcttatgggtataaagattgagatggggttagcagggcatggtggcacatgcttgtagtcctagctgaggccagaggattattcgagcccaagagctcagggttgtggtgagcttggttgcatcactgtgctccagcctgggcacagaatgagaccctatttttaaaaatta

SEQ ID NO: 274555 - DNA, 264 bp, Homo sapiens
ccccccaccaaaaaaagaaaaaagaatcaagcctattcatcccaccactatgggcccaaatgtcttttcctcctcccgctccccactctgctgtatcaacggaacagcatctctcgccagctgtcattcactaccctcaccgctaattactgctcctgctaatcctctgcctcaaagcctatcaaagctgtcccactctctgccatccccacacaccctgtcctagtctttgtccttggccagtgtggctcctgcagccctggc

SEQ ID NO: 274556 - DNA, 4749 bp, Homo sapiens
gcgggtgttcggctacgtcactggggcgctacggttcctggagctgggcagtcttctcgtcagagtggggactggtaagagcgacctccccgccaggtcctgtgtgttgccggctgaagaagggatgatgattattccccaccttctaagagacaaagaccaacgagccaccacagccaccagtcccagaacccgccaatgctggggaatggaaaatgagggagttcaactctggccctcacaatccagtggaggagacgaaactcatctgcctctgtccctctgggcacacctcatgccaggtgcatctgtggacaggggccatgctcctgggcttccaaagttggagaaagctgccaggctcagacccacctaagctgaagattcccttgagaacaagtactgtcctgtggtttcatggcctttcttccatttgtggttcttgcgaagtggaatttaaatgacatcttatcaagatggataaaccctggtttcccagtgctggaatatagaaaatggatggacaagtaaatcccactcagtacccataggccaggcatggggacctcaacacacctgagccccagacatcacctttcattctggacctaccatgaaagacttctgaatccaggaagagaaactgactgggcaacatgttattcagaaacaggaccttgccctgtcactcaggatggagttcagtggtcctatcatggctcattatagcctcaaactcccaggctcaagcaatcctaccatgtcagccttcccagtagctgggactacagctggatctaccatgaaagacttctgaatccaggaagagagactgactgggcaacatgttattcagggtctccctctgttgtccaaggctggagtgtagtagtgctatcacagctgactgcagcctcaaccttccaggctgaagtgattctcccatctcaacctcccacgtggctgagactacaggtgcttgccaccatgcccaactaatatttggaattttcatataagtggattccagaggggtgacagcaaaacgtgggaccatccagttgcaggaaaacaagcttaacacgcccactgattttacattatgctcctaccacccggcagcctctccaggcccagaactttctccagtcagcctctacagaccaagctcatgactcacaatggcctatttaggcccataccctacctcacggcagtctccgcagatgagcctactgcctcacaacagcctccacaggcacagctccatcattacaatggcctctttagacccagctcctgcctcccagccttctctccaggccctgaactttctgaagtcgacctcaccaggcccagctcatgcttctttgcagcctctccaggcccagctcctgcatcttggtggcccctccaggcccagcctctgcctcccgtcggcctctacagtcccaacatctgcctcatagcagattcttgaggcccagcatctgcctcactgtggaccccccaagccaagctcccaacctttcagcagcttctacacacccagctcctgccacccagtggcctctttaggccaagctcatgcttcacaagggcctttccaggcccaactttcgtctcatggcaaccttccctggccagattcctgcgtgtctcccagcagcctagacaggcccaggtcttgcctcacactggcctctctacatccagctcatgcctcacggtgacctctccaggcacagctcctgtcccagaacgtcatctccgggcccaaaacttactcgagtcagcctctctagtcccaactgctgcctcctggtggcctatgaaggcccaaaatctcctcaagttgacctctcccggcccagctcctgcctcctgtcagcatctacaggcccaacctctgcctcatgggggcttctccgggcccagctcttcctattggctgagtctacaggcacaactgctgcctcacaacagccttttttggcccagttcctgtccagttcatggcggccaatgtaggcccaaaacttcctcaggtcatactctccaggcccaccttctgcttcctggtggcatgaacaggcccagctttgacttgagaacagcctctgcaggccctgcacttgcctcccaggggcttttccaagcccagctcttgcctcatggcagctgccccaggccaaatttcttcctgcctgccagcagcctcaacaggcacagctcctccctcacagtggcccatttaggccccactcatgactgtcgggccatttccaggcctagtgcctgcctcctggctgactctttcttgaagcccaaaacttcctcaaatcagccttttgcctaacttctgtctactgtcggactctacaggccagcctctgcctcacagtggaccctccagacccagatggtgtctcactgtggcatcctcaggcgaagctcctgcctttcggcagcctctacaggcccagctcctgccttgcagtggcctctttaggccaagctcatgccgcatggcgacttttccaggcacagcttttgccttttgcagcctgtccaggcccagaatgtccttaactcggcatctccaggacgagcttatcctcccagtgcgtctacaggcccgtctcctgcctcacaacaacctcttttggcccaactcctgctgagctgctggcagcctctgtaggccacagacttcttaaagtaaagctttccagccaccttcggcctcccagcagcctcagcaatcaaactattccctcactgcggccaccgaaagccaagtttctccctgcctcatggcatcctccgaaaactgagcatttgcctcacggtggcctccccaggccacgaatctgcctgcctcccaggcaggtgctgcctcacaatggtctctttaggcccagctcatgctaaaagatggactctccaggtacagctcttgcctcctggcagcctctgcaggcccaaattctccaaaagttggcctctcctaactcagctcctgcctcatgtcggcctacacaggcccagactcttaccacacagtagaccctccaggcccaccacttgcctgatcatagcctcctaaggccaagctcctgcctttcagcagcctctacaggcccagctcctgcctcgcaattgcctttgtaggccaagatcatgccgcgaagtggcctttcctagcctaacttttgctttttgacgcatactccagtcccaaaacttcctccagtcagccggtccaggccaagctcttcctcccaaaggcttctgcaggccaaaatcatcctgaagtcaccctctgcaggcccagctcctgcctccaagtgctgtgtaggccaagctaatgcctcacagcacactttccaggctgagcgtttccttttgtgcatcctctccaagccctgaacttactccacttggcctctccagaccaagctctccctcccagtggcctctacaggccaaaattgtcctcaggtctgcctctccagggccacctcttagctaccagtggcttctgctggccaaaatcgacctcaagtcagcctcttcacacccagctcttgcctctgagtggcctctccaggagcaaaactttctcaagtcggcctctccaggcccagcctcctgcttcccgagggcatgtacaggcccagcctctgcctcacagcagactctccacacccagctcttccctgtctgcggcctctccagtccaaagctgctgctgccttttggcagcttgtacaggctcagctcctccctcacggtggcctctttcagcccaactcatgcctcttgcaacctgcccaagtgtcagctcctgtctcacactggcctgttgagggccagctcatgcctctcgtggcctcaacaggcccatcccctgcctgtcggcggcctctacaggcccggcctctacctcacagtgggctctccaggcccacctcttcctcaccgtggcctcctggggcaatgctcctccctctcgggagcctctgcgggcccagctcctgcctcccagtggcctctgtagaccaagcccgtgcctcagggcagcctttccaggcctagcgtttgctgctttgcatcctctccaggccctggacttcctccagtcggcctctccaggcccagctcttcctctcggcggcctctgcagggccagactgtcgtcaagtcggcctgtccagggccagctcctgcctcccggcggcctctgcaggcccaagtcgttctcaagtcggcttccccaggcccagctccggcctcttggcggcctctccgggtgcaaaagttcctcgagtcagcctctccaggcccagctcctcctgcctcccagtggcctctttcggcccagcccagctcttcctcccggctgcgtctccaggcccgactttggcctcccaacaacgtctttggactcagctcctgcctctcaaaggcctgcacgggcccggcctcggcctcggcctcacagcggactctccacgcccagctagctctcgcctcactgtggcctccccagtccaaagctcctgcctttcggccacttcagcaggtccagctcctgcctgccagtggcctctttaggcccagctcattcctcacaacggccttcccaggccccgtttttcccttccggcagcctcttggcctctaatttgtttatcttttgtgtataaatcccaaaatatggaattttggaatatttccaccatt

SEQ ID NO: 274557 - DNA, 2188 bp, Homo sapiens
ccggaccgtttgagctgtgaggcacaatgtcttcgtcggcattcggacgagcttatcctcccagtgcgtctacaggcccgtctcctgcctcacaacaacctcttttggcccaactcctgctgagctgctggcagcctctgtaggccacagacttcttaaagtaaagctttccagccaccttcggcctcccagcagcctcagcaatcaaactattccctcactgcggccaccgaaagccaagtttctccctgcctcatggcatcctccgaaaactgagcatttgcctcacggtggcctccccaggccacgaatctgcctgcctcccaggcaggtgctgcctcacaatggtctctttaggcccagctcatgctaaaagatggactctccaggtacagctcttgcctcctggcagcctctgcaggcccaaattctccaaaagttggcctctcctaactcagctcctgcctcatgtcggcctacacaggcccagactcttaccacacagtagaccctccaggcccaccacttgcctgatcatagcctcctaaggccaagctcctgcctttcagcagcctctacaggcccagctcctgcctcgcaattgcctttgtaggccaagatcatgccgcgaagtggcctttcctagcctaacttttgctttttgacgcatactccagtcccaaaacttcctccagtcagccggtccaggccaagctcttcctcccaaaggcttctgcaggccaaaatcatcctgaagtcaccctctgcaggcccagctcctgcctccaagtgctgtgtaggccaagctaatgcctcacagcacactttccaggctgagcgtttccttttgtgcatcctctccaagccctgaacttactccacttggcctctccagaccaagctctccctcccagtggcctctacaggccaaaattgtcctcaggtctgcctctccagggccacctcttagctaccagtggcttctgctggccaaaatcgacctcaagtcagcctcttcacacccagctcttgcctctgagtggcctctccaggagcaaaactttctcaagtcggcctctccaggcccagcctcctgcttcccgagggcatgtacaggcccagcctctgcctcacagcagactctccacacccagctcttccctgtctgcggcctctccagtccaaagctgctgctgccttttggcagcttgtacaggctcagctcctccctcacggtggcctctttcagcccaactcatgcctcttgcaacctgcccaagtgtcagctcctgtctcacactggcctgttgagggccagctcatgcctctcgtggcctcaacaggcccatcccctgcctgtcggcggcctctacaggcccggcctctacctcacagtgggctctccaggcccacctcttcctcaccgtggcctcctggggcaatgctcctccctctcgggagcctctgcgggcccagctcctgcctcccagtggcctctgtagaccaagcccgtgcctcagggcagcctttccaggcctagcgtttgctgctttgcatcctctccaggccctggacttcctccagtcggcctctccaggcccagctcttcctctcggcggcctctgcagggccagactgtcgtcaagtcggcctgtccagggccagctcctgcctcccggcggcctctgcaggcccaagtcgttctcaagtcggcttccccaggcccagctccggcctcttggcggcctctccgggtgcaaaagttcctcgagtcagcctctccaggcccagctcctcctgcctcccagtggcctctttcggcccagcccagctcttcctcccggctgcgtctccaggcccgactttggcctcccaacaacgtctttggactcagctcctgcctctcaaaggcctgcacgggcccggcctcggcctcggcctcacagcggactctccacgcccagctagctctcgcctcactgtggcctccccagtccaaagctcctgcctttcggccacttcagcaggtccagctcctgcctgccagtggcctctttaggcccagctcattcctcacaacggccttcccaggccccgtttttcccttccggcagcctcttggcctctaatttgtttatcttttgtgtataaatcccaaaatatggaattttggaatatttccaccatt

SEQ ID NO: 274558 - DNA, 435 bp, Homo sapiens
cagctcctcctgcctcccagtggcttctttcagcccagcccagctcatggctctcagcggccttcccaggtcccgcttttgacttttggcggcctcttcaggcccagaacttgacctccagtcggcctttgcaggcccggcctcctgcctctcaaaggcctgcacgggcccggcctcggcctcggcctcacagcggactctccacgcccagctagctctcgcctcactgtggcctccccagtccaaagctcctgcctttcggccacttcagcaggtccagctcctgcctgccagtggcctctttaggcccagctcattcctcacaacggccttcccaggccccgtttttcccttccggcagcctcttggcctctaatttgtttatcttttgtgtataaatcccaaaatatggaattttggaatatttccaccatt

SEQ ID NO: 274559 - DNA, 600 bp, Homo sapiens
ctacaggcccggcctctacctcacagtgggctctccaggcccacctcttcctcaccgtggcctcctggggcaatgctcctccctctcgggagcctctgcgggcccagctcctgcctcccagtggcctctgtagaccaagcccgtgcctcagggcagcctttccaggcctagcgtttgctgctttgcatcctctccaggccctggacttcctccagtcggcctctccaggcccagctcttcctctcggcggcctctgcagggccagactgtcgtcaagtcggcctgtccagggccagctcctgcctcccggcggcctctgcaggcccaagtcgttctcaagtcggcttccccaggcccagctccggcctcttggcggcctctccgggtgcaaaagttcctcgagtcagcctctccaggcccagctcctcctgcctcccagtggcctctttcggcccagcccagctcatgcctcccggcggccttcccaggccccgcttttgactttcggtggcctctgcaggcctcgacaaggcccggcctcctgcctccagaaggcctgcacaggcccagcctctgcctcacagcggactctccacgccc

SEQ ID NO: 274560 - DNA, 1270 bp, Homo sapiens
attaggttaaagtacacagagaataagcgagtgatccctccgccataggcctattctttccatttgttgcctcacagtatgcaaaaaaaaagtcccgcgaaatcggttatcaactttggggcccggaggaaaattgctgtggcgcatagataagactgaatggcgagaccctgagctataagtgcctactggattgttcttcaaccgcgtaggctgtcgaccgaagatgagccttccacttggcggaagaatctcacaggaaaggtgggattgagaaggtattcagatacttacaaagaaatttaaagtagttgaaggccataatgaatgatggaagagatgaaagagaaggtgactttgaaggacaaaggagtttagaggtgattgtgtgctctggacctgaagtattttgattgaatgaaaaagaaatggaatgaagaaattgaagatatgttcataaaggctagtgtttgacattacatcacatttaatccttaagaagaactcatgcctcccattttacaagcgtggaaacgtataatcagagaatgtttggaaacatataagggattatagatgcaaatcaactctggatgtcgattttcaatatacatattctgaatgtgattttaagtttttaaagttagtaacagaagaattacaattggatttataatctgtagaccatttaaaggaagggggctgctaaatgagaagaaaaaacctatccagctgaaagaaggcagaaatgggaacgagataagcaaaagaaaccagaacatatggtaaaaatgtttttcatgtgaaaagtccaaacatcagtatttacaataaatgtaaatgggttaatttcactcacaagttttaaaagacagttgggaataaaaggacaatccagctataaattgaccataagcaaatgcttacaaaacaggaagcttgaaaatactgggctaaaatatttaatcaaatggtagccaaatgaaagcagtatagcaatattaatacaattaaaagtatcaaaagagaaaggattttatattaaagataaagtccatgaagacagtatggtctcctgaactgttatgaatctaaaaacatggcctatcctaaggtgacgctatgaacgatgagaaattttacaaatttgacaatttgttttcagagtagaagacataaatatctcagaaatatgcaactcaaatgtaaaatataagggaagatatggagaacttagattatgtaattaaatattaatttgaaaaacaac

SEQ ID NO: 274561 - DNA, 1148 bp, Homo sapiens
actgatcgtggaacgtctaaagtccgccattttgaaggataaatgaagaaaggcgtggagttactggataatgacgttcattaaatttagagcaaaagagacctttaaatacaatgtataatgagatttttttttctccaaagtgggattgagaaggtattcagatacttacaaagaaatttaaagtagttgaaggccataatgaatgatggaagagatgaaagagaaggtgactttgaaggacaaaggagtttagaggtgattgtgtgctctggacctgaagtattttgattgaatgaaaaagaaatggaatgaagaaattgaagatatgttcataaaggctagtgtttgacattacatcacatttaatccttaagaagaactcatgcctcccattttacaagcgtggaaacgtataatcagagaatgtttggaaacatataagggattatagatgcaaatcaactctggatgtcgattttcaatatacatattctgaatgtgattttaagtttttaaagttagtaacagaagaattacaattggatttataatctgtagaccatttaaaggaagggggctgctaaatgagaagaaaaaacctatccagctgaaagaaggcagaaatgggaacgagataagcaaaagaaaccagaacatatggtaaaaatgtttttcatgtgaaaagtccaaacatcagtatttacaataaatgtaaatgggttaatttcactcacaagttttaaaagacagttgggaataaaaggacaatccagctataaattgaccataagcaaatgcttacaaaacaggaagcttgaaaatactgggctaaaatatttaatcaaatggtagccaaatgaaagcagtatagcaatattaatacaattaaaagtatcaaaagagaaaggattttatattaaagataaagtccatgaagacagtatggtctcctgaactgttatgaatctaaaaacatggcctatcctaaggtgacgctatgaacgatgagaaattttacaaatttgacaatttgttttcagagtagaagacataaatatctcagaaatatgcaactcaaatgtaaaatataagggaagatatggagaacttagattatgtaattaaatattaatttgaaaaacaac

SEQ ID NO: 274562 - DNA, 366 bp, Homo sapiens
tgggagctgtcagcagctgcttgcagctgctcagtgaaaagactgatggcagccatggccaggctgaggagatgggaggggaggagaagcatcccccgtcttcccacctaccacaggcacacacacagatgcgtgacatacactcagaacagtcttgcagcctcttgcattgatgtgcacctttccggatgacactgtcccaggaagtggagtgggggatatgccagccatggcctgaaaccagtgtccaagaggcagtggaggatgctggatagagcatgaggttcgacatcaggagaccaggatggaacctctcccttactgtcacctactgagtcagcttgaataaatgatgaacctctctgt

SEQ ID NO: 274563 - DNA, 796 bp, Homo sapiens
cagttttacacctaaacatatacacaatagtaattgatgcatacatacaactggggacatacacaagaatgtttattgtagcaccattcacaatagcaaaatcttgaaacaaccataatgcccaccaacaagatgaataaattatgatatatttacataatgaaatattcagcagtcaaaattaatgaactacatcaatatacagtactatgggtgactcccattaataaaagtgaaaaaagttacatcctaaaaggttacaaatagcataccatttttgtaatttgttttaaacataaaatttttcaggactataagtacaaaaagaggatgaacatgggatttcaaatgatggttatttggggtggatgaaaatgcataaatttcattgcagaaatattaatttatttgattactaatatatgtattatgtattaatgtatttttattagacacccactgagcatgtaatgtattatatgtattgcctactaaactccaaaatattactaatttcaaactacatctggatacagtggtttcagttaagagcttgtgaatctgtagaggcctggaatgaaaggcagaaatggagatatattttgaagataaaatggaggagacttgcagataaacttgatttgggggtgaagaagagggaaggatcgaggatgactgctaggttagctgggctaaaggtagtgtcctttcttgaaatggggaatgggaatgtggactacataggtttgggagggtaatcacattgatctggtattaataaatgcttaaatccgta

SEQ ID NO: 274564 - DNA, 571 bp, Homo sapiens
ataacctaggattgccaggccgtttgtagtgacttcaacctctagttctctctctcagtgtccccctccctcacctaaatcttggctgcaagagtgggaggaggggcagggggttggattgatctgggtattttagggatggtgtagcagaaggacaagacagtgatatgcctgcagaaagaatggagttgctgggtctccatgaactttgcagggaaggactaaagcctgaagggaacgtgctaagagagaaaggacagtattcaagagtaagtcttataggtaagagtggggactgggaggttacaagagtttgactttaaaagtgaatgattctgcataaggtcaagagtgtggtttggggtaagttgtcccaattgatgagttcaactaatgtttataattcatttttgagaatagccttgggataatggaagtggtagaggtctggacacagataaataaccccatttaaagtgagcatgacattgattccaggagaaattgtagaagcaaagatcagacctgaaagagatgatcatgtaggagtcaatatgggtgtgtttaagaa

SEQ ID NO: 274565 - DNA, 410 bp, Homo sapiens
ataacctaggattgccaggccgtttgtagtgacttcaacctctagttctctctctcagtgtccccctccctcacctaaatcttggctgcaagagtgggaggaggggcagggggttggattgatctgggtattttagggatggtgtagcagaaggacaagacagtgatatgcctgcagaaagaatggagttgctgggtctccatgaactttgcagggaaggactaaagcctgaagggaacgtgctaagagagaaaggacagtattcaagagtaagtcttataggtaagagtggggactgggaggttacaagagtttgactttaaaagtgaattataaacattagttgaactcatcaattgggacaacttaccccaaaccacactcttgaccttatgcagaatcattcactt

SEQ ID NO: 274566 - DNA, 503 bp, Homo sapiens
tgaaatcaaccctataaaaattatgctacaattattttaaaccctaacataatagtattatctttgatatgaatctgaaaatcaatttatttcttatcttttgatagatattcattagtatgttctatcctattttgttacttatattttggaaaagtttcttaacgttagaataatatttatacgtattaactcctctacttatccatttattcatcttatttattgtgtaatctattctaaaaatttcactggataatggtaatatcttagcaaagaagacaaatactgccattgcttccttggaattttcaatctggtagtaataagtataagagttttctgaatattataatctgatataatatactcagagaagatgttatagcagagcaacccagcactgaaaaactgttgtatgagctgaaatgtgattaataactaagatgttgagaaataataaagtctgtgaggtcaacttaacttggtcagacttaaaaaga

SEQ ID NO: 274567 - DNA, 486 bp, Homo sapiens
taggccctgtgggtgcagcccaaaccggcccacatgggctttgatgacagagccgaggatttgccttttgctcagaggaagggagggggcttcagggcggctctggggctgcagagtcagagcccaagcccctagcaggtcccccagcccgggaggcagagtgtgcagccagggcagcctctggacaccatcaaattgcacacaaaaacctggggcctccatgggaactgcagattatacagagtgagtggggaggagggcaggggattgaaattttattctttcttcctccttccttgaaaattccgatcactaaaagtaaaaacatacacacacatactcactcacacactcactcacccatgcacataccatcttcaacgcctgggctattccatctttgccaaaaagaaccaagatgttatctgtgaggtatgtctgcatgagcttagacaagaccaaacctacatcctctctccttgcaaa

SEQ ID NO: 274568 - DNA, 390 bp, Homo sapiens
accatcctggccaagatgatgaaaccccatctctactaaaaatacaaaaaattagccagacatggcggcacgtgcctgtaatcccagctactcaggaggctgaggcaggagaattgattgaacccgggaggtggaggttacagtgagccgagatcgcgcctctgcactccagcctgggtgacagagcaagactccacctcaaagaaaaaaaagattacagcatgcaattcactggagtttagatatccggttcattcttttctcaagatctgcctcctctatgctgtcagccaaggttttaggctgtttgttatctctgttttattctgcgtagtctccctggatgagctcaaagacatccatggtttcagttttcatctctctactttc

SEQ ID NO: 274569 - DNA, 441 bp, Homo sapiens
ggccctagtccaatataactgttgtccttataaaaaggggaaatttggatatagacacatacacagggggaatgtcatgtgaagattggagttatgctgccacaaaccgagaaactaccagaaggtagaagagaggcctagaacagatcgttccctagtgccctcaaaaggaaccaaccaaccctcccaacacattgatcttggacttatagcttccagaacagtgagacaataagtttttgttgtttaaaccacccagtttgtggaacttcattatggcagccctggcaaacttatatataatgtacaatcctttgtatatattactggatttgatttgctagtattttgctgagggtttttatagctgcatgcataacagatattggtctatacttctctgatatagtctggatatttgtccttgcccaaatctcatgt

SEQ ID NO: 274570 - DNA, 354 bp, Homo sapiens
gtggaagcacaataaattaatgaaagcacacttttatagctagagaattatttactcataagttaatgatgtggaaaaggttttattggtccgttgacttatagaaaatgagattaaatcttttatttctggtaccagacaatattttatttcagtatttatcacttgaaataggaaaaaatagcaataattggaagatacattataatacctttttgatttaatttctgaattctatgatctatcttccacgtttttccactgagtttttaactatattctagatgaaagaaaggggtattagtgtagctgccatcatctcatgcattttattctgagtttgagatctaatac

SEQ ID NO: 274571 - DNA, 419 bp, Homo sapiens
ttttatattccaaaccacaacacagctctccttgcagccaggagtggccatatgatggattctgactaatgagatgcaagctgaagttgctaactgggactcctaaaaacacttttaaaaagtgatggactcatgatctcttcacccttcttctgcctgtctcgaattgtccatcctcagacttcttgatacacaaaaaatttattttcggctaggccatgttaatttggttttccactacttgcagctgactgtactgattatctaaaactgctttataaagttttgtgactagggggtgggagcaatgatcactaatattcattaagtgaaaggataaatgattgaattgtgtatcttaattgtggtatattctgtacaacatttttacaataaattaatgttgaatgagtttattt

SEQ ID NO: 274572 - DNA, 216 bp, Homo sapiens
atatgttctactttttaactagggaattgataatctcactatgaagaactatgtagctagtcattctttccttctcagatgcatgcagtataacagcccctttttgttttcaaattactccattttgcctctctgtgcctttcctattcaggttattttcttcctatcagaagaaatgtaggatagcccagtttatttaaaatcgaatgggcactt

SEQ ID NO: 274573 - DNA, 245 bp, Homo sapiens
gtgtgatatatgtgggtgtgtgtgcatgtgggtgtcaatgtgtgtgcatgtgtgtatgcatttgagtgtgggtgtgcatgtgtgttcatgtgggtgtgcacgtatgtgtgtgtgtgtgtgttcatgtgggtgtgcgtgtgtgggtgtgcatgtatgtgtgggtgtgtgcgtttggggggtgtacatgtgtgggtgtgcatgtgtgtgggtgggtgtgggtgtgcatgtatgtgggtgtgcgtgtg

SEQ ID NO: 274574 - DNA, 332 bp, Homo sapiens
tgctcccactccctcacaggacccacacgggtggggggtggggggaattgtttaaaagcatttagttcctaactagctgcctcacccattatcttccgtttcttgtaatttaggaaacaaagaacaacatatagccagatcaatagcttatgttattttcatatgttaattattgctaaacaacttaggaactgccttttcttttatttcctttaaaaatccatttgtaactgttgctggtgggaccggactacatattcaggataactttaatctgtgctttgaagtttcaatcctcaagactggcccaaataaaccccctacttatatta

SEQ ID NO: 274575 - DNA, 452 bp, Homo sapiens
ttttttttcccacttttccttacgtgcctattttcttaactattttatcccctgcagcattcccataaagagaattacaacaaattgatgtatcttatttttaattgggaacttcaaaaaaaaggtttttgtagagaaagccttggcaatagttgctaaaatacagttgaattcttagaagacttaaaataaacatactatttctgtccccattattatgctaataggttgtcttttcatgcatggcattgaatttgtctcacttgtagcagtaccatacaattaatacagggtgactcacatttggtcttttcagagtaaaacaaaattttctgcactttaaaacaagtctcttcttgtagacagaaagattgaagggaaattataaaggttaatcatattataagttcaggttcaatcactagtaaaaatggacatataatatgatatgt

SEQ ID NO: 274576 - DNA, 652 bp, Homo sapiens
ccaccttggcctcccaaagcattggaattacaggtgtgagccacctcactgagccctccacctttcagctgaacgcagaaaaatacaatcttttaacccaaagcgttcctcacacttagggtcaggaagagcccttcatgccctggaggcaactactaaccctctgctaaacactctgactctgggtgtgagaaacacacctactgtgccccacatatttttccaaatacaacttaatttagccttcacgacaaccctggagtgaaggatcattaactttatttcatagatgtggaaactgagactcagaggcaggaaatgacctccttctggaggctgcaaattctttgatgctcctttgatcaacaggtgggagctggccagaggtggtggctcacacctataatcccagcactttgggaggccaaggtgggaggattgactgaggccaggagtttgaaactagcctgggcaacatagcaagacctcatctctacaaaaaatacacaaattagcagggtgtggtggtgcacacctgtagtcgcagccactcgggaggctgaagtggtagcattgcttgagcccaggaggttgaggctggagtgagccatgatcaagccactgcactccagccgaggagatggagatagac

SEQ ID NO: 274577 - DNA, 263 bp, Homo sapiens
ggtgcagcataggctctggtcaacaagacataagtggtccctgtccgtatggagattgcagtgtaatggaggaaaaaggccataaacgaacgaaaaagtaagcaagcaaagccccatacaaatatacatactttaaaaaaaattgggccgggtgtggtggcgcatgcccataatcccagcactttgggaggccaaggcgggcagatcacgaggtcaggagtttgagaccagcctggccaatatggtcaaaccctgtctctgct

SEQ ID NO: 274578 - DNA, 426 bp, Homo sapiens
tctgtgtgccctctgactgcccatgcctggctcctgcctgggcagggcctgagctggggttcctgctggggacagggcagctatgctcaccgtgtggctgggactgctcccaggaaggctggctggtggatcgctgggctccggggctgggctgggcagagctgctctgggtcctcgtccaggaggcatggcccctgggctctccctgctttatatggcccgcggtgcgcttgctgctctgccgactgcctgctgcgcattcctgaccctgggattccattggggacgctgttgttgaagaggggcagtgctgaccgcgttgataaaaacaacctcacacaggatgtagtctgatgagagggcaggcgggctgccctttggaggagagcagacagcatcattaactgcaaattgcgggcacagacc

SEQ ID NO: 274579 - DNA, 448 bp, Homo sapiens
cagaagaatgtcagctgctggatattatggtcactgtgctattatacatgatggaaagttgccttattaaaagtgagctacaaggtaactcagaattatattcactagttctattattatcagtattattattctagtattattagtgtacttcatatacttagtaatattactaataatgatacttagtattattaatcatattctagtattagtgaactttgtataactagtcttgaaaacaccttatgtttaaaaaaattataaaataatacatgtttgttacggacatctttgaaaatttccagtgaagtttaaagaaaaagttaaaagcacttgtagttttgttattcacaaatacctgttgttagcactttgctatatttcttttctttttgtgtaatgactatatttatagatacaataaatactttttaaaaagttgcca

SEQ ID NO: 274580 - DNA, 611 bp, Homo sapiens
ctcttgctttttgtcagaaaaagattccatccatgttctcccagaaggttgaacttgcattgtccagaggaaatgtgtagggacatggctgtgcagattgggggaaaataggtcgatattcctgttgcaggaccatttgaagtctgagagtttctaggtgagaggaaacgaacctggttactagatttagtgagcaaggctcacaaaagagagaaaggaagacaaaggctagggatccccaaaaagtgggatgtcatgagaattggaaccaagtggcaccccaagagaactagctttcagtggcatgtttctgatggtgacaggcctggtttgtaaaacctctaacatggtcctggactttccctaatctgttaacccagaaacagcatttttctcctagcataaggcagattctttcctgagctgcagcaagacctctacaatttcaaactacagccacgagataatcaacttgttggtgtcactctgtaagagtctgagcagtagtttttattttgtgagtcagttccagagacaggttttggtaagttgaggaggcaataattatgccagctattcctatagtggcacctgagatgccaaactcagga

SEQ ID NO: 274581 - DNA, 729 bp, Homo sapiens
ggatatttcatataaatggattcaaatatgggatattttgggactggctgctttcacctaggggaaaaaattcatcgctgttgcaggatgtactttgttccttttaatgctaactaatttaaagaaagataaaaataaacatgctgttcaagccaaacaacacatgtctgtgaaccataggtggtcctgtgcctgccagtttaagtgtagattacattatttttaatctatgttatttttgacatgaatccactggatttttttccacccagatcattttgataccatcttactattagctaaatgaaactttagtgatatcttgagtctacattttctctgacagcagtgttacttgtctgctaatgtgaattttttttttttttttttttggggaaacaaatgtagacatgagggctaaagtattttaaagcagtaataaggaaagagcttctaatagaataaacatggagtattaaaatattcaacataaagggccaaatctcagtttaaaaatactttcacttgattgccaatttttaatgtagttcagagtttttttcttgtaaaaatctttctaattttgtaattttattggaaaaataagattgatatgcataatttccctgaatgtttcataaatcagtatctgaaattgtgtaatttagtatatcacacactccagagcactctcttgaagtaatctctatttcaagtgatccccttcag

SEQ ID NO: 274582 - DNA, 343 bp, Homo sapiens
ttttacattcttttctccctgcccatctgaatgctgtcaccttccaagccccagcccatttctccagcccatattaattatgctttttctgaaggtctaaagcacttaactgacagtactatttatcttgtcacttagttaaattcagtaagtgctactactgctcattttttgttttgggagatttttttcaaggagcatttctacattcctggcattgtgtttggtgctcaaaatgttttctcacttaattcatgcaataactgtatgcaaattttaaaatcaagcatcaggatgtagttatttgcccaagttttaacagctaataaattctatctgtcca

SEQ ID NO: 274583 - DNA, 341 bp, Homo sapiens
ccctctgggaaactggaaggtggcttctcaaacacccaacactggaaaggctggagccaaaaaactgtgaacaccagggacaggtatagaacaagggcaccaactaaaaacaggggctgaatgactatgtccgtactgaatgctgatagagcccccacctccaacccagattctatccttctttcccatctcagcttccagaacattggtttccaggactcaccttcttggtaggcaattagaaaagattttttttaaggcttctgagcagttcaagaggaaaaaccattaagatactgataccagaagccagccagatcactgtatactgaagctcatag

SEQ ID NO: 274584 - DNA, 369 bp, Homo sapiens
aatgtaacgttaaagtcgaagttcttcacattagaggaggaacttgattttttaatgttgaaatgttataataaagccaaagccaaagtattataataatatcttcataattcaatcaaacacggtacattcaagcctcccaagaatgtaaaactagaaacagtagaggatgaagtagatcagttgatgaaagaaatgccgagatagagaggaattaacaacgaaaccttcattattaaagttttattttggctgggcaccatgactcagacctgaaatcccagcagttgcggaggccaaggtgggaagatcacttgagcccatgagtttgtgaccagcatgggctgtatagtgagactttatctttac

SEQ ID NO: 274585 - DNA, 435 bp, Homo sapiens
atgctcacacatacatgaataaaacctaaatagattatctagtttaattccttttttaaagatggctagatatctaagtttttcaggacaaataacattttcttccttaaaaaaaaaaaattattccctgcaggacatggtggctcacacctgtaatctcagtactttgggaagctgaggctggagaattggttgaggtcaagagtttgagaccagcctaggaaacatagggagaacctgtctgtacaaaaaatataaaaagtagccaggtgtggtggtgttctctcttagtcccagctactcaggagtctgaaatgggaggatggcttgagcctgggagttggaggctgcaatgagacacagtcgcaccactgcaccccagcctggataatagagtgaggctgtgtctcaaaaacagaagaaaacaaaacctaa

SEQ ID NO: 274586 - DNA, 430 bp, Homo sapiens
gagggaaaaacatacagggacccaaacaatgaaaaatgctggtgttgataaagagggtgatgttaatgacagggtaaaatggttgtacaagtcagtggttccaactctttgtcttacattaaaatgaaggggcctccagtgaaattgttgctgataaatcattaaaaatactttttgatgacaaatcactatgtgaaatatattgcctggagattcaaggaataagtgaaattactataactcccatttctatctatttgtttgtgtgaaaaattcctcagggcttatttaaaagaaagaaaattgatactgaaccttgtcttattctagcaatatgtgagattcattcagagttttatggatattttatggggttcattaagcatttgatttcaaataaaatttcactttttaagttcatgaattataa

SEQ ID NO: 274587 - DNA, 303 bp, Homo sapiens
  misc_feature (41)..(41): n is a, c, g, or t
gcacattgtgttctgcaaaaaacaaaaaggatagcctccgnattccagtctaaaaagaaaaaagttaataaaaaattttacaaagaacaaagctggaggcatcacgctacctgacttcaaactatactacaaggctacaataaccaaaatggcatggtaatgttaccaaaacagatatatagaccaatggaacagaacagaggcctcagaaataatgccacacatctacaaccatctgatctttgacaaacctgacaaaagcaagcaacggggaaaggattccctatttaataaatatgttgg

SEQ ID NO: 274588 - DNA, 246 bp, Homo sapiens
cacacacacaacttagtgtcaacacccacagataaaagaggggcgtcctgcaatccatacgggccgaccgccacaaacacgcaagctgctctgccgcaaggccttgcacctcctcgtgtccccgcaaaaaagcagcgccccgccaccgtccctacctattcccgagaaaacgcagagagaactagttggctgctcgctaactgcagcgtagccacccaggcaagattagaagaaaataaacaaaaa

SEQ ID NO: 274589 - DNA, 437 bp, Homo sapiens
tgttcgccgtccccgggctcagtgtctcgctccccgcctgcggagtggagtagttctgagatgtgtgcatgccatctccctttcaatggcgccatcctacaagtggcctcagccaaggttcagccagtaggaggcagacctggagagatttagagcctggatccggcaccacgatgggggcctgggagcgaggtccaggcaggcaggccgtgggaagggcaggctggacctggggcagagctgaagctaccgcccacagcggaatttcttctctggaaagcctttccagtgctgaatcgggcccacccggattgtctaacatagtcttcctcatttaaagtccactgtgatgggtcttttgcacaccaacagaacacctccacagccacatctggacccatgttgaatgaattaccggggactgtcacctggtcaag

SEQ ID NO: 274590 - DNA, 509 bp, Homo sapiens
aaaacatgattaaaccaaataacagtcgtataattttattattaaagatttactctgatgaggacattctgtgctaagtatgattatttctcaaataggaaaatatttactagttaagcaaagggatcaatatgaacccataaacaaacactgagcagtgggggcaacctttaagatgccatggacagtgacagacacctctctccctccctggtagctcccttggtagggattgcaattcagtatggtcagcaattatttttaaagtgtaattaattaaacaaagaaacaaaaagcatttccaccaaacaaggaattctgaaatgtcttcttttggtttcaatcagaaatacactttgtaaaaattttctcaaggtttacacatttattccaagcacatatacactgacccacagtagatttcaccacccatcataggagaaaaaaaagtgtaatatctgttggtttacatcatctatatttaataaattttgattcaatttaaaaaa

SEQ ID NO: 274591 - DNA, 445 bp, Homo sapiens
agctgctaaaccactaaaacctagatattcagctagtctgttaatgaaacctgaaaaaaatacatttacctttacaagaactttgatatgcattatcacattcaagatccatgcaggcacagacggtttggctaatttactgaaaatcagaggttaaacaagggttttaaaactgtgctgtaaggttccagattttattaacaagtggttttctacagttagtgaggggcttttcatgaagttaaggggaaaaagagtctaaaggcaatcacagaatcaaaattttcaaaaattatgaagatagaatatctcacaatcaacctgtggccctcagagttcaaggcctattgacagtcggtaaaaatccttgagagcagagacctgtctttctcctctgtattgccagaaaattttgtgcacataacagtgcccaatgagagctcat

SEQ ID NO: 274592 - DNA, 720 bp, Homo sapiens
aaaaaaaaaaaggcacagacatgagaattgtggaatgcaagcgttttccttggttagagtctattttaaatgcatataataaaaagtaataagattgtggcatgagctggagggatctaaagaagtttggattagaaattggaaataaggagttctactgaagatcattgaatagaattacatgaagaaatatgattagcagccagatacagcgtgattggagggagattgaagtgaggaaggccagttggtgattattatctttgtgagtgggaagggtatattaagagtaaggatgcatagttttaaataagtcaaatcaaatattgtggctcctcagtttgtagtgcagagctaaaataagaatgaaagaattttactatcttctggtattcaaaataaatggagatagagtttgcatatgacttactagcactaattgaggtatgcctttttcttaaaaaaactggcttggccttttttttctgttaagtttactttgaaaaccaataaagttatgctataatggtgttttcctaagtaaaaaatatttaaggtaactggtaagaagagcttgtacttgtatgctgaattttgagttaaaattctgtattttagccatggcttaagagacattataatttgtattggagctggcaggaaaacaggaaataataaaaattaacaatgtggactacaaaaaaacacacaaaacaaact

SEQ ID NO: 274593 - DNA, 373 bp, Homo sapiens
cccaccttaaatcatcccattaggagacaaactgatttgagaaactacagtaatttttaacttgggaatctacagagtactcagaaaaaaactggaaataaacattagtcttaaacgtaagccttagatggtacataatgttcattgctaatagttttcaattcctgacatatatatgtttagtcacattttctggaagtttagtcaggcccttcccatctgggaaacaagcaggtatttctggacagcttttgaattacaaaggtgctttctgtgttgttgtgctaagtttaccaaggctctcccaagtactttattattatcatgcaatttgatagtaatttatgaaattttttttttttttttttgagat

SEQ ID NO: 274594 - DNA, 1159 bp, Homo sapiens
  misc_feature (34)..(34): n is a, c, g, or t
  misc_feature (138)..(138): n is a, c, g, or t
tgaggttttagtattaggtcacaaacccatatanatagttaccacttctatttttgttttgaagtggagttttatgaatatttgagaatatagacagcttcccattgaggattgtattcctcgtccagaggtttcatntcagtggtaaatacggttaagtttgttacaaggtatttacatgagtatgtacagaagtgtattcatttatgcattaattcaacacatactatatgtaatgacgtcttaaagtgagaattaaaaatctctctgaatttctgagtttttaaacccagaatcaatttcattcacattgttctttcttgagcaaaatgtcattttaaagtgagaattaaaaatcccactgaatttctgagtttttaaacccagaatcaatttcattcatcttgttctttctttagcaaacttttcttctgtagagttccccatatgtagaccatgggaggaataggcactgtgggaacatagtggtttatgtgactggcttcctatccttaagagtaatttttttctgtttttttttttttctttcccttttctccctccctctctttcattctttcattcttatttcttaagaatcatgcagtggagatacgtgaatataattcaaggtaataaaagaattaatgtcctactactgatggtggcaaagtggtatgcggcttcagagaatagagtgattaattccaatttcggggactggagatagtttcactaggagatgaatggattttgataaacacccatgtgagggaaggctcttgcagcctgaagccgtaagacatgtaaagggtttttaatgaacctggcagttgagggaataaaatatagtagtataagaatttgagtcatcggctgggtggggtggctcatgcctgtaatcccagcactttgcgaggccaaggcaggcagattgcttgaggctagcagtttgagaccagcctgggcaacatggcaaaaccccgtctctactaaacatacaaaaaattagctgagtgtgatggcacatgcctgtaatcccaactatttgggaagctgaggcacaggaatcgcttgaacctggaaggcagaggttgcagtgagctgagatcatgccactgggcatcccagcctgggtgacagggtgagactccctctc

SEQ ID NO: 274595 - DNA, 381 bp, Homo sapiens
catgcctgtaatctcagctactctggaggctgaggcaggagaatcacttgaacccagaggtggaggttccaatgagggaaaatcccgccattgcactccagcctgggcaacaagagcaaaaactcccaggcgctagacaaacagaagacagtcacctgtcggctaacaaacgtttattgctgtattattcctttatctctggtgagaatgaacaccttacttgacatctttacccctgagtctctgcccagcagggcccatgttcctatccctgtgtatccaacccctttggtctctgtgagtgtttaatggggtggtggcagtattgggctttctgtggtggctccatctccacccaggtgttgctgattgaaatagctc

SEQ ID NO: 274596 - DNA, 447 bp, Homo sapiens
ttttttaagttttgagacagggtctcactgggtcacgcaggttggagtgcagtggtatgatcatggctcactgcagtctccatctcctgggctcaggtgatccttctacctcagcctcctgagtagctggaaccacatgtgtatgccactacacctggataggttattattttttattttgtacagatgaggttccctatgtttcccaggctggtctcgaactcctgggctcaagcgatccgatccttccactttggcctcctaaactgctggaattacaggtgtgagccactgggcctggccatgatggtcatttttatgtggcaacttgactgggccatggggtgcccagacatttggccaaaccctattctgggagtgtctatgagggtgttctggatgagatgaacattggggtttgtagactgagcaaggcagattattctc

SEQ ID NO: 274597 - DNA, 210 bp, Homo sapiens
ggtaaaaccgtacctttaccaggttttctttttccactgaggtacgtgttccaatggccacttcacctccttggatctccatgtatttcatatttggctaaaactaagaaggtaattttgaaagagccattggtctgaatatggaatctaaggcaagtgacttctgtaaacctctctcttcttgaatgtggttaaaaactcgaaacaggc

SEQ ID NO: 274598 - DNA, 476 bp, Homo sapiens
ttaaacatttatttatttatttttattgacatgtaacaattgtatatattttaaggctagcattccaaccgcatgggtgaaagtctttctccattgttgtcaagttacagtatttccggagggcttgggaaatccctggtgctgcgatgaggacgctgaggagcctggtgacgggctcatgccaaggtcatgtggtggcttccgggtggaatttaagtctcttgactcccagcctagtgctcctgctagcatgccacactcgggtgttgtttgtcagtgcgtatcctcttcggaggaaatacgttttgaggttggtaaaatgaattttgttgaaaaatagcatcttaacgtagtttttcatagttatctggagaacttcaaggccactgtgacttttccatgaattatttcacgtactgctattgccctcaggcctctcctctggtgtttattgtgtttggtttattcgagtgttc

SEQ ID NO: 274599 - DNA, 693 bp, Homo sapiens
ttaaacatttatttatttatttttattgacatgtaacaattgtatatattttaaggctagcattccaaccgcatgggtgaaagtctttctccattgttgtcaagttacagtatttccggagggcttgggaaatccctggtgctgcgatgaggacgctgaggagcctggtgacgggctcatgccaaggtcatgtggtggcttccgggtggaatttaagtctcttgactcccagcctagtgctcctgctagcatgccacactcgggtgttgtttgtcagtgcgtatcctcttcggaggaaatacgttttgaggttggtaaaatgaattttgttgaaaaatagcatcttaacgtagtttttcatagttatctggagaacttcaaggccactgtgacttttccatgaattatttcacgtacatcttcctgcacctatcaacaaaaagaccgtgagaaacccacggttccccatttgtaaaataagggaattaaactaggcgaatctagactttctgggtcagtattttggcttctccagaatccgcttgactttgaagtatcaaacctagatgtattggacataacataatagccttaagtgccctacgttatagtgaaaagtaaataggtgatttattagattttaaaacgtattttaattacatagataatgaagaatatattttccttagttaa

SEQ ID NO: 274600 - DNA, 620 bp, Homo sapiens
gtcgtggctggcacctgtgttccaacaacttgagagactgaggtggcaggaggattgcttgagcctaggagttaggggctgcagtgagctgtgatcgtgacactgcactccagcctaggtaacagagcaggaccccatctcagtcaatcaatcaatctcagtggttgaactacccttgatatggttcagctctgtatccccaaccaaatctcatgtcaaattgcaattcccagtgttgagggagggacctggtgggagatgattggctcatggcggctgacgtcccccttgctggtctcgtgatagtgagtgagcgctcatgggatctggttgtttagaagcatgcagcacctcctgcttcactctctctgtctctcctgctccaccatggccagaaacgtgcctgcttccccttcgccttctgccgtgattgtcagcttcttgagggctccccagccatgcttcctgtacagcctgcaaaactgtgagtcaattaaacctcttttcttcataaattccccagtttccagtagttctttatagcagtgtgaaaacagactaatggacccttctggttgaaggaatgtagccattctgcttgtttaagtatttcctttcta

SEQ ID NO: 274601 - DNA, 1012 bp, Homo sapiens
cagaaaaactatttgtctcctttccacatcacattcatatgaactgtatattgtttgttttaacgtccttgtgttctaattccattatttctatcatttgtagatttatttcaattaatttttcatctggatatgggtctttttcacttcttcgtatgcctggacattgtgaattttatattgctgaacactggatttgctgtattcctctaaagactgtcagattgtatttggtcacacagataagtaatgtttggatcagtttgatccttgtgaagcttacttttaaggtttttgtggctagtaatagcggcctttaatccttggactaacttggcccccctactaaggtgttgatccttctaaggccccgtgcttttttcatggtcagagtgaccagccctgtgggagctctgggaagtgttggccctattgctttccagtagattgttccctgaccttggggagacttcctctcaagcacttggagatccgagactgaaaggaacccttctgccagacctccggagccctctgcatgcagcccccgcttctccagtactgggtcctgcaaattctggctgcctcagcttcccccagctctgttggctcctcagtgcattgagacccttggatttggtttcagtgttctgtccctgaagtatgaagcctgggagttgtctccaggctttaagtttggttagtcataaaatttaccttcttttttcctttccctggagggggatcacagtcttgtgctactttttgcccagtgtctaaaacttgttatttcatgtgtattgtctggttttctagctgtttatagtgggaggacagttactgtagcagttacaacttcatgttccaaattgagagtcctcctgtttaaattttgttaatatagtcagccctctgtatctgtgggttctgcattattggattcaaccaccatggatcagaatttttggaaaagaaaataataacaatacaatgataaaacaacacacattct

SEQ ID NO: 274602 - DNA, 153 bp, Homo sapiens
atcattggggatccaccctatcccaaaggcccaatctttaaatgccatcgtgttgggggtaagaatgtcatatgaattttttgggggacatgatttagttcataacacatatgaatgctctttcaatgaaattaagtgctttcctacttaaaa

SEQ ID NO: 274603 - DNA, 366 bp, Homo sapiens
gaactcataaatattcccttatatggcaaaaaggacttggcagatgtgattaagaatattgaattggggagactatcctggattatgcaatcacaacagtccttataagagagccacaggagagtcagaggcagaggtagtagaagatgctaccatggaagccagagactgggagaatgtagccaggagctaacgcatgccagcaacctctagaagttggaagagataagaaatggattttctgctcaagtcttcagatgtaactggctgtagtgacaccttgattttagtcctgtaaaaatgcatttcagatttctgaccttcagaactgtaaaagaataaacttatgttgttttaagacctaaa

SEQ ID NO: 274604 - DNA, 293 bp, Homo sapiens
ctcccattcctatactctcttgcagccagagatgaccacaagacacagtctaaccagtgaggcattcccaaacaaaagagcagagtttccctggaagcaggcaatggggggctcaatcccttactccctatgccctgcctggtggctgacatccactttaggccaggatgaccaaagccctcagccagaggagagagagagagatggcgcaggcccctcagatgtgcctgagcagctgcctgcggctggaccacccacccatgcctcctgttacacgagacacccctctctcc

SEQ ID NO: 274605 - DNA, 1002 bp, Homo sapiens
  misc_feature (246)..(246): n is a, c, g, or t
  misc_feature (300)..(300): n is a, c, g, or t
aaaggggaatttacatgtgggttacaggggagactagatttttacatcaaaattaattttgttttatttgctcctaatttataggtgaaaatgttattttacatggaaacctattttgttccataaaactaaataaaccataacccagaagtgcaatgagacacacacagcatgaccacattatttctgaaagctgaagagttgccagtctgttgatctcaaacttcatgaaccacacagttcagntcaaattgtttccctgaaattgctttgagcctctgccaaacagccactgaaggnctccgaaaaatacaagaactgaaaggggcacatggcagatacaatcataaactttcatttcggagagcagtaaaaaaggagaagaagaacacactggtactccaacaagtcatagtttctgccagatgttgcaaaagtgagttagataactgacctttcttctggggcctgtgtcaactttgaatggagctttcaattgtacaataagcatctggacagttttgacatctttataacactctttgagttcttaaaaagctaccattttgtttaaagatgatttatgtgaagattaaaacaattacttaagtgctaagaataattaatcctgtaactccatatcaataccattatcttcccagaactgggtctctaactactaatcataatcaagacaccaactgtcaaatcaaatcaaaattaaaatttgattaattatttgatgatattaacattcaaatctagttccttcttaggcctaattttgtccttatgtttgctttgcactgaattattgtggtttaaatagcccattttacatgacaactttcaaacaagagcataaattctcataaaaacaggctaaggaattcataatgatagctcttggccgccacctaaaggtttatttcttgttttattttacatgagacctactatgcattccttttataataaaattgttgtcttgtcaaaaaaaaa

SEQ ID NO: 274606 - DNA, 203 bp, Homo sapiens
ccacccccactgctttgaaaatataaaactccccccttaccacccataaccatctagggaaaatgattcatggagaatgggagtggaatacttggagatgtccagacccagctaaaagaagcagcattcccagtgagtaggtctggcagggggatgaggtacagggcatctcatttagaaagggaagaggagacacaaagcca

SEQ ID NO: 274607 - DNA, 199 bp, Homo sapiens
cactctgtataatgaaaatgtgtgttgaaagtgtgtgggtatatgttgtgtgtatatgcattaaaattctcattagcatgggctggttgtaatagtgcatacctgttatcccaactacttgggatgctgaggcaggaggatcatttgaacccagagttcaaggccagcctgggtaacacagcaagaccgccatctattt

SEQ ID NO: 274608 - DNA, 392 bp, Homo sapiens
cagggtacttagccccttttctgggatctgcttttatcattgcaaagtcaaagctctgttcaatgtcatacaaacacaaattctcataccaaaactactgacatttacactgagaagaagcaatagtgggtaaaactgctaacaccttagcatgactcaatgaactagcaccaaactgtattaatagccatagtcattatattatttgctgccacatgtttgcacttaaaaaaagtttcaggccaagcccaatggctcatgcctgtaatcccagtgatatgggaggtcaaggcaggaggttcgcttggggcctggagttttgagtctgcattgagccaggactgccactgcactccagtttgggttacagagtgagatcttgtctcacatta

SEQ ID NO: 274609 - DNA, 429 bp, Homo sapiens
atttgaatttcccttattactagtttgagcattttttcatgtaacttgcattagggttctcctgagggacagaaccaataagattcacgcatctatttcatatatgtatatatacatgtgtgggttcaatgcaggctgacagagtggagatttggacacaggctgcatgaacgagcagactgccactaaggtggcctaaatttatgtccacttttgtcccatagcccaagtttgggcatcttgcccctgctttgccctctagtatctgaccttggtttgctcctcttttttactgtacagagctcaaaatgttgaaaatatagatctgaatctcaagcgagagataagagctaaagttgtggatctggtaatcattggtgctgcctcctccttcccttcctaatccccattgtaatctgtaaaatttac

SEQ ID NO: 274610 - DNA, 419 bp, Homo sapiens
gataaacattcaacaaataatcatgcaaataaactcatacttacaagttgtgttaaagtgctatgaacaaagaatagagagatgaaataaaacagatggacaattgctaagtttaatatttgtctacagcagtaatcgagtgataaacatagtcattaaaatgccctttcctcaattctcgcatctctgtagtgtttgactgtcgattattcccccacttcacctccccaccttctggaaaccttcccctcctctgttgttttgtgccttgacccatcacaggtacccacttagaattcacttagtggcgatggctatagagcacctcctttctgtgcatcctcagcttcatctgccccttgcctacaggcattcccccaggtctgatccttagccagcttcttttacctctccactca

SEQ ID NO: 274611 - DNA, 932 bp, Homo sapiens
cctctttcctcctgtcctagttctatccatcctctgttctttcttgctctctcttttgttttcttcctctggcacacaagacataagagcagcatagccacaagcaaggcttagttaggtctttttcaagagagctggcttaccagagcaccgatggacttggatacctgagatatctgcttgggatcccacactttcaaggtctctcctctggccttcttctggttctgcgactccttacagcgctgggagttggtgatgccaacaggacatacgctcccagagcctacctctcccagatcactttaaaaggcacccaggaccccagaattctcatcctcaaaggcatggagctcagctcttggccctcaacaaatctcttccccataaagatccttttgagagcttaggatgtcccccggatggttttggttgcagattgtggtggtggagggagctatacaatttaatctattgccattaattggatgcgctaatggcagattgggtagtgataatgccataagaggtagtgtgtgagccgtgtgctgcatctgtgctagctcaggtaagtcagcacacagcacctgcagcctcctctcacctctaatggcagattgggtagtgataatgccataagaggtagtgtgtgagccgtgtgctgcatctgtgctagctcaggtaagtcagcacacagcacctgcaggctcctctcacctcttccctgagcagcaccttttcacctgaacatgctgatcccctagtgcttcatcttgacagcaacttaacaagccctgggcagctttttaaaataaatgactatgatattgactatgaatctacataaaagccacttgttttttagtcataatctgtgtctaactgcagaagaaattcacacctttgaaaaacaaataaaaatgtaaaaagtg

SEQ ID NO: 274612 - DNA, 819 bp, Homo sapiens
cctctttcctcctgtcctagttctatccatcctctgttctttcttgctctctcttttgttttcttcctctggcacacaagacataagagcagcatagccacaagcaaggcttagttaggtctttttcaagagagctggcttaccagagcaccgatggacttggatacctgagatatctgcttgggatcccacactttcaaggtctctcctctggccttcttctggttctgcgactccttacagcgctgggagttggtgatgccaacaggacatacgctcccagagcctacctctcccagatcactttaaaaggcacccaggaccccagaattctcatcctcaaaggcatggagctcagctcttggccctcaacaaatctcttccccataaagatccttttgagagcttaggatgtcccccggatggttttggttgcagattgtggtggtggagggagctatacaatttaatctattgccattaattggatgcgctaatggcagattgggtagtgataatgccataagaggtagtgtgtgagccgtgtgctgcatctgtgctagctcaggtaagtcagcacacagcacctgcagcctcctctcacctcttccctgagcagcaccttttcacctgaacatgctgatcccctagtgcttcatcttgacagcaacttaacaagccctgggcagctttttaaaataaatgactatgatattgactatgaatctacataaaagccacttgttttttagtcataatctgtgtctaactgcagaagaaattcacacctttgaaaaacaaataaaaatgtaaaaagtg

SEQ ID NO: 274613 - DNA, 389 bp, Homo sapiens
gaggcagaatagatagtacagaaaatgaccatgatctcaggatacagaaaccatggtgactgtacagccaacacaataagccgtagcattcgcattgtaattgggcttattcaagcaaagttatcctcattaaggactttctgttctagaaagcatgtgcattttgatttcacctgtcctcaaacttaactttcgcttattttaatagcaaaaaatataggccctagccaggcaaggtggctcataactgtactcccagcactttgggaggctgaggaagatggatcacttcaaaccagaagcttgagactagactggccaacatagtgaaatctcgtctcaactaaaaatacaaaaattagcagggtatggtggtgcatgcctgtaat

SEQ ID NO: 274614 - DNA, 343 bp, Homo sapiens
agaagccttacaataacatagagagtcaactaacgcatattttgtatgttatgtatactatatactgtgttgttacaataaaataaggtagagaaaaaatgttattaagaaaatcctaaaaaaatgaaatatagttactgtttatcaagtagtagtggatcatcgtaaaggtcttcctcacgtcatcttcacactgaagaggctgaggaggagaatgaagaggaggggttggtcctgctgtctcaggacctccaatgcagttcaaactcatgttgttcaaaggtcaattgtaagttcttcttccaaagacaggtgtgtattacctttgcctgactgtcatagt

SEQ ID NO: 274615 - DNA, 454 bp, Homo sapiens
tccccaacttgaatcaatctctcgtaattaatgaaaaccattctcagttgccaatttgcaaattaccattgaaattgccaaagcataagaaattaatcaaccgtccacagagtaccaaaagagtttctaaggatcctgtagaagccctttgggataacttgctccattggctggctgaggagctctcagaagaaaatgctgagtctctttcctcaactctccctctgcgccgtagcaccattcagctcatcaaactcaagaaccctgatgatctcacagaacagatccacgagtttctttgcttctggaaaaaatcgcttccaactttcaccgacaaacttcgcctcctggctcgacatctccgcaagattggcaggagtgatcttgcagaagagctcaaattcaagtgggaaaataaagtgttcactgaaccacagcagtgttttgatgtagc

SEQ ID NO: 274616 - DNA, 410 bp, Homo sapiens
ggaaatgagacagaagggcagatgacacatttatcccccatgctcttttcttttcgtttctttatttgagaagattgaatcatgaatgatcaatcagaccttgttttactagaaaataaatgaacagttgggtacagtggctcactcctgtaatcccagcactttgggagaccgaggtgggaggattgcttgagcccaggaattcaggaccagccatagtgagactctcatctctacaaaaaaatatattttaaaaaattagctgggcatggtggtgcatgtctgtaatcccagctatttgggaggctgaggtaggaggattgccagagccaaggaggttgaggctgcagagacccatgatctcacataccctgcactccagcctgggtgacagagtaagatcctgtctc

SEQ ID NO: 274617 - DNA, 447 bp, Homo sapiens
gcagaattgagaagaatggaaaaatgtatctccaaacgttaggctaagatgcaattcaggaaactgaacagcaaagacaaactccttaaaaattgttggctgagaatctacagcccatcatagagaatagaataatagaaattggtttaaatttcagtaataggaaaaaactcaagaggcctccctcctcaatacacacacatacatacatacacataacactacatcacacagagacacacacatttacatgtatgcattaaattaagatcaatctgagaactgactaaacccttagaaatcctgtgttgtcacttgctcactttaaagataaagagactttggtcagagtgatgaacttttatatgcagagtccttccgctatttatggccaatggttcactcaatcctagatcttctgacttcaataaacaagtctccactcct

SEQ ID NO: 274618 - DNA, 448 bp, Homo sapiens
caagatgctttgagctcccaaatagaggggaatggaaaaagtttcatggcatttgagataatctttgataaaggagcagaatgttggcaggtggagatgtgggggaggaggatccaggcagtggtaaggaagggggctctgtgtcctggggagaaatagagaaagtcttggaaagtaagttcatgtcaccttacagggccttgaatgtcaggcgaaataacttattcaacttcgtaggtgatgagagctgtggaaggctttgagcaggagagcaacatggttatagctgagtggaaatcatttgagtccagaagttgctggattaccatatggagctggagactatagctgcagaaatcgtgtggctgttgaaataatctagtggagagggctgttggggacatgtacagttagttatcttattttcattttcctcctgttgatgtaa

SEQ ID NO: 274619 - DNA, 119 bp, Homo sapiens
gtgaacgctagcacaccttaactcactgtgctcatggcccaaatgatcagactggaggtagcagaaacaaacccccggatttccacacagcctagaggaggagaaacagcaatgaccac

SEQ ID NO: 274620 - DNA, 337 bp, Homo sapiens
tttttttcttgagacggagttttgctcttggcatccaagctggagggcaatggcgcaatctcggctcactgcaacctccacctcccaggttcaagtgactgtcctgcctcagcctcctaggtagctgggattacaggtgcccgccaccatgcctggctaatttttgtatttttagtagagatggggtgtcaccacgttggccaggctgattttgagctcctgacctcaggtgatcccgcccacctcggcctctcaagtgctgggattacaggcgtgagccactgcttccggccgattctctgattagattttaaacttttttgatgaaatattgagt

SEQ ID NO: 274621 - DNA, 421 bp, Homo sapiens
gaggtgggaggatcgcttgaactcaggagttgaaggctgcagtgggtgaggatcacaacactgaattccagctgaggtgacagaatgagaccctgtctctctaaaaaacaagcaagcaaacaaaccaaaaaccacagacaaaccagacccctcttagcagaatacttccatgaggtaataaaaggtttaatttatttcagaagtttctagattttattgtctctatttagccaaagccacaagaaaagtcaaattcatatctttaaatgctttcattatcaatcaagaaagaagaaagtgaaacgaacaaacaattttactcaagaaactagtgagaaatcaaagaaatgtccaagaagtaggagacaagaattaatcaaaacagattaacagtggaataaataaatgaatccaactggtt

SEQ ID NO: 274622 - DNA, 971 bp, Homo sapiens
ctgtcagagctgttagcctgcttaaacagaggaaaatggtacaggcagagctggtctggtatcaggaaaaaggctgcctacgataatccactgcaggaccctaaaagtctcgaccttagggccccctcggaccgtctccaaggtcgggtcccgctggagaaggaggcatttcgagagtaggttggaaacactcttttgtaaaatctacaaagaaacattttggagtccattgaggcctatagtgaaaaactgaatatttcgccttgaaaaccagaaacaagctatctgtgaaaatgctttgtgatggaagatttatctcacagagttaaacgtttgtattgattcagctggctggcaacactctttttgtaaaatctacaatgggacatttcagagaccattgaagtctacagaaaaagactgaatatcccatgattaaaactagaaacaagctatccatcaaaatgctttgtgatgtttggattcactttacagagtgaaacatttatttggattaagtaggttggaaacactctttttatagaatctacgaatggatattttagagcccagtgaagcctataatgagaaaccaagcattccatgataaaaactagaaacaagctatctgtgaacatgctttgagatctgtggattcatctcacagggctaaaccattattttggttcagcaggtaggatacactgttcttctagaacctaagaagggacacttcagagctgatttaggcctacagtaaaaaaccgcatatcccatgataaaaactagaaacatgctatctatgtaaatactttgtgatgtgtatattcatgtcacataattaaacttttgtttttattaaaaaggttgaaaacactgttttagtaaaatctactaagtgcgggttggaaacactttatttttagaaactacaaaggaacttttcggagccaaatgaggcctatagtgaa

SEQ ID NO: 274623 - DNA, 1052 bp, Homo sapiens
ctttcttgtaattcagcaggttggaaaccctctttttctacaatctactagggtactattcggaccaaattgaggcctatactgaaaaactgattatcccgtgataaaaactagaaaaaagctgtcagtaaaaatgctgtgcaatatgtggattcatgtcacaaatttaaacctctgcatttattcagcaagtttggaatacctttttgtagaatatacaaagggatgtttcacacctataaaagcctatagtaaaaaaaggttggaaacactcttttgtaaaatctacaaagaaacattttggagtccattgaggcctatagtgaaaaactgaatatttcgccttgaaaaccagaaacaagctatctgtgaaaatgctttgtgatggaagatttatctcacagagttaaacgtttgtattgattcagctggctggcaacactctttttgtaaaatctacaatgggacatttcagagaccattgaagtctacagaaaaagactgaatatcccatgattaaaactagaaacaagctatccatcaaaatgctttgtgatgtttggattcactttacagagtgaaacatttatttggattaagtaggttggaaacactctttttatagaatctacgaatggatattttagagcccagtgaagcctataatgagaaaccaagcattccatgataaaaactagaaacaagctatctgtgaacatgctttgagatctgtggattcatctcacagggctaaaccattattttggttcagcaggtaggatacactgttcttctagaacctaagaagggacacttcagagctgatttaggcctacagtaaaaaaccgcatatcccatgataaaaactagaaacatgctatctatgtaaatactttgtgatgtgtatattcatgtcacataattaaacttttgtttttattaaaaaggttgaaaacactgttttagtaaaatctactaagtgcgggttggaaacactttatttttagaaactacaaaggaacttttcggagccaaatgaggcctatagtgaa

SEQ ID NO: 274624 - DNA, 466 bp, Homo sapiens
ctctcactcttacagggcccaggagaaaagaagcttggatcagatagaccagactggctcccccatgtactttgctgccaagggccaggagttcacacaaggatttggaaccaaatacagaaatttccaacagttaaagagcacttatgtgccaagtattgttcacttgactctccaaacaaccctatgtggcaggaaggatgatggcccccaaagaggtccacatcctaatctccataatctgaatacagtttattccatggcaagagggaatttggtttgctaatcagctgaccttgagttgggaaggttatcctggatcgtccacaagagtcttaacaagcaaaagaggcaggctggagagtcacagtgattcaatgcgagaaggattcgatccacctgggctgactgtgaagacagacgaagaggaccccgagtcaaggaatgcgggaagcttatagaagct

SEQ ID NO: 274625 - DNA, 367 bp, Homo sapiens
aactcccagcctcaagctatctgcccgcctcagcctcccaaagtgctgggattatagccttgagccaccaaacctggcccaaaagtacaagtatgaaaagtcctgccatgaacatagcttcttacctctactcctttatcactcaaggatctgacgctacacaagctctggttggaagactcactattaagtggtccctgaaagaaaaaaaaaatcataaataaataaattttaatcctaagaggatagcaaaactgaagaagcagcctgatgattttttttttttttttttttttttttttagacagagtttcactgttgtcaccccggctggaatgcaatggcgtgatctcggctcactgcaacc

SEQ ID NO: 274626 - DNA, 425 bp, Homo sapiens
ctgtatttgagtgtttatcatgaatgttaaattttatcaaatgcttattttgtattaatttgggattatttcatcttttattgtgataatgtattatattattacagtttcttatatttaatggtcattacattcctgagataaagtctacttggtcactaacaaaaagacatactggctatatttgatttgctagtttttaaaaaaatttatgcacctatgtttatagattagataagtctataattttcttttgctttttgtccttgtcaggctttggtcttaagattatattacctattgggtactgtggtcactacctggctgacaggaatcaccctaaacctcagcatcatacaatatacccttgtgacaaacctgcacatgtactcctaaatctaaaataaaagttgaaattatttttt

SEQ ID NO: 274627 - DNA, 153 bp, Homo sapiens
aacagagtttgtggcaagagaaaccacttaataagctactgcaataatccagatgaaagaggatgatgaaggaggactagggtgttagtagtggatgaaataagaagtggttggatgctagatacactctgagggaaagccaaaaaaaaaaaa

SEQ ID NO: 274628 - DNA, 369 bp, Homo sapiens
ggccaagaacagcccagagtgtgcaagggcatctgtatctaaggatgagacctggggttggaaagataggtagaggccagatcaccaggggcctatgtgttctgcaaaaatgtagatattctcttgggagtcctgctaaagtgtaatcctctgaccagcagtatcagcatcacctgggagctggttagacgcatagagtctctgccttcccccacccccaagtctgtgttgcaacaggatcctccaggagattcgtgtgcacatccaactgtaagaagctctgatccagaccactgttccccaccatttggaagaatggggatgtcttcttaacatcaaaatatttctcagccagtatcccacatgaaa

SEQ ID NO: 274629 - DNA, 432 bp, Homo sapiens
ggactttaagttgtatgtatgcaaatgctacgtataggaaatagagaaaatgacttaggaaaactgataatcatgctaatatgtcaatctctggaattctgatctcttgtgaatcttaggaagacatacactttaaagatggggcagatgtgctggttggtggggagttagcaactgacactatttcacgtgtcttgggcttggatgaagataaatagcagtgcagaaataacttaaattagggttcccactgtgacctacttagtattccttcaagacctattttttcctttgtttacaaacagtaaaaaccctaatgtggtcctttctatgcccagatttgcctttcagtctagtcctgcatttcttgtctatgcagacttattcagatactttctagcccctttccctacagctatcgataggaaattc

SEQ ID NO: 274630 - DNA, 318 bp, Homo sapiens
agccaccagaagatgtgcttcaccaaaatgaaggaggagtaaatgaagaaagaggaagacatgggacgcaggaagcagataatccaatacaggaaagaagtgaaggaatcacttagatcagggctggcagacttttcctgtaaagggccagatagtcagtatccctgtcacagctactacactgtccttcaggtctgtcttaaagaagatgctaagtgccaggtgtggtggctcatgcctgttatcctagcactttggcaggccgaggcaggtcttgaactcctgacctcaagcgatctacctgcctcggcgtcgacg

SEQ ID NO: 274631 - DNA, 338 bp, Homo sapiens
ttttttgagacggagtctcgctctgtcgcccaggctggagtgcagtggtgcgatatcggctcactgcaagctccgcctcccgagttcacgctcttctcctgcctcagcctcccgagtagctgggactacagacgcccgccacaacgcccggctacttttttttgtatttttagtagagatggggtttcaccgtgttagccaggatggtctcgatctcctggcctcgtgatccgcgcgtctgggcctcccaaagtgctgggattacaggcgtgagccaccggcccggcgccccgaaagttttaaaagcttcccctacaaaagaacagaactgaaattcc

SEQ ID NO: 274632 - DNA, 480 bp, Homo sapiens
agaagatggcaaaataagagagatatggtaataattcccagtcacacaaacccatacattctctggattttgccatggactcttgttctccaatgattccagactattagaacacttatgacattttggttaataataatccttcctataggccaaacttgggtaatgatttaaggaggtattaaaatctgggaatgccagacagtgtgctgaaacagagactcgagtcttgaacaagaaaatatcatttgtttaaccttgaataagtcttcttactagtcttgtgcttattttcctcccttataaagtaattgagtcagcaaatcatgggggtataagaattctggatctcgcaccactctccatcaaaagtatttaacacataccccacatatatgtatattaataacatatatttgtgtgttaattatatacatgtactactgtattaacttaatgggcacattacaaaacaaacag

SEQ ID NO: 274633 - DNA, 399 bp, Homo sapiens
ccggtcttccctggtgcctgctctccctcccctgcatttcctccatcagcactgcttccccatgtgtgtggccacactgctcctaggtgctgtcttctttctcccctgttgctgcagtgacaggtcatcgctgcttataaccaaggtgtgcacctgtagctggagcgctggagccacacggagtggcagctgtgatttcagcagaggttctctggcgccctccgatggtgcttgggcaggctgatgggggcctcactgttgtctgtaaaagtttaaaaagaaaaacacttttaatagaaaaatttacagaataaggatataaagaaaaatatttttgtacaactgtgcaatgtgtttttgttttaacctaagtgttattacaaaaagactcaaaagttt

SEQ ID NO: 274634 - DNA, 194 bp, Homo sapiens
cgggggacccctgccctcctcccgtcatgcctgggggttcactccacccagagaggagccctggccgccccttcatatcccaacagctgagctctcagtgggctcttctgacctctgtggctccgtccgaggctattgctgtggattctgatgctcaaatggtgtcagatttgcccagtaaaaaccccagatct

SEQ ID NO: 274635 - DNA, 348 bp, Homo sapiens
gtgtggtccttcctgcctcctgccccggcctccctgggcttccccatcacaaagtgcctactgccctgacttcccttttaaatcctacctatttttcgagcacagatgggggccacctcctgggggtgtccttccccaatgatcccagcacacaacaatctcctcctttaagctgtcatggttcctctgcttcccaccttaccagatgtcgcctgcagttgttgggtgtgtccgcgtgtgcctaaaatgtgtgagtgcctcctgtgactgaggctcctacttaattcccctaagccccctttggtacggggttgctgtcctcacttctcaggtaaggaaaccggggtt

SEQ ID NO: 274636 - DNA, 183 bp, Homo sapiens
tagagattggagtgatgcagacacaagttaaggaatgctcacagccccaagaagatagaagaaacaagaaatggattcttctctggagcctgcagagggagcagagccctgccaacaccttgattttggacttctgaccttcagaactgtgagagaataaacttctgctgttttaaaccacaa

SEQ ID NO: 274637 - DNA, 306 bp, Homo sapiens
tgtggcagtctctgtgaccaagagcagaagacaatagcagcatagaaacctcaaatgaaaaacctaacatttcaagctactaatttagccaaccttggcatcagctatctctggtcttagtatatgaggtgataagcccccactgttcaagttggatggccatcaattgctgcagaatagaagttaatgaggcttcctcctcctggatcccctactagaccttgacatgcccattcagtcacaggcagaaagggaagcagagggtaaggagacctggctgactgtgtcagacgcagatcttacctg

SEQ ID NO: 274638 - DNA, 365 bp, Homo sapiens
gctccaagcccagtggctggcataagactagaaagccaatcaacgtttaagaaattctgaataaattcagatcctttaaaaatgttgtcggccgggcgcggtggctcacgcctgtaatcccagcactttgggaggtcgaggcgggcggatcaggggggcaggagatcgagcccatcctggataacacggtgaaaccccgtctctactaaaatacagaaaattagccgggcgtggtagcaggcgcctgtagtcccagctacttgggaggctgaggcaggagaatggcgtgaacccgggaggcggaacttgcagtgagccgagatcgcaccactgcactccagcctgggcgacagagcgagactccg

SEQ ID NO: 274639 - DNA, 391 bp, Homo sapiens
tactgaagatgactccttacattattttgcttgcatgtgaagaaatatactttgcactgtgttatagaggaacatagcttcttgatgaaaggggctagggaaagatttatttaaatactttatcaatataaatgaaacaatacatggtgtgttactacattataaaatgagatcagtaaaacaatgtaagaaaacgtaataataagatagtataatatacacataacgtattctgtgtatatatacattataaggcagtgagatcatgttttctattcccatggaccttttttagaaaagcatatcatattttcataattttttaatgtttggaatatactgtttttaagattttgattttatggtgtttcaagaatatagaagttatgaa

SEQ ID NO: 274640 - DNA, 411 bp, Homo sapiens
ctaaatctcagatagaaactgagtctttttttttttctgtttactaaagtttggagttattttttattataaatgtttgattccaaaatgcttgagagtagccttttctttttctcttgagcagaataatttagtcacaccaccctaacaatgataatatcctatttagtgattacctactatgtgccagacccagtgcttggaagagatacaaacattgataagacagcctctgagatcaaggcgttctcagtacagacagaaagaaggaagggttaggtgatatgatatggcaagggcaaccatgcaggcatatacaggatgtcatgggagaacatggtggggtggtcagtagtgtagaggttgagaaattctggcctagactaagaaatgacaatatgtacacataca

SEQ ID NO: 274641 - DNA, 394 bp, Homo sapiens
tgctatttaaagaagtttccaaatatattaggaaacttgatttggtgttacttttattactcgtttctcatttctaactttgtggcatagtattagtttcctattgctgctgtcagaaattactgcaaatttagtggcttaaaacaacacagatttattatcttacagttctagaggtcagatagccaaaattagtctctctgggataaaatcaagttgttggcagggctgtgattcttcttgaggatctagaggataatctgtttttttcccctgttctagcttctagagcctacctgcattccttggcttgtgatccctttgtccatcttcaaacagatctgtcgctgactctcagacctctgctcttccctcacattttctgtaactctga

SEQ ID NO: 274642 - DNA, 305 bp, Homo sapiens
cagatatggagggccaactgcatttattttttaaaatctgcgtataaggagatccatgaagttcaagctcgtgttgttcaagggtcaactgtatctgcaactcaaggttctgctaaagatcctaaggagcagacttccaaaggtcacgcctcctgttgaagaccagatatgacaagttggttgataatcaaacagtttttcctctgctctcactcgacaacaatcaatacagaagacttctgtgaccagatgtgtggggttttctctctaccaataaacaagcaatcaattctgcagccaacacc

SEQ ID NO: 274643 - DNA, 422 bp, Homo sapiens
taatcagcttcatattcctcaaggtacctgtgactatattggtggttaatagatgatcattaaaatgtttttgaaagaattaccaaatagcaccttgacatagacagacagtgaattattttagttatttatagactccttcaatttgaagtattcagatgctttctaagtatcaatctaatttatctccttagtatttggcaacatgcagacagataattctactatgaagggaaattaaactcatttagaggattaaattgaaaaattagtacactattttcaatttttatacagaaatacaaatcatttatatgtagttatctatgttgttttttaaatctaaaacactatttagaagcttctctaattaaaatcactgaacatcacgttgtctatggtaggtggtgctcgggcattgt

SEQ ID NO: 274644 - DNA, 408 bp, Homo sapiens
gttgcctctgacaatgaattcttattatattctttgaattacttaaataaaatgttaacatattagagggaaaattaagtaaaatataatctcatcgaaaatttatgaaagtgcaatttctctcaagttttttttttaaatgtcactctattttaattactatttttggctagcaaatatttgctaaaatttatttgtatcacaattccatttgagttttaaaaatatgatatactataaactatttgtattgcattataaataaaaatagctaatatcatctattaaaatgagcaaataaactatgaaagcaaattctaccaaaataagaagtaatttgtaactttggatatccaactatcagtgcctaaaaaatctgctaattttttaaaaggttgtaaagataac

SEQ ID NO: 274645 - DNA, 208 bp, Homo sapiens
cctgtgggcatcctcctaggacaggggagagcacagaaggcatggctgggcagtaaggggatccgactggctaccctgtggagaatcaactggaaggggagagacgagaacaggtaagagatggttggtggaggcctgcaccatttcccagagaaactgtcatgagactgggggaatgggaacagataaggttgatatttaagaggca

SEQ ID NO: 274646 - DNA, 131 bp, Homo sapiens
cccaccgcttttttggaggaagctttcgaaggaaaggcaggagaatggcagacagggaacataaaggatgctggcgaatggaagagtatgcgcctgtccagattcagcagctgccatccagccctgtcaac

SEQ ID NO: 274647 - DNA, 244 bp, Homo sapiens
tgacatgtgcccagcacttggcccatgactggagggacagtgttgtgattgaccatgccttggaccctctttcttgacctaggaagaaagaatgggtattcctcttgtcagggagcagctgtcagataaaagaaggagtctgttatcacagaaagagggtagaccactgatgtctccttcttacccctccctccaactccattcatgttcccactgccctctgtgcataggcaaagaaggggac

SEQ ID NO: 274648 - DNA, 518 bp, Homo sapiens
agaaattacctattttagcttccataacttaaccctttataaggtgccttcattgagtttcatttcattactgtgtctttttagtgacagtatatacaagcaccattatataaatagcattgttgccattttcccaagtctactgttaaaagattggctgctgcgtcattaaatatcccaggtgataaaatctttttaataattatgaagaaaaatttgtgtcttagaaaatgggaaaagatactattttctttcattaattctagcacaaatttaacagttctgtcaatcttgagcataggcagagactgcattaacagtttttgtaactgtctacaatggaaatcatattaccattttaacagaaatttaaaaaatattatttatgctcatcaacaactttgtaatcaggatattaatagttgttagacctacctttagatattagtatttaatgcattattttaaaagcatatttgtttttcctttccggtcagggaaccaaaaaggaaaaagaa

SEQ ID NO: 274649 - DNA, 171 bp, Homo sapiens
cctgccaataccaggagaccagcataaagaggtactgccagcccctcccatcccagaccttgggatgccccggtttattgtgaccagttacacctgccctggaaggagaaacacagcaaaaagagaatcagcgacaggaccagaatcagggaactcatgttctccaagtac

SEQ ID NO: 274650 - DNA, 249 bp, Homo sapiens
tgaaaacaaggcagaccactgacttttctttgcgtggtttctaggcactttttacagagctgcattcagattgatgaggagcttcttgatgtggccaactcctccctctttttggaaaaagaccaggtgcactaagccagcaaccacagccagcaccgggctgtggtaagagcagccacataggggtctctacagacagaaacccgagaagaccgggacagacccagtacccagactccagtatgaaaa

SEQ ID NO: 274651 - DNA, 403 bp, Homo sapiens
aagttgaagagtccttcaagctgaaaggacaactgagagtcatacaaagaaatgaaaaacattattaaaagaaataactgcatagattaaatataaaggcattatttttggtttgtaactttgtttcatgtaatttaaaagattgcataatacagtaactaaatcttgtgaacctctaaattaaaaactctacagtgtataaataaactggaaaactaacaaatatgtggaaaataaataatataaaacaaccagtggatcacagaagaagtcataatggaaattagaaaacacctgaagacaaatgaaaacaaaaattctacataccaacatttatgagatacacaaaaaggaatgttcagagggggatttgtagctggaaatgtctgtattaaaaaaaaga

SEQ ID NO: 274652 - DNA, 524 bp, Homo sapiens
aagtcgggacgttttgtgaaaattctccctgattatgagcacatggcgtacagagacgtttacacctgccgtatgtacctcctgcgagctttggcttctgcggcagccagcacggccaagaactgcatggggagggccctctgattcacacatgggacagctttggtcctggagcaagcggacctcgtggctttttgtcatcctttcacgttcacttgctgcagcgtggctctgcttcagctgtgacagagatcacacctgtgtgttggacccaggctgcatttggcttacctttctgcagtggtttctgggtactaccagtcgagatcactttaatgcacattttcacatgtatcgtttattgaggagctactgcagacacagagaggaacgaacagagtagaagctttaaaattttattctaaagtgaaatatgaatatttgacttctgacctttattagttttaatcacattttaatagcctatgtgaattaaaaatcacatatgcatataccctcaatag

SEQ ID NO: 274653 - DNA, 567 bp, Homo sapiens
tgatacggagtctctcactgtcacccaggctggagtgctgtggcgcgatcttggttcaccgcaagctccacctcccgggttcacaccattctcctgcctcagcctcccaagtagctgggactacaggcgcctgtcaccatgcccagctaatttttttgtgttttttgtagagacggggtttcaccgtgttaggcaggatggtcttgatctcctgacctcgtgatccacccgcctcggcctcccaaattgctgggattacagacatgagccacagtgcccggcctatgtctatgctcttaaaagatagctttgcataaccacatgcagtttcttccaactatatcccctatttcactcacatatcccttcttctaggaagtcttactcatttaagtcctggcccaacccttttcctgagtcagtcctgactttatttatgagagctctcctcttaaatttttaagtgacagtttataattgttgactataggtatggggttgtgcagcgaatctctggagcttatcgctcttgcttaactgaaactttatgcctgttgatttttaact

SEQ ID NO: 274654 - DNA, 987 bp, Homo sapiens
gaattttgaaggcgttcgtgtattttactgctatatgtacaagtcgatcagaagtgatacctgtgcaggctaccctgaaaagaatcagttccattacttcacttttgtagtttagacttgggaactgctgatataccctatggggcaacacaggcgcagttttgaaaaccagactcccctgctgtctaatacctgcatctgagggcagcacagtgaggggacatctttggtttcaatttttacagaaggctccagtagggactgcattttaataggcactggtgtcagggggaccttggtcaatcttatcagctctgaaggcggagcttcctgaaactggatccgggccccaggggaagcagtgtggagagtccagagggatcctgaggtcttgctggtgcggcccaaaggcaccggacgttggggccaagatgacctccgcgctgccacgagccgggccattggacgcgggctccgcgccgagcctgcagtcctcgaggagtctctcgggttcctccgttttgatcacaccttctcggatggccgccgagcttttgccttccccgccctgcatcgcgtccctcatgacctcttccgcctccagcttgcccttctcgttccctcggaagtagtcgagggccggcccgaggccttccaacttgaccgccctggaggctctacgaccggtctccacggccccccgaggcctcaccgatgcgtccaggcaagcccctagctcctacttcttggccttgacgtgcagcgcccggggctgcaccgggtgtaactcgggcctacagggggcgccctcggaagaggcgggcggcagcaggagccgcaggtcgggcctgaactgccgctgggagaggaagcggcgcccttgccaggaacgtggggctgtggtagcagcaacacctgctccagcttcacctccagcagctgctgcgccgcacacggcaccaaaccctccctacacgaggaggccac

SEQ ID NO: 274655 - DNA, 559 bp, Homo sapiens
tcttgaaattacataggtgcattgctttgggtgttttaaatcacagaatggtgtgtctggaaagggtgtaagaggcttcctgggctatatttcttcattcactgattgcctaaacctacccaacgaggaaaattctttttatttttatcttttgtttttactgtctaaccagatgaataaacagtggaaattctctaccacactcttaacaatcaagtcatttcataaccccttttggtaatgggtgtttgtgtccacagctagatcagaaagtaagtactttttctagggatttttttttttttttaagtttgggaaatagtttgatcaaaagtcatggggaaagtaatctctgattttaaaaattgaagaatactgaaggtgtcagtgagttagaaatttttaaggagtaattattttctgaaatgtgtaataaccgaataataaacaagacaaaactctaatatttcagactgtgatcttcagaggactaggatagtcctttccacaagaaaaagacaaaaaaaaataaagttttaccattaaatacaaaaaaaaa

SEQ ID NO: 274656 - DNA, 416 bp, Homo sapiens
gtcttttgtaggattcccttggttcttcaaaacatgtatatagatagatttgggtctgttcattaagttttcaacagtcattggcaaaagagaaaaaagtaaagaaaaccctcccactcaaaaacagaaactagaaaccttgtttcagggcctcaaaatttggagggtgatttaacttgtccttgaaatccaaaagtaggaacaattttatgatttttagcattaacagaatcgtatcatgtaatggatttattattataatattatacagcacagtgagtggcacattgtaggtgcttaattaatattgttgagtaaatccattattcctgatttaatactttatcatatatatatatactccttgaacttggctctaaacaactgtggaatcctaacggtatgtgaaatatttt

SEQ ID NO: 274657 - DNA, 661 bp, Homo sapiens
agaaatggaagagcggtgggagaaggcgcgcccagcactgaataactgggtagtgcaggcatgaaattgcccgttcattccaccaaagacttgaaaagaaacaagcaaaaactgttgtaacaaaggaaacacaggaaggttttaaattctctttgagagacattttcaagctaaatgtagtaaaatcctcaattataagtttcatagagcaaagcagtaaagcctttatagaacactagcactcattttttgataaactaactgctatctggagagactaaaagacttgtccaggctcactcaggtttaggatgcagaagctcacctttcctgagcaagtcctccttctctcatctactgcattttggggcgggcagagtaaggaaaatacttggatttaagtgacacttgtgcaccagctctggcctaccactttgctacttggtggtcataggcagctctcgtaacctcctagatctcaggttcattgctctaaaatgggctgcattgtatctaatgtatgggttattgtaaggattaaatatgtgactacaaggcagggttttcgagagctttagacattgttagtcttattttcaacatgtaaattcctcctttaagcgcccattcagcatttcctttttaatatctgttttttaaa

SEQ ID NO: 274658 - DNA, 247 bp, Homo sapiens
tgtgttcaggctctcccatttcaaaatactccatggaaaacttctttaactgaaatatagcagtcttgtcatattcttaacttactctaaaaatgtacagtagcaggagctcagggtcagaatatgaattcagtttttctgtgttcacatattgtagttaaggaatatctccttgtatgtgaagttataagaaatgttacctggatattttggacaaattgtatacctagttttaaaaaataaataa

SEQ ID NO: 274659 - DNA, 206 bp, Homo sapiens
cggaaactcggggcgggggttactaagcacactaatttggatagaccagagatggcctggtttgtggttagcgctacgtgactgtccaccatcacctgtgcgtatcctgctggtcccagctctgctgtaggctgctgagtgagctctggcttcttccttgcctcctctgacccttgtttaatcccctctgacataacaggaggtta

SEQ ID NO: 274660 - DNA, 401 bp, Homo sapiens
gtggtctgtatcttaccagttctttgatgcttgttaaggttagctccatggacaatggcaggtgttctctacaaataagtgttccacgtgtagctttaaaacgatgtgtattctctagctactggatgcagtttcatgtgtatctataagatgaaaattttaaatgtgctatttaaatctttatccttcttcatgtttttatctacttgatcatttaattactgagagattataattatggatttattattttcatctggttaattcaccttttactttatatgtttttgaggtttattattagatacatacaagtttagatttttaaatatttttgtgggaaattaacccttttgtcatatgtcataccttctgtatctctaatagtattgtttgaatta

SEQ ID NO: 274661 - DNA, 860 bp, Homo sapiens
tttatgatttttcagtaatagttaattagtatgatacaagagaacaggggtgtggctagcctaaaataatgaataacctatatgctacgatatttatattttgtctttgaaatatatgccccctaattaggccctgtccttcactagctgacagaccatggacaaattaggccttaggctgttatttcatctttatacaatggggttagattagatcagtggttcccagctctgactacattttataatttccagagaacttaaaaaaaattttcccctgggctccaggaaatctctggggagaagccaggtgattttaacctatagtcaaggttgaaaaccactggattacatgatgtctgagttcttttctgccgctacaattaactagacatatggggtttggggttcatttttgtttttgttttgggggttaaacacatcaactgagtttgagatgtcagcttaactcttgggctgttctgaatgactgacctgttaatcccttacctcaaataatgtacaataaataaaaatgaattgagcattcactgtacttttctttccctttaggaagcaaaatgaaatttctgcaaaagaaatgaaatctctgattgtctccatcctgaatatacaacagaaagtgccaaagaaaatatttttctaagggtcaggatcccatgaagtattctacaaaattcttgaaattttaaaaggttaaagagcgagtcaggctgttagaggaggattctcctgttgctgctgtagtaatcactggagaattgttgggaatggtctggcaccatgccatctttactctgtctccattttttttttatagcagccttttctatgtgatt

SEQ ID NO: 274662 - DNA, 763 bp, Homo sapiens
gcagcatacctatatcccagtcctgccagcatctatgattgacatcgtgtgctcacctacaccattccttattggaatcctgtcttgctccttaccacagctccaggacctacccattgaagaggtgctgatagttgatctctgtgcagacaagttcttacaggaggtatctgatgaggatgaaattctaccaccaaaacttcaagctgccctgatgcagattttggaagaacgaaatgaaatcttgactcaggagcagaatttttcacaagatgtgacactcaactctctggtgtccgaagcatttgtcaggttttttgtggagttggtaggacattattctttgaacatgactgtcactgagcgtggggagcgtgttttccaaagggaaccattccgtaagtcccacacctcccgaagtgtacgccacttcctggatctcttcatggaaactcagatgtttgcaggattcatccaggaccgagagcttcggaaaagtggagttaaaggtttgtttgagatccgggccatccagtatttggaaacaattcctgagtcggagcccagtgggatgaatagaattttgcggagtcttggttagttgctgtgttttcctgttagataaatgtggctgaagaccaggcgcggtggctcatgcctgtaattccagcactttgcgaggtcaagtaaggaggtttgcttgaggccaggagtttgagaccagcgtgggcaacatagcgagaccccatccctacgctaaatt

SEQ ID NO: 274663 - DNA, 883 bp, Homo sapiens
gcagcatacctatatcccagtcctgccagcatctatgattgacatcgtgtgctcacctacaccattccttattggaatcctgtcttgctccttaccacagctccaggacctacccattgaagaggtgctgatagttgatctctgtgcagacaagttcttacaggaggtatctgatgaggatgaaattctaccaccaaaacttcaagctgccctgatgcagattttggaagaacgaaatgaaatcttgactcaggagcagaatttttcacaagatgtgacactcaactctctggtgtccgaagcatttgtcaggttttttgtggagttggtaggacattattctttgaacatgactgtcactgagcgtggggagcgtgttttccaaagggaaccattccgtaagtcccacacctcccgaagtgtacgccacttcctggatctcttcatggaaactcagatgtttgcaggattcatccaggaccgagagcttcggaaaagtggagttaaaggtttgtttgagatccgggccatccagtatttggaaacaattcctgagtcggagcccagtgggatgaatagaattttgcggagtcttggaagcaaaatgaaatttctgcaaaagaaatgaaatctctgattgtctccatcctgaatatacaacagaaagtgccaaagaaaatatttttctaagggtcaggatcccatgaagtattctacaaaattcttgaaattttaaaaggttaaagagcgagtcaggctgttagaggaggattctcctgttgctgctgtagtaatcactggagaattgttgggaatggtctggcaccatgccatctttactctgtctccattttttttttatagcagccttttctatgtgatt

SEQ ID NO: 274664 - DNA, 438 bp, Homo sapiens
acatcaggagagcctgagaataaaattcactgaaggtggcagaacagaaagacagaagaaatctgggcccatgccgatgtcattaaactgcttaattaaccagccctggaactgccccacttctggacttattatttttaaggacaggatcccggtccagtctcctgactgcgtagagatccctcttcttcccgaaaggcagtggatgtacttgaaaggagacttcacggacattcccaaggagacctgcattttaagcccagctctgtctgcacttgctgtgtattggactagtcaagtcacccacttcatcacggtgagccagtatatggtatttctcggtggatgttccatgtgtacttgaaaagaatgtgtttcctcctgttgttgggtgaagtactctataactctataaatgtcatttagctccagttggtt

SEQ ID NO: 274665 - DNA, 377 bp, Homo sapiens
ctattcacaggtctgatcataacgcactgcagcatcaaactcacggcctcaagtgatcctctcgccttagcctcccaagtagctgggattataggcatgtgccactgctcttggcttacagatgtgaaggagtgaggcatcttgaaatagaaaatgttcctgcattacctgggtgggcctggtgtaattacaaggaggcaggagggccagaggagatgtgacagtggaagcagaggttggggtgttgtggccacaagccaaggaatgtggacagcctttagaactagagaaagcggaggaatcgatttctccctggagcctccaaaaggaagcctgcctctgacctcagaaccctaagagaataatacatttgtgtt

SEQ ID NO: 274666 - DNA, 1949 bp, Homo sapiens
gggttgtgctccttggcggcagatgggctctggaatcagaaaatcctatttgaggagcaggacctccggaagcacggcctagacggggaagacgtctctgccttcctcaacatgaacatcttccagaaggacatcaactgtgagaggtactacagcttcatccacttgagtttccaggaattctttgcagctatgtactatatcctggacgagggggagggcggggcaggcccagaccaggacgtgaccaggctgttgaccgagtacgcgttttctgaaaggagcttcctggcactcaccagccgcttcctgtttggactcctgaacgaggagaccaggagccacctggagaagagtctctgctggaaggtctcgccgcacatcaagatggacctgttgcagtggatccaaagcaaagctcagagcgacggctccaccctgcagcagggctccttggagttcttcagctgcttgtacgagatccaggaggaggagtttatccagcaggccctgagccacttccaggtgatcgtggtcagcaacattgcctccaagatggagcacatggtctcctcgttctgtctgaagcgctgcaggagcgcccaggtgctgcacttgtatggcgccacctacagcgcggacggggaagaccgcgcgaggtgctccgcaggagcgcacacgctgttggtgcagctaccagagaggaccgttctgctggacgcctacagtgaacatctggcagcggccctgtgcaccaatccaaacctgatagagctgtctctgtaccgaaatgccctgggcagccggggggtgaagctgctctgtcaaggactcagacaccccaactgcaaacttcagaacctgaggctgaagaggtgccgcatctccagctcagcctgcgaggacctctctgcagctctcatagccaataagaatttgacaaggatggatctcagtggcaacggcgttggattcccaggcatgatgctgctttgcgagggcctgcggcatccccagtgcaggctgcagatgattcagttgaggaagtgtcagctggagtccggggcttgtcaggagatggcttctgtgctcggcaccaacccacatctggttgagttggacctgacaggaaatgcactggaggatttgggcctgaggttactatgccagggactgaggcacccagtctgcagactacggactttgtggctgaagatctgccgcctcactgctgctgcctgtgacgagctggcctcaactctcagtgtgaaccagagcctgagagagctggacctgagcctgaatgagctgggggacctcggggtgctgctgctgtgtgagggcctcaggcatcccacgtgcaagctccagaccctgcggctggatagctgtggcctcacagccaaggcttgtgagaatctttacttcaccctggggatcaaccagaccttgaccgacctttacctgaccaacaacgccctaggggacacaggtgtccgactgctttgcaagcggctgagccatcctggctgcaaactccgagtcctctggttatttgggatggacctgaataaaatgacccacagtaggttggcagcgcttcgagtaacaaaaccttatttggacattggctgctgaatggtcctatctgctggctctcccctgagatctggacagaggaagatgggagggtgctcatcacccccccagcataatgatcagcctccttcctagagacagactcatgcagattgagatcaaaagtccctctgcttgggatcaaattaatgtttgacagagctggccaggcgtggtggctcatgtatgtaatcctagcacttcgagaggccgaggcaggtggatcacgaggtcaggagtttgagattagcctggccaagatggtgaaaccctgtctctactaaaaataaaaaaaaattagccaggcatgg

SEQ ID NO: 274667 - DNA, 242 bp, Homo sapiens
ctttgcaagcggctgagccatcctggctgcaaactccgagtcctctggtgagggatgatgaccagttctttctggaggaggctggacattgggctgggagcatgagggtagataagctggatggacaaatacgttatgcactggtgtatgcaattagggggcatacagatgaggccacatattagctatgtcatctactggctgtgtgaccttggataatttccttgtctgaggccgggcgc

SEQ ID NO: 274668 - DNA, 2483 bp, Homo sapiens
agtccctttttcttgagagagtgtggctctgtcaccaaggctggagtgcaggggcacaatctcagctcactgcaacctccaccttgcgtgtctcagcctcctgagcagctgggaccgcgggagtgtgccaccacacccagctaatttttgtatttttttagtggagatggggtgtcaccatgttggccaggctggtctcaaactctcggcctcagcctcccaaagtgctgggattataggtgtgagccaccacacccagcctctatatcccttttatcggtggacccaacaatcttctgtagacagaagactgtgtgaataagccaatggtcccaagagagcacgcatcctaatgagaacggagacagataataaagagggaaacaagtaaaccaactatcaatgattaggagcgtcagatagagccaggtgcagcctggacaacatgatgagatccccatctctaaaagtataaaataaattggctggtcatgatggtgcacacctgtggccccagcttctcagtaggctgaggtgggaggattgcttgagcctgggaggtcaagcctacagtgagccatgatctcaccatgcactccagcctagacaacagggcaaggccctctaaaaaaaaaaatgaaaagatagcatgctttggccggatgtggtggctcacgcctgtaatcccagcacttcggggggttgaggcgggcagatcactgaggtcaggagtacgagatcagcctggccagcacggtgaaaccccgtctctgctgaaggtgcaaaattgactgggcgtggtggctcatgcctgtagtcccagctactctggaggctgaggcgggagaatcgcttgaacccgggaggcggaggttgtggtgagctgagattgcgccattgcactccagcctgggcaacaagagcgaaactccgtctcaaaaaaggatagcatgcttcataaacggtgaaatgacatgcaaaggccatagttgtcaagcaccagtaacaccagagagtggcctgtctttccttcaagcagaccagagaggaccgttctgctggacgcctacagtgaacatctggcagcggccctgtgcaccaatccaaacctgatagagctgtctctgtaccgaaatgccctgggcagccggggggtgaagctgctctgtcaaggactcagacaccccaactgcaaacttcagaacctgagcactttgggaggcccagatggggaggatcacttgacccaggagttcaagaccagcctggccaacatggtgaaaccccatctctactaaaaataccaaaatgagccaggcatggtggcacacgtctgtaagcccagctactcaggaggccaaggcaggaggattgcttcaacccaggaggcagaggttgtggctgaagaggtgccgcatctccagctcagcctgcgaggacctctctgcagctctcatagccaataagaatttgacaaggatggatctcagtggcaacggcgttggattcccaggcatgatgctgctttgcgagggcctgcggcatccccagtgcaggctgcagatgattcagttgaggaagtgtcagctggagtccggggcttgtcaggagatggcttctgtgctcggcaccaacccacatctggttgagttggacctgacaggaaatgcactggaggatttgggcctgaggttactatgccagggactgaggcacccagtctgcagactacggactttgtggctgaagatctgccgcctcactgctgctgcctgtgacgagctggcctcaactctcagtgtgaaccagagcctgagagagctggacctgagcctgaatgagctgggggacctcggggtgctgctgctgtgtgagggcctcaggcatcccacgtgcaagctccagaccctgcggctggatagctgtggcctcacagccaaggcttgtgagaatctttacttcaccctggggatcaaccagaccttgaccgacctttacctgaccaacaacgccctaggggacacaggtgtccgactgctttgcaagcggctgagccatcctggctgcaaactccgagtcctctggttatttgggatggacctgaataaaatgacccacagtaggttggcagcgcttcgagtaacaaaaccttatttggacattggctgctgaatggtcctatctgctggctctcccctgagatctggacagaggaagatgggagggtgctcatcacccccccagcataatgatcagcctccttcctagagacagactcatgcagattgagatcaaaagtccctctgcttgggatcaaattaatgtttgacagagctggccaggcgtggtggctcatgtatgtaatcctagcacttcgagaggccgaggcaggtggatcacgaggtcaggagtttgagattagcctggccaagatggtgaaaccctgtctctactaaaaataaaaaaaaattagccaggcatgg

SEQ ID NO: 274669 - DNA, 1128 bp, Homo sapiens
cagcccagacatgagctctgtggtctgtgtgtgtttactgtgtggccagagcgtgtgaggagtgtgtggaaccgtctgtgtgatgtgggagtagggggataagtgtattggcatatggagtgggagtgtgtatgtgtgcacgcatgcacctttgtgcctgtgatctgcgtcatgcagtgtgtctgtgcctgtgtgggatgtggtccctgtgatgtggggcgtgtatgtcggtgtgtgtgtgtgttgtggggtagtgctaaccgggacactctccaggggaagatcctagctcggatggaggtggaggagttaaccaggagaatgggagagggaccagcacgtgcaaaggcctggaggcatgaagatggagcctggagcactggaggacttgaaagtggtccagtgaggctgggagtagggagggagaggcaggggctgggagggacagggcaggccttcctccaccagtttgaattccgttagcttgagggtgtgtacagccaggaggggtggaggggctgagaggaggccgagccaccactgaccaggtggaggggtagggggtgagcctggaccggggcaggtgctgggtggaggtgggggagtgagagccagagctctcaaccaagcctctgggaggccgcagggcctgggatcgcagacccgagcctaatccctgctcagcccaagagctgtagccagaaggttcttagtttcccctcagtaaactgaggttcaggacatttctggggcacttgctctgtgtgactgggcaagggctgggcaggcatttccagcatgaacacgctttcccaggcccactggttggagggcaccgaggggagaagggggacagaggaaaggagccggaagcaggatccagaatttgaacctaggtggtctgactccaagagggccctctctctcacttgacttcaatagtgacattagccaacttcaatagtgaccccaggcgcggtggctcacgcctgtaatcccagcactttgcataatctcagctgaggatttataagtttaccttggtgggattctccgctctcaaactataaagttctgtgacgacaggagatgggtatttttttctcctcactttatttatttattttg

SEQ ID NO: 274670 - DNA, 452 bp, Homo sapiens
ccgggagcccttaaccggtccgggagcccttaaccctccgggagcccttaaccctccgggagcccttaaccctccgggagcccttaaccctccgggagcccttaaccctccgggagccccccggagcccttaaccctccgggagcccttaaccctgtgtgactgggcaagggctgggcaggcatttccagcatgaacacgctttcccaggcccactggttggagggcaccgaggggagaagggggacagaggaaaggagccggaagcaggatccagaatttgaacctaggtggtctgactccaagagggccctctctctcacttgacttcaatagtgacattagccaacttcaatagtgaccccaggcgcggtggctcacgcctgtaatcccagcactttgggaggccgagacgggcggatcatgaggtcaggaagattctcctaaggacag

SEQ ID NO: 274671 - DNA, 426 bp, Homo sapiens
ccttacttcatctcataatttcacatcaacacaagaagggtgagtacagtgccacattcacattaactgacattatgctatactgttataattgttctatcttgttgttctcttattgtgcctaatttataatttaaactttatcatagggatgtatgtatgtataggaaaaaacaatgcatacagggttcagtactatctgcagttttagacatccactgggaatgctggaatgtattccctaaagataagggtagactacagtataaacatcccaagaggctcttctgatactagttataaggcatcagcagtggcagcaatgtgagtagtattagtgattatttgaaccatcaatttacatgcataccatatgttacagatttccaagaacaggttgagtatccctaattcaaaaatccaaaa

SEQ ID NO: 274672 - DNA, 396 bp, Homo sapiens
ccttgatcccagggtcacccagttaacagtgatgtggctcaaagccagtgtactttttccactcagcttctctgatagtttcagattccattagcactgttaatctactggccaagcgcagtggctcatacctgtaatcccaacactttgggaggccaaggcaggtggatcacttgaggccagccaggagttcgagaccagtctgaccaacatggtgaaaccccatctctaaccacaagtataaaaattagccaggcatggtggcatgcacctgtaattacagctactcgggagcctgaggcaccagaattacgtgaacccaggaggcagaagttgcagtgagccgagattgcaccactgtactccagcctgggtgacacagtgagactctgtctc

SEQ ID NO: 274673 - DNA, 360 bp, Homo sapiens
tcacagagctcagggaaacacttttactggtttattattagtattatgtttatttgtttgttttgagacaaagtcaagctctgtcacctaaactggagtgcagtggaacaatcacagttcactgcagtctccatctcgtggactcaggcagtcttcctgcctcagcctccccagtagctgggactataggcacatgctaccatgcctggctctaccagtttattctaaacaatattaccagccaggcacggtagagcacacctgtaatcctagcactttgagagactcaggtgggaggattgcttgaagccaggagttcaagagcagcctggacaacatagtgagatcctgtctctacaa

SEQ ID NO: 274674 - DNA, 482 bp, Homo sapiens
ttccagccagtggaaaccggacagagcagtagggtggacgtgtcaggttataaatgaccctgtctcttttgttttgtgtactctcgaagcaaaactgctggtgagtgtacccttgctgcagaaaataaaaatggtcttgctgagtaaattaaatttatgttcaagtgctatttgtttacggcactggggaagaagcatttaaacactcagctggcgtccgctactgggtctaggaaaaaaaatcccacacatctggtcctagaagtcttcttctgtgaggatgattcctgtggtgtgagagtagaggaaaagcaccatagagagagctctctgacatacagaagtaaaggaagttcttatcagcaacaagagagaggctgacagagctgcttagaaacagagttccctgattccagaggttcaaagccagagttgctgtcagtccattggaggagatgccgttgctgggcaagttttttctc

SEQ ID NO: 274675 - DNA, 264 bp, Homo sapiens
agccacttaagctacaatggcaatgtaccttggggtgattgcatgttttaaaactatggaaacagatttttggtcaggcagaattaaattggactcatttcaaatagatgagatgaggtttgttcagccatcctgcagggatagtaatagggaagaaatgtatttcagttttcacagactcagagaatatagtagtgttcatcaaaatatcctccataaagtcctgtttatattcctacttaaagtaaatatccttttaaaagt

SEQ ID NO: 274676 - DNA, 391 bp, Homo sapiens
ggcattgtgattttctccttactctttctcagtcactcactctgggggaagccaggtgctatgttgtgagaacactcaagcagctcaatggcgaggtccatgtggcaaggaactgaagccacctgccaatggccaacaggaaacaagtgccttatgtcaacagccatgtgagtgaaccatcttgaaaacagattctttagccccattcttcagatggcagcaaccctagctcactttttactgcaacatcataagacaccctgagcagtcatccaactaaaccactcttgaatgcctgacccacacaaactgtgagataacaaatagttgtgttacattgctaaattatgaggtaattggttacacagcaataaataattcaactaggtta

SEQ ID NO: 274677 - DNA, 577 bp, Homo sapiens
cattaaaaaaaaaaagaatgatctcattggtgatatatgcacttttcatgtcccgtaaccagttacttcctagtatgccatttgccttcagccttcagttctgtctgtgatgaactgggatacaattgctgtattaagaatgtccttcccttcctgtccaagttattccaattccaagtggtctctagacttctcttctgttagggggagacagatttgtacatacatgtatatgtgcactcacacaggaatgtagctaacctccatttctaaacgcattgctttaaagaagaagaaaaactgtcatacatcagcttttagaaaatttgtttatttccaaatatctatagagatgctacaagggcttgcactcttataagattttaaggcatgttcattctacccagaatacacctggcattttatatgacaaaagaatggtcattctaggtgcctcctgttttccagaaacctagtgttctggctaatcttagagcttcttcactcttcattcatcatagatgctccaaattactgggatttttaataaaagaatttaggataaagagtgaaagtg

SEQ ID NO: 274678 - DNA, 371 bp, Homo sapiens
ctgcaacggtaatgggatgatgaagccaagctgggagcaggggtgcactgagaacagacgccgcttctgcggtatccctgccagaaagcctcaacctgaacctaatcatgaggaaacatcaggccaacccaaactaagggacaacctacacattaaacgtcttggaatctccgaaagtgacaaggtcatgaaaatcaaggaaaggctgaggagctttccagactgaaggcagcaaaaagacttggcaaccgaaagtaacggcggcttctgaaccagattctgttgatgcccacaaggacatcactgggaccactggcgggacttccctgggtctagactgaatggtattaaagtatccatgtcaatttcct

SEQ ID NO: 274679 - DNA, 880 bp, Homo sapiens
ccatgtaagcccccaagctctttacaggggagaatggtgatgttttggctccattgccaggtgtattggggaggaccgtatgctatttattaattgttgttaaattcgaacttcctaagtaaccctaaaatctatgtagctctaaaattatgatagggaacattattggagcttctgatatggatgaaagacttgggcaaaaattgtttagttaggattgttggcaacagtactttaataatattgacatgtagtagtgatttgggacacagttttactatgactttgtacagtttagaaacatgggggaggagtattcccatcatcactcaccaatttagctgagatttcagatatagcctaagaaataactctgcttctcttttttccctttgatattaagaagaacagcctctgtggcttattgtcttacctgttttctttcatgaaagctctacttcctctactataaaacacttaatagcattattaaaaaacaaacacgtacagagaacgaattgtttggatctccccttcctttattttggaggttttgttgttgtttaaggtcttaacagcttaaattatagaatagcttattaattattgaataatagaactggaaggaaccctagggataacctagaccagtcctgggaggtgggttctagcagtctgttttaacaagcctttcaagtgattctgatgcatgctaaaatcaatgaaccactgaactccttcatgtgacggttaatgataggcctagagtatcagtatctatttcacccccaatgtaagagctagtttttaagttttatatcagacccatgcctactctccatcttgtgtgtgtcttaaaggtgcttagagaaacttcccc

SEQ ID NO: 274680 - DNA, 869 bp, Homo sapiens
tgccacgcagaaaaacgaggggttgcaactgccacgcagcaactgccacacagaagaaggagggactgcaactgccatgcagcaactgccacacagaaaaaggaggggttgcaactgccacgcagaaaaaggaggggttgcaactgccacgcagcaactgccacgcagaaaaaggaggggttgaaaagggagtagcttctgatattcagaagctattggaagagatgctcaaagaagaaaaaattaccataatccaataaagaagaagacctgagatccaggaagcagatgatctgaactgcagagaaagttcaggaaagttccctcattcatgatgatgggaaataacagtaaattctgtacagcagtcttggacaacaaccaatctaaactggcacagtgcagaggcaatcaacagagaacataatattgatagaatgcctgacgcttttgattgtattcacaggaaacataaacaattggaagacagtttatgaatgaattagtgataagcattttttttcaacttttattttagattcaagggtacatgtgcaggtttggtgcctgggtatactgggtgatgctgaggttgtgttacaaatgatcccatcatccaggtactgagcatggtatccagtagttagtttttaacccttctcctgtctctctcctggtggtccccagtttctactgttgccatctttatgtccatgagtatacaatgtttagctcccacttgtgagaacatgcgtatttgcctatttaattatttgtttatttgttgagacatagtttcactctctagcccgatcttggctcactgcaacctacgcttcctgtgttcaagcgattctcttgcctcggcc

SEQ ID NO: 274681 - DNA, 1177 bp, Homo sapiens
tgccacgcagaaaaacgaggggttgcaactgccacgcagcaactgccacacagaagaaggagggactgcaactgccatgcagcaactgccacacagaaaaaggaggggttgcaactgccacgcagaaaaaggaggggttgcaactgccacgcagcaactgccacgcagaaaaaggaggggttgaaaagggagtagcttctgatattcagtaagtacgaatcggccttaggttccctgcctcaagaccctattctcctgcctcacttttagctaagggttattacaaaacagtcagaaagttaagacaaaatatgaaagtttataaagtaaaaagagttacagtgagctaagtataacttattgaaaacatttttttaatttagtatagcctaactgtgtttatacagtctacagtagtatacagtaatatcctagacctccacattccctcgccactcactcactcactcaccgactcactcagagcaacatccagtcctggaagctccattcacagaagctattggaagagatgctcaaagaagaaaaaattaccataatccaataaagaagaagacctgagatccaggaagcagatgatctgaactgcagagaaagttcaggaaagttccctcattcatgatgatgggaaataacagtaaattctgtacagcagtcttggacaacaaccaatctaaactggcacagtgcagaggcaatcaacagagaacataatattgatagaatgcctgacgcttttgattgtattcacaggaaacataaacaattggaagacagtttatgaatgaattagtgataagcattttttttcaacttttattttagattcaagggtacatgtgcaggtttggtgcctgggtatactgggtgatgctgaggttgtgttacaaatgatcccatcatccaggtactgagcatggtatccagtagttagtttttaacccttctcctgtctctctcctggtggtccccagtttctactgttgccatctttatgtccatgagtatacaatgtttagctcccacttgtgagaacatgcgtatttgcctatttaattatttgtttatttgttgagacatagtttcactctctagcccgatcttggctcactgcaacctacgcttcctgtgttcaagcgattctcttgcctcggcc

SEQ ID NO: 274682 - DNA, 650 bp, Homo sapiens
gtaagtacgaatcggccttaggttccctgcctcaagaccctattctcctgcctcacttttagctaagggttattacaaaacagtcagaaagttaagacaaaatatgaaagtttataaagtaaaaagagttacagtgagctaagtataacttattgaaaacatttttttaatttagtatagcctaactgtgtttatacagtctacagtagtatacagtaatatcctagacctccacattccctcgccactcactcactcactcaccgactcactcagagcaacatccagtcctggaagctccattcacagtaagtaccttatacaggtataccatttttacatcttgtatagtgtatttctactgtgccttttctatatttaaatttatttaaatacacaaatattacgtgttaaaattgcctataggattcagcacggtaacgtgctgtacagacttgtagctaagtagcaataggcactgccatatagaaggtgcagtagggtataccatctaggtttgtgtaagtacactccttgatgttggtacaacaatgaaatcacctagctgtgcatttctcagaatgtatccccactgtcaagtgatacatgactgtatattaatatgaagatgaaacctagctatgtaaaga

SEQ ID NO: 274683 - DNA, 700 bp, Homo sapiens
gcggagcgcgtctcctgcttctccctgcacccaacgatttccgatatcatatcatataatcatctcaactccaaatatgacgttggcactgttatttccattttacaaatgaagagatgaggttgagaggtatcgtttattatcttggcctataagtacatggaagagttggaattcgaactgagagccaggatatgaacttacaagtgccttgctttagcactgcctgtcccagaaggattgtacctttctgcttctccagaaactaactaaagattttctcacctgctgagagttgaggatgttgcttcaggcatgttcagacttctggaggggagcattgacctgaaaccacagtgggaatgcatcaagtacagagtataaagaaaatctatcaagattggttcaacagcctttggctatgaaagtctcaaggaatgactaataatcagttttgattagtgagaagagagaagcaggaataaatcagctccacacatgtgactcaacctaggatcaagagttccagtttttcccatgtgaatgacttagtttttttttaaatgctattgtggaagaataaatagtgtatgaagactttaaatttttaaatccttgaaaactttataaaatgagaaaagtttgctcatataatgaggaattatattgaaactaaaaatatgtactgctgtaaagaatg

SEQ ID NO: 274684 - DNA, 576 bp, Homo sapiens
gcggagcgcgtctcctgcttctccctgcacccaacgatttccgatatcatatcatataatcatctcaactccaaatatgacgttggcactgttatttccattttacaaatgaagagatgaggttgagaggtatcgtttattatcttggcctataagtacatggaagagttggaattcgaactgagagccaggatatgaacttacaagtgccttgctttagcactgcctgtcccagaaggattgtacctttctgcttctccagaaactaactaaagattttctcacctgctgagagttgaggatgttgcttcaggcatgttcagacttctggaggggagcattgacctgaaaccacagtgggctataacagtaacttccaaaattgaagactgaaccacagcagtcaaacttatcaaccttttgatcaaaaccggtgactaaaaggaatatgaaacctgtgatacagtttcagaaaaccttatttcaaatcttattcatattaacatggccactgtcacatgtgctgaaaattggttgagagaccgtaaataaaatgaactgttattctgcaaaaag

SEQ ID NO: 274685 - DNA, 574 bp, Homo sapiens
aatcatctctccattcaggaactcagcacagctgctaccatgaggagactgcgaggctccacattttcattttgcgctgggcctcacaagtgatgtagccagtgctacagaggccattgggaatcaaaagatgaactttcaggctgtatttggcagatgcatgggcccagtggtgaactctaatgggtaccaaaagcagcattcactagaagatggcctccaggaacccttcagcaacaaaagatcaaagtgccttcaggcttcccaataactgcctacaacagtgaatggccttttctgccattcccaatgagtaagctttaaaaaaaaacagaagatctggcaacattgggccaccttatgttcacctggcaacaatcagctgaaccaagaaatcactgagccctttaaacctcccagctcactaccgtccagcatcttcagtccctatgacattgtatctgccctctttcactcatttggatatccagtggtccctgaaggcatctgaattggtgacctctgtaccaaagatgtgagaaacagtcattaaatatgcagcaacctggaatga

SEQ ID NO: 274686 - DNA, 427 bp, Homo sapiens
agaaacatcacataggctggatggtgaagtgctctaagaatatctattcaaaatgactatgaaaaggttctatctagcatacagttttcaggaagcggatatgagggcacaggggatgggtttggggtcaatgaatgcatgttctcaggcttactaatagatgagaccatggtagatattcccttgagcttccagaaagcacccagcaagttaatgcattcatgccactgtaaactagcatttgagtaaggggtggtccaaacaccctacttatggaggcaaagagcagcagctcatctgcagaccactaggggttgttcgcaatgcaacagaaaccacgtcttatccttgacagggcagccaataggtaatcatgttttacacatgtcattttccaacttcatcttctttcatccttctgtagtat

SEQ ID NO: 274687 - DNA, 498 bp, Homo sapiens
atggacctgaaacttccctcagtatgtcttttaatttttacttttgaaagatagaaatgcttacatatttaaaatatcaagttaaaccagaaaagaaaaaagaaacaagtcttaaaatcaaaaacaaatagaaacaagtgaagaatctaaaattggtataaagatattggcaacataaccacacagagaaaacatttatttgaagggcttttaaacatgatgtcctggctgtatattttagtgggatatattctaaagacaaaaagaacagcaaaaaatattttaaactttactccatagtctttgttgttagtgttggttttataatttcataacaagttaatgtgtattatgaaataaaacaaattagtaaatttgttaatgtttatagaaatcaagattttcagtataagaaaaatggatacaaatataaaagagctaagaaaaatactgtaatattcaatgttaaattcaacattaaatagacattttaaaaca

SEQ ID NO: 274688 - DNA, 401 bp, Homo sapiens
gaatatgtccatcatacttacttggttgagcatcccaaatcccaaaatccaaaatccagaagactccaatgaacacttccttacagcatcatgtcagcactcaaaaagcttcaaattttggagcattctagatttcagtttaggtatagtcaacctgtatactttaaaactagaggacaagggccttccatttagaaggtctgagttcaaactcacttcctctctgtgtagacttggacaactcatttattttttgggttttagtttcccatgtataactagggaacctcatagaaagtagttttggtaatgaactgaaaacatacagaattcaggacagtgctgggaatgaactgggaagggctgacctagcactcagaaggactcagtgattctgagct

SEQ ID NO: 274689 - DNA, 229 bp, Homo sapiens
tggtttattccaaaaaaaagaggtcaatataaaatgatttcaaagagaggaaaaggcagagaagcatctgatggaaagctttctattgtacctgcaagttgccctgtttcaaccaaagaggcttaatttttggcagtgagtgggttgcagtgtagacagcctactcacatcctttaagcctaggttggacatgtggagaattcacagatcctccaccacagagacatgt

SEQ ID NO: 274690 - DNA, 415 bp, Homo sapiens
cacttatgaaaggctcatttcctacattgtttgataaagacccaataaaaactcaacaattttttaaaaatgaagctttactcaactacataaaaattatttcgttttccattgctcatgtagtgcttatgcaattagtgtttattttatattggctctagcagtagaaataaacatggtgacatgaaaacaaaactttaaaaagtaaggatttaacatgtttatttgtaacatgatggactttaatatattcaaatattatataatatgcttcatagtactttttagttcaaaccaatttttagaaatggttataagcatctagagggtaaatttgcagttctcctatactctgtatagcactatatagtgcttttgtgctttttattaaaatctattttgactttataataaa

SEQ ID NO: 274691 - DNA, 477 bp, Homo sapiens
aagcttggaggatggccatcgtgtgctcctgagttctgcaaaggaagaagtgacaaattacatggccagcagcagcttacttgagtgtgacctttgctgacaattctggttcctgccctgtgtcccctggtgtcatttttacaaaccttcctaaattccattaccagatgaacttgcctaaaatctggctttttagacatcacctactgctcagaaacttccagtggctccaggtatccacatcataggatttccgctttcaaaccggatgggtgttcaagactctacactttggtgctatttacttctgcaagcttaagttctactattcccgccatggacctccggcagcatgccctgtacattccatccccctaccttgtccctttcctggccctctactttttaacgtgacacttcctgtcaagtccaaccccttcatgaaagcttcctggacctttccagccctttctaatc

SEQ ID NO: 274692 - DNA, 322 bp, Homo sapiens
aagaggtgggagtacgggcagaaatcagccaggtagaggggaggtggctttccagacaagaccatgggctgagcaaaggccccagatggaggaggaggaggagcggacaggccagtgtggggagggtctgcgtctgctgggagcagagagaagccccatcacaccggctccttccttgggaggccttctcaccttcctagagggagcagcgcccccatcctgctccccccacctccctgcagcctgcacctgcctatcaagaagccttaccccatctcaagcacacacttgggtatacgttggtctctgccaccagctgcag

SEQ ID NO: 274693 - DNA, 723 bp, Homo sapiens
aagcctggaactctgtggtcctgcacctccccctacaccccccaacaaaaattagcctccaatcagctcctggagacaatgttggtgggaaccacaagggttcctgggcatgcccaatctctggcactgaagaggagattcaatcaaaataaatgtatgctgtcgaggccaggctggccatatgttcctgccaggcagttgtcaggaggagatatttgttacattcaaatgtggacacaagctcctacgaaggcaaacacttgtcatttaaagggacatctgaatatggcagcatgtttccagtgataacccaatttcattttacagccttttccttccctttctcttgggctctgggcctccttaccaacacatcctgttggccagcctgctctatcacagcagtatagttgaaaacctaggcacagctttctacccataagtagctttgtaatattcctaggaggaacttcctttctcccttcctctcccacattgcctctttgtccagatgttaacgtggaagcatattgactgcctactttcaagcccttaactctctaatttcactgatttctgtaatagaaagagctattattattaagtttttatcacagagctaaagtttagtttttgcaagtgaatagaccactattctccttcctgtgttagtaactgctttttaaagctcttgtgttctattaaaataacaatataaaatta

SEQ ID NO: 274694 - DNA, 254 bp, Homo sapiens
gtgggactcacatagtgtggtatgattggtttacaaagaagacatttaggttcttgtcgatgttatcagaagaggacaaatggtttcgtatttattattccatgcttcaggggcattggtgggagtgtggaacggaaaatttaaacatcagaaactccattaggggacgttgatgcactgaatggaagtcacaccagcaaattcttctgcggtgagggcggaagtcacaccagcaaatcctgctgtgggggcgg

SEQ ID NO: 274695 - DNA, 404 bp, Homo sapiens
ccaacactaggacactgcagtgtgattttgagcatctgtcgccaaactacacagcctcttggtagtactcacccaataacccttagagagtcccttgttgccttcaagttttgaatagtgagttgcaattagaagaatggattggaatctgtgtatatcactctccacaaagctgagaatgaagcaatcgcctgactatgatctgagctagttttagaaagggaataaaatgaaaataggagttaaaatacttctgtcaaatggtactcactgcacaatccaaaatcaacttgctttttgtaggtaatctctcagatcttacaatttcgattcaccaagtgaaattacatgagaattaggtcttcatatgtttccatccaagaactaaccactttaagtgtttc

SEQ ID NO: 274696 - DNA, 588 bp, Homo sapiens
ggcaggccagttggcttcctggaagctcaggttcttcataaagatgagaatatcaacattaccttagctgaattatgtgaatcaaatgtgaaaatgttttataaaccctaaaattctatttttaaaaccatgaaggaaagactgacaggctatattagataaatattaaatatttctgcttggcgaaagagcaaggcaccaccactatcaaatgataaactagaagaaaatatgtgtaacacatctgaaaaagagttaatgtctttaaagaattccaacaacttgataagcaaaaagaatccaagaaggaaaaaaatgagcaatgaataggagaaatgtgaataaacttaaaatatgcgaaaaggtactcaaccttactggttggcagagatacacaaataaaagatcaattttgccgccaggcgcggtggctcacacctgtaatcccagcactttgggaggccaaggtgggcagatcacgaggtcaggagttcaagagcagcctggccaacatggtgaaacctcatctctattaaaaatacacaaaattagccaggtgtggtggagtgcacctctaatcccagctac

SEQ ID NO: 274697 - DNA, 212 bp, Homo sapiens
gcatcttatcttcatggcatgaaattgtcatttaaattactctttccgtttgaaaggggagggtatccttatttcccttctgaggtactctgagaaggctttgagtttcctttttcatgtattaatgtataacagcctaacagctcctagaagagggtattcttactagaatggctacatacgggtgacttcagttacatacaggtgacttc

SEQ ID NO: 274698 - DNA, 430 bp, Homo sapiens
tgcattttatagacagtcatgaggcatgcaaattggtgtaatgtatgcagaaaaagaaagggaaattttcagtgtgatactacagttagtccactgtatacctagaattgtctttttcagagaaagatggtggcctttggaaaaggtacagatttgggaggaagatcgttaattcaatttgggcatgttatgtccaaactacattaaatacttgagaactatttctttaataatggatgagtgaagtcagttcatttccaagcttcttatttgtcttatctgtgaaagaaaaattgtgatgtctagtacccagatatgtaaaaagtaaatgtaatctaccacattaaagctcaaaatgctcgatgtttttgcaaatataaaataatgtgacttactttaaagataataaattaaatattaaacatggctt

SEQ ID NO: 274699 - DNA, 510 bp, Homo sapiens
cctccataccttttaaaagtgcaatctacttttgctttctacatttaatcactatctgttcttgacttcaactttgcaaacatattttttaaccattctttttcacatttcccttcctactggccttccggatgaactgtcaagtttagcagtcttttctcagtgatcatactttcttcagtgtttgctgttattgtttatactgtctttatctaaatttcttaaaatgacacagacacaagttaggcccattcttcttactgtaaacagatgaaaatgttggataaaatataaaagttttctcttatgtatacagttgatcttgagagagaaagtgcccaggtactagaaacttagaaaaatcagtcaactttaagggaagtgtggccttgggggatttactagagataagattcagtagttggggctgaggttataatgccattcaatgaaaggagacagaactgtgggaactgtgtgcttaaaaaaattaaaaaatgaaaagtgttc

SEQ ID NO: 274700 - DNA, 400 bp, Homo sapiens
tgggcatgcttccacaatttctctaaaagtccctttcctcatctatataaagtggaatcataatccccataccatagaatcgttttgatgtttaaatcaaggatcaaactagctatttaaggacctgttctggggccaggcatggtggctcacacctgtaatccccgcattttgggaggccgaggcaggtggatcacttgaggtcaggagttcgagaccaaccttgccaacatggcaaaaccctgtctctactaaaaatacaaaaattagccaggtgtggtggtgcatgcctgtaatcccagctactcgggaggctgaggcaggagaatcgtttcaatctggaggcagaggttgcagtgaaccgtaatcagcctgagtgagagagcaagactctgtctca

SEQ ID NO: 274701 - DNA, 220 bp, Homo sapiens
cttttaagaagaaaggaagggggaaattgatttaacaggaaatgactgtactcttttttggtggcacctttatgtgccatgtcttatttcatcttcatattgaaccttaaagaaggcagaccatacttttttatatttgtggataaggaaattaaagtggatttggggattttacttggacctctctgactctaaactcaagttatttttactgcagagc

SEQ ID NO: 274702 - DNA, 469 bp, Homo sapiens
ttcaagtggatggccacctctgggcggggatctgcattctgcttattccaggtgttttccaggccacttccccgattatgtaactttgatcaaatccagatgcggcagaatgtttgatagaagaggtcaaatggcatttgagaagaaaagcatttctgtattcatgactttggtttaatttcctgtgtgggcctggtctgccaaagttgtatgctcatggccacgaggttgacgcaccagagggaggcactcaagtgccttttcaggacagcctgaaggaagcctccctccccagcatgctttttcatgttaaattatcaattatgtaagtttagggccaggcgcggtggctcctgcctgtaatcccagcactttgggaggctgaggtgagtagatcacttgagaccaggagttcaagaccagcctggccaacatggcaaaaccccgtctctactgaaaatgaaaaaaa

SEQ ID NO: 274703 - DNA, 535 bp, Homo sapiens
cccttacatacgtggaataaatcccacttggtcatggtgcatacttcttatatattttgaattttgttttcaaatattttgttgaggattttcacatgtaagttcatgacagatattggcctgtagttgtgtgtgtgtgcacacgtgtgcatgcagtcatgctgtcttcggtttgttatcagggtagtgtaatactggcctcataaaatgagttgagagatatattccccctcttctatttttctggaatatcatgtaaagctgatataaattattctttaaatgactggtacagttctccatctgggcctagagatttctgtttgggtagatcattagtagttcaatttctttactggatatagggcttttcgatactcaacttcatcatgggtgagttttggtagtttgtggtttttaagaaattaatccatttcttccaagctgttgaatttataagtgtgaagttgttagtagagatccttttttatttttgatgttggcaaggtctgtaataaagtatttcatttttaaa

SEQ ID NO: 274704 - DNA, 556 bp, Homo sapiens
tgaggaagccggccccctcctacagccctgggtcccacactaaccatgccttgggacttaaaggatgaggggtcgctttgatcagaagagctggagatctgaggctcaagggcaggcctcggttcaaagccagctgcacttaattgactgcaacatttgtccagtctctcaactttctgggcctccttgtttataaaatgggtattcatgaccatccatctcccaaagctgctgtgaggccccagtgagaagacttgctgagtgctaggtaaggggcccttagggagaggtggggtcttgaatcttggctcagggccctctcctggtctctgtcacaaggcctggctcctccctccccttccatcccaggactggccgccatggtccaaggtgagccttcccttccaggctgtgtttctagggaggcgctgactctgcctcaggactatgctcactgtgcaggacagtctctgcacccaagtgaaataacagattcaaagagcctgaggtagagtaggtgctgaataaatgatagttggaattaacatcaataata

SEQ ID NO: 274705 - DNA, 344 bp, Homo sapiens
cgtctcaaaaaaaaaaaaaaaaagaaaaagaaaaagaaaagaaaaaaatcttcttagtattttaaaggtgcaaaatccatttggcaggaaaatacttttacccagaatgtttgcacatagattggagctctcagttgtgccatttatttattagtacctgttcttttgttttgtcatgaaaaaaacatatgtatgagacaaagtataaggttttatgttattaataatataaactattttggctcatgccttaatcccagcagtttggaggccaaggcaggaggattgcttaagtccaggtgtttgagaccaggttggccaaaagaatgaaaccccatctttac

SEQ ID NO: 274706 - DNA, 485 bp, Homo sapiens
taaaggatactaatgagctaggcttatatcttaaaggatatctattgttctcccttcacatccagaggtttaaagaagaactccatgtctcagaacgttataggaggtccaagatttaatttgcatccactttcaccccctcccttaagtcgtcctcaccatatttgtgccttggtcttttgtcataactgttccttctgaaaaatatgctgatatttcttatgtgatctcctttcagaattaactgtgattgttatgttgaatcatatttctgcattctattgatagtatacctataactgattatgctgttatgcataactttagtaagatatttataatacctataacattcataaagactatccctgggtcagctattagaatattactcaatatgttgtggaaagtagatatgcatacgttaagttttgagtcaccaggtgataactttaaactcattgaataaaagctaatatataaca

SEQ ID NO: 274707 - DNA, 382 bp, Homo sapiens
acatactcatttcagctctacaactttttctggaatggagcagcttgtaagaggacatcattaattattctgcatgttctaagatatgtgctatggaatggaagtggatttattttgcagcctgaattaaggtgggatgccctactacctgtatccagaagcttgtacctctcaccttaggggaatggagaacagcttccttacccatgtcctgtcactaaaatagagcaactgagtacagtagtgcccccttgtccatggtggtttcattttccatggttacagttatgcacagccaactgcattcagaaaataacctctttatagactcatcattgagatgccaaattatcacccatgttctctgtacaactggatatta

SEQ ID NO: 274708 - DNA, 431 bp, Homo sapiens
aattaatcataaatgccaatgtttaagaaaatcctacttcagttagaatagtaagggaaatggataagacttcacttttgtggccatctgaaaggaaagttataaataggttcagttggtttaaggagtcaaagaccatcttgagtaattggacctgggaaagacggaagggcattgtaggggatatgtgtgtatcctgtccagggaaacacttgacataacgagaattacccgagcttcaagcagtgagaaaagcaagagatacacagaagaatatttctgagttaacaaaggggtaataagttaagtttggacattcctcctataatattaatgtttcaacaatctggctcatttatttaacactcatactggggacctactttgttccaagtgtgtaggttatagtaggcttttgatggaaaaaatta

SEQ ID NO: 274709 - DNA, 1109 bp, Homo sapiens
gccgggggccaccccgcaagttctcacagcctgagcccagcgctgtcctcaagagacacccgcagcctgagttcttcggtgatctccctcgaaagcctccactccccagctccgcttccgagagctcactgcctgcggccgtggccggcttcagctcccggcacccgctcagccctgggtttggagccgctgggacaccccgctggaggtcaggaggcctggttcacagtggaggggccaggccaggcctcagacccagccatccaccccggcggaggcctctgccccctgccagcagcctgggacaccctccagccaagcccccgctgcccccggggcccgtggatatgcagagctttcggagaccctctgcagcatccatagatctacggaggacccgctcggccgctgggctccacttccaggaccgacagcctgaagacatcccgcaggtcccagatgagatctacgagctgtatgacgatgtggaacccagagatgactccagccccagccccaagggcagaggtttgttggtggcctgcccgagtccctgcaaaacattcggggcaaggccattttctgccatgctcctggtgtaagagcaagtaacattttaggacctgctggctcctgctgggtggaactacataaggggagcccagaggcgaaggaccagtgagaaggctgttgtaggcagaggtgtggcccaggttggcagcaggagatgtgggagcagtgggtgaattcagtaatcaaaagcaggcatcaggccgggtgcagtggctcatgcctgtaatcccagagctttgggagcccgaggcaggaggatcgtttgagccaatcccagggctttgtgaggccaagacaggaggatcccgtaagcccaagattccagaccagtctgggccacagagcgagacctcatctctacaaaaaaacttaaaaatcagccaggtgtgacaagcatctgtagtcccagctatttgggatgctgagacaagaggattgcttgagtccaggaggtcgagactgcagactgcagtgaggctgtgactccaccactgtactccagcctgggcagcaaacaccctgtctcaaaaaaaaaa

SEQ ID NO: 274710 - DNA, 314 bp, Homo sapiens
gaaggagaaggatccccagccacagcagttgccacccatggacccaaagttgctgaagcagctgaggaaggcagagaaggccgagagggagttccggaagaagttcaaggtgaggcctctgagctaagcaggagtcctggcagggcggagaccagggtcccaccgatcccaggctcagaaagaagacaggggcccaagggcggcagcacaagcagaggccctaacatctcgcgccccagtttgaaggggagatcgtggttcacacgaagatgatgatcgaccccaacgctaagacacgtcgcgggggtggcaag

SEQ ID NO: 274711 - DNA, 1101 bp, Homo sapiens
gccgggggccaccccgcaagttctcacagcctgagcccagcgctgtcctcaagagacacccgcagcctgagttcttcggtgatctccctcgaaagcctccactccccagctccgcttccgagagctcactgcctgcggccgtggccggcttcagctcccggcacccgctcagccctgggtttggagccgctgggacaccccgctggaggtcaggaggcctggttcacagtggaggggccaggccaggcctcagacccagccatccaccccggcggaggcctctgccccctgccagcagcctgggacaccctccagccaagcccccgctgcccccggggcccgtggatatgcagagctttcggagaccctctgcagcatccatagatctacggaggacccgctcggccgctgggctccacttccaggaccgacagcctgaagacatcccgcaggtcccagatgagatctacgagctgtatgacgatgtggaacccagagatgactccagccccagccccaagggcagagatgaagcgccctcagttcagcaagccgccaggaggccaccacaagacccagcgctcaggaaggagaaggatccccagccacagcagttgccacccatggacccaaagttgctgaagcagctgaggaaggcagagaaggccgagagggagttccggaagaagttcaagtttgaaggggagatcgtggttcacacgaagatgatgatcgaccccaacgctaagacacgtcgcgggggtggcaagcacctcgggatccggcgcggggagatcctggaggtgatcgagttcaccagcaatgaggagatgctgtgccgggaccccaaaggcaaatatggctacgtgcccagaacagcgctcctgcccctggagacggaggtgtacgatgatgtcgacttctgcgatcccctggaaaaccaaccactccccctgggacggtaagaccggtaggcgtggggccaggacagccagccagcccagcgcccgctcacccaggagccctggatcccggcgcgggaaagtcacagagctgcctgggcttgtacctggccacataaagccccagtttaaagcaatc

SEQ ID NO: 274712 - DNA, 426 bp, Homo sapiens
catggaaggtggctctgtaggattactaaacattttgagaaaaatcacatttcaacttcacctttgtaagaggttgtgctgggcttcctttccaaatgaaatgcggtgtgacagaaaatagactcatgtagctctctttagtgggatagctttctttctcaacatcaactaacacatctcctaggtgtccttaaagtttcaacctataaatattctacctcattaagcataaggaccagccatggacatatgccgctagtgtccactttccttcagagatttagggtgatgagaagataaagggtctgcttaccagatggagcttgtcagattagcaattggagcagagtaaatatcgctgtcatattgttgttttgaagcacaaagaaccccttttgtataacgcatgtgcatatttaatagttt

SEQ ID NO: 274713 - DNA, 801 bp, Homo sapiens
ctacatgctcggagagttcacttagctatttagggatccagagtctttccaaggttgaccttggaagctctgatcactttcgtattttgagaaggggaaggcggagaaggaggaggatatgggtacagaaggaagggaagaaagaggaggaggaaaaaaaaataatgctgatgggtgctacaaagctttaaatattcacatgtaataaaataatgttagcatataaatataccatcccatctgtataattacaacatttacaagataactgcagagtttactgaaaatattcattgatggtgtgttgtagacactctggatgaagaatgggacatggatttcaagttgtgtgataaacatctactttcagtcctattagtgcctttacttcatttgcaggacatatttgaatttcaaacttaacatcttgtgtaaatatgagactggggccaaagacccagctttttccactcattctcctttctcctgtgacaggcgctggacacatccaccctctccccttattctgtctttaggttccattgtaggtaaatctgttcactacatgtgattcttgatcctcaacttgtgacaagctaaaagcttagattacttgcagctccacatttcagaaaactgcactttgcctccatcaggtattcccttcatttcccatggatggtcactgtggccagcagcattttaatgtcttgatgcctaggagatacaggggctagtgtgtggtctggcctctgtgtgactagggagtaactgaaatctacaagtttgcatatatacaaa

SEQ ID NO: 274714 - DNA, 333 bp, Homo sapiens
ccagtcaggtcaggcaccagtgcccacgctcggtttagttgctgctgcttgtccactcgggtgtgggccctccatggctgacatggccattgcactggcttgagccagactgcatgaagagggggactgggggcggggctccctgtctcctggcctctgcttgagccacagctctgccctacgagctgggtcgttcaccgtctttgagcttgagtccccattctctggctgggatctggtccttgctttccagggctgtggcaaggcctgaaagccctcagtgccatctgggcatctgtgtcccctgacacccatgctggagagcctcagtgg

SEQ ID NO: 274715 - DNA, 366 bp, Homo sapiens
gatacaaagaatgtgctcttaagactgttttaaaatccaatatgtatccatcagtggatgcatgggtaaacaaaatgtgatatgttcatacaatggaatagcatttgtccataaaaaggagtgaagtggccgggcacagtggttcatgcctataatcccagcactttgggaggccaaggcgggtggatcacgaggtcaggagttcaagaccagcctggccaagatggtgaaaccccatctctactaaaactacaaaaattagctgggcgtggtggcgggtgcctgtaatcccagctacttgggaggctgaggcaggagaattgcttgaacccggaaggcagaggttgcagtgagccgagattgcgc

SEQ ID NO: 274716 - DNA, 487 bp, Homo sapiens
cactttctacctcagatcagaggtcaatgagcaggcatttattaagatcctgcatgctcatctttcttacctcccttcttagaatctaagctctatgagtctacatctcacaaatcctagctaactgcagaccctgaaatattcacacattatcttgatagttttaaaaatgtatctattacattagaccaaaaaaaaaaacccaagcctggcgcagtggctcacgcctgtaatcccaacactttgggaagttgaggcggtcagatcacttgagcccaggagtttgagaccagcctgggcaacatggcaaaatcctgtgtctactaaaaacacaaaaattagctaggcatggtggcgcacatctgtagtcccagctactcaggaggctgaggtgggagaatcacctgagccagggaggtcatggctgcagtgagccatgattgtgctactgcatcccagcctgtgtgacagagtgaaaccctgtctc

SEQ ID NO: 274717 - DNA, 369 bp, Homo sapiens
aatttggaagatgattagggcatgaaggtggagccctcatgaatgggattagtgttcttataaaaaagatcccaggccaggcacggtgcctcatgcctgaaatcatagcactttgggaggctgaggcagccagatcataaggtcatgagttcgagaccagcctgaccaacatggtgaaacccagtctctactaaaaatacaaaaattagccaggcgtggtggtgtgcgcctgtaatcccagccactcaggaggctgaggcagaagaatcgtttgaacccaggaggcagaggttgcagtaagcagagattgtgcctctgaactccagcctgggcaacagagcgagactttgtctcaaaaaagaaaagaaa

SEQ ID NO: 274718 - DNA, 668 bp, Homo sapiens
gaatttaaagacagaaatagcaactactcaacatgaaatagaaaaaaaggaattttttaaaaatggaaaagagcatcagtgagctgtggggcaatttcaaacagtttaatatacatttgactggaatatctgaaggagaagagagggggtggaagagaaaaattagttagaaaataatggctgaaaaatatccaaatttgatgaaaagagtatagtcacagatccaaaaagctcaatgaacaccaaacataagaatcatgaagaaaaccacacaaaggctcatcataatgaaattgttgaaaccagtggtaaatagaaagccttaaaagcagccagagaaaaaaggcacattatatacacaggaataaagaaaaagataacagtggtttttttgtcagaaacagtgcaaatgggaagacagtgaagcaacatatttaaagtactgaaagaaaaaaagtccatttagaattctatacctagtacaaatatctttcaaaaacaaagacaaaaataaagactactttagacatataaaagctgaaatatttcatcaccagcagatctgtgctacaagaaacactaaagaaaatccttcagacgccgggtgcggtggctcacgcctgtaatcccagcactttgggaggctgaggcgggcggatcacgatgtc

SEQ ID NO: 274719 - DNA, 439 bp, Homo sapiens
tcagcccactttctctctgtcttgtctccaccagtgctctgtggatcctcatctccttggtcaaagccaggtcatgggcaccttatggctacacttcagaagcggaaaagagcatgaagtgtgtgctgcttatgtgtccatgcctggaagtgggccacaccgcttctgctcactcttagagcttttagagcagggtggctatttaagcacagttatgaattcaaagcatccagggaatatacaaatagaaaaaaataagaataggtaacttaaggataccatttaggactttagattaagccaacttaaggaatgcaggacaaactaagaggtcagtgcatttgaaagcatataaacagtaggtttattaataaatataaaaactatctatttgaaaaggcagattaaataggcaaatgtctgccaagtattttggcaa

SEQ ID NO: 274720 - DNA, 383 bp, Homo sapiens
aaatatctttcaagttattactggtatttgaaatttcaagtttagaaattcatttctttttaactcaaagtgcaaatttcatataatgattatgatggttttagtgtccatatttttgtgacttcacttatcatctctttcagcagtagctacccacagtcagctcctagtaaaatggctacaggaaaactgaaagaaaagtttaagcctgagtaggcatagagtaaaaaatgcataatgatgcattattaatataagagtaaggctttttttattttgagtatcctaactccaaacctagtgttcttttcactccattatcctgctgtttatagcaaatcaagacccataatgatacgtctttcatttatttcagttctgcc

SEQ ID NO: 274721 - DNA, 386 bp, Homo sapiens
tacattagaaaatttgaatttattttcttatgctttctcatggaggagacagggatcttgtccctaaacaaggaaagatagctccattcaatcctgcccactggtttgagggaattttaaaaaaatgtatatttgtattttaaattgtggagaaaatacatgtaatatgaaagctattagtgacattgagtacattcagaatgttgtacagccatcacgactaactagttctagaacattttcatcaccaccaaaggaaatcccattccagtaaccagtcactgcccattttcccccattcccttcccctggcaaccactaatctttctgtctcaatgggctttctgactctgaatatttcctataaatggaatcatataatatgt

SEQ ID NO: 274722 - DNA, 324 bp, Homo sapiens
ttctttttgagacagtctcgctctgtcgccgtccagtggcacgatctcggctcactacaacctccgggttcaagcgattctcgtgcctcagccacccggctagctgggattacaggcgcgcgccattactcccggctaatttatttcgtatttttagtggagacggggtttcgccaaggcggccaggctggtctcgaacttcggacttcaggtgatccgtccgactcggcgtcccagaattctgagattacaggcgtgagccaccgtgcccggccttgatttgaatataaaggttccaacactcccaaacacaaggtgacccca

SEQ ID NO: 274723 - DNA, 396 bp, Homo sapiens
aaattgggtgactggcccataggctatagtttgcctactcttggtctaggcatgtgaagaaactgtaatagaatattaagtcaggataaaatgatggcatgctcctgtcttggtgaattttctctattaatacgttcaagattacttcatatgagttttgtcagtttgcttagagttttgccggaattattaaatccatttttatttccttgaacttaattattaaatgcaattattgtcaccagttgtcagattatgttatggtacattttttaaaagttaatttttattgtttttaaaatcaccaattaatagtgtccttttaaatttttttatgagttgaatgtatgcctctcgccttagctttattttaataaatatatccttaaaatcaga

SEQ ID NO: 274724 - DNA, 455 bp, Homo sapiens
cgacacactgagcaaatgtttttgccagcagaaagatataggtgggttcaccgtggcgcaggtgagggagaggaagctgtgcacagtaagcgcactttctcttctccagacatcctggtgccacagtagttcccattctctctcctcttctgtaacttctaagacctttgccttaagtgaatggatcctcctaagacagccataactgcatttatttacgtccctgctctttgacttgaaaagttcaccctttcttggagagagagacttggaaaagagaggcatgaagggtctcaagccctggcaattctgcctcagtgaatccgacttctacctccacagtgaaatctccctagctagttgaggggcagcagtattaattgttccttcctaagagttgtcaagcaaatcaacctgagaactggaatccacccaagacacacctatgcctttta

SEQ ID NO: 274725 - DNA, 455 bp, Homo sapiens
gtacaatgctattaaccaaattacagctttcatttgaattttgcccatttttccaatattgttcttttcctgctacagcatccaatctaggacctcatgttgcatttatttcttatgcatctttagtcccctaggatttgtgacggttttctgtcttttttcttttgaagactgttcattgcctctgttagtttaatgatcctctgagatgttattcacagtaaaatagcatgtgaatttcacctaactaaaaagtttatttgatccaaagccctgattttaagaatttgaaagaaaaaaatgactctatttttcccagttctaaacattttactagaataataattgtattctttcaacatggaattaatgttgatgagaagcaaacatctaaatttaaaagaaaatatagtttgttgagggaggtaatagacaataaaatgtatttattatag

SEQ ID NO: 274726 - DNA, 324 bp, Homo sapiens
aaagtcccttttagcataacattcccaaattctgggaattaggacatagaaatctttggtggaccattattcagtttaccgcacccacctttattactttagttttgattatagccacaaacccaccacactaaaaagttataatgacacgagtttatatctgtatctatgctatacctcctacacacaataacacacacccctgccttcgcttggggtaaccatctttctgaatcctgtctttactatttattgctttccttctacaaggttttattccacatgtacatagtcctaaaaatcatatgtatatacatgtatatt

SEQ ID NO: 274727 - DNA, 502 bp, Homo sapiens
aaatggtacttgaatttaatcagatacaagaaaaatgtgtacagaattgtgactgtacaccatgttatagggaaatacagacaaggaaaatattacattgagcatggagtacatgacctttagtaacagcatgggaaatttcctggttacatgaaactatttagacatatcaagaaaagccacgaatatagaatcaagttatactggagaaaagcattccatttctaggcctttaagataaacatttcattatctgaccacaacaaaagttggaaccagagaaaaatagttacaggagctgatgaaaaggttgaagaagagagttagcaccccaaccaagcaaaaagatacatgatttcaagagaagaaaaagaagacaacaatgtataatttgcaaattacatgcagtaaagtagaacaaaagttgaatttctgagatacatgtgagaaatttcaaaaagaaacatttccaaattaaaaattaatacctcgtgcaatataa

SEQ ID NO: 274728 - DNA, 180 bp, Homo sapiens
cgacagagcaagactccatctcaaaacaacaacaacaacaacaaacaaaaaactaggcccagcaaggggagagacttgctggggtcctgcagcagtgcagtgggtgagactggccagcttgggctgggctggctttgaactcaggtccatgtaacgcattgatgattgtcctgaccagca

SEQ ID NO: 274729 - DNA, 319 bp, Homo sapiens
ttgaggctgcagtgagctatgattgcaccactgcactccagcctgagcagcagagtgaggccccctcccccaatctcttaaaaaaatacaataatcaacactggtgagctcaccattcaataactataactcagccgggtgtgctggctcatgcctgtaatcccaacactttgggaagctgaggcaggcagatcacttgaggccaggagtttgagaccagcctggccaacatggtgaaaccccatctctactaagaatacaacagttagctgggtgtggtggcaacatgcctgtaatcccaggtactcaagagcaagag

SEQ ID NO: 274730 - DNA, 375 bp, Homo sapiens
  misc_feature (331)..(331): n is a, c, g, or t
ctggaggtgcatactgggtgctgttgaagtatgcaagaggccacctcactcaaaggaagggcttagggagggattatggaagcagtcaattctgatcagagacttcgaggcagctcttacataaatgagccagaagtgggtgtgtcctcccttggtttcccaagctctgggaccttgctcccagctgtgctgtcgccccactaccttacatgctacttgcctctgacaactctttcattcatgatgtgaatatggggaatgacctgagagccacactcagctcctcaagggcagcccagcttggggctcacgcctgtaatcccagcacttngggagtccaaggcaggtgggtcagttgaggtcaggagttcaaga

SEQ ID NO: 274731 - DNA, 310 bp, Homo sapiens
ggtcttggataagtaaatttaattttttgagcttcaacttctgcatcagtaaaatagaaataagacattcttcacaagattattatgaagattaagaatccacttaaagcatatagcatagtgtttggtacacaataagtacatattaaatgtctgttgaatctgtgactaataacttgttgctgccttctctgtgatcttcacaacagccctttggagacgtctaccatgctacttttatctcccgaaaactaaaatttacttatccaagaccacgtttgtcgacgcggccgcgaatttagtagtagta

SEQ ID NO: 274732 - DNA, 497 bp, Homo sapiens
gagagcaagtgaaagagaaagaccaagaggcattatacaagcacagggtgaaatcgtgtgccttaggttatagctggctgaacagaataaaagagtagtaacaataaaagccaacatttgttggatactcatcatatgcgtggtggaatgttaagtgctgattatgtgattatgtaacatttcatttaatcctctttgaaaaaagaaaaaaatatgcagtttccctacaactactaaaatttgatacctagatgagattttttcagattttcttcctgcaactaaatgtctagagataacttttaatatacatggcattctttttcagtacctaccatggtgccaattcattgaccaaataaacatgctagacatttttaaaggagaagctgaaacattctaaaaaactagaatactatagaacaaaatggccaggtaactgcagattcttcaaacttcttttccctttaagtgagttatgcaatctaaaaattaaa

SEQ ID NO: 274733 - DNA, 504 bp, Homo sapiens
gtctagagtataccaggacttgcttcctgcacttcctgttttactgagaaaatggaagcaatgggaagaaaacttcgatgagttcttaccccctcttcacctcacctatatgaaggtgttatcccctctgtggccacatattctgcctgcctcctattaattgtgcatgacctgtccatgttcctatctaaggcacatccctctagtgcccaaggctcagggtcccctcccacccacagctccggattcagatggccagcattggagtgtgcgaacccaggggctctctggctctcattagcagggggctcctcgaatgtgttcctgagaacacctgttctgtaagaagctccttggggaagagaagggttccctgtcaaaagagtttgggaagtgctgggttaaaccacgttagaaatggaattctaggccgggcgtggtggctcacacctgtaatcccagcactttgggaggccgaggagggcagatcacgaggtcgggagt

SEQ ID NO: 274734 - DNA, 435 bp, Homo sapiens
ctgcatgaactcagttgggggagagtcgtgatcagttggcttgctcagagatgactaagcagaaaaggtggtgtggaactgtgccctagcggatgggaaagaagggcagacatggtaggggccagagtaagaaccaggtcaaaatccgcccagcaaattttaccccctctcttcttcacctctcctttataacactgtccaattggtcaacaactcttcctttataagtctcttgaaaggcaccaaaacccccttttgggtgcatctctgctaacaccctggtctaagaccacactgcctcctaaacagaaagctgaaaaatcaatcctagttgtttttctagctgcactatttagtatggtgcctaataatcttcctcaaaacaccttttctactatgtttatttctagaaggaaggaaggaaggagaaaaaaa

SEQ ID NO: 274735 - DNA, 396 bp, Homo sapiens
gccaggattggttcttctgggtataagtcatgaggggattcaacctgcacctggaaagaaggtatcaagctagggatggggagaaattacccagggcaatccagtgctggggattacacaatgaaaagtcccttagacagcagtgtggtggatacttccaccaacattcattcagtaaatatcttctggtgacctggtatggatcttttaattctgaggcaatcacagagatggcaggtcaccagtagtttctaactgaaggtggtagtaactggcaatgcattgctttaggactgtaggcattacagctatttttttcaatatgaactttataatgtagaactaagaccccagaaaaacctcatagatataaaattttcctctctagctattgat

SEQ ID NO: 274736 - DNA, 360 bp, Homo sapiens
tatgtagggcagaaactgtggcgtgtctgccactccctggctctgaagtttgtgagaaggaatcatgattgagtcaagctcgacctggcaggacctccaggatttcaaaaaataagtaattaaattcaccccaaaaggaaaaggataaagattgaactggaagaaaagttgtctctgggtgctaccataaaataccaggattctgtttagagagactttcaaatacttccttgggaaaagcctaacagggacaaaaattcacaatcttccctcactatcttcattttctaagggaggaaaattcttcatgttacagctcctaggtttcctttgttgtagagaacccacaaggagaaatta

SEQ ID NO: 274737 - DNA, 535 bp, Homo sapiens
agaaggccaaggggaagaaggtggctccggcccctgcggtcatgaagaagcaggaggccaagaaagtggtgaatcccctgtttgagaaaaggcctaagaattttggcattggacaggacatccaacccaaaagagacctcgcccaccttgtgaaacggccctgctatatcaggttgcagcggcagagagccatcctctgtaagcggctgaaagtgcctcctgcgattgaccagttcgcccaggccctggactgccaaacagctactcagctgcttaagctggcccacaagtacagactaaagacaaagcaagagaaggggcagaggctgttggccccagctgagaagaaagctgccggcaaaggggacgtccccactaagagaccacctgtccttccagccggagttaacaccgtcaccaccttggtggagaacatgaaagctcagctggtggtgattgcacacgacgtggatcccatcgagctggttacctttctgcctgccctgtgtcgtaaaatgggggtcccttactgcat

SEQ ID NO: 274738 - DNA, 367 bp, Homo sapiens
tgtggggtcttgcagagcaaacagagctgagctgaaggcctcacctaccccccagtccctgcacagcacacgtgtcacatggccttgtgcattccccaaagtaagcgatgcccatgccacggtcttccacacatctgaaatgcaccatccttctaggtgaattttagttttatttcctctacctcccgcccagcaatccccaagcaggtgtgaagcccttgatttagtgtgttatttttgttgttctgtgttagtaggccatttctcttgtgcatcaaatgtttattgagcacctactatgtgtttggcagttggatgctggggtggatactagaaaaacaatagcaaaaagagggtctagatgtga

SEQ ID NO: 274739 - DNA, 229 bp, Homo sapiens
attcatctctctatcggcaaacctgttctactgcatgagctttcctctgtgggggtcttagggaataacagtacctttccccattttgtgggttgaattgaaagctaagagagaggcctgaaacagatccttccttagtgccttcagaaggtgcatgactctgctgacaccttgattttaaacttctggcctccagaactgtgaaacaataaatgactgttgttctaag

SEQ ID NO: 274740 - DNA, 324 bp, Homo sapiens
atttttcaaaatcattaaaaaaaattctcattagaggataaaagaacaaatactgagagaatcctaaagaatctacgtcttcttgttgtgactgattctcaagcaaaggaaaaggaattttaaataaaggatttctgttggatttctagccttatagaagaaacattttccaaaatgctgatatgttttaatttaatgatgtgctatttggggtccattttttgtacattcatcatgattctaaaactgagtttggatgaaaagcatgtagtgcttgccttgttcttacatcagaagaattttttcttttgtccattttatgct

SEQ ID NO: 274741 - DNA, 233 bp, Homo sapiens
ttattgtgcaatatcattatcacatcccaaaagcaaacaaattattttttctgaactgcattagtgcttcttctccattcagtcgaataattgagttaatgttgcaatacctcaatatttattgagattgcctcaacttgcagggaggccatcgactgtttgaagccccagattgcattgagcatgttaataaggaacagagcaaaagagaaatattgacaaaacaaaaataa

SEQ ID NO: 274742 - DNA, 666 bp, Homo sapiens
ttacaaatgtatagttatactaacattaaaagagagaatgggctgggcatggtggctcatgcctgtaatcccagcactttgggaggctgaggtgggcggatcatgaggtaaggagttcgagagcagcctggccaacatggtgaaaccgtgtctctacaaaaaaatagaaaaaaaatccctgcatggtggtgagcacctgtagtcccagttactcaggaggctgaggcatgagaatcgcttaaacctccgaggcggaggctgcaatgagctgagatggtaccactgcactccagcctgggtgacagagctgggtggtggctcaagatatgttttgtaaacctgaagatttgagatcatataagccaaatagaaacttaattggcattcataacttttggttctagagactccatgatcaactaagagccaccaagcatttcccatgtagactattttgaccatgctgactctactgacactgtggttactgaattcattttatctctagaaattaattcttactaatggatgtctgtcactgtaagatccttctatcctctgaaataaggagaacattttaacttcagtagtttaaactagtgtcctaaactatagcattcaaaatgagataatatgctaaagtaatacacaaaccaaaaatcccag

SEQ ID NO: 274743 - DNA, 389 bp, Homo sapiens
aaaaaaactgcaattatttataaaaatactttatctatattttgtatgttgtataagaaagtattttcttcttttagaaagaagccatggccaggcaccgtggctcacacctatcacacctgtaatcccagcactttgggaggcctaggcgggcggatcatgaggtcaggagatcgagaccatcctggctaacacggtgaaaccctgtctctactaaaaatacaaaaaattagctgggcatagtggcgggcgcctgtagtcccagctacttgggaggctgaggcaggagaatggtgtgaacccaggaggtggagcttgcagtgagctgagatcacaccactgcactccagcctgggcgacagagcaagactccacaagactctgtctca

SEQ ID NO: 274744 - DNA, 464 bp, Homo sapiens
acacttggaagaagagaacgacactgggtgattttcctgtttcggccttttatccaatggcaggcccccgccagggatctaaaactctgttaggaaacctgcagtcttactggcctgaggaaccagaggccagagttcgggacaaacagcctctggaaagtgaggaagaaaatcctgaaaaggagagccccaagttcgtcgcatgaacttagaaatttctggctgacaactgaaccgtgtatacttaggccagactccaagcagcccagccaaggctaaaagcattgactgacaggactttacagatagtggtttgcagggcttagctgaccgaccctcttcctactgaaggaaattacttgtatataaaccacacaacacaaagtctctgaaaatttccccagaagcatacaacaaataaacattcattcaggaaaatccactactaagtcttagaaagaaca

SEQ ID NO: 274745 - DNA, 558 bp, Homo sapiens
tacggtagagcagaaaggctcatcatctatgtcctggggcagatgcagagagcgtcggcaaggtgaggagggcgtgaggtttgctcgcggcaccccaacacgaacaggctcagacggtgcatctccctcagaggacctcactttcatgcaaaaacatcagactacgcgacgagctcccagtatccctgagccacccactcggaaccctcagtccatctgcatgtgtgaccctgaggtgcagacagatgcaggcaggctgaggtgggtgctgaccctcgctggccagaccaaaccctcccggggtcagttttctcctccacagaggtctgtccagctcaaaggtgcccctgagctctctgcagcccaaggcttcaggctatttctaacatttaaacatgaagaaagatgaggaagtttgcccctggtggaaatctgagaccccacacagaccctagatccatgagtaagggtggaaagaaaattccatgtatgcattttctctttctagccttaagtcaatgcagatttttgaaaactgcccttgaaatgaaatggaaa

SEQ ID NO: 274746 - DNA, 339 bp, Homo sapiens
tagagatagtgtttcgccatattgcctaggctgatattgaactcctggattcaaacagtccacctgcctcagcctcccaaaatgctgggattgcatgggattacagatatgtgccaccacacccagcctccagtgcttcttactattttcctgttagcttttacaagatggcttacctcttacttcaccaagaaagtaggggcaatctggagggaactccctttgctcctgctaggcacccttatcgctcctcaatatttagaaatgttacccataactatccttcttttcctgtctcctgttaaagcttcgctttcatccccttctgtcgtcttctcg

SEQ ID NO: 274747 - DNA, 315 bp, Homo sapiens
atttatattgtattaggttttctatgtaatctacagatgatttaaagtatatgggaagatgcatgtaggttacatgcaaacacgacaccatttcatataaggcacttgcgcgtctgcggattttggtatctcagggaggtcctggaatctatcctccatggatactgagggactatactaacaaggtctttgttggaataagattcatggaaaagtttttatctcaaatggttttattcatttctcacaaccctttgagtagacttctcctcccagccaaaatggagtgaaagggactggtctgccctcccacct

SEQ ID NO: 274748 - DNA, 444 bp, Homo sapiens
gggcgatctagaggatcccagcgcgagcttccatcaatacaaggagtgttttatcacaaacttcatcagtggccgaaaactcattcacgtcaactgctcaaacctccctcagatggggataacaaactttgaggacatgaaggcaatttctcggcatacgcaggagctcctggaaattgaagagccattattcaaacgctccatcagccttccctatagggatattatcggcttatatttagagcaaaaaggtcatactgggataaaatctgattccttgactttatctgaatttgtcaaagcagcaggattacaggattatgctccagaaataactgcccctgaagagaatgaggaattaccttgcactgaaccataggggaaatccacttcacagagcttgaaagatcaaactaaattacttgatggaagaggtatggtctt

SEQ ID NO: 274749 - DNA, 755 bp, Homo sapiens
agcggtgtgttgctccttgtggcaggtatactgttccaatgccctgggatctctgtagtggtcggtactgtattgattataaatggtgaagtcctagtatcttgctagagtgagctggccaggatggtggagctctaccaccatttcacaggttatagacaggggccaccaggtttcaggaaagcagcaatgacccctcagtaatagttggaaagtgtgatatgacactgagcttcactgtgttggtgaagaagaggtgaggaaaataaaagctgcagtttgcctccacctctgaagaagcacaatacacctttctgggttaccaatgggatacttcccaacagctttgtcatcacatacaatattctcaaacaagatcttaatggcatctactttctccaggaacacagcccctgacctgtgcgtgtttgcgtagagaaggcatgctatgtaccccctaggatatgaaagagaggatccatttgcttcaaagagcccatcagcaagctgtccttcctgttttatcacaagattcctgtagcagattgagctctggcagttgatctcagtggcttgatagagtgtcattataaaaacgcacctggaagattctgtggaaaagacaacctcagaagaccaagaggctgactttgcaagagagagtccgtttaccacttagaaccgtgaacaccacccccgccctcatttatctccagacttgaactagtggttaaatcccaacatgtcccagagaa

SEQ ID NO: 274750 - DNA, 590 bp, Homo sapiens
agcggtgtgttgctccttgtggcaggtatactgttccaatgccctgggatctctgtagtggtcggtactgtattgattataaatggtgaagtcctagtatcttgctagagtgagctggccaggatggtggagctctaccaccatttcacaggttatagacaggggccaccaggtttcaggaaagcagcaatgacccctcagtaatagttggaaagtgtgatatgacactgagcttcactgtgttggtgaagaagaggtgaggaaaataaaagctgcagtttgcctccacctctgaagaagcacaatacacctttctgggttaccaatgggatacttcccaacagctttgtcatcacatacaatattctcaaacaagatcttaatggcatctactttctccaggaacacagcccctgacctgtgcgtgtttgcgtagagaaggcatgctatgtaccccctaggatatagctttagcctgcatctcacacgctccagtttgaagcacgtgtcctgtcctctctcggtgtgcctggcttcattaaggaatcctcatttttgtagcactcattaaaactgacaacttatttgga

SEQ ID NO: 274751 - DNA, 315 bp, Homo sapiens
caggtttcaccatgttggccagaatggtctcgatctcttgaccttgtgatccacccgccttggcctcccaaagtgctaggatttcaggtgtgagccactgtacccggccaattttttgcatttttagtagagacggggtttcaccattttggccgggctggtcttgaacttgggacctcaggtaatccaccccccttggcctcccaaagtgctgggactgcaggcgtgagccattatgcccggtcagccctgatctatagttatgtttttgctgttttagttggaagtacttccaggccaggcttagtggttcac

SEQ ID NO: 274752 - DNA, 834 bp, Homo sapiens
tcacagttctggaggctgggaaggtcaagagcatgatgctgacatctggcatgtgtcatcccatgatagaaggtggaagggcaagaaagcatgcaagacagaaaaggagaccagactcctgtaacccactcctgcaataacagcattaatccattcatgagggcagagccctcatgacctaattacctcttaaaggtcctgcctcttaataccatcacaatggtaattcagtttcaacatgagttttggaggagagattcaaaaccatagcacttttgatatgcaagctaactaatccagagccatatctcccctgtctggcctttatatctcaggaggcaatggtcctctgctttgatcgtcccagggtcaggtactaggcaaccagggacctacctctcctgtgtcttagagcctgccaaaattattcaaactagccaattctagactattcaccctgccctgtcttgcctttcctatggaaactccaataataggctctggcctaaaccttcccctcattcccatcttctgccttctgaccatcctagtgtcttttctgtgtggctctgcatggcctgctgtacctcttgtctctaggacctgcaagtataataaactttatttttttcctgagtctctaccttcttttaatggctacacccaactgactatctcataaaaagaatatgaaacaggatggagatccaaatatgtcctccactgacattgttgggcggggatgtgctctttaacactgggctgtcccaagccttttctgatggtactgctgatttggaagagagttgtcttattatagcctggtgagtgtgg

SEQ ID NO: 274753 - DNA, 398 bp, Homo sapiens
tttcacttccggaggtatgctaggcttgtacctctctgcccatgtgttagtcagctcaggcttccagaatagaataccacagactgtgtgtgccttaaacaacagaaatttatttcctcacagttctggaggctggaagcccaagatcaacaaggtgcaggtagtgtcatttctggtgagggctcttttcctggcttatagacggctgccttctcaccatgtcctcacatccctttcctctgtccacacactcctgggggcccttattctaagtcataataacttaacctgtcccgagtaatgcagcctccataataaatatcattatcttgcttgagtttcttcatgtttataatttttaaaaatcatataacatttcaaagagttaaggtttcact

SEQ ID NO: 274754 - DNA, 528 bp, Homo sapiens
ccttccgacgaaaatgacccgagaaattgtcccacatgcagccacgtaccttccaatgagaacaacccgagaaatcatcccacacacggccacataccttccaacgagaacaaccagtaccttccgatgagaacaaccaggtaccttccgatgagaacaacccgagaaatcattccacacatgcaaccaggtaccttctgacaacaacgacccaagaaatcgtcccacacgcagccaggtaccttccaacgaggacaaccaggtgtcttccgacaagaacaaccaggcaccttccaacgagaacaaccaggtaccttccgacgagaatgacccaagaaattgtcccacacgtggcctggtaccttccgacaaaggctctgagaccattcaatgggaagaggacagccttttcagcaaatggtactgggaaagctttatctccacatgcaaaataatgaatgaagctggccccttacctaacagcatatacaaaaattaacccaaaaaacataggatgaaacacctaaa

SEQ ID NO: 274755 - DNA, 238 bp, Homo sapiens
gctgagtgtggtggtaggagcctgtaatcccagctagtcaggaggctgaggcaggagaattgcttgaacccaggaggcggaggttgcagtgagctgagatcgtaccactgcactctagcctgggcaacagagcgagactccatctcaaaaacaaaaaaaaccctcgtcctacataaaacaggaagtctcccctggtgccaggcctgctaatgatcgatgccagaagcaacttctatgt

SEQ ID NO: 274756 - DNA, 297 bp, Homo sapiens
ttttttttttggggggggctaagatctataattaaaatcattctcacttcactttctctcaaatctattgtaactaatttttctcccactgaaagaacaatacatggtattgtcttttgtgtcggggttaaaaatggttcctttgtcattttattcctttgtgtaattggaatataaaaacttttctttatgcaatgcaacctgacacttaaacttgtttaggaaaatatataatgggttatgcttattttaaattgccttgtgtttattactgttcgggaatgttttacttcatga

SEQ ID NO: 274757 - DNA, 712 bp, Homo sapiens
tgcaacattcaaggaaaactgaaaaagccagagtagttagcacagagcaaggcagcagagagtggcgagagagaaggacagggacatattggggcccactatgggctgagaagttctcagatgggtaagggtggagggaacgggggctaagcattgacggtgttggtggggagaagtggtggtccccctttgggaataattttaaggtagaaatgatagtatttgctgtgcagtatgagaaagagggaaaccaggggtgacttcaaggtttggggccagaagaattcaaagaatggacctgcctaactaactacaatgggtgaaagaccatgggatgggcaggtgtagtgggggagataaggattttgttttggaaacgctctagacttacctatgacacatccaaatggagatgtcgaaatgtgatgctggacatgagtcctgagttcaagaagctatgtgggctcaggatgtaaatacataaaatatgtcatactgattcccacttacccagtccctctgtaactagatctcatgagttggaatgctgcaaccctccatgggctcctttatcttaaaaaaagagatgtagcagccgggtgcggtggctcacgcctgtaatcccagcactttgggaggccgaggcgggcagatcacgaggtcaggagatggagaccatcctggccaacatggtgaaaccccgtctgtacta

SEQ ID NO: 274758 - DNA, 497 bp, Homo sapiens
ctactggagagagttaatcaggcatcatagctcacagttctccataatgcatatttcagggaacaccaaggctagtcacccttgactgctgcggtttttaaaaatgtgtatttccttagggtgctgcgtccttttctccatggagccctctttggtccctttccctctcggggctcatgctctccagtcctcatgccgatcctgtgtattttaatcaaaggcaaggagtaggtagctcgtgggttgtcatgaggatgataggatgtgaaatgaccactgtattgttttcatctctccaagacagcagcctggtgttgggcattgccagctcattagaggatgtcactgagaaatgcaaaatagccaactccacattatcaactccttccaattccctcagcacagaacatcagagctggagcatgctaatctgatttcatcacttgggcagtggaggtttttattgagctcactcagaggtggctgcagggcttaaa

SEQ ID NO: 274759 - DNA, 378 bp, Homo sapiens
aaaactgacagaaaaagatagggaaaatctgaatagttccatgtctattaacatattgaatctgtaagttaatattttggtacctaaatggtttcattgatgaattctttattttttatttatttatttatttttgagatggagttttgctcttgttgcccaggctggagtgcaatggcacaatctcagctcaccgcaacctctgcctcccaggttcaagctattctcctgcctcagcctcccgagtagctgggattacaggcacgtgccaccatgccctgctaattttgtatttttagtagagacagggtttctccatgttggtcaggctggtcttgaactcccaacctcaggtgatgctcctggcttggcctccca

SEQ ID NO: 274760 - DNA, 216 bp, Homo sapiens
aaataccttcctagaattcatcaaatcatattgttggcagactgttcaaactaactctcatctcttttgctgacaataaatctgtgggatgtgagtatgcaaggattttggtatactgggggagggaggttgtggagccaatctcctgcatataccaaggaccaactgtaatttctacatttcttgtttaggttaagaatctacctgggagcaaaa

SEQ ID NO: 274761 - DNA, 609 bp, Homo sapiens
tttttttttttttaagagacagagtcccaatcagtcacccaggctagagtgcagtggtataagcatggcacattgtaacctccaactcctggcctcaactgatcctcttgcctcaggctcctgagtagctgggactataggcacatacgatcatgcctggctaatttttaatttttttagagatgggatctcgctatgttgcccaggctggtctcaaactcctggcccggagcagtcatcctgcctcagcctcccaaagtgctaggattacaggcccaagccactgtgcctggtcaggtgtctttgagagtggtgctatcccactgaactggtgagaaagttgagtagaaccaaagaaagaaaacttgatagaagcaagaattatgattgcgaatcactagcccttctgattttctccagtctaaattatgttttgctcattttacttgaccagtaaggtaaaaccccacgtgggaggaaggggagttgctgtttcataatgggtcagaatcaaaaccccattgtcccaagccaagctttcagacaggctgactccctgcatttttctaagtcaaaataaaaacaattcctttatgccgtcacgttgca

SEQ ID NO: 274762 - DNA, 280 bp, Homo sapiens
tccccagtagcaagtaaacaaacaagaacagcagattatgtgtgaacaaagagatctggtgcttattatatatttcttcaattcatttttcttttcccttgttgtgtgagacatgcataattttcttggctctgtatataattacatacctgctttgagatgaacattcttaagtgtagtgattaatggtctgggattggacgtagtcgccctgcagtctaagttattcaatatctttcaccaaaaatgctaataattaaactgccagtggcaacaaaca

SEQ ID NO: 274763 - DNA, 524 bp, Homo sapiens
tcccttgacttggcaaacacgaaaaaccaaaggaagctaagcattcaaaacccctgccaaggtcatgccacaggaagagcctgcttaggaaactgctccagctagtaatgccaccaccaacagccactggaatgaactccaaacggtccttgcatctttgcatctctcacttctggtgcaagtccccaaagtaaagggcatctgactggcacagtttgggtaacatgacccagctctagctgccaggggtccagcacagaaagtttatctatatggtatgtgtatgtgtgcacccaacctttccagcatcctctcccaataagattcacaaaaaagcaatactggaagggggctaaaatggtaaacagacaaaagaaacaacaaagaaccattttaaagcccaattagtaaaatgtccaacacaggaatcctgccagtctagccatttggaatcaacttgaattactgtgccttcttctacttcattgttccaaaaaaatttcctaaaaagtaattttaggcaa

SEQ ID NO: 274764 - DNA, 557 bp, Homo sapiens
  misc_feature (432)..(432): n is a, c, g, or t
  misc_feature (471)..(471): n is a, c, g, or t
  misc_feature (529)..(529): n is a, c, g, or t
gattacttgaggtcaggaatttgaggtgcagtgagccgtgatcgtgccactgcactccaatctgggcaacagtctctctctctctcttaaaaaaagagagactaatttgggcaattgagatcttttcagcatcaaacattcatgtctaggaatgtggtacttctctccatttattcaggtcatctgttatattcatatccttttttagaactctcagttttttccatataagttctatatatgtcttgttaaattcatttctcaatgtattatatcttaggtagctgttgtgagtggaatctctttttctctgatagtattttctaattgttactgacataaaagacaaaaatattgatttttatgtttattctgtattcaaccaatgtggcaattttttttttttttttttttttttttttttttcctttngaaaaagtcatggaggccatggggttggcttgaaaccanctttggggggttcgattccttccttttttgtctaaattttatgtatacgggttcttcnaatgtgtggtagggtggggggcatccat

SEQ ID NO: 274765 - DNA, 349 bp, Homo sapiens
agtcccttccctccttgggcctctgtttctcatctctgcatatggggtaaaatgccccatccttagtccgggctcaggtgagccgctgggttcctactgggccatgggaagggccctaatacctgaagggcagggaggatgagggcaggcagctcagctgccctccctccatcctggggcctgccacctcccctctgtcttctcctgattccggttccccaccaggaagggctcactgtcctgctcagcaagttctctcaacaagctgggcagccaggggggggtgctctgctggactggaggagccgatgtgagcccaggccacccatggaggctccctctgaagaga

SEQ ID NO: 274766 - DNA, 255 bp, Homo sapiens
ttttttttctttaagctatctatttccatgaatatttctccctttacttcttgtatcattttttggatttccttgcattgggcttcatctttctctggtccctccctgattagcttaataactaatgtcctgaattctttttcaggtaaatcaagggtttcttcttggtttggatccattgctggtgaactagtatgattttgggggggtgttgaagatccttgttttgtcatattaccagggttggttttctgg

SEQ ID NO: 274767 - DNA, 763 bp, Homo sapiens
gagttcagagaacggaagagtgtatgggtcaatagtttactttttattatctccgaccagctgataaaagacaataattaaatacatacatatatacataaaatagataatttactttcaaggctgctattctgcctataattttatgtcttgataatcttgcttcccaaaacataattttatcagatttctttaaacttagtctttaacttgattcttttatgcatacttattaccattttagttaggaagatgctacttttaggcatgtgtcacaactcataataattgccaaatattctacagtttaatggtttttttgaggaccctcatattttataagtttataataaagtgtcttaagtttcttaaaagtatcaactgttttcgtttgtttgagtggtctctgaatgaattggcatgcttagagactttttttttttaatcagaatctcttatctctgtttccatactgtctcccagtcttctcactgaaggtttactatgtaatttagcataactgttctgagtataccagagtttagagttgcaaggtatgttctaaaagactaccttttctccctcaacccactgttgggtgcttccctccaagtcttcaccaccagccgaatagtggaatgaaattacatatagtaggcttaactgtaagggttctgcagacatggaattaagtcgagattttgttcatggcttaaaaatctgttttaagtttgaggtcaattatatacaatgaaatacataa

SEQ ID NO: 274768 - DNA, 315 bp, Homo sapiens
agattgcagagtacccacctctatcctgggcaccagcttggcccccatcatcactgcagcacctgggggtggcagcacaggtggcagtggattctgtactgggaagtccaaaggtctgtatcctagtcccaccagcaagcatgctttctacaactgtgtggatgagcacacatacgaggaggcttgtcaggaaggcctggtctttgataccagctgctcttgctgtaactgggcataagctattcacctgctgggtcccttggagattgtaagactaaaggatgattaaagggaagttttgcatgtgaatgccaa

SEQ ID NO: 274769 - DNA, 130 bp, Homo sapiens
catatggatcaaagtacctacatcatttatttccaagtgaactatacagaagaggcattagtatacacactagaagtgtgctaggagctgtaataaaatacctacacccaaaagccttacctacacctgg

SEQ ID NO: 274770 - DNA, 485 bp, Homo sapiens
tgccctataacttcatgcttggcacagagaagccactcaacaaatatttgttgactaccaactgtaatttccactattatagtattcttctttgattttttaaaataaaataaaaatatcctttagaaaaggtaatctgcttataaagaaagcccatttattcacactctagtattaatctcattgaaagatttgatggagtatagagtacagaacagttttttgaacatggattattacaggaaaagtctgggtgtggcaaaaggtgtcctgaggagtgatgggatgttagggcatgaagaagaatgaagaagagtgtccaagacaactggttcatgttgcaattttactgaaggtcagcaaagtggagaatgctgttctgggagaactggatgccttcagattgtgccaggtaaaggcaaggggtcaccaggacctccttgggtcaaccaaaccactgtctcagtatctaggagaaattagat

SEQ ID NO: 274771 - DNA, 531 bp, Homo sapiens
cctccaattcaccacaggactattcctagccatgcactactcaccttttcctcaaccgccttttcttcaatctacccaccttggcctcccaaagtgctgggattacaggtgtgagccactgctcctggttcctaatgttttttaactatataaatgcatttcacaataatatcttagattcttacatcacatttttgccaaaaatccagccttatgcttttgggtacaactcctaaaaggagataaatagtataaagatagagaaggttatcacacactagagtgcatgattacagcaccaggccatgctgccagcaggctcctgggaccttatttctgcccagaattatggtctgtcatatgcattcttaacaggtgattcgtggtctttgccattaccagaattggccatttggataatcttttttcctaaacttgtgaccttttattgcctttttaatcttcctactgactttagaaatgccactcacatccatttgtagctttttctcattgggtttccatcaaacc

SEQ ID NO: 274772 - DNA, 392 bp, Homo sapiens
ctgacaagcccctccagccctgggcagacaaaggcttgaaaggagaggaattgcacacggtccagacgctgctgtttctaatacgttattttgacacacaattaactgcaaaatttgctctaagctaagagctcgggccctcacaggattcgtacagcacaattcaagcaggatttggttctgtgaaacctcatttttcctgaagggctagggattgccggctccccacggtgatgccacccctctcagggctggctgtgggcaccgatcagagaggaagcatcagcccgcccacagcccagcatggggccaggggaaccatggcacgagtcatgggagggggtggataaagcttgcacaaaaccgtccaacagagctccctgaacaacaac

SEQ ID NO: 274773 - DNA, 571 bp, Homo sapiens
attttgtgttttataaaactcaaagtgggaggagctttcctttttcttcaaaaattctagaaatttggagtttttttgatatctcccaatttttttcatattagaaagcaaattatcatattaaaaatgcctatgactgccaaataaaatctgtctttggatgatatcctgtgagctgcatgcttctgacttctgctctaggaacttagatcaactcttgttttaacatctgtgacgcacctactatatgccagttccttatatttcgtcatttaagcctcacaacccctcaatagggcagaaattattattagttttagtcccatcttatcactgaggcacagagagaggaagtggttttcccaaagctataccaccaggaagtaccagagctaagatttgaaccccgccactcagcctcaaaaatcctatttgtaattactgtgctaaactgcctcttccctcccacctggtggttgatttttgctgaagatgtgtatgtggtaaattcacagacgacactattctcaaggttttcagtttccctggaaatagagcactgacttaaaaa

SEQ ID NO: 274774 - DNA, 353 bp, Homo sapiens
taatctttttgttcctgatcttaatctttgtcttgttcctgatcttaaagaaaagtattttgtctttcatcattgagtatattattcactgtgggatttttcagatacagcttttattattttgagatagtagccttctgttcctagtttattgagtgtttttgtcatgaaaatgtgttgaattttgtgatatgctttttgtgcatcaattaagatgtggtgtttatccttcattctgttgtgctgtattagactgatttttttttttttgtatgttcaaccatctttggattccaggaataaatgccaccttagtcatggtgtataatttctttaatatgctgctgaatttg

SEQ ID NO: 274775 - DNA, 379 bp, Homo sapiens
cctcttcatactccttaaaatgaaataaatgttcataactaaacataatagtccacatgtggtctgtcccataaaatattttaattgaagtacaacatacatacaaaaaatgcacatgtgtgtgcacattggtgaatcttcacaaacctaacataaccagctttgagatcaagaaacagaacattaccagcaccccagaatgtatgtgaacacatgtttatacatataaataaatatacatcacagatttcatataaacacagcagactacagtagctctcgaaggcagcttcatcacactattgacccaagtcaactaaaaatctctaacttccgtcttccctagcagctgtgtctgtttaataaagctttaccattt

SEQ ID NO: 274776 - DNA, 187 bp, Homo sapiens
gtgagctgcctcccagaggcctggaaggaccaggccttgccaatcaccgacaagggacgtagaagagcacccccaaaggacagtaggtccaaaacacccaaagtagcaaaatgcatcccagctgcaaccaaatgacagaatccactgggacagcaggggccatgagggcagctgtggacaggaaaac

SEQ ID NO: 274777 - DNA, 417 bp, Homo sapiens
ctgctatatgtaaagtcatacgtcattaaaaataataaaaattgactatttactagtagtgcttttggtactattagaattataagagaaactgtaatgatgattgttaatcataatatactactaaagatatatggtatgtaggtggagagatagatggatagataattggtaggcaggtagagagagtgagtaagacagagagagagagagagagctcaatctatctgtctacaaattctgatagaacctgagttctgtgctgtcaccacttttttgaaatgttcacctagatgcctcaaattccatgtagcctgttgaacatattatggagcacccaggattgcacttcatcctgttttacccctgctggctaatggcttcaccatctactcaaccatacaagctggaaccaag

SEQ ID NO: 274778 - DNA, 357 bp, Homo sapiens
taagaaactaggtcttcctaagtaagttgtctggtttggtctcgaactcctaggctcaaagtgatactcccacctcagccgcctgtgtagctgggagtccaggtgtgtgccactgcacttggcaatatgtaactctttgtgatatttgtcatgagtattttttccaagttttttctttttttattttagtgccattgtgcctggcaatatgtaaccctttgtaatatttgtcgtaccttttccaagtttgttcttttttattttagtttttcattacaaagcagtttatgaagttttttatattttcttctgttgccttaagatgaacaaacttgtcatcccttctgtcgtcttctc

SEQ ID NO: 274779 - DNA, 501 bp, Homo sapiens
ctgtcttcaagcccacaagaagcatagagcagaagaagacagaggagggcccatctggcccactacctgttcttgtaaataaagctttattgaagccaggtgctcaccttctagcacattcttcaagagttactctgaggcaagccagccgccatgtcatgaggacactcaagcagcaccatggagaggtccgatggcgaggaacagaggatccccctgccgacagccaatgaggaacaggcctcctgccaacagccgtgacaaaccggagaaagccaaatatgctcccctaaccaattacttaggatgcccctcttctaatgagcccaactgtagctttcctgcaccaccaacaggacgtacctgaagccttctcctttttccgctataaagccttcccctcggcctgcctttgagtctccatgaaaagcaagtgacagtggctgcctcccttactgtaacaagctctgaataaacagcctttgcttgctctcaaaagag

SEQ ID NO: 274780 - DNA, 467 bp, Homo sapiens
taggtccaggccagatggggtcctgctcctgacgtggatggttctgggagaccaaatatgcaaatagacaatggccagaccacatattaaaatagaactctgcccccaaacctacagcaccagcccaggaagccaacgaacaacccctgcagcaatcagccccaaatggccaggacttgatggtaactgacagcttccctaattttgttcccactttcaatgcaggacaaaccggagaaagccaaatatgctcccctaaccaattacttaggatgcccctcttctaatgagcccaactgtagctttcctgcaccaccaacaggacgtacctgaagccttctcctttttccgctataaagccttcccctcggcctgcctttgagtctccatgaaaagcaagtgacagtggctgcctcccttactgtaacaagctctgaataaacagcctttgcttgctctcaaaagag

SEQ ID NO: 274781 - DNA, 483 bp, Homo sapiens
ctgtcttcaagcccacaagaagcatagagcagaagaagacagaggagggcccatctggcccactacctgttcttgtaaataaagctttattgaagccaggtgctcaccttctagcacattcttcaagagttactctgaggcaagccagccgccatgtcatgaggacactcaagcagcaccatggagaggtccgatggcgaggaacagaggatccccctgccgacagccaatgaggaacaggcctcctgccaacagccgtgtaaggggtcaccttggaagccaatggcccctccctggtcaggcttttacatgactgcagtcctggccaacatcctgacggcaacctcatgagagaccttgagccagagccacccacctaagctgcttataggttcctggccctcagaaatcacatgagatcataaatgtttgctcaatttgagatatttgtgatgtagcaataaataacaaacacacttacct

SEQ ID NO: 274782 - DNA, 283 bp, Homo sapiens
acaaaacccacaagcagaggatggggatcctggataaatgggagaccagggaaaagccctagtttcagagcggcacctttttcctgctggtcctcaaagggcctttcagactagggaaggattctctggtattgcttccctggagatacactagccagaatcagcctcctgcttgggcctccactctccacgctgtcctactccggcaggctgagcttttccccgaccccaggcctgtggagtgcagcagtcaaagctttattgcccacacactggagccgct

SEQ ID NO: 274783 - DNA, 140 bp, Homo sapiens
tgactgacgagatcaacttcctcatgcagctatatgaagaggagatccgggagctgcagtcccagatctcagacacgtctgtggtgctgtccatggacaacagctgctccctggacatggacagcatcattgctgaggtc

SEQ ID NO: 274784 - DNA, 201 bp, Homo sapiens
cagggtttcaccatgttgattaggctggtctcgaacccctgacctcgtgatccgcctgccctggcctcccaaggtgctgggattacaggtgtgagccactgtgcctggccatttttatagattttcaataggcatcctttgctaacacagtcagcattctgtattcatagattcaacgaaccatggatcaaaaatactcag

SEQ ID NO: 274785 - DNA, 497 bp, Homo sapiens
aaggattaatacatggaatctataagatttaataagaaagtagacaagtgatgtaaatacttctcaaaggaagacataaaagctgccaataaacatgcagaaaattgcacaagatctctaatcagagagacggaaaattttggagagaagaaaatctttataaactgttggtgaaaatgcaaattcagcccctgtgaaagtttctacatttttcaaataactaaagatagaattgccatttgacccattaaccccttttttgggtatctacccgaaggaaaatattttactaaaatgacacctgtacttacatgttgattgcagcactatttacagtggcaaaaaccttgaaaaactatagggtatgatgtacactatgtgggcaatggaattattaaatgtgcaagcctcaacatcctgatgtatacaggttacaaatctgcacatgtaccacttgaatctaagataaaaataataaaatgttttgtggtataatg

SEQ ID NO: 274786 - DNA, 244 bp, Homo sapiens
gatatgtgaaccagagggcttggggacacagagtatctgggcaggtattacagaggcagtgacatttaagagataaataggggctgggcgcagtggctcatgcctgtaatcccagcatttgggaggccgaggcaggcagatcacctaaggtcaggagttcaagaccagcctggccaacatggtgaaaccccatctctacaaaaaatacaaaaattagcaaggcacagtgttgcgagcctgtaat

SEQ ID NO: 274787 - DNA, 256 bp, Homo sapiens
ccatctctaaaagatggggaaaaatgtgcaaaagtttcaaaatccaacagaaaagtcttagcagcaacttttaatgttgggcaagcacaagggcatgatcactggggattgacaggaaacacgtctggcagtggacagctggactctcaagataagctgcaacagaggcatgttctgcattttagggcttgcccaggactggggacaagccagagttcaggaacctgtgggaggagagaggcctgatggaagtgtg

SEQ ID NO: 274788 - DNA, 554 bp, Homo sapiens
gctattgaggagtatcctgaggcatgggggtcaggtgttgaggtcttggtgagtgtcttcctgggcttagttccctcagcccccatcgctctaaactaggggtatcattatgggtttagtggattctcatttgcttattttctggttgtgcagttgcagtttcacatgaagaggatatcgtgttttagtccttttgtcaacctcccatgttgattctttcaagtatatatttctgaacgtttaagatctatttatagtttccagggctgattcaggatattcctctgttataatcaactggtcatttctttggtaatctggcacaaagaaataagcttatagctttcttatttggaaattgtattttatatatgtgatttgaatcataggggggatattgaggtaatttagacccagtgattgtaaaggaatggatgaatgatccaataaataaatagatgacaaagctcatcttttgcaggtgagaggcattagaagtaattttacggttttgagaagagaaatatagatgagaagagatgcctaggagaata

SEQ ID NO: 274789 - DNA, 278 bp, Homo sapiens
aggaaaaacaaaaaaaacttcgattcctgaatctccaaatggaggaaagccacccacggacccagatggaggaacacccatcctggcctgtgatgtaagcaagaagtaaactttgattttgtttaaggtatatattttcagtatttatttgttaccacagtttatattatcctaattaacacactctgttgcttgggttgttgtaagaattaaagaaattattatgtgttaagttcttagaagagtgtctgacatataataaacactgaattaatgtt

SEQ ID NO: 274790 - DNA, 430 bp, Homo sapiens
gaaacagatgctattggatatgagtagcatatgcaatggaaatattgacattgccttcccgacagtcatgagggatagaccataggctttttggtaacctatattttctaggcccaaagcagggaatgagatggcagggaaattcagggtaaactccaaatttacataaagttatagaagaatatagatcatgagtagtggctagcaccttcctgacttccagaaaatggtggtgccgatattgaacaacagtttggagaaaatgtaaaatgtttacatttacatttacagtttagtctttgaacaacagtttggagaaaatgtaaaatgaaaatttgttaacgaacttgtttttaaaaagcacctagactccatataagagtacttgtcctatgttattttcataaactacatttgtgattgttttggt

SEQ ID NO: 274791 - DNA, 256 bp, Homo sapiens
aatgctcatggaagttgtgtgcagtcagtgttggaagcatgaggccgactcctagaactcagaaaggctgatggcccacatggccttcgcctttggagctgggccttgaagagggggacagcaggaaggagagcctcttatcagatgtggcgtggaaggctgcgggataggaggggagtatggactccagccttttcttagggctctcgagtatgagcagaaagcagcaggtgcagtgagtggttctgggcctggg

SEQ ID NO: 274792 - DNA, 279 bp, Homo sapiens
ctggttccacttgagatctggggcaaatacagtgcttgggctgagctggtgattgcaaaactgaggccccctattagacagttttccatctaggcctgcccttctggcttgggcttgttcccagagctgctttcctgtctctcccttgaatcttcttttctgaagcccctgtgtctctgccctaattcatcatctggaatattttaatattaccccaactggtcttcccgcctttagacagtaagacctatctatcttgcttatagctgtcagagttat

SEQ ID NO: 274793 - DNA, 203 bp, Homo sapiens
tgtctgcttggagaagtgtcccggcagctacctgactctcggaggctagcctggagccaggagagtggcccagcagctaaccatgggccaggcctgagccagttgggcagagggtaagagaagaagcatcttagacacagggaccagacatacgggcagggagggaggcggcggcccaggggctgctggtgagaaagagaagc

SEQ ID NO: 274794 - DNA, 462 bp, Homo sapiens
tgagctgagcacacacaattaaaatctcccctctgcagccagaggaaggacctgggctttggggagggcacaggagcaggcggctgggggcagggcatgctccctttttgtctctagctgcctttttgttcaaagataaacatgcctcgacctgcttcccctacctgaaagccgcttctgccggcgagagaaatcgtacacaatctctgctctggatgtacaaaaagtctgaaattgcttggagaccaggcgggagggagcggggtgaggctgggggatccgggcgggtaattgcgggtcatccatctgccttgtcggaggcaccagcccgcagcatttgcagagaggactccgtgaatttgctttttccccacatcttgcattacttactcttgcctcagcagccataaaaccttttcctaaaactgccctcaagcataataaacaggagacattcggaac

SEQ ID NO: 274795 - DNA, 736 bp, Homo sapiens
tagtattaccatgatcactcactttaaaagggcttgtttgtctaggtaaatagtacgaaattagctttgcaaacttatatatgttcatgaataagaacttacatatgttcatgaataagaattgttttgatattcttacgacttaaaatatttttctgaaaaagtatatatagcctttgagtttttttactgaagtactgtagatactaagagttgatattttgtttaaaatatatttttattgagcaaataatatttggaaaattttgatgtaagttggactttattatgataagtagttaatcttaactggaaggctatcagtagatgtacaatgtagctaaattagaacctgactcttgttaataaaggaaacgattatatttactttttaaaaagtgacattgttaaattagtgaggatttatttagtgcttactgtgggcccaatacagattgaaaataaatatgtaccataaaaaagagatacctgctaaatataatgtggttaaatagcttaattttaggcattttacagacctgagttctaattctgaccctttcactgatttagctgtatgaccctggcaaatgttttaatctacttgagctcaatattttagtaataaggatttttctaaggactgataactatcagtgaagttagagcaacgtttatgaagcagtctgacatacaatacacgctcattgtacaaatttgaaaaatgtagaaaagc

SEQ ID NO: 274796 - DNA, 637 bp, Homo sapiens
aaaatggaccctgccccagagtcccccactgtgagagcatccccatgtggagagcatgtaacccctgaagccccctacccggggggtgggccttgcccatgcctcctgcagcttcggagcccctgcggagcgccgcccattcactccctcatcccacgagcctggctcccaggtcgggaggccgagtctaatagaggaggcaaactccacccctgccactaccagaagctgaggctccggggccaccggccgcccagggacctcccaggcctgtcacaggctgtgcaccctgcacactgcggggccactacctaggtgcctgctagctccttccttgccctccctcttgccttccttctgtctttacgagacctagtggtcctgagaggctcacctccacctcccagaaccttctgaccagtgcattcctagggggtctcagccctcatggcagccctgcccgtctccagagccccccattcttcagtcttggctccctgcaccccacccccctgctaggactgagccccactggccacctgggccaggctgtccctggctgttcccatgggcaccttctgtccccagtcctcttcccattcaaattgctttgtgggactggctaagtttcaaaggg

SEQ ID NO: 274797 - DNA, 415 bp, Homo sapiens
tttcacatatcccagaaagccccattttaggacagcatttagcagagtatattcaagatcccactaacgttttcggaagacatgacttccagatgatataaggctccatcaggaactgtgcaggactgtgcactctgttgatactcacatggtggaattatattgcccttggccaaccctaaagccatcaagatagcaggtttggaataattcactgtcgaagtcttcttgagctgagcagtcatgtgagcttggaagatgatccctctccagctgatccttcagctcaggccatcatctacatctggattcctgacccggagaaactatgagtaatgtgtgctgcttttgagccactaagctacatggtaataggctatgcttcaataaacaataatacacttgaaaaaaaaaa

SEQ ID NO: 274798 - DNA, 335 bp, Homo sapiens
actggaccaagctggagacaccccatgagcccaggagcagctttccttccaactctgctaacacctgaacagatctccttttgatttggtctctttgagaagttctacaacagctttttctgaatcactttgtctagttttgtgcaaacggtaactggggcatccagaagaatgtacagagcagagagttggtcaaaaatgtgttagtcctgagaagaaataaaaggcagcctagacattaaatttgggaaggacaacggctcgacacatatggattaaaaatatatcacccacaatgaatgaaatgttaataaacagaaataaagaagtattaa

SEQ ID NO: 274799 - DNA, 387 bp, Homo sapiens
cagcaaagctaagcgactggggacagccacttgtggctgagacaaaggcaggctccccctgccgcaggacgatcactaggactgtcaggctgtcgaaatgtatattgcagacaggacatccctcctggcatccagtgtgagcgaagtccaggccacggcaacaacagcctggcctgaggacagcctgcaccacacatcaaagccagaggccctgggaggctggccagccgccaaagacgcctgagagcggcaggggagtgtgttgccttaggacaatagcaaactgggacgtggtagagtctgtaaattccaagcactggggaggtcttctcagagattttaccctctcctgtcagggctgtgatttaatttcctttgaagaaaaaa

SEQ ID NO: 274800 - DNA, 284 bp, Homo sapiens
ccagcctcccaagtagctgggattataggcacctgccaccatgcccagctaatttctgtatttttttttttttttttagtagagatggggtttcaccatgttggccaggctggtctcaaactcctgacctcaggtgatccactgacctcagcctcccaaagtgctgggattacaggcatgagccaccacgcccagcctagaccctgcttctaaaaggccgctataggggaactgccctgggatcttagactccagttagcaccagaaaaacatactaggaaaaa

SEQ ID NO: 274801 - DNA, 462 bp, Homo sapiens
cactgggaaggacaattgcttttaggccttccttattttgaggcatttttaataaagctgtaaaataatacgtttttaaagagagggaaaaactcatgagttcccactgatatatccaattctaatttgaaatttaaagatttcaattctctgattttacatgtgtgtttcatttcctgtgtgtgaattgttaacacaaccttagctcaagccatcatgtcctcctccctaggattcttcggtagtctcctaactggccttcctaaatttactcatgccattctccgcagcaaagaatggattttttttacactgtgattttgtattttgaatttaacctacagtttatacaagagatttataagacatgaacttggaaaacagaacaaaatgtaattgaggtataagagcacagtatgtcatgtttcaataaatataattcaaaatttttaaatgatcaaa

SEQ ID NO: 274802 - DNA, 396 bp, Homo sapiens
tggcccccaagctgagaaccgggagccggaggaaatcatagcgaaatctcaacctgatgtagccccatcagcatcacacacacactcagagcaaaatggcctgctcttcaatgtagcttagtttagttcaattgtcctgcccaccccctcctgaccctcctgccgctgaggggtggtatttgaaagaacagcttctttcctctcttctccttgggacagcaacagcacagagagtgggccgccatctcttactgcccactcaaccgttgctggggactgattctttcagctctacatagaattcaagaactatatttggatctgcttcagagcagtaatccccacagccttaaaacatgcaaaataaaaataaattaatcatccatcagcaaaata

SEQ ID NO: 274803 - DNA, 454 bp, Homo sapiens
gagtttcctgtgatgctccagttcacagagctaaaaggagtagagtgatggctcagacgcgggcctcccagctcaagttctgtgctctggatggaaagtcagggtgaccctgaaggacggggcagctgtgcagggacaggataggcccatcctggaaggctcattggctgagggaaagagggtacaggggaaataattccctttcatccatccatccccattattgctcctaaacttcccttccacctccagcttctttcctctcttctccttgggacagcaacagcacagagagtgggccgccatctcttactgcccactcaaccgttgctggggactgattctttcagctctacatagaattcaagaactatatttggatctgcttcagagcagtaatccccacagccttaaaacatgcaaaataaaaataaattaatcatccatcagcaaa

SEQ ID NO: 274804 - DNA, 757 bp, Homo sapiens
tgtggtgatgggcacctgcaatcccagctactcaggaggctgaggcaggggaattgcttgaactcaggtgacaggagattgcagtgagccaagatcgtgccactgcactccagcctgggtgacacagagggagactcttaaaaaaataaaaataaaaataaaaaacctctcttcctactcccttagtgttttgaagaaaatcacacagtcctggccgggcgcagtgactcaggcctgtaatcctagcactttgggaggctgaggcaggagaattgcttgaacccaggaggcggagcttgcagtgagccgagatcgcaccactgcactccagcctgggcaacagagcgagactccatctcaaaaaaacaaacaaacaaaaagaaaggagactgcagaatttttttagtacaattttaaatattaaatatctctgatatttgtacttgtgtcagttaaaaaaattgctaatatacttggcaataattaacttttaagcattttgtgaaattctgcagaagttacccaatttcattctcataataattaggagtaggttctgtctttgccctgtattttgatgggcagacagaaagcacagtgaactttagtagcttgctcaagattgtgctagcaagtggcagaaccgggacagaaccccaaatctggtacgtagaagcattcatatgttgtagtccattacatatattatctttcaaaatttgcagtaagttattgaaaagtaccaacaaaaaaacaa

SEQ ID NO: 274805 - DNA, 244 bp, Homo sapiens
ttttttttttttgagacagagactcactctgtcgccccaggctggagactcttaaaaaaataaaaataaaaataaaaaacctctcttcctactcccttagtgttttgaagaaaatcacacagtcctggccgggcgcagtgactcaggcctgtaatcctagcactttgggaggctgaggcgggtggattgcctgagctcaggagttcgagaccagcctgggcaacaacagtgaaaccccgtctct

SEQ ID NO: 274806 - DNA, 303 bp, Homo sapiens
tgcaaagaaaaacaatgagaggaaacaaaagtatacaaatcagtcagaaaacaataaaatgacaggagtaagtcctcacctattgataacaatcttgaatgtaggtaatttaaatttcccaaatgaaagatagatactggctaaatgaattaaaaaaacaaaacccaattacatgctgcctataagaaactgacttcacctgtaaagacacccatagactgtaagggaatggatagaaaaagatattccacacaaacagacaccaaaagcatgcaggagtagacagacaaaaaatactgagtc

SEQ ID NO: 274807 - DNA, 192 bp, Homo sapiens
aagaaatctcttcccatggccccaccactgggaatgcgctgggtcacacctgaagccagcatggccctggctctcacccaaggcctgtgacagttgttcaatttggtgctcctgttgggggaactactgctggagtgttctatttggccatcttgttccacccttgaacccaaatatatttctgatattgtc

SEQ ID NO: 274808 - DNA, 484 bp, Homo sapiens
tgcatcaaactttccacagctgttaggagctagtacgtccgtagcctcattgggccctttccccacccctaccctgctgaagaacatgggaaatttctgggcatgctacgtggagcctttaaaatatgaatactttgtctctctggtgagaaagcactggggtccagatggggagaagatgttctgccataagaaaatctcctggtctggtccgtgccttggcttagcacagggctgttcaggcagtgtgaggacccgacaggagggaggggcaggcagaagggagaacccacttttttatccattctgcccagcaagtaggggaccggggttgtccgggcgtcgggggagcggggagctcagactgtttttagactgacttggaatccggcccagagcttgatgcccggttcaaagcattccctcctgagtggacattacaagacctgcagcgaagaataaaacagaaagacttgcaaacaaa

SEQ ID NO: 274809 - DNA, 204 bp, Homo sapiens
ggtcaaagaaaaacacaagggaaattagataatacttagacaagtgaaaacaaatatatagtataacaaaacttacgagatgcagcaaaggtaaggaaaatatatatctgtgaacatctacattaagagagatctcaaatcaataaccttacttcattccgtgagaaactggaaaaagaagaaaaaactaaacccaaagctagc

SEQ ID NO: 274810 - DNA, 392 bp, Homo sapiens
  misc_feature (253)..(253): n is a, c, g, or t
tcttgtatatctgtatgcatggatgtatgtatgtatgtatgtatgtatgtatgtatgtatgtatgtgtgtatttatttatgtacgtatttatcaggagaccgggtctcactctgtcgcccaggcctgtagtgcagtggtgcgatcttgggtcactgcagcctccgcctgccaggttcaagcaattcttccaccccagcctcccgagtagctggggttacaggtgcctgccccacggcgcctgactccatttcngtattttcaagtaagagacgggggtttcaccacgttggcccgggctggtctcgaactcctgacctcgggatgacagacgtgagccactgcgttcagtgtacagtgccatttcttagaaatcactcctcacgggaacaca

SEQ ID NO: 274811 - DNA, 1054 bp, Homo sapiens
ctgtgcaattcgggtgagttccttcacccttctgagccatcccttggctcgtctggaaaatgcaaaaaaaaaaaaaagaaaaacaccaggtttttgcatcctcctggatgagggatataaagtgcctgacacagcatatgacagggatttgataaatgggggctgttagctgtcccattgtggatgtgagaatagcattctgctggctaaaaggcagacatgaatgttctagaacatggcgatcccggaatgtgcagtgaaggcaggaagaggaagaatgggcagggaagaacaagttgggatggaggaatgaactcttatctccagaagcagagctaagaatgcccacggagccttggcacatgacagcctccgctgagccaaatggcccaaagacttctgaatgagcttttgctgcaacaaaaaactttggatcattttgagagcctcccgtgaggcgccaatatgttgcagtaccttcccggccccgacactgatgtgattcatcgtaggtaacatatgaatacgctcaagctggccagcagcttgaaaaattggagtctatcaaattgaccttgagaaacacaggaaggtaatatttagtgacataccagatgaaatccttgcgcagagatgtgaggtgaggaaggacctgaagggaagtagaccagcaaatatcaagggtcaaggagttgggggatgatatagagacgaagcctaacagatgtcaccagagcaagaaggccttacgacttcacatcctctctgcagggtatgaatggtgcaatggaatgaaatggtaactacagcttctggtgcaaaatttgagtttccataatcatcatcttgggaaaatgaggaacacaatataatggcatacagagagaacaagtgaaaagatgagagatgatgaacaggttgagtttcttcagcctacaacctatcaaatctaattttaaacatctggagccacgtgtattagttttgtttctgttccattttcctttttctgtgtccccgacggtgaatgattctgaataattcttagtctggg

SEQ ID NO: 274812 - DNA, 594 bp, Homo sapiens
  misc_feature (553)..(553): n is a, c, g, or t
ctgtgcaattcgggtgagttccttcacccttctgagccatcccttggctcgtctggaaaatgcaaaaaaaaaaaaaagaaaaacaccaggtttttgcatcctcctggatgagggatataaagtgcctgacacagcatatgacagggatttgataaatgggggctgttagctgtcccattgtggatgtgagaatagcattctgctggctaaaaggcagacatgaatgttctagaacatggcgatcccggaatgtgcagtgaaggcaggaagaggaagaatgggcagggaagaacaagttgggatggaggaatgaactcttatctccagaagcagagctaagaatgcccacggagccttggcacatgacagcctccgctgagccaaatggcccaaagacttctgaatgagcttttgctgcaacaaaaaactttggatcattttgagagcctcccgtgaggcgccaatatgttgcagtaccttcccggccccgacactgatgtgattcatcgtaggtaacatatgaataagaatggaggagtgatggctgttgganctcgtccctcttttgacaaaaaaggggtgattgtggttgaa

SEQ ID NO: 274813 - DNA, 333 bp, Homo sapiens
caccactgaatattggggcattttattaggtagtaacatattattacaacgttgatttttgtaacttattattattttttttagttgttccagaagccacaatgtcccattaccaccttctacaacctaactgaaagcagaaacctgaacctagtgattttgcagaagcaatttgcaaagttcattataaggtaaaattatttctgagaggccaattttctctaagatattctaaaacaaacaatttttcaaacacaatatactccaactaaatcactgcaattataaccattttcgtcttactaaataaactattgtacatagataatcaag

SEQ ID NO: 274814 - DNA, 909 bp, Homo sapiens
  misc_feature (12)..(12): n is a, c, g, or t
  misc_feature (20)..(20): n is a, c, g, or t
cgcgctaaattntttgtatntttagtagagacggggtttcaccgtgttagtgcaagcttcgcctcccgggttcatgccattcccctgcctcagcctcccgagtagctgggactacaggtgctcgccaccatgcccagctaatttttgtatttttagtagagacaggtttcaccatgttgaccaggctggtcttgaactcctgacatcatgatcttcccaccttggcctcccaaagtggataaatcttttaataatgtaatttttagatgaggaaactggaatctagctagtaggtcacatacctaataagtggaggagcaggaatttgaacccccgaactcagccacaactgctgtttaccccaaataaggtccacaaatcatgacacaaaatgtgtttttgtgtatgaaaaatttagaagggtctatgacccaattctcagctctggtgacctgtgtggtgggaattggggtgacttgttcctgttctagtcttttctatatcttaaacagaaaaccgacactttggttattacaacataatgcaattttaagtaaataagcaggagccgtctttaccctcctgggatttccttgtggccgaatgaaaacccacccctacgctgtcattttatgtctttcagtttctgtgcagtcagaccacagagaggggctttcttcaccatggatttggcatcccttcagttagagagtggatctggacatatgccagatttgcctggatgtttttctgctttccaatcataagccaaaaaaacaaaaaaacaaaaacaagaagcacacaggaatgtatgatttgaattctggatctctcagttcccatctcttaattttttagttgtttggctaatgcttgggcattttagccatggataaatactagtaaaga

SEQ ID NO: 274815 - DNA, 466 bp, Homo sapiens
agggtaacttcccttgttttcagtacttctcctgtatttgcagtttctccaaataatcagctcaaaacaattcttctgccaaagaggcgtattttgggatggaatattctggcctcctacagtcatattttgggatagcatatcttgaaccccatcagtagttactgacagaagttattcacaaaagaccaaatatatgattctatctatatgaaatgttcagaataggcaaatatatagagatagaaagagactcaatactgtatgggactgagggaggtggaggaatgtggggtgactgctaatagcaatggggtttcttttgggggtgatgaaaatgttttaaaaccaatggtaatgatagttgcacaactctgggaatatactacaaaccacaaaattgtatactttaaatgggtaaattgtaaaatatgtgaattatatctcaataaaactgttgaaagag

SEQ ID NO: 274816 - DNA, 353 bp, Homo sapiens
cttgaaattaaatggcagaatttcatactgtaataggatgtatcaatttacctagtattaattagtgttaaaatactggatttttgtcaattattattagtctttgatgcatttctgtagctagcattgtcttttgtatgtgttggcctttgcatatttttccaaagaagtattatatacttttggggtttcttattttgaattgaagaatatgctaagattgcataaaaggaaaaataataaatacactatgttcaataggtcaatgtcttgttttttgttttttgtttttttttcacagcaatgattttaaataaaataaacatagtttaaaagtctgaagtattttgtcc

SEQ ID NO: 274817 - DNA, 342 bp, Homo sapiens
atattcaacctgtatctgggaacccaccctgcaggaggacagagggcctttgagggtggtaaggcccaatggagtgctgacccgacgtagtcaccctggctgaagtccctgagatgcctcctgcaccgctggtcaggaagagggagagcacatggaagtgcagggaaacctgaggcagtcactgaggacactccaaagctgcattactatcatgctgcccagacaaagccagcattctgttccccaagtgagcattcaaggcagcacagacacaggacaaaaagtgggtaaatgcattttccaacaccacaaagcatgggctacggcagcactccgaggcta

SEQ ID NO: 274818 - DNA, 887 bp, Homo sapiens
ggctggagcagccttagatgccaggtcagggtggcccgggggccactgcctccagctgtgtctagtgctgcagggatctcggcatgaggccccttctcccaggaggggaggcacagcctggagacacaggccccatccttcccaatggggacacttcagggagcggctctcaggtcccgagaaagaccttcctggccacaggagacacacggacatcgggaacggacggaggaaggatgtgcagttgcagccttttcagcagacgccctgagaacgggaggtcaagagttggagcagacggcgacagggcctcagacctaaggcaggagcaccccctatgccagacctcctgggtcacaggatatgcacggacattgggaagggatggaggatggacggaggaaggacgtgcagttgcagctctttctgcagatgccctgagagaggagcaagaaggtcctcgccagatgctcctggacttgctttggactttcccttgctcttggacttgctctggcacctgtgctcttggacttcacagcctctagaactgtgagaaataaatttccgttcagtataaaacaacaacaaaaacacaaaaaaaaaattgttggggcgcctgcgggccccggaaaaagtattcaaacccttcggtggcgcgccgggcccaggaggggatggaactgggccaagcgggccaaggaaaccggctgacagggcggtttccaccaaaaaaaccgcgggaccgcgtgtcgcacaaaccaagggctcgcgcttccggctctaacacggcccacgcgatacccccccgcgtggcgacagtcacacacgaacacacacaaaggaagatcaacgacccacccacacgcagacagccatggcagggc

SEQ ID NO: 274819 - DNA, 256 bp, Homo sapiens
ggctggagcagccttagatgccaggtcagggtggcccgggggccactgcctccagctgtgtctagtgctgcagggatctcggcatgaggccccttctcccaggaggggaggcacggccaccagatgcctccacccagaaaggtcagatgtgggagagttccagagtcattccccaaccctggatgagcttctgcagcctcagtgctactcaggttccagcaagacctggagcaggtgcaggtgaggccggaggcca

SEQ ID NO: 274820 - DNA, 869 bp, Homo sapiens
gggccaggtcagggtggccctggggccactgcctctacctgtgaccagcgctgctggggggatctgggcatgagaccccttctcccaggaggggagagcctggagacacaggccccatccttcccaatggggacacttcagggagcggctctcaggtcccgagaaagaccttcctggccacaggagacacacggacatcgggaacggacggaggaaggatgtgcagttgcagccttttcagcagacgccctgagaacgggaggtcaagagttggagcagacggcgacagggcctcagacctaaggcaggagcaccccctatgccagacctcctgggtcacaggatatgcacggacattgggaagggatggaggatggacggaggaaggacgtgcagttgcagctctttctgcagatgccctgagagaggagcaagaaggtcctcgccagatgctcctggacttgctttggactttcccttgctcttggacttgctctggcacctgtgctcttggacttcacagcctctagaactgtgagaaataaatttccgttcagtataaaacaacaacaaaaacacaaaaaaaaaattgttggggcgcctgcgggccccggaaaaagtattcaaacccttcggtggcgcgccgggcccaggaggggatggaactgggccaagcgggccaaggaaaccggctgacagggcggtttccaccaaaaaaaccgcgggaccgcgtgtcgcacaaaccaagggctcgcgcttccggctctaacacggcccacgcgatacccccccgcgtggcgacagtcacacacgaacacacacaaaggaagatcaacgacccacccacacgcagacagccatggcagggc

SEQ ID NO: 274821 - DNA, 1083 bp, Homo sapiens
ggctggagcagccttagatgccaggtcagggtggcccgggggccactgcctccagctgtgtctagtgctgcagggatctcggcatgaggccccttctcccaggaggggaggcacagcctggagacacaggccccatccttcccaatggggacacttcagggagcggctctcaggtcccgagaaagaccttcctggccacaggagacacacggacatcgggaacggacggaggaaggatgtgcagttgcagccttttcagcagacgccctgagaacgggaggtcaagagttggagcagacggcgacagggcctcagacctaaggcaggagcaccccctatgccagacctcctgggtcacaggatatgcacggacattgggaagggatggaggatggacggaggaaggacgtgcagttgcagctctttctgcagatgccctgagagaggaggtaggagcacccttgctgtggtttgaatgcttctctcctccaaaactcatgttgaaatttcattgccattgtaacagtatgaagagtgattaggtcataaggtccccacctcatgggtgggattggtgctgttataaaagggtgagttcggccccctcttgctctctttcttgccttccgccatgtgatgacacagcaagaaggtcctcgccagatgctcctggacttgctttggactttcccttgctcttggacttgctctggcacctgtgctcttggacttcacagcctctagaactgtgagaaataaatttccgttcagtataaaacaacaacaaaaacacaaaaaaaaaattgttggggcgcctgcgggccccggaaaaagtattcaaacccttcggtggcgcgccgggcccaggaggggatggaactgggccaagcgggccaaggaaaccggctgacagggcggtttccaccaaaaaaaccgcgggaccgcgtgtcgcacaaaccaagggctcgcgcttccggctctaacacggcccacgcgatacccccccgcgtggcgacagtcacacacgaacacacacaaaggaagatcaacgacccacccacacgcagacagccatggcagggc

SEQ ID NO: 274822 - DNA, 659 bp, Homo sapiens
gaccaggagaccatccctgcagcagccgggccatgctctgaggatgtgggacgaggacccccactgtctctgagtacagggcctcagacctaaggcaggagcaccccctatgccagacctcctgggtcacaggatatgcacggacattgggaagggatggaggatggacggaggaaggacgtgcagttgcagctctttctgcagatgccctgagagaggagcaagaaggtcctcgccagatgctcctggacttgctttggactttcccttgctcttggacttgctctggcacctgtgctcttggacttcacagcctctagaactgtgagaaataaatttccgttcagtataaaacaacaacaaaaacacaaaaaaaaaattgttggggcgcctgcgggccccggaaaaagtattcaaacccttcggtggcgcgccgggcccaggaggggatggaactgggccaagcgggccaaggaaaccggctgacagggcggtttccaccaaaaaaaccgcgggaccgcgtgtcgcacaaaccaagggctcgcgcttccggctctaacacggcccacgcgatacccccccgcgtggcgacagtcacacacgaacacacacaaaggaagatcaacgacccacccacacgcagacagccatggcagggc

SEQ ID NO: 274823 - DNA, 1338 bp, Homo sapiens
aggctgtcatcactgaattctgatgggctacctggaactggcttagggtgggattacatacgcctcctgccacatcggatttccttctattttgtcaggggtggcatcatccagtgagtaaatctgttagtgatctccctcgcataacctaggaattctctcaggatccatttttccagtagttttgagaaagcgaccaacaacagcaaagagagtagttcttccattccaagagcagccatcttgcttaactgacaaactagagagaactgcaaggactcagtacatccctggcacagtccgttctctctcacagcatattgtatgagactgtgtgagtgctgcttccacggtacactaaaaacccatggtccctgcattatttgagcaactgacaagcttctgaagttcaggttcgcgaacgctgagagcagcacccagtggatttgtggcagggacagcgtttcactatgttgtccaggcttgtttcaaactcctgggctcaagccatcagcctgcctcaacctcctaaagtgctgacattacaggcatgagccactgtgcccagccaggaaatgtttcaaatacttgagatttttgatgaaccaagctggctggtgtcgcctcagtttgtctaaattaccaaggaccgctggaatttccctgggaatatgtttcgggaaaggtcagaaactcttcagtcgtcttcacgcttccactcagtagcaacgtttttgcacactcattgactatcaactggttgtctatgactcaaattacataatgaatccagcacataaattatttactcagatttaatgccagcaactgttatctttgtatttttttcccctctgccagctaatctggctcatttcattggaattttggtcatgcccattctccttcggcactaaattaactccataacgtagtataaacagaacaagcttgtgtgtgatatgcttaactgttaatttacctaattaaactaattcaattaaatcatttacatctttttggtaacatgccagttgataccacagcagaagtggaatgtttcagaagatgattgttcagcaaatgaatggaaaaaaaataaaaggaaaacaaaatgagacaaccgtccaaatctcttggcttgaaaattaaatgatactgaaaaaatgcagctttcacggggcactgtgattagatatttttctgaaatcaattttctctacaaattggtattttaacagagtgatcacaatctattgtacaaaatattttaaacactatttgtacattcacatatttggtatgtttaagtaaagtgtgcttgttcccacaaaaagg

SEQ ID NO: 274824 - DNA, 935 bp, Homo sapiens
aggctgtcatcactgaattctgatgggctacctggaactggcttagggtgggattacatacgcctcctgccacatcggatttccttctattttgtcaggggtggcatcatccagtgagtaaatctgttagtgatctccctcgcataacctaggaattctctcaggatccatttttccagtagttttgagaaagcgaccaacaacagcaaagagagtagttcttccattccaagagcagccatcttgcttaactgacaaactagagagaactgcaaggactcagtacatccctggcacagtccgttctctctcacagcatattgtatgagactgtgtgagtgctgcttccacggtacactaaaaacccatggtccctgcattatttgagcaactgacaagcttctgaagttcaggttcgcgaacgctgagagcagcacccagtggatttgtggcagatgaggaaactgaggcccagagaggttaagtgattgccctgaagccacacagctaaccagagaagatataagttcctgccttccttacttcccattctcataagcaagtttccgcatgaacaaggtggcaggtctgagcaaaatgctaaaactgtggccccattttgtttgtgcacatgtatgtgtgtacatgagctattggtgtgacgggagtttgcggggatattctctccctgttacatgttttcacatttcccacaagacgggaatgaaaaggaaggaagagctgaaccattccctcaggcaagtagatctgtggcaaacaaagagtccacagctcggtctccacgggggtcagtctgacttccttccctcagaagcatcccgggctacattttcatcttcgccgtcttccaatcttgcataatctataataatgtgattccaaatgcattttagcaaatgcaagatggaatggga

SEQ ID NO: 274825 - DNA, 393 bp, Homo sapiens
gggatgggcacagtggcttacacctgtaatcccagaattctgggaggctgcggcgggtggatcacctgaggtcaggagttcgagaccagcctggccaacatggtgaaaccccatctctactaaaaatacaaaaattagccgggtgcagtggcatgcacctgtaatcccagctatggcaggagaatcgcttgtatctgggaggcggaggttgcagtgagccgagattgcaccactgcactccagcctgggtaacagagcgagactctgtctcaaaaaaaaaagtcatttatgttaccatatgatagattctttattgtgatttttcaaatgaagtactaaataaatattgaaataattcctcaattttaatatagaatatgatacatattaaca

SEQ ID NO: 274826 - DNA, 1502 bp, Homo sapiens
acatcgatacgactttttttttttacgattcaaaggaacaccattttaatatctgaaagtagcataatgttcagccaataggcattggtacaaccatacatactgcttgtttacagcaggcatcccttctgagtggctggcatctgtcctgtaccagttgttaaaatattttgaaaatcatctctgtattaaaataattgtggccctatgagatagggaatatgaaataaatgaaggattcctttaacatcaaaggtctttagagtaagactagaatacattagtatattttaaaagtctaaggaatgcaaaattcaataaagtgatatagccaacccttcacctaagaaagaaaaacacatcggggaacttcccactgtacaaagattttccaggatgggaaactaacatgatagaattatctgggtgctaatgggcttgctagttacattctgtgcacaaaggaaggaaaggtttataagcactggatcccaaatactttacattcattgcaacatagaagagaagagaaaaactataaatgtagttttaaattaaataccaaaactaatttcaccacttacagttcatttcccagtgtgactttttgcatctgagagccagaatgtttgtcaaccaaaagaaatccatgatgatgaagaaaccacatggctgaaggtgattttggtccattgaactgatgatcgtttactctaaggcagctaaggagacagtacgtaagcacttggatctcgccaggatggaattggaatgtatcctcaagagacagcagcaagaagtcgaagagtcccgcaaaatggccaataaaaacatcatatcctcctttctattcacaaacaactattatcaaatctttcccagatatctagaaagcagacactatgacaaatcttcaggctaggaagttcttcctggtatctaaactaattccttctgttgcaatctaaactcaatctcttactctatcctcaatgaaaaccaagagacgctgctcatcctcacttactgttgattttccctggatccctttcctatctaagcgacacaactcaaatgtcccttcttggctcttgtatcatccaagattcttgccagttatgcaggctgctgctaaggagtgatggagatgcacccaggtcagaggcatcttcctggctgtggtggcaggcactgccaatgcccagatcatggatcttcctggtagctgacctcctgacaacctctgggtctgaccagcatcccccaggggaggtaatcaaaccaaggcccagggctgcctaggagcctgtagacactaagagcactggagagccagagaggatgtcctctctgttcccctcctactccccactctgtcctttaggaagagggacctcactgaaggactcctcagtggcagaatgaatccatatggcttggcaggccagcagagaatttcagagaaaacgtctggaaaatgggaagctagctcttcaaccgct

SEQ ID NO: 274827 - DNA, 747 bp, Homo sapiens
atgaacaaaagcccagaagtggtaaagcagaggttccattctgcagattagtacaataggatattttaaagagaactgtgggtcgattctagactttgtcttgcatataataaaaagccacttcaaggtatttaatactgtcctttgaaatatcgcacttgaaatcccaattggctttctccacagcaaactactttagtcctgaaaaacttccagaacagtggttctcaagtggagggcttgttaaaagattgcctcttgcccaagggattctgaggcaggtctgggatgaatcccaagaatttgcatttctaacaagttcccaggtgatgatgatgctggtccagggaatacactttgaaaaccactgctctagaacaacatattcctaaaaagagaatttcaaggccaaaatttcagcaaactttgcatattataatcctatccttgagattcacagtgcccattagcaacattaaaggtcctaaggaatgcttatagtaaatgcttcacatttttgacctagcctttatcaaacaccttcttccctccatagatcacctattaatgtttcaaagtttgagaaacactgctctagaaatttttgtgacttaaacctaaggttgttagaataatacaaaagacactgtatattcagtgtttagcacgttcgtgcttaaatatggatggctgttagctgctacctgacaaaacattcagcaagcaatcattctttggtccaaaaaa

SEQ ID NO: 274828 - DNA, 345 bp, Homo sapiens
cccaggcagtcaggcctgcataagccccacattctgcagggcaagtgcatgtggcgtggctcaggaagagcagggatgaagagagtgggaaccccacgaggaaccgtgggcagcaggctggcggggagcccgcggtgcctggcgcgttctgtcttctggcctggaacgtaatcacgcgggcgctctgcttctcacccttgcatttgcgtgcacgctctgctgtgctcagagtcactgacaccaagggccctgtgtggctgggtggggatgcgagatgcaggcttgcctggtgacaggacttcttgcttcctgagttgtaccctgcacagactgcagaggctatca

SEQ ID NO: 274829 - DNA, 360 bp, Homo sapiens
ctgaggcaggcagatcacctgaggtcaggagctcaagactagcctgaccaacatggcaaaaccctgtctctactaaaaatacaaaaattagctgagcgtggtggcacacacctgtaatcccggctactctggggggcctgagagacagagcaagactccgtctcaaaaaaaatgagaggggatatcactactgactttatagatatcaaaaggattataagggagtactttgaaaaacctcagacaatgtaaatgatgaatgaataaacttctaaaaagccacaaagtaccaaaagtaactcaaaaagaaatagaaaatctgagtaaactgaaaagaaaaaattcttacaaagagctttc

SEQ ID NO: 274830 - DNA, 399 bp, Homo sapiens
ttatatcatgcaggaaatagtctctcaccacaatggaaaagttttaaagcataacgataagaaatcaatgacaacttcaatatttgccaattaaacaacaattctaaatggtgtattgatcaaagaagaaaccataaggcaaatcagaaatattttaaatggaaaaaggtataatttgatggatgtagataaagtattgcttagagagaaatttagtgctttaaatatttatattagaaagcaaaaatagggcatggtggtgggcacctgtagtcccagctactcgggagtctgaggcaggagaatggcgtgaacccaggaggcggagcttgcagtgagccgagattgtgccactgcactccagcctgggcgacagagtgagactctgtctcaaaaaaa

SEQ ID NO: 274831 - DNA, 375 bp, Homo sapiens
agtttgttcctgactgttgactttgtcctatgggagaggtcatctttgtgcaaattggcaatccacaagaagtgagctgtgcacaagagcatttgaagactcatgacacacagtcatagcaggaagtggcaaggcagcaagctgtgaagaggcttaaggggaagatggggaccagaggctgagaaaagatacagatcatccagagagcaattgtaatagacaccgagcctccctcttcaagtactgacctctaataaacatcttgcattcaagctccatctccactccctgagaacccaacctatgaggctaagtttaaaagaatttacagcaagagcagcaaaagcacattaaaataattaaacaatttttact

SEQ ID NO: 274832 - DNA, 443 bp, Homo sapiens
attaatacagagcctcaagaaagacaaagcaggttaaagaaagtacaagcatctttgcccaccagagtgacaaccctagacatcaccgaggatgggcaaggcacatccaatatccttctggcaggagtaagaattagccccagctctttggaaagcactttggcactgtctagccaacctgtgtgtactgtgtgaccctgacattctctgtcttggtatagatgtgagcaaagttcatactcatgtgcgttgggacacgcgtataagaaggtccacagggcattgcttataggaaaaaaaaaaacaacccaaaaactaggctgggcatggtggctcccacctgaaatcccaacactttaggaggctgaggcaggaggatcacttgaggccagaagttcaagatcagcctgggcaacatagtgagaaccaatctttcttttaaa

SEQ ID NO: 274833 - DNA, 343 bp, Homo sapiens
actccgtacccccctcccacatacacacgcctgacagatggggaaactgaggctcaaagagccgagcgcggaaagagcttctggacttcacaggccaatccggtaaccttatgcctgacaaacaaaaccttattgtcattggaggaggatggagggcgggagtgactaaatagctctaacttctgcttgccacctgccaggactcctttccctgggcttagtaagaggagagtctaaacgcgctaatgcccgggaaggagcaggcctcgcgttctggcaggctcctctatgggatcccggttccgaagaacagtagcaaataaacctctcctaggttatgcac

SEQ ID NO: 274834 - DNA, 474 bp, Homo sapiens
ctaatctccgtttcttataagcatatcagtcatattggattaaggccccctaataacctcattttaacttaattacctctttaaaaaccttatctccaaatatcgcattctgaggcactgtggactatcacttcagcatatgaatttgagggtaacacaaattccacacattaacagatggaagaactgagtctgtgaggtcaagtgtcttgcccaggctcagagcacagtcaggacttgttttctgtactagacacctaagcaacaaggaaacttctaattttcactttctgatatatcatggaattttttccacatcattgaaaacacttctacataatcctttttaatattacctagtttcccattgtgtgatcataatttatgtaagcaatcctgcattgatctaagatgtttcttgcactttttaaaaaaatatgcctgggaaacatagcgagaccctgcctctgcaaa

SEQ ID NO: 274835 - DNA, 397 bp, Homo sapiens
aactctgagggtgcttgttgaatggaattcatctgaaacttcagaagtgccttcccattgtgtcagggtgtgtgtgtgtgtgtgtgtgtgtgggtatgtgtgtaggcggaggaaggagggacagtgtgtgtttaatcttctcaactaactttcacatttttttgagagtagggtcaatgtcttctactttcattagtgtgcttgtctttcaaagctccttgcctactgcagacagcagagtgaatggccctattttcatgtcatgttaaagacacccatgaaggtgaactgaactatacagaagagaaaggtagccagggagctgataacaacagagaaaaatgagaatttactcagcaggtggatctcaccaacttgcagaaggctttaagattct

SEQ ID NO: 274836 - DNA, 487 bp, Homo sapiens
gccttccgttattacagcgtagtacaagagatgagatgtgtaggaaaataacaggaaaggttcagataaagagctacagtgctcagtggcaagagagatagcttctgtttgaggtgatccagtaacagagctggtcttgaaggatggtaagttttaaacatctttggtgagaagaaggtcattcctgatggaggaaccatcatttatgcaaagacacagaagtgggaagtcttaggatatgtcctgagagcagtaaattgcttaatttgtctcacccagttctcaactgggtgattttgcccccatggatcactttggcaatgtctggagacatttttggctgttacaaatggaggaagagggagttgttactagggtttagtggatagaaagatgctgctaaacatcctacactgtacaggacatcccccctgcaccaccacccccaacaaagaattatctggtccaagatgtcagtaggactgag

SEQ ID NO: 274837 - DNA, 276 bp, Homo sapiens
tataaaaaaggaggaaatgtaggaaagggagttaattatcaacacataaaacattttatgcacagaacactagtctgctcacttataatagtggccaaattaagataacaaaatttagcagatttcaatgatgtgagggaccaaggtgaggtttatgaggtagttgacagagaacagagaattaaaattacatcattaaccatatagtgaaacattttcattgaggatcatcatttctcttttcttcctagtacagctcaatgatacacatttata

SEQ ID NO: 274838 - DNA, 945 bp, Homo sapiens
atcagaaatgatgcgtacagtagtagttgtttgttgttagtgcgaggactttgtgatggagcaagctttaatttaaacttttcaagacaatattatgaagaatgcacagaggaaaaagcatgttatggatataatttgagccctatgaaatggggatagctacagcattgaaatgtacctaatacaatttgagttattctcactaagaaaccttgatggtatctgccttctaggtactgtgcttttggaaatactatatatccatttaaatgcagatcttctcttttctccagggagcagttggtgaatctttcaattgaaccacgggtatgataaaaccaactgaaaatttttccatgaacaatagagtctgtcgttttgaagtaatgattatcaagtttcataatattgtgatttttaaaaattcatttaaaatatcttcataaagtcaaaataatgtaccgggacttcttgtgcaaaggaagaagttttctcttgtcactttgttgtcagtttgttaaagctgtgaaatcatacggctttgcaattcagtttttaggttggcactgccatcccagtagagtaaggtaggctttaggaatcagagcaaagaattataagtaagttctatgtgttctcaccctctcatgctagtggatgagcgtgtggtgctgtaggagagtttaaagatctttctcggctgggcacagtggctcactcatgcctgtaatcccagcactttgggaggctgaggtgggtggatcacgaggtcaggagattgagaccatcctggccaacatgatgaaaccctgtctctaccaaaaatacaaaaattagctgggtgtggtggtgcgcacctgtaatcccagctactcaggaggctgaggcaggagaatggcttgcacccgggaggtagagatagcagtcagccgagatggcgccact

SEQ ID NO: 274839 - DNA, 2175 bp, Homo sapiens
tagctataacccttctcttatttcagtggcagctttagggtttctgggatacatctttaatttatcacattctgctttcaagtgtaattatacctccctttctggcctttatcctagtgttacgtatttttactttatgcattataagttttgtgattatcattaccttcatttattatgtcaaatatttttaaaaagatttaaattataagaaaatgtgtagtacatgctttctaaatgccatttccaatatttgtttttgtataggtccagatttttatctgggatccttttgcttctgcctggaggactcttaagatttcttgtagcgtgggttggtgaattcttttagtttttgtatgtttttcaatgtccttatttcactcacagttttgaaattttatttttgcatagaattctaggttaatttttttctctagtactttaaaaatgttgccatttatgaagcattgccatttaaagtatcatctttcatgtgcttgtgaaaatggcataaagccggtttcttgtgctggttatgtaattttcagaatgtgtatttaaatttaaaatattaaattttcctaaaaaactaaaaatattaatcatgaatgtcctagattcatcttaaattccaccaacagtgcacttaaaatgtgcccaacctgagggtcaaacctacctgctgacatgtaatttgtgtttgtgagacattctcaacagcatttgctttccccagctgagtgatcttcctcacatctgaatgtcttcagtgcaaaaggaaatgtttttcttcgcaaaaatactttcaaatactcttacttcaaggaagtgcattaaaaacaaacttctcatttgcatccctggaattcaaagccctaatcaagtgcttcaggatcaagagctaaacaggggaggacaaagcgtggcttcttcactaggagtcaagccaaagtcaactggtttggtctccaacgtagatcggaactcggttcaccagcgacctgaggacccggcccagaagagggagtatctcttcatggtgccttcagatagaaaatctcctaggatttctttctttccctttgatctacttccaactctccctttctatttcttcaagacctttttcggatccctactgcgaaggacctaaggggccggtgcccttccccactggtccctccctgcctggtgtcttaggagcccaagctcacctggaacattactgcccgccggagacagcgagaggaccaaggagcgcggcggtgcggtgggaaccacagcgtcaccgctcacctgcgcctcgtgggctcctagaaaattgaataaatgccccctgaagcttctctgcaggtcacacggaagaggagggtggctgccgacacgcgggagaagcttcaagaagcgtcgggaggacctacctggtcctgcccctgggccttgaagacaggcctggccaggctgatttggtccggtagtctcaaagaaaatgttcaagggtggcccaaacctccaccccaagattaaggctcttaaatgtctgacggttttgagactcgtcagtagaatcaatcccgcctgtatcaggagactcctttgccaaaattcaaagaccaagaaagagaaagattgggcaggttaaagtctgtaattaaccaaacaggagacagaatttttctgagaaattgtatgtgtgctgtgagaaaaagactagcctcaaggagaatctgttcttttggcttaattgtaggaaagaatggaattgccaccaacaatggtgcgttgaaacggcaggtgcatcaggctgtagatgtgaaggaattaaaaatattttaccccaaaatacatttctttgacatattttgagatgtctgttcagaaagccagctgcagaagtagccctgcaaagttgtctttcgttggggagatttgcatctgtagggaatctgcattgatgcagccaagtctttccttgcccagatctaggaaagattaactgagagtctgacagctgtaaaggtctgaaagaaactttcagagcttattctttctgagagctgctgcctgtaaggtttcatttacatattaagatcacctttgctagccaggcctcctcttctctccctcccataacctgtcttgcccacaataaatggatatacctctgactct

SEQ ID NO: 274840 - DNA, 467 bp, Homo sapiens
agatggctaaaggaaaaatcaccaaaaagaaagggttctaaaggaaaatcctgaaatcacaatggcaaaaatgacagaagaaaatgaattaaaaaatcaaaagagacagatgttacatgcagaagcccacgtctgctttctctgagaggatgtgatatactcttccccgggcaggagctgatcatttaaaagacctttatttaatagtttcggatggtttatttgtattactccttttagaaggatgataataaaatttcccttttcctaatgatttggccccattttataaacattgattttttttttctccctcctaactcaatacttctccacagtagtggctgaactatgtacttccctgtggcagtcatgagacaaataatcatccatacagagcttgatcagtgctccctgcacagccaggcaaaggggctttatgaagaaaggcactaggaattctgaat

SEQ ID NO: 274841 - DNA, 355 bp, Homo sapiens
  misc_feature (125)..(125): n is a, c, g, or t
  misc_feature (134)..(134): n is a, c, g, or t
agaagtgctcgcctctctggcagagggagcttcacttctgttccattcatctccctagctgctcagcagttcctccttttggaggctgctgttcctctcctcttccgaggcttgggcatcccagntgcaggacntgggagcccaagccccccagccacgtgagcctcgtgccccggtgcacagcagccccgctcctgcccagccgtcagcgctcactttcctcccagcttttgttccgcacctttcctccctacaggttctggcactgcgccttgctgctgacttgtatttttttctccatgatacaggagggagggtaattaggaggaaatcctgagaatcttcaaactactgg

SEQ ID NO: 274842 - DNA, 368 bp, Homo sapiens
ctctttatttgttcttactctgttctatttggccccagaaagggctccccatttcagaaagagaatgtctggtacaggggagacgctcagtaaataaaagaccccaatttgttctcaagccatgaatattttgcaaattaatgcaaagttctggtttactaattaatctactgtgcatttggttaatttgaatcagtcctcagggtcagacagtcctggaagggggaatagaaaaactggcaactgaggttatcaatctgcagacagactttgaactctggtgccccccacccactacagccaatgaaaagggccttgaatgacacaggagctttctccctttcctttgaaaagtgtttgtcctttcc

SEQ ID NO: 274843 - DNA, 139 bp, Homo sapiens
tcttgtactgtactctagggctgtttatatttttttaatctataatattaagtttcctagtcatttacctttttttggtaaacacttgagttatacaatgatgaaaagtaaagttccttcctactgtttctctccagtc

SEQ ID NO: 274844 - DNA, 561 bp, Homo sapiens
gtgtagcctaggggcaataggctatgccatatagcctaggtgtgcagtaagctacagcacataggtctgcataagtacaccctatgatgttcgcacaatgacaaaattgcctaatgacacatttctcagagggcatccccaacaataagcagcccatgactgtatattgctaaaataagtacatatagaatgtaaaaatatagcaagcaaaacaaaacaacaacataaaaaaatcctcatatttacactagcagccaggaactgtcttttgagttctgaggacaatgacctcctttcactgaccccaaatggctggagtcagtcagtagtccacacatacttctttacttgtttcctctttgccacattcactaggaagatgctacaacaaccatcgccaggtggccaactctggttcacctctatgctcacattcaaaatggccctgggattgagctgggtagaatgcagcctccaaacctagaccagaagctccccattagagcttccttttcttagaataaataaacatccaaggtaaagaggagccaaaatgtattc

SEQ ID NO: 274845 - DNA, 301 bp, Homo sapiens
cagctagtaagttgcagagctgggattccagttcagttggtcagattctttaaccagttcttaacctgcaggctagattttagccttatcctggttcacatgtatttaaatattctggccggaggataccccactaagtataaaatagctttgaaataaagctatttcaagggaatgtctaagaaggtatctgaagcatctaaatgaagaaactagcattagaaaacatactaactggcaattttatttagaatcatgtggctgtgcattccatttcttaaagatagtaaattttcttaag

SEQ ID NO: 274846 - DNA, 315 bp, Homo sapiens
ttggccactcctaaatttggagcaagaaggccccgagggaggaaggggaatcatgtggtcaaaagtgcccagatcaggccagtaccaggtcagcgtgcgggggctgaaactctctgtcccactgatgctggggacgtaggaggactgggttcagaagcccctcagtggttgttaggagtctggaggtccaggcacctagacagccctggcgtgttcgtgttattaatcagggatctctttttatttatttatttatttatttatttatttatttatttatttttgagagcgtagtttcagtcttgttgcccaggg

SEQ ID NO: 274847 - DNA, 566 bp, Homo sapiens
gctggttgcgggttgagcgaaaacaaggaacagatttgagtttgtccaaagcatgcttggtacttgaaaattaacccttcaagactgggcatgtgtccagtgatgctctgaagctggcaaagatgagcatcaaatcaccagacgtgcatggagagcatgagctgaacgaccgtcgtgataggcttggcagaggatgaagcagagggtggcaccggagccctacctgggtgctggcactgcctcggcctcttgcttactatgacgccgtgtgaatcacagcatctagcggccctccttcccccttactatgacttccaattttgaaatactgtgactctgctgtgtacttaattgacatctctttctgaaggaatttacaatccagttgatgatgtaagacccactatcataagccaattagagaaccaaacaagtgctgaagggacccctatggaggcagagaacctgaaatgaacagtgaagactaaatctgacttacaaaggtgaggagcagggagtacatttctttcctaatgcttgcactgggatttctgacgaatacctca

SEQ ID NO: 274848 - DNA, 319 bp, Homo sapiens
tcgtgctcatgcgctctctctttctctgtcatatacattagagaacctatgagcccacccgccagccaccccacccccaacactggggacattgctgaaagtttgtttaggactgcaaaatgaagaaaaaataagtaacgtggtgtgtagaatggagtggtggaggaggggaaattgacagggatgggaaagctgggtgggaagggttagctcagtatcacagctgtgaggtgagagtagcagtggaaacagaataatgaaaaaatagagacattttgaggactagccttctaggaggagatttctggatataggaaaa

SEQ ID NO: 274849 - DNA, 451 bp, Homo sapiens
atagggtagccagaagatgaatggtatttgtttgtcccccacatccactgcatccctagacccactgccccaaaggcagtagaagtaatattactagtgaacaaattcagcccacctgcatgcctgcagtccattctaggtagaactaggttactcagaagcaggcactggttctttgctgatggtaaacacttataggagcattggagttcactacaccaggagccacttttcctcagggcagttcagtgatttcccagagcaaaagcaagaaccaaagggaatcccaaccatttctcctccctggtccgctccatcacaaagtcacacccacagcttcccttgtacctcctctccctaagcatgcagctctttgaagttttctgaatgttttgaccactagctaaaagaagacaattgtggggtaataaatactccctttctatgcaaa

SEQ ID NO: 274850 - DNA, 232 bp, Homo sapiens
gcccagagaaacaataagaagcataagaattggaaaggaagagataaaacatcatctgcatgtaagtagataaaatgactgtacatcagaaaacctaaaagaggacaaagaccactagcaaaggattggctacaattaaacatttaaaaaattcctgtcattcttatgccaaaacaaaaaaaacagaagaaaatgtagaagaaaagagtatattttctattgcacagaagtg

SEQ ID NO: 274851 - DNA, 273 bp, Homo sapiens
tggcatgagattgttctatcaataatctaaggtaattcaggaaagattgaattttgagtattaaaggtttgcagatgctagtgtttaatttttgatagtgtggtgtcttggttatgtattgcggcatagcatactaccccaaaacttagtgtcttaaaaccatattttaattatctcacaagttccttggtcaggaatttgctcagtgcttggttgggtgattcttctgcttcacatggcattgactggagtcacttaacagtctggtgtggg

SEQ ID NO: 274852 - DNA, 400 bp, Homo sapiens
tgagatggagtctcactctgttgccaggctggtgcaatctcggctcactgcaatctccagctccctggtttaagcgattctcctgcttcagcctcccgagtagctgagattaaaggcatgcaccaccatgctcaactaattttgtatttttagtacagagggggtttcaccatgttggccaggatggtatcaatctcctgatctcatgatctgcccgccttggcttcccacaatgttgggattacaggagtgagccaccgctcccagccctcaattctttaaaacagaaaattcagcatctcagatggaatcaattgagctgttagtttaattttgagaatctcagatcaagctgatgaaaaggacataatgaacacattttaagaagacactggctatg

SEQ ID NO: 274853 - DNA, 260 bp, Homo sapiens
tatgggcaactcaaggaagaaaggaaagaagagatagaggaaaaatggattcaacaaatgaaagtgttctttctgactactgctgtgtttacaaacattttaatcatcaaaacatgctttatttgatagaaagatcaaatctgcctttgtaaaacaagagactattttaatcattaagacaacacatatgtttgatttggaggcgtgttctcattcaaaaccttgcaaaatataatttcttcttgtctgggagatggtgt

SEQ ID NO: 274854 - DNA, 850 bp, Homo sapiens
aaagtcgcgtttattacgcaagtccaatatgtctctagcccaaatgcgtttgaatgtgttgcacaggcgcatgtgttagtgtgtgaaggagtccagcccccagaactggtggatgaggcaccccagaaacgtgcctgagttgagaagtttgttcagagccaggcattttgagcttgaacttacacccataggggtaaaaatggaaaccacacagttgattagtcagtccgccaaacatttttgcaaggagttacacaacttagtgccacgttgtgtctgtacggccatggggttgtgaaatgggggaacccgaaacattgttgcgacttgaaaatcacagcatcttggtttaggtaaaatgtgtttttgtcacgcaaagcttttaaaaccaagcgtggcacttatggtgtaaagagtatctgtgttccctagcttttgggttctaccttaatggacagagattaaatatcttgctaagaaattaaaagcacaatgtctcaacgggcataatcatagacggttgtgggcggtgccatgttcttcatcggtttcaccgcgctcgttatcatgtggcagaagcactatgtgtacggccccctcccgcaaagctttgacaaagagtgggtggccaagcagaccaagaggatgctggacatgaaggtgaaccccatccagggcttagcctccaagtgggactacgaaaagaacgagtggaagaagtgagagatgctggcctgcgcctgcacctgcgcctggctctgtcaccgccatgcaactccatgcctatttactggaaacctgttatgccaaacagttgtaccactgctaataaatgaccagtttacctgaa

SEQ ID NO: 274855 - DNA, 594 bp, Homo sapiens
  misc_feature (1)..(1): n is a, c, g, or t
  misc_feature (34)..(34): n is a, c, g, or t
  misc_feature (36)..(36): n is a, c, g, or t
ngagagagagagagagagagcgccgatccatatnanctgggagcgaaaagtcttcgctcttcacaacactttcatgagctcgtacacaccccttgccggaggtggcccatgtcaagcacctgtctgccagccagaaggcattgaaggagaaggagaaggcctcctggagcagcctctccatggatgagaaagtcgagttgtatcgcattaagttcaaggagagctttgctgagatgaacaggggctcgaacgagtggaagacggttgtgggcggtgccatgttcttcatcggtttcaccgcgctcgttatcatgtggcagaagcactatgtgtacggccccctcccgcaaagctttgacaaagagtgggtggccaagcagaccaagaggatgctggacatgaaggtgaaccccatccagggcttagcctccaagtgggactacgaaaagaacgagtggaagaagtgagagatgctggcctgcgcctgcacctgcgcctggctctgtcaccgccatgcaactccatgcctatttactggaaacctgttatgccaaacagttgtaccactgctaataaatgaccagtttacctgaa

SEQ ID NO: 274856 - DNA, 512 bp, Homo sapiens
cttcaagtagccatccggactcgtaggcacctccttaccagttcagaatgcactgaaggtagaacgacaaggcctcctggcagtcaccctgtccagttgattataaaacttcgtgattggagaaccctcgtggcgggagagctttgctgagatgaacaggggctcgaacgagtggaagacggttgtgggcggtgccatgttcttcatcggtttcaccgcgctcgttatcatgtggcagaagcactatgtgtacggccccctcccgcaaagctttgacaaagagtgggtggccaagcagaccaagaggatgctggacatgaaggtgaaccccatccagggcttagcctccaagtgggactacgaaaagaacgagtggaagaagtgagagatgctggcctgcgcctgcacctgcgcctggctctgtcaccgccatgcaactccatgcctatttactggaaacctgttatgccaaacagttgtaccactgctaataaatgaccagtttacctgaa

SEQ ID NO: 274857 - DNA, 351 bp, Homo sapiens
aaagagatagccaagaagagccctcctggaatctggtttatccttgaggttcgggaagtatgtatggacagggctgtatccactcaggagcaatcagatgtgaaacaaacttgaaagcattctctaaggcatacacagatccatcagcaaagagcagaaatcttattagctcaaagtgcttaagcagaacctctgaccaaacactggctgaacacataaatgtgtttgttcaaagaactaaaggaaatcatatttaaaaaaggaaggtaaaggaacaattacagttgttcctccatatccatggattcctcatctgtggattcaaccaactgtggatcaaaagtatttagg

SEQ ID NO: 274858 - DNA, 580 bp, Homo sapiens
agctactccgcaaggcgactacactcattctttgggctcccaaggctgagaaatggagaaccaattggccggtttgctctctgttgcttcccccccacccggccttcctccgagtggcgaggcaatcctgcacaagagtttgtaaagtgcttaggaagcttgtaggatgaaagacgctataaatacacccaatgttactagtttatgaccacggagcattccgtggaaccactgtcactgcgtcgggggcaggttgatggcatagaccttcctggggaggggggcagagagagagggcagccccttcatcaccctaaaagctaggctgggtaaattttcaaagtgtagcgaaaccccacgtgaaaagttccacacacgccccacacagggaggactccgcggctgctagcagcgccggagactgggcctacaaccccggcaacgtggggaggcgtggggcggccgaggggccccggccgcagccgacgcccgcggagcggctgaaggagcagctcccggacgggggcgcggcgccaggcccgggctcccggcgcggggaacggcccgggagggcggccgc

SEQ ID NO: 274859 - DNA, 274 bp, Homo sapiens
attgctgtgtaatattccattgtataaatatatgttgtatagccgtaagtacggcgcaatttattctaacagtggacatctgggttatttctagttattagctaacaaaaagcttctgtgaatactcttgtacatgtattttggtgaacacatgcatttcttttggttgtatgtacctaggagaagaattgcctaggatagtcatgtggctagtattagtaccttggtttttaatgtatggctcttggaccagcattatcagcatcacctggca

SEQ ID NO: 274860 - DNA, 280 bp, Homo sapiens
aggatcgcttgagcccaggagttggaggctgcagtgaactatgatcatgccagtgcactccagcctgggtgacagagcaagacactgtctctaaaggaatgaatgaatgcatgaatgctactattagccacatcagtaaaacatcagcagggaggcagccagaagttggctggcaggggcaggggtgggcggtctccagaagcaggtgaggccctgatcccttcattccctcacttggataggctgcaggagatgtggccaaactccctcattccagaca

SEQ ID NO: 274861 - DNA, 408 bp, Homo sapiens
taaatgagacagaatcttgctctgtctcccaggctggagtgcagtggcatgatctcagctcactgcaacctctgcctcccaaatagctgggactacaggcgtgcgccaccacacacggctaatttttgtatttttggtagagatggggttggtctcaaactcctgacctcaagtgatccacccaccttggtctcccagagtgctgggattacaggtgtgagccaccatgcccagcccgactggcttaacataatgccctctaggttcatccatgttgtcataaatgacagaatttccttatttttttttccataagagacagccttaaataaaaaagaaagaaagaaagggaaagaaagaaagaaggaaagaaggaaagaaaggaaggagggaaggaaggaaagaaag

SEQ ID NO: 274862 - DNA, 764 bp, Homo sapiens
ctcagtaatgtgctccggttcattcaggagtgtgggtttcttgctgagctgggaatatgctgtttaaaagcgatgcccgaatcagtgcttacttatcaaaaaagagttcctcacagtggaagccgttgctactaatgctaaatggggattatgctgccgagattcgaaggtcagggattaatgcaggagacatggaaggacagtgtcccggggtccatcattacagcagtgcagtgtgcgtgtctctctggagtggtttgtgtcatgtggacaagccgccgaccggagcagcacctggtgtggaacccgtttagaaactagcttacaataattttcatttattagggccagtggaaaattgtgaaagtttccatagatttccttgtttttaggtttttattctttttatatttccagtttggggggaaaaatacatgtattgccacttaaacagattatgtgattactgtgtgtttctttcaaataatagaattattacttgtaaatttctgcatataattacagattaattgcctttcagagaataaatgggatatttagccaatgcatgttgagattctcagtgaggagcttccttcttcttccactgctttaaatgaaactgttagagtgcttaatagatttctaacctgtgtcaattgtctctgaacactgccttacttctcctattctgacttgttaacaaatatcttatacacaaagtgaaaaaaaattaaatccagtgaaataaatcacttacaaat

SEQ ID NO: 274863 - DNA, 302 bp, Homo sapiens
ctgcagtgcctggcctcgattcttttcctatactgtgcctgtatgtctcctgtaatcacttttggagggctgcttggagaagctacagaaggcagaatagtgagtacaaagattggtagtggccaggcttttagctcttcagaggcaagtgtctgtatgcatttgtctcactattcatacttttatttgaagagtctacccacagcatgattaacgtgacccaaagcagactttccccaaaggtaattgctgtggaaaacatggggaagccatttgaacagaagatgcacagttgaggtaaa

SEQ ID NO: 274864 - DNA, 328 bp, Homo sapiens
acagcacagaagagaccagagaagagcctcctggaggagagcctgcactttgaccatgctgtccggatgggtgcagtgctcttttctgcaaagtgttcacttctctgctttttctatggtcccatttcatagaaagatttggggtgatgtttctttccctcaacttttattttgaaaacttgcaaacacagaaaagttgataaaatcatacagtgaacatctgtatgctattcaactggattcactagttaatgttttgtcacacttgttttctgtcttctgcgtatggaagattgtatatgtgccctttttccctctgaatcatttc

SEQ ID NO: 274865 - DNA, 706 bp, Homo sapiens
gttcaacatgaaagaatccatacaggggagaaaccctatgaatgtaaagaatgtgggaaggcttttagtcgtggctatcaccttactcaacatcagaaaattcataccggtgagaaacctttcaaatgtaaggaatgtgggaaggccttcagttggggttcaagcctagttaagcatgagagagtccatactaatgagaagtcttatgaatgtaaagactgtgggaaggcctttggtagtggctatcaacttagtgttcatcagagatttcatactggtgagaagctttatcaacgtaaggaattcgggaagacctttactcgtggctcaaaacttgttcatgagagaactcatagtaatgataaaccctacaaatataacgaatgtggggaagcctttctgtggacaacttactcaaatgagaaaattgatactgatgaaaccttatgattgaaagttgtaaaagaatattttgtgtgtgtgtatagacaacttatcataataagaactcttactcttgagaaaccttgtgaatgtaagggttgtgcaaaagccattcatttctgtttatgggcaattatcttgctatccagcaattcatactagtgagaaatattttgaatataactaatatgaaaaggcctttagacttctgtacagtcttattggatatcaatttatactgatgtaaaatcatttaaatgta

SEQ ID NO: 274866 - DNA, 422 bp, Homo sapiens
gaaatgagctccatcaaccaaacacaacttttaccacagtcagaccctcaaaggtttcaaaaagcgtaaaggcaaaaagcaccatccaacggacaacaacttcaaaatttaaagaaacatcagctaacacagatgagaaaaaacccagcaaaagaattctgacaactgtaaaagtaaaagtgtcttcttacctccaaatgatcacactagctccccagcaatgattcttaaccagactgaaatggctgaaatgacagacaaagaattcagaatcgggatagcaaggaaactcaatgagatgcagaagaaggttaaaacctaattctaggaaagcagtaaaatgatccatgagttgaaagataacataacaattttaagaaagaaccaaattgaaattctgtaaatgaaaaatttactacatg

SEQ ID NO: 274867 - DNA, 403 bp, Homo sapiens
tgagggtttggggcacagtcttcacacaggctggagtgcatcccagaggtgagggtttggggcacagtcttcacacaggctggagtgcaccccagaggtgagggtttggggcacagtcttcacacaggctggagtgcaccccagaggtgagggtttggggcacagtcttcacacaggctggagtgcaccccagaggtgagggtttggggcacagttttcacacaggctggagtgcacaccagggaggcttcccgcctctggcagaatcaccgccatgctcagtcacaaacccagagctgcgtttggacgctgcagcacacgctgcggccccagcaacggtcctgcgcaccaggctcctctcccagtaaggtccgcttctctgtggagctcaggggtccctgca

SEQ ID NO: 274868 - DNA, 274 bp, Homo sapiens
cggggtctcaccatgttggtcaagctggtcttgaactcctggcctcaagtgattcacctgcctcagcctcccaaagtactgggattacagatatgaggcaccatgcccaagcctccttttctctttttttcttttctttcttgtgagacagaatcttgctctgtgggtcaggctaaagtgcagtggcatgatcatagctaactgaagcttcgacctcctaagcttaattgatcctcctgcctcagcctcccaagtagctaggacacataggtga

SEQ ID NO: 274869 - DNA, 381 bp, Homo sapiens
tcttaattctcacagccaggtgaagagggaggtgtcagtcctctcttcttacttacaaaacaacaacaacaacaaaaacagaaaaaacaacccaaaacccctgaggctcagagaggtaaagtgacttgcccaaagacacacagcaagtaaatattgcagctggtatacgaaacctatttccctgatactggaaacagcaagcactctttccactatcctgtaattctgtcaggctgcagcatgaagacaaagatcacactgatcagagatttacccaggatgctataaataccattgctaattactcataaccacaaaagtcaccacgtcttgccttgttgttcctttaaccaatacacaaagagccattctcagcaatgt

SEQ ID NO: 274870 - DNA, 473 bp, Homo sapiens
aaaagattagaatttaggtaaatttatagcatatgtaagattttatagaaatatttacctaaggggtagttattttaactgtctatgtacagcagtataagtgaaggccactctgatgtgctggtttcatatgggagaaactataattaaccgaatgcataatatatagccagcaagacagtttatatacagtgtcatttggtccttagaagaattctttgaaatagatgattttcatctccgtcttataagtatgaaagctgaagttctaagttcagtaactcatctaaggtcacttagtaagctgcagaggcaggatttgaacactgcttgatctgattactcagtccataaacatttcatgtatcacacaacttccattcttgtccatttattgaagttgcctttttatctgcaacactcctctttaccttgtatactttaaagtgattaaaatatcctgtaaaaatgtt

SEQ ID NO: 274871 - DNA, 945 bp, Homo sapiens
actttttggttttcttaggaactaaatatattacctcttaatatgtttagatatatataaatatatcttattatattggtatatattaatatatattattcccactggtgtactttaggataggtatgttaggtggctcaggatgaggattacagaggtgcaaatagaatctgctcagaagccagattgtctagggcattatttcacctatgtggactgtcaaatgcatcttcccttgacttactagagaactcagaagtaagcaagccctggagcacctgaaagtaccaaggatacaaatcatgtattccatgctaattgggttctttttgagacagaaggaaagttcattttcattaggtagtttatcaagtttctccaaaagcaacactgaggaatataggagaagctatgagaaatgcagaaagagaaaagaaaaaaaaaagagttaaaagaatgagaacaaaggaggggttagaatgacagatactgggggcaagtgatggggagcatcagaaaggactttgagagaggacaaaagaaaaagctgccgtatttcttctaagatgtaattttttttttcacctcataacataacattaactgtcttacagttaatagcatctgagtattgcttttggccaggtggcagttttgatctagttgtcattgtacaggcatggctctgacttgctgtttctgttgctgtcatttcagtctcagtgtggacattgttttaacttctcgtgttgagtaattgccatttaaaatattttcttagttgttgttttcacatcttcatttagatcctctagggacaccaaacaggcaccagtatcaaaatttgcaggatggttgtcagtggcttgaaagacagtcctggagcagtgtcggaacattcttcatacttacattcttgatggcagaaggatgatactgtgaata

SEQ ID NO: 274872 - DNA, 301 bp, Homo sapiens
ggaattagaggtagggtggatatcgggtctagggttgggtgaagggttggatctagaatttctgttgcttttgggtttgggttgagttgaggcatggagggtggatttaggatggatactgtgatgacctgttggtggctgtccgccctacagatggttataggattgtagtaatgtggatggagaagtttattggcattaggattagggtagagtttggaattaggaatgacattgagaaaggattaagaattgaggctggctgggcttggtggctcacacttgtaatcccagcattttg

SEQ ID NO: 274873 - DNA, 442 bp, Homo sapiens
tcctgcctcagcctctcaagtagctgggactacagtcacatgccaccatgcctggttaatttttgtatttttagtagagatggggttttgccatgttggccaggctggtcttaaattcctgacttcaggtgatctgcccaccttggcctcccaaagtgctgggattacagctgtgagccaccatctcccacccttccagacaaattctatacatatacaaatatccactctctctctgtgtatgtataattgtaggatatttggttatatatctttttccctcacaaacagaagcatactgtatacggtttgcaccttgctttttcatgaaatgatgaactgcaaattgttctgtatcagtaaatctagattaactccttttttcccaagagctacatagtattttattgcatcatcctctttttttttaaaaaaaaaacaa

SEQ ID NO: 274874 - DNA, 408 bp, Homo sapiens
aggctggtcttgaactcctacctcagatgatctgcctgcctcggcctcccaaagtgctgggattacaggcatgaggccccatgcccagcctgctctgtgcttttaacaaatgttatgtaactgaatcctcaaagcagcccctatcaggtaagtggcacctgtgttttagaccaggaaatagtgacacagagaatccaagtgtccaccacttcaaagtagtgggcctagggtctgcctccttgtatgtctgcctccaaccccagtgtctgtaatcactattacatgctgctgctgttcatttctcattattgtaaaattagattttatgtctatttctctgattctgaaaatgacctaagtgtttcagtggaagcctatacaacatagctagcttggtcactttcatgg

SEQ ID NO: 274875 - DNA, 684 bp, Homo sapiens
agttgataagtttagttttgaattctgagtttgagtttacttttccaaatggaaacaagatcaaaggatggatgagaggacaggagtgcagaaattcaagaattggtacagaagggatattgagggctacacagaagtggctgaagtcatcaggtatgattatgactcaaaatggcaaacaattattcagtgttttttatgtgctaggcacaatttcaaatgtactacaagaattatctcttttattctcacagttctaagagtttctcttcctattttacatatggtaaaaaatgaggacaagagaggtctagtaacttgcaaaaggttacaaaggtcaggggtgatagagccacagttcaaacccagcagtctgacagcagagtaaatgctcttaactctttatgttgtgttacctacacttaagttagaggaagtcaggatgaaacatgagagtaataagccttccaagtgagggaactggagagacaagtagagtaccaggtcaagggaaggagtactgaccttgagatatagcctgtggggttctgggtaggacaacggagaggactgcagaagttccagcagacactgggcaccaacttcacctgctgcacagttttgcttagaaacagcagcatgttataacacattcagcttccttgccttaacaaagcactaagt

SEQ ID NO: 274876 - DNA, 363 bp, Homo sapiens
ttgacctaccacatctcaattcaaacaagtcacatttcaagtgctcagtagccgtatgtggccacaggctgccatattggacaacagaggtctaaggtgtatatgatttggggaaatgcttgcttatttctctaagcttcagtttccttatctgtgaaatagagattagcatgcaccttccagagtccttgttagaattaaatgagataatgtattttaacattcccaaaacaataccagtacacagaaattgctcaaaaaattctagctgtcattcttactttaataactttgtcatttatcttccttaaatgttacccttgatataaatgtaattttagaagaaataaatttgtaattgca

SEQ ID NO: 274877 - DNA, 107 bp, Homo sapiens
atacaaacaaatttcctttttaaagtacttttaagaaaaaaagcatggccttggaagttttggttcttttttcctcccctgttgcaaattctcatggtttgggttgg

SEQ ID NO: 274878 - DNA, 334 bp, Homo sapiens
tttccaatcttcagaatcaaacagaaacattagctcttcttgggtctctaacctgcaggtgttcaaactggaatttacaccattggttctcctggttcttaggtttttggacttggactggaactacaactacatattagttctcccatgggtctctacttgctgactataggtcttgggatatttcagcctccataatcatgtgagccaattctgtattatgaatcatataaacaaacacacacacacacacacatacacatagatacataaatacatatatatataaatacacacacacacatacacatagatacataaatacatatatata

SEQ ID NO: 274879 - DNA, 424 bp, Homo sapiens
gttagccaggctggtctcaaactcctgacctcaggcgatccacctgcctcagcctcccaaagtgctgggattacaagtgtgagccatcatgcctggccaatataacagatcttataggaaaaatagggttggggcagaccagtcaaatctcatgcagttttgttaccagagcaccaacaaaatcagtaataatcgttaagtaaaaatgctagtactaataatctccacttgcatttgtagtcagtatcatcattttttgaaattagttatttgcattcttaaaccctgaggttatgcttctttctttgagatacaggtccttgaagggttttgcttccaattagagaccagttttatcaaaattactggtccaaggaataggaataggcttcttcatcagtctctttaggggatgtatggagag

SEQ ID NO: 274880 - DNA, 500 bp, Homo sapiens
aatactggcattataggcataagccaccatccctggccaaaaaataattctgaaacagcaaggaggaaggcggtttcttcttgggaagtcttgattttagttgagcatgtagagggatcacttgacttattaaccacttaggattgcacagtaagataatttaaagggtagccagcactggagtgggcctgggaaggggatgggcagtttgtgttagtgtgtgtgggtccaagataaaaatgttgggtagcagagttttgcctaatgcattgtcgctaaaagggatgaagggcatcgggatctacaggagatggaaaaagtagtgacaggatagtagtgggaaaaactaggatcggatcaaggcactggaaggcagaaatattgagtagaatgtttgctgcaatttatgtttctgtataaataccgagtacaaagtttcacttgggtggtcaaggtgctatggctgtgacaactcctgagagtgggttttctggttaaaa

SEQ ID NO: 274881 - DNA, 300 bp, Homo sapiens
aagttgacacagaagatgaaccatcccatgcacctttctaaagatttttttctttgatttttgagcaatgcttgagagttcacaaactccattcacaggattatctccttgaaacaacaccctggggagctgtgtcattcttgcttccatgtggagactcagagagaggtgaaggggctgggcgccatggctcacacctgaaatcccagcgccctgggaggccaaggttggggggaatcacttgagcccaggagttcaagaccagcctgggcaacatggtgaaaccctgtctctaccaaa

SEQ ID NO: 274882 - DNA, 382 bp, Homo sapiens
agtgcttccaaacacttttccttctttgtctttctaagccctaggtaattttaactatatgtatacctcaggacagaggatctctccttctttcctcaatgcagttttctacaactcttttgatgatcagttattggtaacaatggcttccatttcatcatctttctctctatgccaactcattcttgttgactttgtatttatttacggtgataacccatcttacaacctagcttgccatttctttacaattttcacctctactaactttgtttccaccccgtctcagcccagagccttggcactacattcattgcatgacttctggcatcttgaattcaagtatactctctgaccactgccttcaattcttctagctcac

SEQ ID NO: 274883 - DNA, 397 bp, Homo sapiens
aaatatttttattagtatttcaaacatacaggaaaagacaaatgttttccattcatcttgatagctaaatacctttagatctacacaccaagatgaagaccgccttgtgtcttggataaatgtaacgagcagatgctggcagctcgcaggtgctctgggctggagtagttagaactgccgggccaggtggagtgagccagcactgctcaggggagcttcatctctctgattccaaaataaatgttttctggagtctcaacttcaccctcctggagaggggtaatcttatctgtggaggagagagcaagggctgagggggcgctggggtggcatgagaggcccaaagaccttgacagacacggtgggcttggccgcggggcaccgggttaaagaggag

SEQ ID NO: 274884 - DNA, 180 bp, Homo sapiens
acttagtgaggtgttgattacatagtgaacctattattcacagaaattcaatggatgttttgaggtgccctctacttgatgcaagcctcagcgaggtggcagtggtggcctctgtccccatggcacggatggtctgttctgctttggaagcactggaagggcacatctgacaattgcagg

SEQ ID NO: 274885 - DNA, 473 bp, Homo sapiens
ctggacatgaagacaatatcactgcccagttagttagactatgacatatctatatcaaaaacccaggatgtagagggcggctctaagataacagaatagaaggctccaccaaccatccctccaacaaggacaccaatttaacagctacacacaaaaaagcactttcccaagaaccaaaaatcccagccgggagcagtggctcatgcctgtagttccagctactcaggagggtgaggcaggggaatcacttgaactcaggagtaggaggctgcatgagctatgattgcaccactgcactccagcctgggtgacagagcaagaccctgtgtcaaaaaaaaaaaaaaagaaaagaaaattagactaccatcatagatggtacaaacacttcccagtttgttgctttcgttttgtttgttgccatttttactatacagaaaaaaaaggcaataaagaatacattattatatatgtta

SEQ ID NO: 274886 - DNA, 244 bp, Homo sapiens
atgaaaaacttattacaaatttcagccaactcagatattaagaacatcagtgtcaatcctcctcccctcctgcgacctttttacacttgttttggtggactaggggctccttttctcctcctttttgacatataactgtgccattaaaaacatgatttctgatgaagctggcctagagggaatgaaggagattgcgtgggtatggtctctaggacaggcgtagctgttgcagggccaccctgtc

SEQ ID NO: 274887 - DNA, 539 bp, Homo sapiens
tggtagccatggtgaatcgattccaggactccccatggataccaaagtcccagatgcccgtgtccctgatataaaatggtgtaggatttgcatatcacctactcacgtcctcctgtaaactttaaatattctctagattgctcataatacctaatacaatgtaaatacttgttatactatattgtttagggaataataagaaaaaagcctacatgttcagtaacaaccatccatttttttttttcagaatattttcaatgcatggttggttaaaggatgtggaatctgtggatactgagggctgactattttattctcacccttgttttgggatgcatctgtctttcctagagacttcactggtgtatcctcaggcagataattcccaccaaccttggcccttgctttgtttggttttcacattgtattggtctcttgctgtcatttgatttaccctctatttaattccaagtttccattactttttcccctttgtttaaaagtatttttaaatgtaaaaagtcatatatggttatcat

SEQ ID NO: 274888 - DNA, 676 bp, Homo sapiens
tggtagccatggtgaatcgattccaggactccccatggataccaaagtcccagatgcccgtgtccctgatataaaatggtgtaggatttgcatatcacctactcacgtcctcctgtaaactttaaatattctctagattgctcataatacctaatacaatgtaaatacttgttatactatattgtttagggaataataagaaaaaagcctacatgttcagtaacaaccatccatttttttttttcagaatattttcaatgcatggttggttaaaggatgtggaatctgtggatactgagggctgactattttattctcacccttgttttgggatgcatctgtctttcctagagacttcactggtatctggccagtgggagcccctcaagctggcttcttgatatgtcttcattattttttgaacatttacttattttcttataccacaaaatgttctaggctcatcctggtttttttttcctgtgcagggtgagtccaaactattccagagttgcataaatttcaaacaacaaaaaaaattagtgtcgatcattcatcgtaatttaaaagagttgtttaaatctgtagtttggaagataacttttattctataaagtgcattcccgttgtctaataaatattcatagcttctaggtaaggtttattttataaaatg

SEQ ID NO: 274889 - DNA, 269 bp, Homo sapiens
gattcactgtgatgtttaatttgagcattttctaaatcaacctatgtttgcttaaatcatttcttattttttgcattttagggtgagtccaaactattccagagttgcataaatttcaaacaacaaaaaaaattagtgtcgatcattcatcgtaatttaaaagagttgtttaaatctgtagtttggaagataacttttattctataaagtgcattcccgttgtctaataaatattcatagcttctaggtaaggtttattttataaaatg

SEQ ID NO: 274890 - DNA, 540 bp, Homo sapiens
ggatttcagtcagaatggcacaggatggggaattaccaaaggggtttgagcaggggtcatgctctaattcacgcttttaagagatcactttggctgctgtacagaaaatgggctaaagtggaagcacttttatgcagctcagagagacttggttttatatctgcacagctatgcttattacagtgtatttaaatattaatatttattgactgatcacagcttaataagggttacagtaaaaacctggtcctttccctagagagttacaaaggcaaagatgataacagacacagagggtgggccgggggattctgagcaccttccttaggactctcgacagcagaagtaagtagaaggcaactccgtgctcaccctgagacacaacaccattcttggtggcaattttttcttttgtgctttccttgagtaaatgaataccaaacaacattccagcaacaacacttggtctgttctcatgtacatcaagcagtctggtaaattataaaggaataaaacctgctcaaatatgtgcactccagt

SEQ ID NO: 274891 - DNA, 194 bp, Homo sapiens
agtgcgatgggcattctcagtgggggacgaagggcatgaaacatcctgacctgccctgggcactgccaggaggtccagatggcaggagctgacggtttgaggggctcgggcagggcatcccgaggacagctttgggtgatctgtatgcaagggaatattgaagccatgggaacagatcctgaggatccgggggg

SEQ ID NO: 274892 - DNA, 620 bp, Homo sapiens
ttagattagggcccacccaatggcctcatgttaatttgatcacctctttaaagaccctagctccaaatacagtctgttctgaggtacaggggttagagcttcaacatatgagtttcgggggtatacatttcagctgctaattgtgtcttttgcctatttcctagttgattatttattttactgtcaagttttgagagctgtttatatatcttaggcactagtcactttgttgtgatttgcagttattttctcccagtctgtagcttgtcttttccacctttgtattagtctgttctcacgctgctaataaaaacatacccaagacggggtactttataaaggaaggaggttgaattgactcagttacacatggctggggaggcctcacaatcatggcagaaggcaaggaggagcaaagtcacgtcttacatggtgataggcaagaaagtgtgtgcaggggaactcccatttataaaaccatcagatcttgtgagattactatctcactagaatagcatgggaaagacccatccccatgattcaattacctcctaccaattccctcccatgacacgtgggaattatgggaactacaattcgagatgagatttgggtgggga

SEQ ID NO: 274893 - DNA, 338 bp, Homo sapiens
cactccagctatatcatatagtatttgtctttttgtgactgctttatttcaattagcataatatcctcaaggttcttctatgttgtagcatatactggaatttccttgtgtgtgtgtgtatgaacctctataaaggatccttcctttttaaggttgaacaatattccatgtatgtatatatccagttttgcttatctgttcatctgtcaatgaacacttggattgttgccacattttagttattgggaataattttggctattgtgaataatctgtacacatgagtgtacagatatttctttgataaaataggtaaataaaattgctttataaagaaa

SEQ ID NO: 274894 - DNA, 367 bp, Homo sapiens
acaaaatcaatatacaaaacccagtggaatctctatacaccaataacattcaagctgagaacaaaattaagaactcaatcccatttataatagctacacacacacacacgcacacacacagcacctaggaatacatttaaccaaggaggtaaaaaagaactacaaagcacagaagaaactgcagatgacacaagcaaacggaaatacatcccatgcttatgaactgaataaccaatatgattgttttaaatgaccatattgcccaaagcaatctacagatttgatgtaattcctattaattaccatcattttttcacagaactgggaaaaacaatcctaaaattcatattgaacgcccaactccaaa

SEQ ID NO: 274895 - DNA, 421 bp, Homo sapiens
tcgcttaatggtcacctgacattcctgggggttccctctcctgccttactcatgtccgcctaacctacctactctaacagcttctaagaacgaggaaacacgaactaaaataatcttgtcgtttttctttgattcatattctttattaagtatctaaataacaatctatgtttccaagggagttatacaaaccctgaattctacaacagaataaatattatttctacatgttccaaagatcttattaaagcacacactccatgtctgaacaactctcttaataactgagtgtctgtctgatctttctatttactggtgaatgcagcttgtctggtattatcctagtaattcctctgtgtactttatcaaccctttatggtgcaacatgagaaggaaaggggagagttactaacattacaaa

SEQ ID NO: 274896 - DNA, 303 bp, Homo sapiens
tgtttcagttataaccacatgactgacatcttgccaacaggaatgcatgtggaaaaggtataacacttcccatctgaggcactcaagaaaaggcgtgagttctctaccttctctctcccatccacctggctgacagagttggaggatggaagtgtcctggattcctaacagaaactgccagagtgctgcccaaccctcaggagactgacacaggtgccatgctctacacagaagctcacaggattgtgctacccattcctgtcttaaaatattaaagacctcactgctttcagcataaaaata

SEQ ID NO: 274897 - DNA, 425 bp, Homo sapiens
gaaggtcctctggaaaatatggtacatgagcttcaggcctgaagatggttcgctttggagatgaaacttatgggctggaatgtgaaacacagttactttgaggtggacctcagtgaaacttttccagacaggctgagaccaagggaagactagtattaaggattttatcctcaaaacaaactaggttgtcagagtccctgtaggctctctgggtagcagcctctgtgatttgcctcttcctgactaggaaaacctgtaagctgacaaagaagtatatttaaattgacctccaggtgagcctcatggtatgtcaggttgattatttgtacctggtttggtgttttgttttgttttttacttgataactgtataaattattttagtgaagagcctgttcttattctggaactcactttgaagacaaa

SEQ ID NO: 274898 - DNA, 338 bp, Homo sapiens
ccatatttttactgtatgttttctgtttagatacacaaaaacttcccattgcatcacagttgcctactgtattaagtacagtaacgtgctatacacatttatagcctatgagcaataagctatatcatacagcctgggtgtgtagcacgctctactatctaggtttgtgtaagtacacgctatgttagcacaacgatgaaattgcctaatgatgcattcctcagaacacgtgcctattgtgaaatgacgcatggctgtatatacagtcagccctctgtatctgtgggtttcccgtctgtgtattcaatcaaccacagatagaaagtatttaaaacaaa

SEQ ID NO: 274899 - DNA, 377 bp, Homo sapiens
gacttctccaggttctctacattcctgaagcaagtgctatagaatggcttggcactccacctgcacgttcccaagcacagaatcagggtgcagtaaagaggatctgggctgaccaacagtgtcttccacagatacacttgctaattcacgcatggaagacccagagtgtatcactcccctcaactgctggactactgtgctgcaaactttgagtcagaatgatgagcttcagtcaggcatatcatggctcctgaacaggattttgagagcaagattctgtgcctccctcatcctgctgcagcctctcagtgcatctaggtgtttctgcttccattgtacatatctatcaaaataaaattgttataattaaacaaaca

SEQ ID NO: 274900 - DNA, 373 bp, Homo sapiens
aaattatttattagtaactctcaagatcattttgtctaagtgaattggagatcttataatttaaagtgatccttaaatagcaatacaattactgttgatttttaaaattgatagacatttaaaatttttaaataaggtaaaatctatagagtcacataattgcagcattatatgaagttataaaaatcaatccttttataaaaattctggctaataaatctaagtaaatgtaaaatttaattgaactttatatttttacaattgtgaacatttatgaaagcaatgtttgctttatctcaggggttggaaaactctggctctggaggccaaatccacctgtttttgcaaataaagttgtattggaacataaact

SEQ ID NO: 274901 - DNA, 466 bp, Homo sapiens
gttttggagacagggtcttattctgtcacccaggtgcaatcatagctcactgtgacctcaaaatcctgggctcaagcaagcctcccacctcagcctcttgagtagctaggactacaggccacactgccatggctggccaatttttaaattttttgtagagatgggacttgctgtgttgcccaagctggtctcaaactcctggactcaagccatccttccgccttggcctacaaaagcattgagattccaggcgtgaaccaccgcaccctgcccatatgctttttgtaggaactcctcagctctgctgttgtacaatagaagtgccatagataatacgtaaacaaatgagtttggctgttttccaataaaactttatttaaaaaaaataggcagtgggccatagtttgctagcccccaattcaaagaaatacagattttttaaaagctattgggaaatttagagaaa

SEQ ID NO: 274902 - DNA, 186 bp, Homo sapiens
tatagcacttagcactgtatgacattgtttattttgaaattgtttatttctctctcctcaataatataagcccaaaaaagacaaggaatatgtttttgattctgtttctatccccgggccctagaatagggtctgggagatagttgcagcagaatccctagctgaaatggcaatcttgtgctaact

SEQ ID NO: 274903 - DNA, 1158 bp, Homo sapiens
  misc_feature (23)..(23): n is a, c, g, or t
  misc_feature (27)..(27): n is a, c, g, or t
  misc_feature (1099)..(1099): n is a, c, g, or t
  misc_feature (1104)..(1104): n is a, c, g, or t
  misc_feature (1115)..(1115): n is a, c, g, or t
aagcagtggtatcaacgcagagngccnattacggccggggagcacagactcccttttctttggcaagatggcggagtacgacttgactactcgcatcgcgcactttttggatcggcatctagtctttccgcttcttgaatttctctctgtaaaggagatatataatgaaaaggaattattacaaggtaaattggaccttcttagtgataccaacatggtagactttgctatggatgtatacaaaaacctttattctgatgatattcctcatgctttgagagagaaaagaaccacagtggttgcacaactgaaacagcttcaggcagaaacagaaccaattgtgaagatgtttgaagatccagaaactacaaggcaaatgcagtcaaccagggatggtaggatgctctttgactacctggcggacaagcatggttttaggcaggaatatttagatacactctacagatatgcaaaattccagtacgaatgtgggaattactcaggagcagcagaatatctttatttttttagagtgctggttccagcaacagatagaaatgctttaagttcactctggggaaagctggcctctgaaatcttaatgcagaattgggatgcagccatggaagaccttacacggttaaaagagaccatagataataattctgtgagttctccacttcagtctcttcagcagagaacatggctcattcactggtctctgtttgttttcttcaatcaccccaaaggtcgcgataatattattgacctcttcctttatcaggcacaatatcttaatgcaattcagacaatgtgtccacacattcttcgctatttgactacagcagtcataacaaacaaggatgttcgaaaacgtcggcggttctaaagatctagttaagttattcaacaggagtcttacacatataaagacccaattacagaaatttgttgaactgtttatatgttaactttgactttgatggggctcagaaaaagctgaggggaatgtgaatcagtgcttgtgaatgacttcttctgggggcttgtcttgaggatttcattgaaatgcccgtctcttcatatttgagaacttctngtcgnatcaccagtgntcagctttaactgttgccaataattggactgactcccgaagag

SEQ ID NO: 274904 - DNA, 1002 bp, Homo sapiens
gctaggtgcagccgggtgtaaatcggccgaggcagactggcggagtacgacttgactactcgcatcgcgcactttttggatcggcatctagtctttccgcttcttgaatttctctctgtaaaggagatatataatgaaaaggaattattacaaggtaaattggaccttcttagtgataccaacatggtagactttgctatggatgtatacaaaaacctttattctgatgatattcctcatgctttgagagagaaaagaaccacagtggttgcacaactgaaacagcttcaggcagaaacagaaccaattgtgaagatgtttgaagatccagaaactacaaggcaaatgcagtcaaccagggatggtaggatgctctttgactacctggcggacaagcatggttttaggcaggaatatttagatacactctacagatatgcaaaattccagtacgaatgtgggaattactcaggagcagcagaatatctttatttttttagagtgctggttccagcaacagatagaaatgctttaagttcactctggggaaagctggcctctgaaatcttaatgcagaattgggatgcagccatggaagaccttacacggttaaaagagaccatagataataattctgtgagttctccacttcagtctcttcagcagagaacatggctcattcactggtctctgtttgttttcttcaatcaccccaaaggtcgcgataatattattgacctcttcctttatcaggcacaatatcttatggcattccgacatgtgtcccccattcttcgctattgactacgcagtctaccaacaggtgtcgaaacgtcgcgtctaaagacctgtcagtttcccgggcctccctttagcccttcgaatgtgggtgctgtccttgctggggcccaaacgcgagggccggggaaaacccgggggcggaggagccccctgagtgcgccctgactgggagccccggggtacacgcgttgggcccccaat

SEQ ID NO: 274905 - DNA, 1033 bp, Homo sapiens
  misc_feature (23)..(23): n is a, c, g, or t
  misc_feature (27)..(27): n is a, c, g, or t
aagcagtggtatcaacgcagagngccnattacggccggggagcacagactcccttttctttggcaagatggcggagtacgacttgactactcgcatcgcgcactttttggatcggcatctagtctttccgcttcttgaatttctctctgtaaaggagatatataatgaaaaggaattattacaaggtaaattggaccttcttagtgataccaacatggtagactttgctatggatgtatacaaaaacctttattctgatgatattcctcatgctttgagagagaaaagaaccacagtggttgcacaactgaaacagcttcaggcagaaacagaaccaattgtgaagatgtttgaagatccagaaactacaaggcaaatgcagtcaaccagggatggtaggatgctctttgactacctggcggacaagcatggttttaggcaggaatatttagatacactctacagatatgcaaaattccagtacgaatgtgggaattactcaggagcagcagaatatctttatttttttagagtgctggttccagcaacagatagaaatgctttaagttcactctggggaaagctggcctctgaaatcttaatgcagaattgggatgcagccatggaagaccttacacggttaaaagagaccatagataataattctgtgagttctccacttcagtctcttcagcagagaacatggctcattcactggtctctgtttgttttcttcaatcaccccaaaggtcgcgataatattattgacctcttcctttatcaggcacaatatcttatggcattccgacatgtgtcccccattcttcgctattgactacgcagtctaccaacaggtgtcgaaacgtcgcgtctaaagacctgtcagtttcccgggcctccctttagcccttcgaatgtgggtgctgtccttgctggggcccaaacgcgagggccggggaaaacccgggggcggaggagccccctgagtgcgccctgactgggagccccggggtacacgcgttgggcccccaat

SEQ ID NO: 274906 - DNA, 836 bp, Homo sapiens
  misc_feature (23)..(23): n is a, c, g, or t
  misc_feature (27)..(27): n is a, c, g, or t
  misc_feature (777)..(777): n is a, c, g, or t
  misc_feature (782)..(782): n is a, c, g, or t
  misc_feature (793)..(793): n is a, c, g, or t
aagcagtggtatcaacgcagagngccnattacggccggggagcacagactcccttttctttggcaagaggatggtaggatgctctttgactacctggcggacaagcatggttttaggcaggaatatttagatacactctacagatatgcaaaattccagtacgaatgtgggaattactcaggagcagcagaatatctttatttttttagagtgctggttccagcaacagatagaaatgctttaagttcactctggggaaagctggcctctgaaatcttaatgcagaattgggatgcagccatggaagaccttacacggttaaaagagaccatagataataattctgtgagttctccacttcagtctcttcagcagagaacatggctcattcactggtctctgtttgttttcttcaatcaccccaaaggtcgcgataatattattgacctcttcctttatcaggcacaatatcttaatgcaattcagacaatgtgtccacacattcttcgctatttgactacagcagtcataacaaacaaggatgttcgaaaacgtcggcggttctaaagatctagttaagttattcaacaggagtcttacacatataaagacccaattacagaaatttgttgaactgtttatatgttaactttgactttgatggggctcagaaaaagctgaggggaatgtgaatcagtgcttgtgaatgacttcttctgggggcttgtcttgaggatttcattgaaatgcccgtctcttcatatttgagaacttctngtcgnatcaccagtgntcagctttaactgttgccaataattggactgactcccgaagag

SEQ ID NO: 274907 - DNA, 396 bp, Homo sapiens
ccagattgccagctctgggttgaccatggaggtagatgcccccaaatctcaggacctcgccaagatcatggcagacatccgggaccaatatgatgagctggctcggaagaaccgagaggacctggacaagtactggtctcagtagattgaggagagcaccacagtggtcaccacgcagtctgtcgaggttgcagctgctgagatgatgctcatggagctgagacgtacagtccagtccttggagactgacctggactccatgagaaatctgaaggccagcttggagaacagcctgagggacctggaggcccgctacaccctgcagatggagcagctcaacgggatcctgctgcacctggagtcagagctggcacagacccaggcagagagacagcg

SEQ ID NO: 274908 - DNA, 227 bp, Homo sapiens
agttaggataaacaggcgttaagtaagggttagtgtagaatttaaaattaaacatacccacataattcatatgtaagaagaaatcagcaaaatgaacagaaaaggcaacatctccaccaatctgtggctcccttctctacatacactgtgagaaacaaatatgttctgagcactcactacgtgtagaatatggcagtaatcattccctttgtccgttctgcagatag

SEQ ID NO: 274909 - DNA, 251 bp, Homo sapiens
tttcagaggaagtcaggccagaatgtggcaggcatcgagtgtcaggatgaggaactcgtcccaggtgtgagtcctcaaaatgcaaacacagccactaattgtaaggagcctccaaagagacagtgatagttgatggaaggaagcagcatggaggaaaggacagtggcataggaagagtgacctattccattggggtggaagggtgctgatcagatttagtcaacagtcatcgagttcctcccttgtcctag

SEQ ID NO: 274910 - DNA, 1857 bp, Homo sapiens
aaaggggcacatcttgccaaggtgtgcccaaggggcaggttgggttgctgtgatgatgggtacacagggccctgcacacggctttccagtcggagctgcaaaaggagacacaaaaatcacagctcattccaagaggtgcctgcagccagcagcacccagcagcattgtcaccactgcaagcagccactgacagccgacctgagaatgaacatgagggccagggaggaggcagctcagcctgcagcgtcagcagcgcagttcggcagagcctgctaatcgtcttgctcaagtttcaaactctgtttaccaaatgaccacagaagcgttttaacaacaaacacctcatttgaaggccaagatgaaaaattttacataaaaaattaattttactggtttacattgtttttatacattaaaatgaatacatttacttatttttttgagacagggtctcattctgtcacccaggctggagtgcagtggcacgatcatagctcactgtcgactcgaccacctggacccaagcaatcctcccacttcagcctcccaagtagctgggactacaggtgctcactgccacatctagctaatattatttttatttttcgtagagatgggggtctcgttatgttgcccaggctggtctccagctcctgggctcaagtgatcctcctgctttggcctcccaaagtgctgggattaaggcatgagccaccacgcccagccaaaatggacacatttacttattgtaaatttagtaatggccacacagctcataagtgacgatgccaggctcaggacccatctctgggtcctaataaaatattttctagcctctgtcctgtctaacaatacagttggaaaaaaactgggtacagctatgtttttatgtgcctaagggtcagcaagatgtcagagatgactgtgcatcgtatggatgggctggcaccgtctggatgagtaactgaatgcagtcgagtgagattcataaattacacctgcaccatggcaagctggactttgtcaggcaagaggctcttggactcctgctatcagagaggaaggaccagacaattcaatgactgcacctcttgtctcacctcagctcttccacctctcagaccctgcctctactccagtgcaatgtctgtctctgttggtgatgcacaacctacctgcctttacagcatttagatgaagtggccttttgtttccaagttgtcaagcgggagacgcagacagtgtttcttcgaggcttggggggtggttgtgcgagagtggacgctaagtccgggccaacactgagtgctgtatcccagggacataggagtcctgcgtgtgggtctgcgacacgtaagggcctctcaagcgtggggtctgtggcaggtgccctcctgcctgggtctaaggccagtgccgattattgttgtgaaagccccacattcctttcagaagaggtttggcaatcgactgctttaccataggtgctgccttcatgatcctgaggtcgtgggtaaaaatctccactttcaaccacaaggctgctttgaggattgcaacacttgggcagcagaggtttatgtccactgctggtttctaagccagcctgtgtctgtgcttgcacaggaatgggcaggagctctgattcatacagataaaaagctgcaaattataagagtttcagactgttctctctgtggctgctgcaactcacagattttgggagaagcctgggtatgctgagggcttacgaagtcgagatgacctcacaccacaaggtgacatgttggtggttccaacgtgctaatctctgatgcatcacacttgtgaattggccacttccagtgcagttacaaa

SEQ ID NO: 274911 - DNA, 706 bp, Homo sapiens
gtagggttttgtttgtttgtttttaaagaaacagggtctcactctgtctcccagggtaggcttaagtgaccctcccacctcagcctcccaagcagccaggactataggcatataagcatctaccacgacacctatctaatttttaaattttttttgtaaaggccaaggtcttactgtgttgcccgggtaggtctagaactcctattttttttaaatactcgtgctttcttttttaaccaggaattatttagaagtatgtttttaatttctaaatattagagatttataatttttttgttgttactgactttaatgaattgcagtcatagatggtggtctggaagaaaatagttaagatttgctttatggcctagtattagtcagtttttccatttgtgctgtggaagactatgcattccctaattgttagatgtaaaattaaaatcaagtatcttaactactttatcttttatagctatcaataattgaggaagctgtgttgaattccatagtagtggacttgtcagttgctccctatagttctgtcagtttttgctttgtatattttcatgccattttattagtggcacagtggctcacgcctgcagtcccagcactttgggaggccaaggcaggaggattgcttgaggccaggagttctagaccagcctgggcaacataggaagaccatgtatcttaataaaaa

SEQ ID NO: 274912 - DNA, 337 bp, Homo sapiens
ccgtctctactaaaaacacaaaaaaaattagccgggcatggtggcgtgcacctgtagtcccagctacctgggaggctgaggcaggagaattgctggaacctgggaggcggagcttgcagtgagccaagattgcaccactgcactccagcctgggcaacacagaacagactctgtctcaaaaaaaaaaaaagaaagaaagaaaaaaaagaaaaaaagaaaggcatctcttcctcctggcagacaccacaccaagaaatatagcttggcaggcagtgcacagaccgaatttcagtcctacttgccaccttggtctagtaattttgcacagtacacaact

SEQ ID NO: 274913 - DNA, 239 bp, Homo sapiens
cataaaaagaaaagcggtacatatacccaatagaacacaattcagccttaaaaaagaaagaaatcatctcattggcaacacgaatgagcctagaggatggtacactgagtgaaagaaagcaaaggccaggcacggtggctcatgcctgtaatcccagtactttgggaggccaaggcaggtggaagcgttgagcccaggagttggagatgaacctgggcaacatggtgaaaccccatctc

SEQ ID NO: 274914 - DNA, 432 bp, Homo sapiens
cagctcacagtcttccctttgtcgtttgaatgtcagtgtccctcctgctctcaaagtgatttttccttttttgctttatgttctttttttttcttttttggtagagatggggggtggggggggggtggcgatctcactgcccaggctggtcttgaactcctggcctcaagcactcctcctgcctcaccctccccaagcgctgagatatagacctgagccacagcgccttgccagttgttttatgttctttatccttttacctgcttgccttctgtaacctgggttgcattaaatttactcctacttgtgagtaaatgtgaaccatagcaataaatttagtctatccccagaaccttcagtagcaagcacccctattcctacgttatttgtatgtgtccactttaaataaattacctttcaattctgcctcta

SEQ ID NO: 274915 - DNA, 275 bp, Homo sapiens
tttttcttttttcgttcttacagctttattaaggtaccgttgatatgaaaaaaaatgcatgtatattatatgtccatttttattattgtggacacacacaggcacccataatagcatgaacacaatcgaggtaataaacatatccatcacctataaaggtttcctgtgtccctttgctctgctctttattgttttataaaaatacttatcatgaggtctaccctcttaacaagtttttatctgtgcaacactgtgttgctaactatgggtcgacg

SEQ ID NO: 274916 - DNA, 461 bp, Homo sapiens
gaatagatgtagggcagcagaatttcgaacttcttttcagcatcacaatactttaaaacagtgattgtcatctgcctcaaacccattgcctctcacataggaaatattttgaaacatattttttagtaccttgaaatgaaattcatgataattaacccatctacacacatttttaaaaatcaatatagggccctaacagcaatataaaggggaaataaaaagaaactaattgtaataaaataatattgatttcaataagtacattctagcccagtgcttataaattttaatgtgcatatgaatcatccagcattcttattaaatgcagattctagttcagtagattttggttcagtaggtaagccctgagatttggcatttctagcaagctcctagatgatgcccacactgctgtttagtaagagcatactttgagtagtaagggccgaaaagtataaaaa

SEQ ID NO: 274917 - DNA, 457 bp, Homo sapiens
tagggtatttctcttaactacaaaatttgttttttaatatttacaattcaataataatttaaccacagaaatgtgttccagtaacatattttggcatcaggaactttactactaaaactgaaagtgatatagagagggtcaagatatggtaaagagtgatgatttactatattagaaaatgaagatccttaaatgctaactaaaatacaactgtgactaattaaaatcatctcaacttaaatcttaacttttactttccttttttgtatgggacacaataattatgttttggctgaatagtactagcaaatgcaatcaataagcctttaaggccagggttctcctatgttttacatcaagcctcagaatatggtaaaattcctgctaaatcttccaaagccatatacacaggcatggtcattttgttttctagctagggcttgacctgacctcacta

SEQ ID NO: 274918 - DNA, 406 bp, Homo sapiens
gaccttgtgttcctctcacaggaatcttgtttgtaccagcagatgcccttgcggctcttatctgatctatgtccactttattcctgtcattataaccactctctaagagagctgtgaatagaaataagatacaatgcgaagatggccatcggaaaaccaggaagagggcctttaccaagaacccgaccatgctggcaccttcatctcagacttccagctaccagaactctgaagaaattgaagctcagagaagttaagatacttgctttagaacacagatagttaggggcaaagctgggattcaaactcaaagcacttggctcacgaatctatgtagttagaagtactctattctgccttcgtaacactctcttgctttaataaagtgaatgataataataccttg

SEQ ID NO: 274919 - DNA, 367 bp, Homo sapiens
tgcctcaaaaaaaaaaaaaaaaaatctagaacaatgttcttaattggggtgactgtgtcccctagttccccaggggacatttggcaacgggacaagtgggttggttgttacaactgggaaagtactactgccacatagtggatagaggccagaggtgctgctcaacatcccaggaaccacaggacgaccccatagcaaagaacgctctggccccgaaatgccaacagtgccaatgtggagaaaccctggtctggatacaaatgcatcccttggtattggatgccagcagaggcccatgatagctgcctgagagaagcttaaaaaaaagaatctgagtttgatactaaaattttcaaaacaaatatgt

SEQ ID NO: 274920 - DNA, 540 bp, Homo sapiens
caacaaggccagagggcagagaaaccagttaggagactccagtgataatctaggcagagaagatggtttgaatggaaaaaaatgaaaagaattaagtcactttcatcactatcattcctagttcttattttgttcttatgcttgtctgtaagaaaaaatccgtttgaaaaacctgttagactatacttggtgtgaaaggctttcctgactttattctagacaagattactcatttttggtttcaacctttctaaacttccagaaatattaataagggaagaaaaaatattacatccctgactctgcttctcagaattttactctgtgagctctcttcctcctactcaatcacaaaattattgctttacttaataataaaacaaacaactgcctcttctcccaggattccttatttattttcctgtttattctctaagaaaagaaaaataaaagaatgctattccctgtcccctcgtcatcattctgttacatgttattctggccagtctattagttcttccacatttttttttcttccgc

SEQ ID NO: 274921 - DNA, 231 bp, Homo sapiens
cacaggcacctgctttcttccaagaaggagctctcacctgtcactcaaaagcacctgcactgagaagttgggagagccagagaagactcctgccctttctgaattttaccaattatctattcaaatgtatttactcataagtgggtactcaaatggaaatgaaatgtaactcatatggaaaattcatccctaacctgtattcaacaggaaaagtaatatattctgaatggt

SEQ ID NO: 274922 - DNA, 422 bp, Homo sapiens
acaggctctgaatttacgcagcttgatagaaaataattcgtctatttttcaaacaatattgttatatattctcatagggtgcctgagtttgaataggcacagcgttcttaaccaggggtggaagcttttagaaacagattccaggcctcatctccccaagattctgcttcagcagctgtgaatggggcagtgtgtgtgtgtgtgtgtgtgtgtgtgtgtgtgtgtgtgtgtcagagaaagagagagacagagattgatcttgatgtacagtgccatttgaaaatctcaaaactaagtaagttgttccccttcagctacatcaggggagtattcatcaaataacagtcactagttgtgctgggaaaatagttgattaattgagccaaacctatctctgctaccaagcattgtagctggctgga

SEQ ID NO: 274923 - DNA, 544 bp, Homo sapiens
cttttgttacagaaaggtcatagtgagattttcctaaccaactgaattaggaaggcctagaggatttattgtattcttgccattccctaaatatttactgtatcctgtgtaatttggcacaaattaaacactcgcatccaaaccaaccattgtctttttaacagttggcatgttaaaagtgttcatactaagacatgccttaggaacctccagattttcttttgtttttaataaacaacaggttggactcggattagaaaccataaatctgacgcttcccacagtgacggagcttcaaataatagttgtgtacaaagctctgattagacttcataaaaccctttttaacttttcattatggaaaactaacatatacataggtagagagaataatgtataatgaatcttcatgtatgctcatcactgctttcacaattagcaacccatggttactcttaacaaccaatactttttggggaacagaagtggaaagatatttgtttacaaactgttcttcttgaatgattttagaaaattaaaaaaa

SEQ ID NO: 274924 - DNA, 315 bp, Homo sapiens
gatcttgttacagatttcctttaagtttgtcacaggacaaataagtcagggattgttttcggagcccaggcgctgtctttatacaggaattcttttcagaataacacacatcaagttctttaaggtattttgtcttagttgaaatatagcacagctgcctgctatgtattttcttcttctcagctatctgacatggtgtatattcatgtgctggattattattttctgtcttcccccacccagttgcaggtccactaaacagtccttgcctgcagagtttactctttgatggggtcgacgcggcagcgaatttag

SEQ ID NO: 274925 - DNA, 489 bp, Homo sapiens
agggcttgagtgttaattctgtaactgtccgaacccgtgagtgcggagccagacaggccaccactcctggctgcgaagcctggctgtcagcgtcctgcttgttaatgattgtctaatacaatgcctgccttgcctatctcacggggtaattgtgagggcaacataaggtcctgtcattaggaaagactcagttatccagcagcagttccgtctgccttcttcctgcgtgtcccacattttaattggtgttctcgtatgatttgggtttcccttattccatactaatcagacgacttcgctttgatttacttgttttggtgatcagtcatcaagtccagacttcttgttccctcagtttgttttcaggtctttacttaaggtttgtgcaccaatagttttcctgcaaactgtaaagtgaggatgacaatactacctatttaatatagtttgggtgtaaatgagattgttgattaaatgtagtcagatatt

SEQ ID NO: 274926 - DNA, 255 bp, Homo sapiens
ggtcctttctctgtcgctcaggctggacttgagttcctgggctcaagtgattctaccaccttggccttccaagtagcagggatcacaggtgtgagccaccgtgcccagctagagcaagtttttaaatggaacactgtactattttgtatgatctattcctaactgtccaatgtggcaaccactagctgtatatggctacttaaaataaaatttgccgggcgcagtgactcacgcctatattcccagcactttggg

SEQ ID NO: 274927 - DNA, 426 bp, Homo sapiens
ccgcctacctgagcggcgtcagggaccagggggcaggcccgacgcccctcccgctccgccgcagccccgagccggcgcgttcccggaaacgggggccgggcgggcgccaggtaagcggcgggggcgatggggacggccgcgggggcggtcccggaccaggtgggccctgcgggccggctgagagcccggtagggcccaggggccaagcgcaggcagaggccgcggccggggcctatgcgggccggagcccggatccaagccgggccggaggcggccgggagcggggcgggaagccggggagggagagagggagaagccggcggctgccgtggcttcctcagccgggtccgggggcgtccgctggggcaggccgcgacgacgcgggttgccgcgctagggggctgggatctcggcgcggccgcgttc

SEQ ID NO: 274928 - DNA, 122 bp, Homo sapiens
gaaaggaaaggaaaaaggaaggaaggaaggaagggagggagggagggaaggaagaaaggaagggaaaggaaagaagaaagaaagaaaaagaaagaaagaaagaaaagaaagaaaagaaaaga

SEQ ID NO: 274929 - DNA, 453 bp, Homo sapiens
aggctccccccagctcccttgctctccctggagcaccatgggcaggactctgaccgggatgggcaggttggggcattctggagaggaggttttggagtgatgggtgcagaaggcgttcagggtggtgaatttccctgaaagcctcaggcccagctctggctctgctccttcaactctaaggccccctttattcatctgaagaaattgaactcaactcaggttcccactgggggacgccacattgtcagttgcgtggaggtccttagtggtgtctgaggggctcctagcgtcagagagctctgcagaggcccctgccccacaggtgtctggtttggggctaggtgatgccggttaggaggggcaatgggtagatttggagcacctcatagatgtgttttcaaatgaaaatacaagctgggtgcggtggctcatgcctataatcccagcactttg

SEQ ID NO: 274930 - DNA, 392 bp, Homo sapiens
ctctgatgcattatccaagacatcattaaggtagttagtggagtcgatggctgagtcacagtgatgaatggatatacaggaaacagtggactgcaagtgtacatcactgctatcctcaaagaacaggaaagacagtgtctactgcagtgatcaagttccagcctgttcagaatcacccataaaggcattaagtgcacaggaagtaaatgtgaacagaaaaaatacccgagatagcggctttcaaatagaaatcaaggagcacttcactacataatactatttcctatcaggtagattagaaaagcctctccattaattcaaactctacacttacttttacttcagaacagatggccaacctaagccctggttttctataatttggccatagc

SEQ ID NO: 274931 - DNA, 331 bp, Homo sapiens
tgaaaacattaattgctttccttagatttaggtcagtaaacatttctgttgggtgggcgtcactggattggtgttaactgaaagacatttaacaccactggagtagactgagcacattggctcatacctgtaatcgcagcactttgggagtccaaggcgcgaggattgcttgagcctaagagtttgagaccagcctgggcaacacagtgatacctcctctcttctaaaaataaaataactgtccagttgtggtggtgggcgcctgtaatcccagctgcttgggaggctgaggcaggagaattgcttgaacccaggatgcagaggttgcagc

SEQ ID NO: 274932 - DNA, 405 bp, Homo sapiens
aattaagaaaataattcctgactttgctggtttctgatatgctaagctgcctgtgccatctcctaatgctgtgcttggttcccaatctcccaatttgacccaaactcacgtccctgcatccaccctgtcctgttctcgtgattttgccttgtgcagatgaaacctgttcaaggcaaatcccttctgactggctggtggtgattaaaccatcttctgatcagtcagaactcccctggtccttaattactgtgctcttccaggaagagtcccataatgcatgtgtttgtagatgatttgtaaaggtgggttctgaaaacaaagaaacagagactaagtgccttttaaagacaaatacttcttttgttgatactttcaataaatatctgagtggctaccacatgccaa

SEQ ID NO: 274933 - DNA, 286 bp, Homo sapiens
cacccgaacccccgttcagctgcgaggcataaacgccttcccctggttaggagctgatgcctcactgtgagcttggatggcaagttcatagaggccatccacacgaatgggtttaatgggatttctttatcaattgtttaaagagagtctttagcgtccctcaataccctttccaggaggatacacagaataaattcctgcttgacttttagatcccagataaaactactcccgcagaagaattagaatttctttgtcatattggacaataaaaattatgtaactt

SEQ ID NO: 274934 - DNA, 310 bp, Homo sapiens
tgacccagtcagctttgttttgtggctttagtggggcagcagccaaaagaaacatgctctggctgggatcctgccgcagtgcctcacaccagaccaggaaccatcaggccatggaggaggactgggggtgcccccgtggtccagccgtactcctctcctgggaccaccctctctccctcagtccccaaccttcttcccaggggtctcccacttcaaatttacccatttcctttggtactttgaattagatataaatactttaaatagtaaaatgaagtgaaactcctgcctcaccccctaattcaaatgg

SEQ ID NO: 274935 - DNA, 329 bp, Homo sapiens
ctgcctcgggaggggcgctggctgaagcacaatcaaaaagcaaggggtgatcgggcatggtggctcacgcctctaatcccagcactttgggaggctgaggagggcagattgcttgaggtcagtagttcaagaccagcttgggcaacatggtgaaacctcgtctctactaaaaatatggaaattagctgggtgtggtggtgggtgcctgtagtcccagctactcaggaggctgaggcaggagaatcacttgaacccgggaggtggaggttgcagtgagccgagatcacaccactgcactccagcctggatgacagagcgagactccatct

SEQ ID NO: 274936 - DNA, 260 bp, Homo sapiens
gggggatgggggagatggacaaatgaggtctggtttaaagaatgagaagtgtgaccaggcatggtgactcatgcctgtaatccagcactttgggatgctgaggcaggaggatcacttgagcccaggagtttgaggttacagtaagctatgattgtgccactgggctccagcctgggtgacagaactagaccctgtctctaaaaaaagaagaagaggtgtgtatccttctaaatgataaaacagatcactcccctgcttac

SEQ ID NO: 274937 - DNA, 387 bp, Homo sapiens
tttaaatatgatccatagtcttttaacataataaccaaaatgtctccatctcattcaaacatcacttgtcatatcaagaaccaggaagatctcaagctgaataaaaaaatacatttaatagatgacagcgatgttagaattatcttacaaagatttcaaagtagccatcataaaaatgaatgaacaatcataaacatccttgaacaaatgaaaaaatatcacctatttcaaaattggttgaagagaagatttggaatgttcccaacacaaagaaatgataaatgtttgagataatcgatattcaaattacctagattttattatacattgtatgctcatatcaagatagcacatgtaccccattaatatgtacaattatgtagccat

SEQ ID NO: 274938 - DNA, 335 bp, Homo sapiens
gaaccaaatgcaattccctggccgccctgagggagttagagtcgactagttcttcaccccttccagaggcgtgtctgctcaatcaagtcaaatactgaacaacttcctggcggagaggctgagaattttatacttgcttgctcgaaagcaccccaaataagatgatccacgccaacacctcccctttacagcaaaaggctgaagctcaaatacattaactacccttcccaaggtcagatagccagccagtaatggggcccatgaggaactgaattctacatctaactgattgaaaagctatgttctttggcatttgattaaactactttaatcat

SEQ ID NO: 274939 - DNA, 487 bp, Homo sapiens
tttaacaggcagctttccgtgtctattaatgttctttctcaatggtattttctattgtatggatggcactgtagtttatttaatggacatttggcttactcccaagtggttttgctctcataaacatggctgagatagcataacaagagttgttttgacagtcatgttaaacaggatgtcagcaggccctcagtgggaatgcgaaggggaacttggggtggtacagctgtgtgagggtgagtggctcctttcctagtttcttcatcctggcctcttagctaaacccctgtgtactgctttgttgttaacttggtccagctgcacccgagagctcattgaatggttcacttaagagctatgcatttcactatgtgtaaataatcctcaatattttttaaaattaagtatgtcctagttccaaaccagcaagatcttgctgtttttgtgcacattcacataaatgggattggatgtaataaaaaccaaa

SEQ ID NO: 274940 - DNA, 291 bp, Homo sapiens
ctccctcacaccgcgctgacagccccttgcactagactagggctcaggggtaagggctgatactctggtctctgggtccttagggcctggcacaaggcgggagtcagtgtacaggcagtgacccagtgttctcgggcacaatgctcgccatgcagcccgcaagcagaggccacaggcctttaactctgctccatgtggaggcccttaatcatcgtgagtgaaaggactgtagattctaacccgtgtggtgactgccaggactcaggtacaaggggtcaggtaggctctgga

SEQ ID NO: 274941 - DNA, 419 bp, Homo sapiens
aaaatagattatctactttcacttccgccttcatacgactttcctagaacacgagatcatattaggagagtatcctacaatttcccttctcctctggtttacagaaaggaactgaggcagcgggaggtaaggagacttctttaaaatcagaagacacttagtgccaacagagtctaagcctctcaactcacaagaaaatggccagcccaccctactacccctgctctgccctctcctctccttcgatacacactattgagagtgcatacaccaagtctagagatccattccagtacaagaagcactgactggaggggcaagagatcgatgtttggttctaaatctattatctacaatctaagccacttactatataagaaccttagccagggtaacatggcaagacctcatctatacaa

SEQ ID NO: 274942 - DNA, 364 bp, Homo sapiens
ctgccccctccccaggttttctttgaagatataaaggagttgctacaggctttcttccaatttaggaggttgcaactgtattttaaagatgatgctcctaaaatatgttatagtagggtatatggctaggaaagatccagagacatggttcaaaggcaaactctgcttccgactggtgagcaagatacacatttctgaaactttgtttcctttgtataaaatgagtggactgggggccgggcgcagtggctcacacctgtaatcccagcattttgggaggccgaggcaagcggatcacgaggtcaggagatcgagaccatcctggctaacacggtgaagccccatctctactaaaaacacaaaa

SEQ ID NO: 274943 - DNA, 380 bp, Homo sapiens
tgaaagtttacaggcaaagtctctacttgagtgaattttctaactcctatttactttcaactttaactgataatttctttactatagtggttttcaactagggacaatgttgccctcagagaacttttagtaatgtgtagagatttttatttgtttgtttatttacttattttttgctcacaggtgggagaaatgttttagaggcaagagaggctgctaaacatcctacaatataaaggaaacatccccacagcaaaaaaaaaaaactgttcttctcaaaatgttgacagtgctggagatcagacacattgctctactttatattttattgtctgtccctgaacttctttattaaatggccaatattgtatggtaaaatc

SEQ ID NO: 274944 - DNA, 551 bp, Homo sapiens
aggtcaggagttcgagaccagcctggccagcatggtgaaatcccatctctactaaaaatacaaaaattagccgggcatggtggtgagtgcctttaatcccagctactggggaggctgaggcggcagaattgcttgaacctgggaggcagaggttacaatgagccaagattgggccattgcactccagcctgggtgacaagagtgaaactctgtctcaaataataataataataataacaataatatgtttttgtgggtataagtgtggatgtaggatagatgtttatgtaagtgatggaaggctacatagtggttatagttgtgtagcatataatgtttactgaatttatacaaatctctgttcactaggcactacagaaaaacataagatctgattcctagcctctagggatgtacagtctcataaggatttgtctgttttaagttggaagtatttgtaatgttgtaaaggaagagtgacattggaggggcatatgatttggagaaagtgaggtactgactggacagtgttaggaactaaagatgtggag

SEQ ID NO: 274945 - DNA, 612 bp, Homo sapiens
gacagacctttcataaccctgctccctgcaaccacgctaatgtctctaactgattcaaagcaggggaagaaccgctccggggtccgcatgtttaaagatgttgatttcctggctccagcctcaggagagttatgggatcgacttcgcctgacctgctcccgacccttcacgcgtcatcagtcctttggcctggcctttctacgggtgtgttcttctctggactccttagatgactctgtggtgggtccctcagcccttctgagctctgtgctgaacaaggtgggagaaatgttttagaggcaagagaggctgctaaacatcctacaatataaaggaaacatccccacagcaaaaaaaaaaaactgttcttctcaaaatgttgacagtgctggagatcagacacattgctctactttatattttattgtctgtccctgaacttctttattaaatggccaatattgtatggtaaaatcgagagtatcatcagaaagaaaattaagaaaaacaatcagaattagaaattagaggctcctctgcctatggaatagccattcttttattcctttgctttcttaataaactttgtctcacttaaaaataaaaagaaat

SEQ ID NO: 274946 - DNA, 386 bp, Homo sapiens
acagttcttgccttgaggggaatgactgcttgcttctccactgcgtgtgtgtgttgaagcagggaagggcactaattcttgctcaaaatctaagcagctgtggtataacgcgaggaggtttagacatggaagacttgggtcaaggcacagctctgctctagtagctttgagactctgggaaaatccattaacctcattagactcagatggacctgagttttctcatctcaaaaactgagataattatacctgccctgtctctttcataggatgttctgctcagttgagataggggttgggatgggattttgctcaacccaaacccttacttctccactcaaacagattcctgactgaaggtgccctaccaatgagaagcacagact

SEQ ID NO: 274947 - DNA, 488 bp, Homo sapiens
tgagctggtgccagaatccaagttagatctgatccagtgcagatctaaccttattagatcccagtctaataaggtttttcttaccaaacagtggtgggaataattctttaagagtctggacgtgaccagatagttttctttctgggacttttcaagaaagtctgcttgtaggtggaaggttactgtactaacttcattataagaaatttagaagaattcagccgggcgcggtggctaacgcccgtaatcccagcactttggaaggctgaggtggagggatcacctgaggtcagaagtccgagaccagcctggccaacatggtgaaaccctgtctctactaaaaataaaaaattagccgagtgtggtggcaggcacctgtaatctcagctacttgggaggctgaggcaggagaactgcttgaacctgggaggccgaggttgcagtgagccgagatcacaccattgcactacagcctggggcacatctca

SEQ ID NO: 274948 - DNA, 240 bp, Homo sapiens
tcaaattttctgtttcttcctgattcaatcttggtaggttgtatgtttttaggaatttatcagtttcctctagattttccagtttgttagtgtatagttatttataatagtttctggtggtcttttgtatttctatggtaccagttgcaatgtctgctttttcatttctgattttgtttatatgggtcttctctcttcttggttgatctagctagtggtttatcaattttgtttatcttt

SEQ ID NO: 274949 - DNA, 465 bp, Homo sapiens
agcctgccaaagtgctgggattagaggcatgagccaccacacctggccaacatcagaggatttatatttgagaaaaaccctgcaaatgtaacaaattttgaaaaactttttcaaaaactacagcttaaaaagcagcagaggattcatactaaaatatatttttgcagatgcagtagatataaaaatatatttaatccaaagttaagtttatgtaaatatcagaggattcacagtagaaatatctaaggtgctggcacttcagacaccacactaaatcagagtgctgagtatagaaaataatccaaaactaaatttggtggattaattatttgtatataactttaaaagaagtagaactttttttgcagagttttaattacattcaaagtatacttttttccttaaaaaagttaggtttttttgaaaagaaaataatcatgtcattcaactttcaaattacttcat

SEQ ID NO: 274950 - DNA, 147 bp, Homo sapiens
aggcacaattttgtaagaagtgctgctgttcaactcttatatcctctggacacataaatgccatttggagtctcctaattcaaattcccatccttacaaattccttaaagaagtgtttaacttaagacaaaaacaaccacaggccag

SEQ ID NO: 274951 - DNA, 252 bp, Homo sapiens
ttatctggtacatagtgagggccccatacatgagaactgtttttgtcatctaaaggctgggtgtcatttatggcattttacagatgaagatgcaggcttgggacgttcagtcaacagacatttgttaaatcccagccccatgctggatcctgcgaaaacacatccccttcccttatggaatttaaagcagataatgttaattatgattacatcttatattaagtgctaaataaaaaggtaatgaacaaaaaa

SEQ ID NO: 274952 - DNA, 259 bp, Homo sapiens
taatggctgtgtggtgctatggcacttagcgggccagggatgttgaatgttctgcagtgatcagaagagtagcattctccccactgaaaaaatgatgattagaggactcattatgagggccaaattttgtgagttttatcagttaataattttttttttttgagatggagtctcgctctgttgcccaggctggagtgcagtggtgcgatcttgggctcactgcaacctctgcctcccaggttcaagcgattctcctgcc

SEQ ID NO: 274953 - DNA, 414 bp, Homo sapiens
tttaaattaatgcagctatagtaatatttttcctattataccccggtacactgtacggctgcctgttctatcttgtgaacaggttatgggtctgtcacataaagtgttatttttactatagtttcttcttctatgtagttataatatagtttttagaataacctacaaatagtagcagttttctgtcaatgagaactctgtgattatcatcaattttattctaatttttttttgaatctagtatttggcctgcatatgtatttgaatcagaatataaaacagatacattatgaaaaatagaaagaaattgaaataaatataatgagtcaacatatattaatgcaatatattgtattactacatagcaactacttttttcagttaaaccctaaattaaaaaaaattaaatatatt

SEQ ID NO: 274954 - DNA, 459 bp, Homo sapiens
cgtccatacactccgtctcctgaaggggaagcgggctcttctcagatgcacagggacaatgtgaaaatcctgtcctcagattgagaggctgtttcgtgggcaccgaattcggggtcaggaaagcagcctgcatccacgagtatcctcgggttactaagtggggccagtggctccaggtgtaacccatttaagtttgccagacagccgggatgttctggtgaaggatctgaagtgtatggccacaccagtcccagaagagcctgggagaagggaagatggtgaacacagtggagttctgctgcaaagccgaagatggttctggcacgtggcatgacccacatgactcaacatcaggagatctgacttcataaaagtgaactatcacaatgctgctttgcaagctgtgtgtgagtgtaaaagcgttgaaacttcctcaataaatgaaaagatatctttaaa

SEQ ID NO: 274955 - DNA, 1051 bp, Homo sapiens
ggtttcattataaaatggctttatttcctttgaactgttacgagtttccagagcatactacattagtcatctaatatctactgctcagataatgctacaaaacacacttcattttggattatctacattgttaacttcttgaacacagatattcacagttggctaagaataaggaaaaggaaagtggagtttaaagattaggggcaatgagatatagtgaaaggcttaactagcctttgacttattaccagtaaacaaatatttgttttccatttacaacatgtgttatcctgggcaagtgatttcatttctgagcctttgcttttttatttgtaaaacgaagcatcatgacttcagttgtctgccttatgatcaccagattgggtagactgttaacactgggggcccccatgaaccatacctggtatttgcactcttgtgtagttagtcctctcccacactgactctgggccgatgtgatttggcccagaggacatttgtcaagcagaggcttaaggatttgcacatcagggcttgccctcttggaacatttgctcttggcaccctaagctactgtgtagagaggtctggttactctgctggagaaactaggtggacagaaagatgtctggccaaacccagctttttcagacatgccaactgagcaccagacatgcatgaagaaattatctgggatgtcccagacttagtagatactacactaagcagaacgacccagcggaattcagaattgggagaaagtgttttaagccgctaactttgggggtagtttgttgtgcacagggttctgtggtgtgctggatgccctttaaaaaacctcatgaaaaactaaatttgtaattggtcagggccaggtatagtggccttcctgttacatattttattcatgcaaccgacatttgaggtctataatacagtggtgagtgtggcatagatatgtgctttcatggagttctccaatggatgagatcaataaacaggaaacaataaaaactcattttgcctttatgaataacccagtgaacaacct

SEQ ID NO: 274956 - DNA, 996 bp, Homo sapiens
ggtttcattataaaatggctttatttcctttgaactgttacgagtttccagagcatactacattagtcatctaatatctactgctcagataatgctacaaaacacacttcattttggattatctacattgttaacttcttgaacacagatattcacagttggctaagaataaggaaaaggaaagtggagtttaaagattaggggcaatgagatatagtgaaaggcttaactagcctttgacttattaccagtaaacaaatatttgttttccatttacaacatgtgttatcctgggcaagtgatttcatttctgagcctttgcttttttatttgtaaaacgaagcatcatgacttcagttgtctgccttatgatcaccagattgggtagactgttaacactgggggcccccatgaaccatacctggtatttgcactcttgtgtagttagtcctctcccacactgactctgggccgatgtgatttggcccagaggacatttgtcaagcagaggcttaaggatttgcacatcagggcttgccctcttggaacatttgctcttggcaccctaagctactgtgtagagaggtctggttactctgctggagaaactaggtggacagaaagatgtctggccaaacccagctttttcagacatgccaactgagcaccagacatgcatgaagaaattatctgggatgtcccagacttagtagatactacactaagcagaacgacccagcggaattcagaattgggagaaagtgttttaagccgctaactttgggggtagtttgttgtgcacagggttctgtggtgtgctggatgccctttaaaaaacctcatgaaaaattcatgcaaccgacatttgaggtctataatacagtggtgagtgtggcatagatatgtgctttcatggagttctccaatggatgagatcaataaacaggaaacaataaaaactcattttgcctttatgaataacccagtgaacaacct

SEQ ID NO: 274957 - DNA, 1532 bp, Homo sapiens
tgagaactgtcctccaacccccatcagggctggcacttgtactggccattaggaggaccaggtatagacctgcccatctcagccccaccctgctttctcctctacccaacaccaccagctttcccccctatttcccaccttggaagcaaagtacaggactgagaccgctgagaattccgtggcccaacccattgcctgggaaacccaagtacatcaccaagttaacaaaggtcaagccttaactgtaacaccaccactgcagctggctctcacctgcacgcactgcctactggccaggatatcaacatgcacagccactacaaagtctgatacagtttcatcctataagtaaacagcattgcagcctaaaaggaaacagcattgtctaacctaaccgaatattctgaatgtcagacaaaggcgagtaaaggtagcagatctcattcctgcctgtcaaagccatggtgctggtaccgcccttcactccccaagcggagacctcagcagatttcaccaggggcctgaggactcccccaccacccctctcagggctggtgtgtacatctgccatggggggcctgagtgcagggttccccaatctggctttactcagctttaccaccccatcctagagagaaggtgactcaagcccttgagcactccagggcccaacccaccacctgggacactgaaagcgcttctacagatgttaacaaagatcacatataaaccctactgctatcatggcagcctgctctaactggcatgtaccacctactgaccaggtcagcctccaaaacacaaggcaaatctgctgaaaaagatgcacagcactcaggaaggagacaggcttcatgtgacctctgcatccaccatcacccatgccaccctggcttctcagtattctgaagtggcttcttcatccacccagtacacagctactacaactgccattttataaagccaccacattaaagctatttttaactaatattgtacagagtctttgctactgaacatacccagaagcaaagagaaacagccctacataacatcatagtcacatcctgaagagaaaaaaaaaaatttccccccaaagaaagtaaattcaaaagcaagaagaagcaactgttttctcatatgtaaagaaatcagtgtaataatgctgaagtatttaatagcaaagggttatggcatccccaaagaaacagtaattctccggtaatagatcctaaccaaaaagaaataatcaaaataccaatttaaattattgattgtaaagaatctcatggaaataaaaagacaaatctgaaaaccagtactgatgaatcaacaaattaattttgaatatgaatgacaagtgtaccaacgagatggatatcattatttctaaaaaagccagaactgctagaaaataaaaaattattgaaggaattaaacaagacagttgaaagcttcaacaagagactagagcaagcaaagcagagaatctcactgcttgaaacaaatcttttaaattaatagagtcagaa

SEQ ID NO: 274958 - DNA, 131 bp, Homo sapiens
attcagtgacactaaatatgttaacagtgttgtataaccattaccactatctatatccaacactttatcattatccccaacaaaaactatgcccattaaacaataactcccacccttctacctctccccac

SEQ ID NO: 274959 - DNA, 262 bp, Homo sapiens
ggtagggaggttggggacacactgttgagataaatttgtttttaaatcttctttctagtgcatagtagagagagaaggcaactaaagagcaaaatttgcatataccctggaaagccctacttcttgattaactttatttgggatggtctctttatagcgcttttaagttttggagtagaaagatgaattcaggtaaagaaaactagacaaactaagttgtaatcattaaatgactgcttcccttctaatttcctccttagaa

SEQ ID NO: 274960 - DNA, 630 bp, Homo sapiens
atttcaggtagaaatgctatttataaaactgaagcagagcatgggaagagcgaatgaaggtggctatttgagaagacccccaaaaaagcgagactgcaaagcactcgcggttgttccttttctgatcttctagctacaggcagcgaggtgcgctcccaggaaggcccgccctcttcctcctgatagggcgcaaggtgccagggacgctcccccgctcttccccgcccagagggcacttgtgggggcggacgctttgtgcccagcaacatgagcgcggcgcgaaagagccgcgcgcgagaagggtcccggcattctcctcgttctcactaggcgtggagaattactccaggcggatcgtggcatgatgggaactgtagttgacgaccgccggccccgcgcctgaggggcagtaaaagtcgccaggtccggctccatttctggcacaaaacttgcagcaccgaggggttgtggagagcccttgcaggggaagagggcagggtcatcccgagaaccaacgggcacgtatagcccggcgaacgcccaagccggtcaccgcccccggtcacgtgtcgccagcctccgcggccgcgcgccgctctcagcaccgttcccgccccacccggcccggca

SEQ ID NO: 274961 - DNA, 334 bp, Homo sapiens
cccacctcagcctctgaaaatgctgggattacaggagtgagccactgtgcccagccacaattatcatttcttattaacttactcttttcctgtttccccctccagcctgtaacaccataggggcagggaccttgtctgtgttgaccacagcgaggtctctagtgcttaacatgtggtatttgtaggagatcggtcagggtggtggaagaaattgtaggaaaagatgcaaaccttcttggaagaggttttgcaaaagcttcaaaaaagggtttggctgaaggcagccaaattctcttacctggagcctgagagcaaaggttagataataagggga

SEQ ID NO: 274962 - DNA, 334 bp, Homo sapiens
tcagctagtcaagaggctgaggcgggaggttcgcttcagcctgggaggtggaggttgcagtgagctgagattgcatcactgcactccagactgcacaacagagtaagaccctgtttaacacatacacgcttttgcagggcaataactgtttgccagtgagttgactgacacacacacaaaaaaaccccaaacctgcaaggagatgctacttcatacccattaggatgactgtggtcaaaaaaactcagaaaacacgtgttgaaggatgcagagaaactggaacccttttgccctgttggtggagtgtaaaatggtgcaggtgctgtggaacaca

SEQ ID NO: 274963 - DNA, 659 bp, Homo sapiens
catctcgtcctgagggcactgtctccatcactttaatctgaactccttgggccacaggagtgatttacgtgatcacctaacctaagagatgcctcctgacctacgcctcccagggcaatgcagatggcgctgtgaacctcctttaaggagcacgggaaagacaccacgtgagggtgacgatgtgacagcaatcacaatatcaaagaaactaacccccaaaggtaaacttctttatccctttaaaaattttgaaacggaagtgcaaacatctggccacgcacagtggctaatgtctgtaatctagcactttgggaggctgagctgaagaggatcgcttgaacccaggagtttaagatcagcctgggcaacatggtgaaacccttctctacaaacaatttaaaaattagccagacgtggtggcacacacctgtagtcccaaccactcagaaggctgagatgggaagatcacttaagcccaggaggtcaaagctgcagtgagcagtgattgtaccaccgcaccctatcctgggtgacagagtgagatcctgtctcaaaaaaataaattcgtatctagattggctttggtcttattttcctaatgtgtcgcccgttgtcttcaccccattcatggtcagtgcgttagtctcccactgctgtga

SEQ ID NO: 274964 - DNA, 350 bp, Homo sapiens
gtgcacatctgtggtcccatccttggaggctgaggtgggaggatcacttgagcttgggaggcaaaggttgccctgagctgagatcgcaccacttcactccagcctgggtgacagtgagatttcgtctcaaaaatatacatataaaagaaagagaaaaaaagaaatgtgagcaaagcagaaggaggcggattcaaaccccagtgtgtcacgcctcatgccttttctttagtggtgggaaacccttatcttgtaaagggaatgtgtccccttcttcagccagcctctagtgtatttcacagaaaacaaaacctcccaataaaactgttgaaacctggaaaataaaacaaaca

SEQ ID NO: 274965 - DNA, 357 bp, Homo sapiens
atagaccactgttaactgtacctgaatgcaggactgcagaaaaactacgttaatccttatgtcctcatactctaccttcgtcttaaaaaagacttaaagaacttagtaaaatagccatagtaggaatcactttccctgacactgacccattgccaactttagcagctgaatcattgttgctacctttcttccctgcccaagaacttgcatttcattctctgggtaatttgctatttttttaaatagtaattcagcgactgacccagagccaacctacagctccagttgtgtgtgtgtgtgtgtgtcagcaggctaagaggcacatataaggcaaggcacacacatacaaggaccaaa

SEQ ID NO: 274966 - DNA, 426 bp, Homo sapiens
ctgctgggtgctataagaaatatagttgaagtagcaaacacagcttcagtctttaaacgattttgggtctggctattaagcggaaacacatatgtaagggaatgactcccagctatgttgaaagtctgactctgtgtaatttcaatgtacaggctgctcttggggccaagcaaattcctttccagggtctgcaagaggtggcagtctactaacttcagagtactttaaaaaaccagcgtttgtgagaaaaccaaaaacaggactctcatcttggaatatctaacttaataaatttcatttgcatgtatacagaaaccaacctacttactgctgccagccccaggagccagaggttagagtttttaataataatagcaataatgagttatacttattccagattagttttctagctctcaaaaaaac

SEQ ID NO: 274967 - DNA, 229 bp, Homo sapiens
ggcctgaaatctgtctcttaactcagagggacaccaggtcccactggcacagaagaaagaaagagggaagaggaggaggagaccagggccatcataacctcctaactttgccttgatcatcactagtatctactatcacctttttttctttttgtgacagtgtctctgttgctgaggctggggtgcagtggcgtgatctcacctcactgcaaccttcgcctcccaagtt

SEQ ID NO: 274968 - DNA, 2006 bp, Homo sapiens
  misc_feature (773)..(773): n is a, c, g, or t
tgactatacatttgcaggccttacacgccatactgacaggtgccacttacgtgactcatcagatgatgtcaccattgctgccaattatgggaaataactaatgcctattccagggatgagcccaaaccacacataaatgggttctaaatctcaccctcctaacctgcagtgagtccccccgttccaccctcttgaggctgcaaatctactgagaaggaatgggaaggattctacaacccaacttttgatactttttggccatctctcagtctctcccagcccctacccccacaccacctccctgctcccaggcagagaccgggttgcactttgttagggccagcaggtcaactgtaatggccaagagtgagttaaggctggaatgagaaatatgccccaagcttggaggggtaagcaggaataacacaaagcaaggaaagagattctttttgccctagtgaggaaaggaagcttcagaatgagggctggaggatagcaacttaggactgcagaagggggcagcttatgaagatgggagaaagtgggactgaagttgtaggggagcaggagggtagtgattttccgcttttctttctttctttctttttctttctttctctttctttctctctctctctctctctttctttttctttcttctttctttctctttttctttcctctttttctttctttctttttctttctctttcttccttctttctttcattcttctttgttctttcttctttctttctttttttttttttttnagatggagttttgctcttgttgctcaggctggagtgcaatggcacaatctcggctcactgcagcctccacctcccaggttcaaggggttcttctgcctcagcctcccaagtagctgggattacaggtgcctgccacgacacccagctaatttttgtatgtttagtagagacggggtttcaccatgttggccaggctggtctcaaattcctgacctcaggtgattctcccgcctcggcctcccaaagtgctgggattatgagcacgagccacggcgtccagccgattttccgctccctttcaagtgttaactcaccccctgacaggtgaagagggaagggttccttttacgcacaaccaaggttagcaaatgcccatgcaggatatggggtccctgcctctctggttgcttcatttcagcacttctatattagctgcttatggggaccctaaaatgaactggtcacccctccaccagctaagaaacaagggtgggattgctgtgccataagtcacactgaacgacttgcttctggcaagcatgctcctgtgtgtcaggaccttaccaaggcaaagaaatgccaggctcaagaggagcaggacgtgagacattggcctggcttctaacctggtctgagtggaagagacacagcttagggatttcagttttgctcttaggctactagatactgttatttcaccccctgagggagggacaggaagagcacggatttattttctctccgtcttcagtacttattttagcatctagtcataccccagggagagatgcgagacggtgtcactggctcagctgaagcagatgagcccgtctctagcagagatgtgcctgtttcttaggcatccgttcagcactagtcttggccatcagatttttaaaaaagaaatagctcatgaggcatttgcaacttctcctctctagacttctttctagttttcctctgttgtgtcactgcgatgtgtccagggacaaagccataagtagagcatacatacttaagactatgctgtacatataagacaagacctgtctgggttaaagcacgaccttatgcccaagcatttactctggtgctgaataacgcgaactactggaatcagcctcccccaactctgcgcgccccctgcccccctgctcctatcccattcttgctctcaaatggaccacaccattctcaactcgtttataaataaagggatgcagaattgcactt

SEQ ID NO: 274969 - DNA, 364 bp, Homo sapiens
tccaagttatcctctttatcaatttttactttttgtactatagaaaagtcaaaattattgtattaaaaaatctgtaacaaggctattgataaataacttcttttagggatagaaaactcaggaagttcaagatttctggattaatgattgacaatgttcttagtggtccctctttgatttatttcaattgtaagtaattcttggtgatattctaacataaattctgacaggtgaagagaataaataaattaagtatctctaggagaatcaatagaataagattatcttggttaaatagctaagaaagtatgctaaatagacacaaaaactttttcatcttccaaaatcagagttaaatagtaaa

SEQ ID NO: 274970 - DNA, 629 bp, Homo sapiens
tggctaaatttttaaaacagttttgtagagacggtttctcactaggttgcccaggctggtctcaagctcttggcctcaggtgaccctcccacctcagcctctcgaagtgctgggaatgcagacgtgagccactgtgcccagccaacacacgttcttgacacggtgaggacatgctccataccatgtccactaaaagtctgggtagaaaaatcagttccaaatgctgaaggaaatgcctccagcccactgtatttgtgaagaaaatcttgggtatcagggctgctattttaattttgccttaaaacaagcattgctcagaatacatgttgtaccaaagaatatagacttgactttgcttgtacatgtgactgttttaagaaagcagtgtcgaggccacaattagaagcagaacacatttagtttctttgcctgcagccccaatgtctttggtacatctgtgtcctaaatcatagttgtagtaatgtttgtattcatcacacagcatcaaaaattaggtaagtatgacaggcaagtgcctagtgtgttttagtggtattttcaaaatgaattcatgtcacacccaaatgaattgctctctcagggaacccagtagagaaggttgtacctga

SEQ ID NO: 274971 - DNA, 488 bp, Homo sapiens
ttcttttccttctctgggaacaggggcccggatgtggaaagcttgcagggagagtgtgggggaccccctgtgaggctgatgtttaatcacttgtctgtttagcaccgacgagtcagggagcaaatgtggccctaggtgtgttgttttaataataaatcagaggtgagtgctcacaattccttaattatgtacattttcctcagaaaaaatttcagggccccagcaggtgcctgctctctgggcctcattactgttgacagagctaggatttatgcgctcacagcggcttgtggcaaaatgtgcacagggctgggagaccgcccgtgttttccctgctattaaaatgtcacctcggggtaaataatatgtgttaacacaccagacacatctcccaggtttgtttcttttacctagtctgaaaataattaacagcttgtaacaacttcctaactaaatgtagtgagttatttagcctttctaaaaaaaaa

SEQ ID NO: 274972 - DNA, 447 bp, Homo sapiens
atgctaatgagttgacttatggctgacatcccctagtttcagaatggagggctggtcacctgaaagaccaaggcccgattaaagggttgggacttttcagccctacccctaattcctggtaccaattgtctatcttagtccattttctgttacttatagcagaataactgaaacaggggcctttatgaagaaaaggaattcatttcttacacctttgaaggtgcacctggttgagagggagggggtgaggttaagttgatcaccaatagccaatggtttaattaatcagatctgtgcaatgaagcctccataaaaccggaaaggatagagtttagaaggcttttcaggttgctgagcaggtggaggttgcagatcgtgccactgcactccagcctgggcgacagagcgagactccatctgaaaaaaaaagaaaaagaaaactgagct

SEQ ID NO: 274973 - DNA, 823 bp, Homo sapiens
caaaaaaaaagttcttgatttaaataagcaaactcaagagtttcagccttctttagaagcctggactgaattccagcaaggcctgggagagcctcaatccttggaactatctaaagtaccacattaacatctcatatatagttctgggaataatgttgttctgtctctgtttcctgctcatagcctgtaaaatcagatggattgccaatcagaaaataaagctgcccaacctggccttacattcattcaattaatgcaaaaacagaaagggagagatgttgggatccagaagcctgaggattgtgaccaacacagcattccactggaagctatatgatcaaagagcaaactgtttatcatgaatgcagaatgtgggcaaactcacatctgcacctgacactggaaggtatgctaaggggagccactccctggtgctgtgctccttgagattatctactgggacatctggagcctactgtttaaagaatgctgtcatacaggcctacactaagtcaagcagctgactgacaatcagccccttctccctatctcctttactcaatatatataaagggctctagaactcagggcccttgttcactagaagcaaggagccccctgaccccttcttccaaataaacttttttgtctttgtctttattcccacattcatcttcctttattcaggccaccagtgtacatggcaaagtaatcaaaatacagtagtcagtgagcaccaaccatgcaattgtgctaggtaaggagatggaaaaaatatttttgaggtgggagaaacatcctaacagataaattacagcagaca

SEQ ID NO: 274974 - DNA, 511 bp, Homo sapiens
cgtacccgatcagacccgttcccctatctgccgactctctctgctggaacttctctgttaggatgtgtctcccacctcgagaatattttttccatctccttacctagcaccactccctggtgctgtgctccttgagattatctactgggacatctggagcctactgtttaaagaatgctgtcatacaggcctacactaagtcaagcagctgactgacaatcagccccttctccctatctcctttactcaatatatataaagggctctagaactcagggcccttgttcactagaagcaaggagccccctgaccccttcttccaaataaacttttttgtctttgtctttattcccacattcatcttcctttattcaggccaccagtgtacatggcaaagtaatcaaaatacagtagtcagtgagcaccaaccatgcaattgtgctaggtaaggagatggaaaaaatatttttgaggtgggagaaacatcctaacagataaattacagcagaca

SEQ ID NO: 274975 - DNA, 419 bp, Homo sapiens
ctttgcaaaggtatataagaataaatacaatacactgaaggtatcacttacactttctttaaaggtaagaatttgtgagacttctgggagaattttgacaggtcctattagaggtattttaaaacacacaggggaaagtgatttgatgttaagcagtggcaaatctacacaaaaacaaaaacagtcatcggagactttcactcaatacaaagttctaccagacctatgcaaatagtaatcgcattttctagaaagagttctaaagtaagtcacacacacaaacctcagtagtagcacaaaacatcctttgttgccggacgtgagaaaaacacactcgcttctaaaaaaagccataggaaggaagtggaagaacctcaggggcgagtgggagtgcgaaaggaatgttgcagctctttttt

SEQ ID NO: 274976 - DNA, 619 bp, Homo sapiens
tatttttcagattatggtcccagggttatggttattgttactaaaaaagttgactactgggataaagatgttaggcaaaaactggaaaactgtactaaaatttttgaaaaaaatgtctatgtagataaaaatcttacagagttttggttagatgcatatgtgcaatatttaaaaggtaacagccaagatcctaatgagaagaatacttttatgaacaatattcctgattttttaagcaattttccaaattttcagcatgatattaatatttcttcatcaaatgaaatcatttcttcccggggcttcattcagacaacagatgtttcttcctcagccaaaaagaaaatattgttattctaattacgacgcatagctgaagactgtcaaattcccctaatggtgtataaccaggcatttatatattttgatcagtatgctgcaatattagaagacactgttagaaatgtattggttgcatcagcagctatgttcattgtttccttattgttaatcccttatccattgtgttccttgtgggtgacttttgctattggttctgtgattgtaggggtaacgggtttcatggcattctggaaagtcaatcttgattccatatcca

SEQ ID NO: 274977 - DNA, 329 bp, Homo sapiens
ggtacatagtaggtgtatgtatttatggggtatatgaaatgttttgatacaggcatgtaatgcataataatcatgtcatggaaaaggtcctaggtctctatgatcagtggttagcaaatcaatccaggttttgtgcccttccctttagggtagcaagttcgcccaagtcccaggtgggtctgaagatcctatctgaaagccagggactggagtcaaaagccttataaatttaccggtattctattctgctgcaactaagctggcactcaaaccaaaatacaaagtcctttgtcgacgcggccgcgaatttagtagtagtaggcgacagc

SEQ ID NO: 274978 - DNA, 364 bp, Homo sapiens
gaggacggaattggcaatatgaagtagatatggatttttaaaaaatcactttttctcccagcttaaatggaactcttaagtgttccttccattagcaaatcacttttttaattctttttttgttttgttttgtttttcattcagtttcattcagaagcataccacttattagaaaaaaagaaaaaatcctcaagcattctaggaaacaaaaatgcatagggataacttggcagttccataagaaaaaacacactaggatgagtgcagtgtgcatatctgtaatcccagaactttgggaggccatggcaggaggattgctacactcactacacttccctacctgtcccctctcattttaaagcaa

SEQ ID NO: 274979 - DNA, 376 bp, Homo sapiens
tcagtattgggcagttttatctgaatgggctccagcagtatggcctggcgaattttctgtttccaattccaattagggcgctgcctacccaggtgggaagagggctgttggctgccctcccctctgtagatgataggtttcaagactagctctaaatgtcaccaccctggagtcggccatgtatttttcttcatcacagctcagtgtgtctttcagtcacagcccagaaaactgacaactccatgcttccctcccttaccttattttagatttcctcctttctaaaatgtagttgaagaatgatttgctggacacattgtcacagaaaatatgctgccaggtgccccctgcccctccctgaccccacaaatccctg

SEQ ID NO: 274980 - DNA, 452 bp, Homo sapiens
gtcccaggaagacagacggacggaccaggacgtagagtgatgcagtgtgctgactcccgaatgataacttcagctgagtctcacccagagttccacagtgggatcccacctgacttcccctcatggatatttgataggcttcttacatttgtcatgggcaatgcagaactcatggttttcctctttaaatctatgctttcctccgtttttccagtctcaatacttgttataaagcaaagcccacctttttcttatgtccacacatccagtccgtcagcaagtccagtcagttcagcctcaagagtgtatttcaaatttgtccacttctcttcatttccatgaccacagcccctgtccaagtcatcatcacctttcagttgagtgactgcagtttcctctttactggcctccccagctctgcatccagcaacccaaataatcttaaaaaaaaa

SEQ ID NO: 274981 - DNA, 276 bp, Homo sapiens
  misc_feature (55)..(55): n is a, c, g, or t
acttgctgacggactggatgtgtggacataagaaaaaggtgggctttgctttatnacaagtattgagactggaaaaacggaggaaagcatagatttaaagaggaaaaccatcagttcagcctcaagagtgtatttcaaatttgtccacttctcttcatttccatgaccacagcccctgtccaagtcatcatcacctttcagttgagtgactgcagtttcctctttactggcctccccagctctgcatccagcaacccaaataatcttaaaaaaaaa

SEQ ID NO: 274982 - DNA, 431 bp, Homo sapiens
tagtcattgcagctactcagctacagtatttatggagatggtgtgtcctgaacagtgtagctcaggtcagcttgaactttccatttctgctctcattgtaggtgtaactactagtcctaatgtcaactgacccatgatttctactgtcagtcaatataagtgaacattgttttaaatatccttaactaacttaaagaattttaaaattgtactgtgattttcataacccgttgcctttttggtaccagagctacgtggtttgaattctggctacatgttttaagtaagaaaaaaaaagacgtatttttgcttactcagataaaagacaacctgtaaaaatataataattaaattttacatgtgctgtacaaggggttattttaaaaagcatttgttcaatttcaataaagctaagtgtgccgcaaacttct

SEQ ID NO: 274983 - DNA, 383 bp, Homo sapiens
gaggcaccagagaaaaacgaaactacatacacatcaagtccctcaggaatagagatgcaaaaatcctgaccgaaataccagcaaattgagtaccacaacaaataaaaatgattatacaccataaccaagtaggatttatttcaggaataaatgcaaggttgtttgaacatctaaatatcaattaatgttaatatatcatattaatagactaaagagtgagaacatgctcatctcattagatacataaaaagcatcagacaacatccagtacccatttatgactaaaaactctcagtcagatgcagtagcttatgcctataatcccagcactttgggaggctaagggggatggatcccttgaagcggggagtttgagacccacc

SEQ ID NO: 274984 - DNA, 451 bp, Homo sapiens
cacattcgtaaatagtggtgtgcattcctgcgctggtctgccagaaaacctgcattaaaattaataatttgctagaaacttttcaggttggcctggcttgacatggagtcattaagttttcagatatgcataaaaaccataggtaaaaactatcaaaaacaagttaaaagagcatatttgaataatttgtgtcaaggatggataatataataattagaaacattaagttccttagggtgtcttaatttgctttgggatattaacctctcacatttggcctcaataggcatgcaattttcatatttgcagaaatttcaatgcgtttccattatccatttgttgatgggggtgaagatgaattaagtaatctgtacttattttaatgtttagttgtcatcagttcatgcctaagaggacaaagcacttgaaatgtgtacatggtcatggcaaa

SEQ ID NO: 274985 - DNA, 290 bp, Homo sapiens
gccaggattcaaacccagacactttgctccagggccaaactcttgaccactataaccaaatgaagccagagtgattcaccagaatgagttcatctcgcatcaaaactctggattatctgtttaagcacccagacttccacctcctcatgagccaggaccttcctcagccacatctggatcctcagcccctcacagcacacagcggtagtcagaaagtatgctgagtaagtggagaatcaaaacaattccattgctagtctgacatcgtggttgtgaaaatcagtcgacgc

SEQ ID NO: 274986 - DNA, 605 bp, Homo sapiens
tctggcagaaagcaggcgagcctgggccggcgcggggccttgtgggagggcttaaggaagtaaaatggcggacctggcgaacgaaggtaggggaggcgccgttggggaccggctggcggccggggaacgggcggcgggaggactaggggccacaagcccttggggggagcaccgcagagtgcaagggtttcgtccgctccaggctagcgccgtggcgggccttgcagccgccccctattgcgtcccctcaggccgggctcaccggcccggcccatcactcccggcaaccccagccactgcagccgtctggctagaggagccgggtggccatcgggatcgcagccctaaggcccctctgcgtcgcagccaagctcggggctgaagggggcgggaggcgcggccccagtgcttcggccacggatgtaaatagaccttagggcctggttgtggcccggagcgcgccacgctccctccccgccccctcgtcctccgccacccggcatctccccttccccggcctggctgcctatctcctaagcccgtgaggccctcgtcctccgcgggccagccgcacaccgcggacggaggaagcccaggccgttttc

SEQ ID NO: 274987 - DNA, 598 bp, Homo sapiens
tctggcagaaagcaggcgagcctgggccggcgcggggccttgtgggagggcttaaggaagtaaaatggcggacctggcgaacgaagaaaagcctgccattgctccgcccgtctttgtgtttcagaaggataaaggacaaaagtcccctgcagagcaaaaaaacttgtcggattcgggagaggagcctcggggggaggctgaggccccccaccatggcacgggtcaccccgagtcagctggcgagcatgccctagaacctcctgcccctgctggcgcctcagccagcactcctccgcctcccgctcctgaagcccagcttcctccttttccgcgagaactggcaggggaagaagaaaagactcttcctttgaacccagaaggaatcccctgagccctttatctttgtattaagaagccttttgaagattataggtggagaagattgtgaactctcaagaacaagaaatgtcttgggtttttgaagtttgataaattgggaaagaggtcagctggcggctccagtcctgaaggcggagaagattctgacagataagatggaaattactgccctcctgtcaagcgagaaagaacatcctct

SEQ ID NO: 274988 - DNA, 430 bp, Homo sapiens
attcaaatttctttctatttggatattttcacctcccttatagttcaagataattgttcacttttggggttaatggctattcatttattctcccagtgatcgtaatctagagggacctaggaggggaaaatactcagagaataatggcatttgctcagctttataaagaaacacaatcatatgttgtattgattctttgcagtttaaaaaatatttgacagagggaactgtaaaaatctttcctcttgtcagttgtaagaactggaattttaacattctcttctcacagaatcaatgtgaaaaacatgaaaatttaataccagttggcagtaaaatctcactttatttaactgagaattttacattgagtatgatgagatcatgtacctcaaaataatgttagtatatgacagaaattaaaaatgatggt

SEQ ID NO: 274989 - DNA, 395 bp, Homo sapiens
atggtcccatctatcctgcttgtgttcactgccatttaaaatacaaacatttactactttccaaacaactctcgacactaagatgctttccttttctcccagtttcagttaccactttttagtcaaaaactcaaaacgattatctaccctattcttaccataaattccgaatgtctttcatacacacacgatttaatcgtgtgtgcccagatctcttttttactttctcatccagaacattactttcaggggaatttctccatcagttaaaatggttttttgaacttttggattctgccaaataaagtaacgtgttttaaaaacaaagctaaagagtttcctctatacttcaaagacacatgaccatcatagtttcattcttgatggactgagcc

SEQ ID NO: 274990 - DNA, 202 bp, Homo sapiens
acctcttacatagtcccattcttagatgctggagatcaggatttcaacatgtgaatttttgggggtcataattcagtgcacaatagcaagtgaagctttattcccggtggtggcagcaggcagaggtgtggacagacctcttgagaatcaccagctttccatagccgttccagctacagcggtgcaaaaaaggccccctgct

SEQ ID NO: 274991 - DNA, 418 bp, Homo sapiens
ccaggccaaaccacgtccctgtccgtgacttcgcacctggcctttcagcaccaggtgtctgcacagctcttggctgcacctgcactctgagtcattgcaggcaccaaacccaagccctgtaccttcaccctacacctgagccccttcctcaggagctgtgctgcctcctcagaactcaatttcatctcatcagactctgcccctagcaggtcctctgctccgtgctgccacaccctgcccagtgcgcccattcaggacagaagtcagtcctcgcaggcttgtccctgggtggcaggtgacaggcgctgggccacggcagagagcacatgtcaaccgcagtccccgtgttatccaggaggaagcgaagaaaacactgggcaggtccacagttaaactgcaactctctaacaagaagtgg

SEQ ID NO: 274992 - DNA, 434 bp, Homo sapiens
agtgctgggattacaggtgtgagccacggcactcggcccaagtacttcttaactgcaggacttctcagaggcttttaatatggtaatgagtgctgtgcagtgagatgactcaaatcaatatatagccaacacgtttgatatgaccacagaacccatttccctgaacactttttatcacctcctagagcaggggtcagaaaactactgcccatgtggtctgatctggccactgcttgttttcgtaaattttcactgcccacagccaacctcatttgtgtacatgccgtccatggctgctttcacactgcagccgcagcgatgagtcatgagacacgcacccgtggctcacaaagtctaaaatatttactctttggccctttacggaaaacgtgtacaaactttgtcctctgaaatatagtttgggaacctacttc

SEQ ID NO: 274993 - DNA, 510 bp, Homo sapiens
tcaaagatttttagaaaggctaatacttataagtattagcacattaatgcctgtcacatagtgctcagtcatttttattaataatagtaatattattgccttaaaggtataaaagcagtattttcccaagtggtttctttctggaaatgtagttatttactgttaattgtatcttttgacttgatagcaacatttacatcataattattcttgaattgttggcagaagcaccatgcccgtcatttattggctgcctccgactctggttttagttacactcaatttaataaattgatggggcatatccaagtcctcaccattttaacaatttgtgctaacgcatttgaaaaaaattttacttccaacctctaaatccattatctctgttaacaggaggcatttctgaacacagtaccaaggctcattttacctttttacaatgctttcttaatgtttgacctttatcagagttatgtttaaagaaacattaaaaatttaatgttaatgaaa

SEQ ID NO: 274994 - DNA, 377 bp, Homo sapiens
gccctgggccacagcaggaagccagcaggtctggtgggcacccctggaactcactggagttgaggcctggtcctgatgctcattccgacacctgaagcctgattagcttggcaagtctagctccctcttgcacgagctgagcgacgcagcagggcgaggcctggcccgtgcccaacgctgacgcttccgcctggtccagctggtgacaacgtatgagacacctaggcctgtggccggctgccaggaaaggagggaacctagactgctgttcaccatctgaataccccgtgacttaccagcaagcaggccactctctcacacctccaccagggtcgcctcccagataatccttctcagtcataaggaggaactcttga

SEQ ID NO: 274995 - DNA, 379 bp, Homo sapiens
gcccagcccctcctttctttccagaagcccaccagtggcccagagtggaagggtgggagtcagaccagtccaaggttgctaattaagactggactgccaggcacggtggctcatgcctgtaatcccagcactttgggaggctgaggcgggcagatcacctgaggtcagaagtttgagaccagcctggccaacatggtgaaaccccgtctttactaaaaataaaaaaattggctgggtgtggtggcacgcacctgtaatgccagctactcaggaggctgaggcaggagaattgcttgaacctgggagacggaggttgcagtgagccgagatttggccactgcactccagcctgggtgacagagtgagactccgtgtcaaa

SEQ ID NO: 274996 - DNA, 281 bp, Homo sapiens
cactccattaccgcaagatgaagatgaggaaactgaggcacagagaggctgagggagttgcctgaagtcatatggtgaggaagtggtggaggtgagatggtagccacatgtctgtctctaggaactctcaggggactcccctgcagacagacaatgctgcatgtagtccaactgatcccttggctggctttactgtgacatctttaaaccgttcacccagcgcccaggtgacgtgtcttgggccactagccactgtgggttgggttttgctggaagccacc

SEQ ID NO: 274997 - DNA, 199 bp, Homo sapiens
ctgggagactgaggtgggaggttctcttcacccagggagatcgagactacactggtgagcagtgatcgccccactgcactctagcctaggtggcacagcaagaccctgtctaaaaagaaaaaaggaaaagaaaacctagtaagccaagaaattgcaacatttattctggtattttcagaagtttggaaactgaagcagt

SEQ ID NO: 274998 - DNA, 277 bp, Homo sapiens
aaaagaaaatctcccattccatctcatggaacacgttgtctttggggtacctagatattagtgttagttcaggctctgctggggtggccaatatctggtttactggtggcaatttcatacgagtctgcagcaacgtcaagtcttgcctccccagaggaaggaattcaactgaggggcatacgtaagaagagactcaaggaggttctgagcaggatggagtttattaaaagagagcaggaagaaaggagagactttattggagtctcttgaagacact

SEQ ID NO: 274999 - DNA, 390 bp, Homo sapiens
aaaaaggaaagtttagaagctagcatgatgctgaaaacacaatctggtaagattaatctgaaacaacctacagatcactgtcactcatgaaaataaatataaaaatcctaaagtattagcaaatttagttgagcagtattgtttacgtttaggacaccttgaccaagtaaagatgatttttaagaaagtaagtttattgtaatattaagactttaattagtaaaatatattatcagtagatcaaagggacaaaaccaaatgatcatctcagtaaatgccatgacaagatttcataaaaatcatatcagtgtagaaaaatttttaaggaacacaggaatatttcctgaacaagctaagtattatctagctcaaatcaatagccaacatcat

SEQ ID NO: 275000 - DNA, 346 bp, Homo sapiens
ttgaaggcttgtctgggctggaggtctatttccaaggtgaatcactcacatacctggcacgtttctgtcaggtattggcagtcgtcagttcctctcctctcaggcctctccacaggctgcttgagtgtcctcatgacacaacagttggcttactccagagtgagcaactcaagagagagcaaggcagaagctaccaaatctttatgtttgaagtcatgcaccatcttttccacgagtatcctgttgattattttgatcagcttgttcagtctgggagggaattgcacaagggcatgaatactccactggcaaggatcattgggggccatcttggaagctgtgtgaa

SEQ ID NO: 275001 - DNA, 442 bp, Homo sapiens
atttgttacaaaaaaaatttagtcttaatgtttcccttggggaaaaatttctcagaccatgaaaaccgaaacagacagacacttacacacacacacacacacacacacacccacacccacacccacacccactcttctttattttatcaggcccttctgggaaatattgttaacaaaaatactaaacttgagtcagaaaactagtctcagcctcaatactcaccaagtatatgacttatggatatcttttaatatcaaacaacctccatttccttacttgcaaattaaaaaaactttttattttgttcacctcagaaagttactatgaggattaataagtatgtatcatttacaagttatgaaaagctatgcacgtggcagttacatattttaagcaacccgaaattagttggcagtaaacaccataaatgccagcattgca

SEQ ID NO: 275002 - DNA, 435 bp, Homo sapiens
gtttttcttaatattttgtgaattttcatgataaatgagtatcttttaacagtaccccatctctaatggataaatactatagatgtatagtagtatgtgaatttgccatcatttgtttaaatgatttgtctatagttttcaattttttattataaaagttctactatgaatatcattatagttgaatttttccatgcatccttaattatttctgtaggataaattccaaaaagtagaattacttcattctgtacattttaatattttttggtgtatatgacttagaaagtgaaagtccatttccccaaggacagccaccatcaaaatcaatctttgtctagccttttcctgtatatatcctaacataaataactatatatattatttatataaaacctacatataaataattttatatagctgtttctgtctctt

SEQ ID NO: 275003 - DNA, 1744 bp, Homo sapiens
  misc_feature (313)..(313): n is a, c, g, or t
cccctagtttgctacttttagctgaatctgataattgcatggaaaaagttggaatgcaggataacaatgtcatccaagggaccccgtcccttttctggcctgctcatcatacagtggttttctagggagatttctccagctaaaatgcagacattactggtaagggtaacagaagtcaagttttgagcagcaaaccttgtggtaaggattactttatcagctcaatttccaatgcgaacagctggctaagagcagtgcctcccaacaacaggacacaggactggtagggcagtgggcatgggaagcttgggtnggatagaataatgagggagtgggcacaaggatgcactaggcagggttcactccctttcctgggcttcctcctgtttatgagaaagttaatcaggaaagaaggatacttactgcatgagggagtgggtgttactgaacactgtctgggtcagagacatgattattttgagaaaataacgactcagaattaaaaggctactttatttccaccaaagtcaaacataaaaactagtgataattaaaatgaaggagcataaatttattacatagtatattaattcaccgcaagaatagatttataggtgttgtcatgtcttttgtttttagggggtgaattttcaaaagagaggttaatgagaccacataaaatggtcgtatgaaaaatgtttttgccttctttggtaaaactgctctggggacagtgttcattattttcaattttccttttataaagatccaaatgatagggtcatgagttcaaggccaggaacaagttgatttttttcctgaatagtatgatttaatttattagataataagatacacgttaccatatgtagccccctcctctctttcttgctttctctctgtgtggctggaaggtaaatgaatgcatcagagggacttaagacctaaagaaattatttagggctgctgcttcctggaatatctctcataagaactgtaattaaataaagtaataagttatccccatgaaagattattttcaagtccaaagcagtatattctggtggcagctaattgatgattctgtttcaaagagtatagttttgtgaatattttgttctcttcttatgaaagcctaaaaagtgattcttttcccacgaagacacttttgcttcgatcctttccagtggtttgccaggaggtgggttggcctgcctaaccttagcctgcatgtccgagggaaggaagtaccagttcaggagctcagcagagggcagagctggggttagatttcatcctcaggtcctggagttactaaatgctagggttgaaaaggactcagtgaggaacttgaggcccagaaagggaaagtgctcatacatatgcacataatttttagtggccaacaagaacttttgccatttgattctacattcaggcacttttttggtgccatgtggtgttttcatcataaaagaggttgaaattgcagagtaatttctactgaactgtggtcagttcaccaaggcacatgcctgtaggactggagactcacatgaggtagtgtctgattgagagtcctggaggcagttagacttctttaaggatggatggcagagagatggggattcctgcttagttaatctgacttttatattctcttattattgatttgatagaataaatatttaaactttatgttctactaataaattatggtgtatcctagttaggaaaaaaggaa

SEQ ID NO: 275004 - DNA, 227 bp, Homo sapiens
cagtccccatcccaggaggaattgttctaatgcatagaattgaacagcaaatttcctaaaacataagccttcaaagatatgataaatgtggccggatgcagtggctcacgcctgtaatcccagcactttggggggccaaggccggcaaatcacttgaggctaagagtttgagaacagcctggccaacacggtgaaaccccgtctctgctaaaaatacaaaaattagc

SEQ ID NO: 275005 - DNA, 340 bp, Homo sapiens
gtcataaacataagggagattccaaaaagagtgtgtgctttgcgactgaagtcagtcacataaatcccccagtggaatacttatatgtgcagatagaatttgctgtagatatcaaaagtcagctatgacagttttagaagaaaagaaaattcaaaaaggatattacgttttgacactatccagccaaattatatttgaagtggcttaagagtcaaagagtttccacattttaagaaatttttatatgttttgtgccacatctatgatctgactagattaggaaaagcagcaaatggatttgggaaagagaggacactagggaatttgaaaatggaaattt

SEQ ID NO: 275006 - DNA, 240 bp, Homo sapiens
gcatatgcagcaatattaacacttaaaaattagaattgagtccaaaaatgtatcataagtgacaaagaaggacaatatatgaagtaaaaaatgacaagaacaagaacaagaaagtataacaatcatgagcatatattcacctaataatatagactttaaatatgtcaaacaataacaaacagaatgtaatagacttaaataaatcaataactggagttagagatttaagcaaacacttct

SEQ ID NO: 275007 - DNA, 1150 bp, Homo sapiens
cggtctgggcagcttctagacgccgttcacgcagctgtcctggccggggcctccgccgggctctgcgccttccagcccgaaaaggacgagctgcttgcgtcgctggagaagacgatccgcccggacgtggaccagctgctgcggcagcgggcgcgtgtggcggggcggctgaggacggatatcaggggaccgctcgagtcgtgcctgcgccgggaggtggacccgcagctgccccgggtcgtgcagaccctgctgcgcaccgtggaagcctcgctcgaggcggtgcggaccctcctggctcaaggcatggaccgactgtcccaccgcctgcgccagagcccctcgggcacgcggctgcgcagggaggtttactcatttggggagatgccgtgggacttggcgctgatgcagacatgctaccgtgaggccgagcggagccgggggcgcttggggcagctggcagcaccgtttggctttctggggatgcagagcctcgtgtttggggcccaagatcttgcacagcagctcatggctgacgccgtggccaccttcctgcagctggctgaccagtgtctgacgacggccctcaactgtgaccaggctgcccagaggctggagagagtcagggggcgcgtgctgaaggtgtgttctgtgggtacggggtggcatggggtggcagtgggcctgggtgctcagatggttgctggacgcaccgctgggtgtgttgtgcagaaattcaaatcggacagcgggttggcgcagaggaggttcatccgaggctggggtctctgcatctttttaccttttgtgctgagccaactcgagccaggctgcaaaaaggtgagttaatgggaagtgtgcaagagggtctgacagcatcaccatgcatccacttaaagtgggcaagaatgctctttgaggctgggcgcagtggctcatgcctgtaatcccagcaatttgggaggccaaggcaggcagatcacaaggtcaggagttcgagactagcctggctaacatagtgaaaccctgtctctactaaaaatacaaaaaattagccaggcatggtgatgggcgcctgtaattccagctactcaggaggctgaagcaggaaaatcgcttgaacccgggaggggaaggttgcagtgagccg

SEQ ID NO: 275008 - DNA, 1215 bp, Homo sapiens
ggaggggcgggggtaaaggctgatacatgggcagcggtgggccaaggtggcccctacaaagacccaggtgggaatcctgactgggcccgcccctccgaggctcagttttctcatcattacaatgggtagaagagggcgctcagcgtccctgctcgcgtccccctcgcgagggcccctgcacatccccatctgtgaggcaccttgcggaggggactccagaccagtgtcttccactcccagcggatatcaggggaccgctcgagtcgtgcctgcgccgggaggtggacccgcagctgccccgggtcgtgcagaccctgctgcgcaccgtggaagcctcgctcgaggcggtgcggaccctcctggctcaaggcatggaccgactgtcccaccgcctgcgccagagcccctcgggcacgcggctgcgcagggaggtttactcatttggggagatgccgtgggacttggcgctgatgcagacatgctaccgtgaggccgagcggagccgggggcgcttggggcagctggcagcaccgtttggctttctggggatgcagagcctcgtgtttggggcccaagatcttgcacagcagctcatggctgacgccgtggccaccttcctgcagctggctgaccagtgtctgacgacggccctcaactgtgaccaggctgcccagaggctggagagagtcagggggcgcgtgctgaaggtgtgttctgtgggtacggggtggcatggggtggcagtgggcctgggtgctcagatggttgctggacgcaccgctgggtgtgttgtgcagaaattcaaatcggacagcgggttggcgcagaggaggttcatccgaggctggggtctctgcatctttttaccttttgtgctgagccaactcgagccaggctgcaaaaaggtgagttaatgggaagtgtgcaagagggtctgacagcatcaccatgcatccacttaaagtgggcaagaatgctctttgaggctgggcgcagtggctcatgcctgtaatcccagcaatttgggaggccaaggcaggcagatcacaaggtcaggagttcgagactagcctggctaacatagtgaaaccctgtctctactaaaaatacaaaaaattagccaggcatggtgatgggcgcctgtaattccagctactcaggaggctgaagcaggaaaatcgcttgaacccgggaggggaaggttgcagtgagccg

SEQ ID NO: 275009 - DNA, 197 bp, Homo sapiens
ctagtgttctttcttagaggctgtactcaaagtttcattatccattcagtatttttattcttctttgtggaggtggcaagtgctaggtgcctctagtcaatcatcttgaagccccctgttatgttaaagtctttaatggaaaaagaagacaacatgcatgaccaggcagatactttgagcagagtcataggaactgc

SEQ ID NO: 275010 - DNA, 411 bp, Homo sapiens
tcttaccacatgaaaaacagcatggagcatcccagccacatcaaaggcacggtttgagccttgggctgtagaggctcagagagagtgacaaataagaccctggtgagagaccaatggggacagtatttccagactttggcatgaaacagatttctgagcacctcatgaaatgtctgcaagggcagctcctcagagtgaccctcccaaatcaatcaaagctggccccctatcttaattatgacttacaaatagaagcatgcacctggctggatgcagtttgccacatggtttacaatagcggtagaataagaaataacttaccaaacgagtacattttcttggctggctggggcactcagagttgacactggtaaggctccattaaaatgcctttatgttctgatatacaca

SEQ ID NO: 275011 - DNA, 612 bp, Homo sapiens
ccataatgggtgaaagagtgagactctgtctcttaaaaaaaaaaaaaaaaaagtggcagtgacatgattcaagaccatctgcttccaaagatcatgctggactttaaagggagtggtaaagagcacagggtgtatgtacatcagatgtttaaatgcttactagctgtattactttgggcaaggtgattaacttccctaagtcatagttttctcacttaaaaagaaaaatacaatatctgctttactggatagctgtgagaataaaatgcaataaagatgataaaagtccgtggcacagagtaaatactcaataaatgagaactgctattattgtcattattataatagtcatgacatcattcaaacttttggctaaataaaaatcatactagatgtttcttgtacataatcaaacattccctatatacattccttttatctgttaagatttagtgacaaattttatgttcttggatatagtttattaactgctaaaacaaagcacaacagaaaaatatattctgtgaatatattttcccagatacaacatttctggaaggacagacggagtggttttctctggcccagttgggcaatggcatgttctgattg

SEQ ID NO: 275012 - DNA, 332 bp, Homo sapiens
cctcagggagcttttactggtagcgaaggtgaagtgggagcaggcatatcacatggtgaaagcaggagcaagatgagagagagtaaggtgggtacagtataccacacacttttaaacaaccagatcttatgagaactcactatcacaaagacagcaccaagccatgaaggactgccaccaagagccaaaccacctcccaccaagcccccacctccagcattgggaactacaactcaattcaatatgagatatagatggggacaaaaattcaaactatacatttagcctgtaatctctcattctggagactgcattatctgatgtttatatag

SEQ ID NO: 275013 - DNA, 362 bp, Homo sapiens
cgtccttcacatggcagcaagagagagaagtgccaagcaaagaggggaaaagtcccttataaaatcgtcagatctcgtgagaactcactcactatcaggagaacagcagcacgggcgtaaccgcatgggtggggacacagccaaaccatatcaattactatttaattccattgtggtttcagagtatacatatgatttctattcttttaaatttgctaaggtgtgttttatgtcccagattgtggtctatcttggtggatgttccatgtgagcttgagaagaatatattgttggatgaagtattcagtaaatatcaattagatccagttgattgatggtgctgttcaattcaactatatcct

SEQ ID NO: 275014 - DNA, 467 bp, Homo sapiens
ctcctgcgtcgaagtattcctctgtagcccaggctggagtgcagtggcaggatctcagctcactgcaagctccgccttctgggttcacaccattctcctgcctcagcctcccaagcagctgggactacaggcacctgccaccacgccgggctaattttttgtattttaatagagacagggtttcaccatgttagccaggatggtctctgtctcctgacctcctgatccgcccaccttggcctcccaaagtgctgggattatagtcgtgagccaccgcgcccagccaatttttttgtattagagatggggtttcactgtgttagccaggatggtctcgatctcctgacctcgtgatccgtccgccgtcatctcttgaactgccatctgtcagctaagtctaaggttttatgcttaaccatttgtggtgtactagctggactagcttcaggaatgtcagtgttttctac

SEQ ID NO: 275015 - DNA, 408 bp, Homo sapiens
tgcactttcaggggggtttatttctgaaggcggaaggcaggcctcgaaccccaggtgttcttgctggtggaggaaagtggaaaacacgcaggctttgtgggaagaaaggacgccactcctcctcccgtggattgcctgtggagctgggacaggcagcttgccactcttgtcaggatgactgtggaaggtgatgtctagaagagagagcaggagcacaggcgcccctcttcagcttggttttgcactaaagggacagcagaacccagagggcctggctctgtcagcccagcctccagtgccttccgaaaggaaaaaccacgcgtggtacgtaggcacacacgcacgccgcaccacatgctttttattgaagtatacgtgtgctacagaccatttaagtacagaaaagct

SEQ ID NO: 275016 - DNA, 542 bp, Homo sapiens
  misc_feature (26)..(26): n is a, c, g, or t
  misc_feature (32)..(32): n is a, c, g, or t
gaaatcatcatgggctataagatcangatgcnaccaatatcctggtgtctccactggtctatctatatcctgacattcccaaggagaggcattcggaaagtattgtcggccagagagccaggagcatcctgaagctgacccaggtagcgctgccccatacctgaagaccaagtttatctgtgtgacaccaacgacctgcagcaataccattgacctgccgatgtccccccgcactttagattcattgatgcagtttggaaataatggtgaaggtgctgaaccctcagcaggagggcagtttgagtccctcacctttgacatggagttgacctcggagtgcgctacctcccccatgtgaggagctgagaacggaagctgcagaaagatacgactgaggcgcctacctgcattctgccacccctcacacagccaaaccccagatcatctgaaactactaactttgtggttccagattttttttaatctcctacttctgctatctttgagcaatctgggcacttttaaaaatagagaaatgagtg

SEQ ID NO: 275017 - DNA, 492 bp, Homo sapiens
  misc_feature (26)..(26): n is a, c, g, or t
  misc_feature (32)..(32): n is a, c, g, or t
gaaatcatcatgggctataagatcangatgcnaccaatatcctggtgtctccactggtctatctatatcctgacattcccaaggagaggcattcggaaagtattgtcggccagagagccaggagcatcctgaagctgacccaggtagcgctgccccatacctgaagaccaagtttatctgtgtgacaccattcattgatgcagtttggaaataatggtgaaggtgctgaaccctcagcaggagggcagtttgagtccctcacctttgacatggagttgacctcggagtgcgctacctcccccatgtgaggagctgagaacggaagctgcagaaagatacgactgaggcgcctacctgcattctgccacccctcacacagccaaaccccagatcatctgaaactactaactttgtggttccagattttttttaatctcctacttctgctatctttgagcaatctgggcacttttaaaaatagagaaatgagtg

SEQ ID NO: 275018 - DNA, 258 bp, Homo sapiens
gagctcgcaccaatgtatagatatgagttggagataaaaaattcctatcacctaataacattgtagccatcataatgtgttagtgaaatgaattactcaagtgtttatggtgattgctggtgtaaacaagcctgctgcactaccagttgtataaaagtctagcccatacaattatatacagtacataatacttgatattgataagacatgactgtgttactggttatgtatttactatactatactatttttttgaga

SEQ ID NO: 275019 - DNA, 491 bp, Homo sapiens
gaggtgctcttccgtttctggtgtctgtagccatctccagtggtagctgcagtgataataatgctgcagtgccgacagttctggaaggagcaacaacagtgatttcagcagcagcagtattgcgggatccccacgatggagcaagggaaataattctggaagcaatgacaatatcagctgtggctatagcagctgagatgtgagttctcacggtggcagcttcaaggacagtagtgatggtccaatggcgcccagacctagaaatgcacatttcctcagcaccggctccagatgctgagcttggacagctgacgccttggatcatctgccactgatctctggtcaacatttttatcacccaacacaaaagaagcagagatttatcaagttacttaaacaacctgaccctttcatcttttgctacacatactcttgtaattgatctctccatgaattgttttctgtttaaaatatctagaatgttttctgct

SEQ ID NO: 275020 - DNA, 310 bp, Homo sapiens
agacatcctctgagaatcgcttgatatccaggaggcagaggctgcagtgggccagatggtccactgcactccagccttgttactgtgtgaaaaacctcctgtggctaactcctggaaagattacaaaagcgccagcatcaaaatgcttcacatcagacaaaagacaatctttctttacttgctgggatatagctcccccactacactctcagcaacaaagaacagtaattcatttttttaaaaaaatcttcatatcctctaacatagaacggtgactggtacgcaacagatatttgatctgtgttaattt

SEQ ID NO: 275021 - DNA, 319 bp, Homo sapiens
gtacatgtgcacaacgagcaggttagttacatatgtatacatgtgccatgttggtgtgctgcacccagtaactcgtcatttaacattaggtatctctccaaatgctatcccgcccccctccccccaacatccctgcattttcaaacttcttagatagttttcaaaatatttctgtaaacaaccataattttacctaatccgaaaacatcttttataagtgaatttaaccaattcgtatttactatgcttagtgatgtgtcattttattttgtgtttcctacttataatatgttcctgtcttctctccattctttatctg

SEQ ID NO: 275022 - DNA, 670 bp, Homo sapiens
atgaaaggcagtctaccaccttttcagttactagaacaaagtattctgtttttccctgaatactgtctggtatccatgaagtggtattccacttttatgtggaaaagaaagatgggtagtgttggcttgaacaatgtatgtattcctctcctatattattcgataaattatttctgggtttacccagctttgcaaaaatgtacttgcccagagtcattgttggtgaatagttaatacagaatgccatctttgttcattttgtaacctgcttgggattctgaaattatcttaactgatttcatgattaaatcaatgcagtttcttaaaactggaatttaagaacttgggagaaaactcgggtttctcagactactggtaaagcaagtagccacaaattgcgggctttctgagctgtgttatgacttcctatacctttcggagccctgactttgctatttcaccgacctgccctctaatttttactattgtgaagatatcaagagggaaattaactgtagagggatttaggttttgtcaggttgctgacaaagcaatgtaaagatgtattttgtgtcttgtcaataaagcatgtttagcggaatattagatttgtgtgccgtatacaatatcagtattaaatacgtgatgggcttactaacatccctataaa

SEQ ID NO: 275023 - DNA, 268 bp, Homo sapiens
cctctgctgaccctcccgatgtaccagatgaagagactgggtcagtaacgcaaggaggtgatgtggacattcactacccagcattttgttcatcgtgcagcttttataaactgtccaaagcaaggttcagaaaaggcaggattttgcaaaaatctcacatcagtttcatctaggacgtgtggacatcacagtgattgggatgatgggctggctgacccttggtggttctcaacaatttccaggatgttgcatttatttatccatgaca

SEQ ID NO: 275024 - DNA, 334 bp, Homo sapiens
aaaaagcaacggtgaattcttgagcagagaatacttgcagaaatgtgggatgatagacattagttacccccaagagtgagagggccaaggctattgtagtggtctgaggaaatggaattcagagtctcagtggatgccaaaccatctagaaaatggttcttgttaccttggcaatggaagtcaaaccttaactaatgatcttttactgagaaaactcacaagcaaatgaagtgaagagtaattggagtcaggctatacattgcttccttagtttcaccttgcatgacagcttggaaagcagtttggacataaaaaatgattatctcaagcctcc

SEQ ID NO: 275025 - DNA, 387 bp, Homo sapiens
gatggaatgccaaacacatttttagaaaacataaactattaaatagtgattacattcatgggtttttactacaaaagctttttaaatttgtaatgaaactgtaaaaggaaatctttagctcattgacctaattattattccgaaaactatatatattagaaaatattttctaagtttaaaacaactctggactttcactaatgttttctgatcaattgatattcatgaaattctaaaatgattgttgttttttaaaatgttattttaggctgggcactgtggctcacgcctataatccttgcactttgggaggccgaggcaagtggatcatttgatgccaggggatcaagaccagcctggccaacatggtgaaaccctgtctttact

SEQ ID NO: 275026 - DNA, 267 bp, Homo sapiens
ggatattaacactttatcagatatgtggtttgcaaatatttcttccagtctgtaggttcccctttcattttgttggttgttcctttgctgtgcagaagctttttagtttgatgcagtcctccttgtttatgtttacatttgtagcctggcttgtggtgcgatatccaaaaaattattgctaaggccaatgtcaagaggctttccccctatgttttcttctaggagttttatggtttcaggtcttatttgggtctttggtcttgtatc

SEQ ID NO: 275027 - DNA, 443 bp, Homo sapiens
gttaattggcaaggtaacatgtgtctccctatagagcactgtgaattatttctttgcattcctccatagacatttaaagaactgacacattagtcaaataaaaggaaaaacagaaagcaactccatgggttgaacttcagtttggcaattggaaattccaatctgactaccaggaaaaagaaagagagtgggcaagatagtatttcatgagacccaagcaatggtatcatgttttgctttggtttcgttttgatttcaccacttgcacacaatagagcagaagggggaggaagacatggagttgaagagatgatgtaccagaggacaaaaaaaaagagagaacatgtagtaacaattagttataactagcatttttataaaattttacaatttgcaatttgtttaaaatattttatttcactttattctatacctcaccaccc

SEQ ID NO: 275028 - DNA, 140 bp, Homo sapiens
tgcagtgagccgagatcgcaccactgcactccagcatgggcgacagagtgagactccatctcaacaaaacaaaaactacaaaaaaaccatgtgcctgcattcaaagatttggtttggcaataattttcaagctatttttc

SEQ ID NO: 275029 - DNA, 168 bp, Homo sapiens
tgagagctgatgagactggctggaaaagatctctttggtactgagaaacagccgcctgaacttttcagtgttgctgcaatgggtgggtctttctctggcctccctaagctgttcaccttccccaccctgccacaggcaatactttccttctctacttttcctttccta

SEQ ID NO: 275030 - DNA, 298 bp, Homo sapiens
atagcttcactttaggttttaaatacactacggaagttcatgaaagatagttttaccatttttgttgtgttatgtgagaagccaatgagtgcacctcattttccagaataagtgtgttcctaattagtgaagtacaatgtgtacattataaaattaaaataatggactaaaatatccgtccccaagtaaaatttaaaatacatactaacatataacccaatttcaacatattaagtgaatatgtattcttaaaagatccactactttacatttagatgcgttaggatgtattagaaat

SEQ ID NO: 275031 - DNA, 327 bp, Homo sapiens
gtgctgctgcactccagcctcggtgacagagcaagagccagagtggggcgaggggagggcatggaatagttctttattagagttgaaatccgttttcctataatgtttgctcattgatcctagcagactgaatgaatccctttcatggcagtccttgggttatttatatgtaaatgaggggaatgctgcagtatagaacattccttctggatttcataagaaattgcaaataatctgttaccataactgtgttaacgagagctggctggcagatggatccctgcaagtaccatgggcactgtctttggttgaccctgttcagtcttc

SEQ ID NO: 275032 - DNA, 225 bp, Homo sapiens
ggtcaggactcagctatagttacaggcgcatactcctaagttaggttttcagtctttctacctattaagtgaggttgcagtttgtccacagggactcaaatctagaagtacagagtccttcccaggccatatttagttcactgtaacagttcctattatgacctcactgacagttctttttctctgaattctcctttcttctcaacagcttatccaaatgttccg

SEQ ID NO: 275033 - DNA, 582 bp, Homo sapiens
aagtgtgttattacggttggggggagcccaggtcccttctctactctgtttctggagagctttcacgaaacactcgtgcatttcccccagaaattgaggtcacagggcctggacatctggatttctccaaagccccagtggttctatgtggccaggaccaagaacccctggtggcataagcagtttgaaaaggcaggcaatgatctcctgggcccctaccgtaagagttcttgaagcaataagtggatctgcggcagggcccagattccatttccaggaagctcccgggggatgctgatgctgctggacagctgaccacacttggagtagcactgttatgactgatgatcagctaccgcagaccatggtaaaatgcagaagaaaacctaaactaagaaatgactgataacaagaaaccagtgcgttgagctcttggtatttccttaaatcttggtttgtattatatctggactggcttagtatgtaaaactactaattaagattcttagtaatttgcactattaatttagaaatgtaatagggtgcagtatgtactgctcaggtgatgagtgcaccaaaatc

SEQ ID NO: 275034 - DNA, 423 bp, Homo sapiens
agagcgactcagaaatggtttctgtgctgaggatctaaagccatgtctctgtggtcctgaagttggtatcttagtggaggacaccccattggacactttattgtgtagtctgtgtgacacatgccacatgagatctgtgcctaagatgctctggaaacactggccctggagctcctgggattgcttggtcacttctcactgtcgtaggacggtgattccaggactctcctcgagccaggctctatggagtaggagatcagagggtaaagtctatggctgcacttgtccctctcgtgtcatttaatcactctccacctagcctggtcagggaactgtcttttcttctcttagattggaagctccctccttgcaagtccccagtattttccaaccactgacttctcattgccccctccatgcagg

SEQ ID NO: 275035 - DNA, 417 bp, Homo sapiens
gggcacagtggctcacgcctgtaatcccagcacttagggagactgacgcaggcagatcacctgaggtcgggagttcgagaccagcctgaccaacatggagaaaccccgtctctactaacaatataaaaattagccgggcgtggtggcgcatgcctgtaatcccaagttgctgggactacagccatgtgccaccatgctcaactaatttttttgtatttttagtagagacggggttttgccatgttggccaggctggtcttgaactcctgacctcaagtgatccgcctgcctcggcctcctaaagtgttgggattctaggtgtgagccatggcacccagcctttatgtctgttcttgatttatcaatactgtcgttgcctcctcctgactctgtccaatgaattacttggaagcaaat

SEQ ID NO: 275036 - DNA, 291 bp, Homo sapiens
tgaaaagacctgaaggaaacgaggacactagccacagagatagctggggaagagtgttcctggaacaaggaacagcaagcgcaatggcccagaggcagcagcacatttgcaaaccttttcttaaagggccagatggtattttttggctttgtgggctgaatggtctctgtcaaaaccactcagctttgccactgcagcacccaagcagcctcagacaatacctaaatgaacatgtgtggctgttccaataaaactttatttacggacactaaaatttgaatttcatataat

SEQ ID NO: 275037 - DNA, 316 bp, Homo sapiens
gaactcctgacctcttgatccacctgcctcggcctcccaaagtgctgggattacaggcatgagccacggtgcctggccgccggcaggtttttaaagctaacattttatacaaaaaacagcttttctagtttcagtgagcacaaacaagctttaacttcagtggtaagtgggttactgatgtgcagctgctggtgatgttttaggggtaaccttacttgggagaaaggagatagaagtgaaatctgcaaactggcaaaatttgtaaaactgattctgaccttaattgtctctcatgcattccattttcttgcaacat

SEQ ID NO: 275038 - DNA, 382 bp, Homo sapiens
cgcgatctcagctcactacaagctccgcctcccgggatcgcgccattgcactccaaagtgagactctgtcttaaaaaaaaaaggatgaaaatcaggatcagtcaaaacagtcaagagacccacagagtgaggtctggcatggtccagccatgaggctcccgtgtccttgagctatgccatcctccttgtgggcggcaagccacccaggtgccgaggcaagagaccgagggcacgagctgttacagtataataaagaaaatatacagaataagaatagttatactggaactagaatatagatatgatgatatatgaatattaatcattagtttgtagcattactctttgttccaatattataataatctctgttctacaatta

SEQ ID NO: 275039 - DNA, 444 bp, Homo sapiens
tctccaccacacttgctgcagacgagggtccgggaccagacacgcccagagggccccagtgccctgtggttggggtggtgtttccttctgtctctctccctgatggggcacagctggaggcatctgctctgctctgaccattttttttttttttttttttttgagacagagtctcgctttatagccaggctggagtacaacgacaccatctcggctcactgcaagctccgcctcctgggttcacaccattctcctgcctcagcctcccgagtagctgggactacagccacccgccaccatgcccggctaatttttgtatttttcgtagagacggggtttcaccatgttagccaggatggtcttgatctcttgacctcatgatccgcgtgcctcagcctcccaaactgctgggattacagccgtgagccactgcgcccggcctgc

SEQ ID NO: 275040 - DNA, 468 bp, Homo sapiens
actgcatcacctaacttcgtttgcaggccactgctcactgtgtacataaccagcatcacaagcacagggactcaggaccgggcgctttctaatctcttcagtctctgggtctcctgcttccaggacagggctggagccaaggactcactctcaactgactgactgactgcgtggctgatgaagggaggagtgcatttttaaaaggagagtaagctgtccccaatacaccagtctaagaaatgacctcttttcctttctctacgtaaacttcatgtccttattcacaggcatataaaattacaaaatcatggtgtagacacacatttactccccgctctcctttctgtcatgaccctaatgatgcatttacctatacggaatcctcgggctctctcagacacaagcaaatacttctgatggcagagagaaaagtcaagacgtggtaagaaaatcagtgtccgggagcta

SEQ ID NO: 275041 - DNA, 474 bp, Homo sapiens
acaaagagtagaccacatatgacagtgatgacagtggccccataagatcataatactgtatttttactataccttttgtatgtttagatatgtttagatgcaaaaatgcttatcattgtgttacaattgcctacagtattcagtacagtaacatgctgtataggtttgtagcctgaaaacaataggctatactactatatttagcctaggtgtatggtagactataccctctaggtttgtgtaagtacactctatgatgtttgcatgatgtcaaagttgtctaacaacacatttctcagaatatattcctgttattaagcaacacatgactgtactgtgatataaagttaactattggccaggcatggtggctcacacctgtaatcccagcacttcggaaggctgaggtgggaggatcacttaagcctggcagtttgagaccagtccgggcaaaatagtgagactcatctctgc

SEQ ID NO: 275042 - DNA, 271 bp, Homo sapiens
gtatggatatgggttgtgttccaataaaactatttgcaaaatcaggtggtaggccagagttggctgggagggccacagtttgcagacgctgatggagaggaaaggactgagcatcttatcaaaactaccccccacctcacccccacccagggcacccatttgttgactgggctcttactgaaagccagtggctgatgctgcaacactggggcagcaggaggctcatgactgtgccctgccctggccctcgctttccaccatgattcccatt

SEQ ID NO: 275043 - DNA, 378 bp, Homo sapiens
ttcctaataacagcatcaatattcagaaaggttaccttttcataaggcattagcaatttgcatgttacatctatcaaaagagatgggtaaatgagctatatgggagtcaattacaatgtcgttcataatttattccatgtacaataaacagccgatcagatttcatgcgtgtttactttctgaaaagataactgcttgtggctgatactagttgcagaatacaaatatgtttcagagtaatgtgtttatctcactttgacattttaaatctccaaagttctctcactctctgtctttttttttttttttacaaagttgtctctgcttgaaaattagagcttgctctcaaaaataaaagatcattcttactggcctaac

SEQ ID NO: 275044 - DNA, 400 bp, Homo sapiens
gggcctcataaaagatgattaggtcatgtaggtgctgctttaatgcttggactgatgttattgttgtgggagtggattagttattgtgagcatgggttggttataaaagcaaggtcaaggctgggcgtggtgcctcatgcctgaaatcccagcactttgggaggccaaggtgggtggatcacctgaggtcgggagttcaagaccagcctgaccaacatggagaaaccacgtctatactaaaaatataaaattagctgggcatggtggcgcatgcctgtagtcccagctatttgggaggctgaggcagaagaattgctggaacccaggaggcagaggttgcggtgagccaagatcacgccattgcactccagcctgggcaacaagagtaaaactccatctg

SEQ ID NO: 275045 - DNA, 437 bp, Homo sapiens
caagccttgagttccctcaggagtctcatggtttatccatttttctgcctgccctggcttccttttctttgaaaacagaggaatttttctccaaaagtctgctagtagacttgagtttgaattataagagtttcttgattccagttctaaaattctaggaaaaggacactgattggcttagcatgggccatgtgcctgcctatagaccaattaagtactacaaggaaatgaatacaacagtaacaatatcttggctccggtgaccactcctggtggtcagtcagttgtatcctggaagtagggtcatagtgttgcagaatattgctccttagttcagctaaaactgggttcttgtcacacgaccaggaaaatttaggcacgcacacacactgaagggtgagtagaacaggattttattgggtgaaaagagaaaaaaa

SEQ ID NO: 275046 - DNA, 477 bp, Homo sapiens
ccacagatatagggatttcttgccctcttacaggcttttcctccaggattcctgccaaatactcacagggaagatcagggagaatcctgagaaagtttttcctgtgtcttggctggggtagaagaacaaaagccactgccaaaatctgcctagatatctctccatctccctaaggaacaaaagtcttaatctgcaggaagaaagtaacagaaagtgagactactggtggaaacccactgtaattggggaaggagaagaggaaaaagaaagaagatctactttcttgggaaaggaaatgaatgcctggtaggcctggcattgtgtttggaggaggatcaggaatgcttatgaaggccacaaccccaagacccaggttcacagtatctgcataatattgcaaattaatcagaatatcagaatacccccatttctcacctccttactataaagctaacaagcatcaaataaaaataacaa

SEQ ID NO: 275047 - DNA, 238 bp, Homo sapiens
gacgccacacctgtgctgcatgctactactcttaaccagggtcctgccccacctccctaagaagatcacattcagatgagctgaaggcagatccaatggtcgtcgattgagacagcattaatgcaatgtcagctgggttgatttctaaccacatcactgaaacactactaaaatcacaataaacgtgcttagacaacattacgtaatagtcaatatgctgagaagcaagactgtacat

SEQ ID NO: 275048 - DNA, 499 bp, Homo sapiens
caaagaagaatactatagacaagaagatttaagtcatgaatatctattaaccattaccttagcatcaaacttcataaagcaatcttccattataggaaatataaatataagcatgataaaacatattttaaagatttttgttgttcaaatttacctcagcccttgagaaataaatgttttctgtttttttaaaaaaagttatagaaaatctaaaaatcttaactattaaagaagaaactttgagctctatattataaaaaagataatatattttattttcaaagtccgtgcatttttcaaattcaccatatattaggtcacaaagagattcccaataaagtttaaacagtagaaatagaacagatgccattttctgatcataatgtaataaatttggaaatattattgaaataaaagaagaaatgagacttccgctttcagcaggattgcaaattagctgttctcaagaatcttcttgctgtaatacaattagatcctg

SEQ ID NO: 275049 - DNA, 765 bp, Homo sapiens
cttcaggtgagagctgcacttctttgctttgtttcagatgaatttcacaggggaacagggacaaagggcaggggttcttgactcccaaattggcttgggaacggcctctggggcctctttaccccagactttacagggcctgggcagggggccgaggccacccatatgctgctggtgattggctgactctggaccttgtccagtgtagaggaggggtggacccagacaagaacagcctggagtaagggcatcagattccaaacattactatgtagttgccccatttgggaagtttcgtagcaacaaatttgttgggttctttctcccctcccctggtttagaagcaaaccagagctggcagggttggtgcgtacaaaggactgtaataaacatacccggggaacaggcggctgcactctccagctattcagtgcgatttcacagcactgggacggcctcgttatggtgcaagctgttgtcctatacaaaggcagatgagataaatttctcccttttctccgctgaatggtctgtgaatgatactcgtcttggagtctgtcaaaagacaggaggttttgtttaccatttgtcttctttgtggactttgggggctctttctctttagagcgggcaaagacgaccaaagacgacgttgctatttaaccatttcggccctgcccccattgataacaatattaatttatcattttcccaaaccatctgtgatggataaagacattccaggagtctcccgtgaaccgaata

SEQ ID NO: 275050 - DNA, 194 bp, Homo sapiens
gacaagggtcctaatgggatgagatcctttcggatttaggcttttatacaaactcctgagaactggcaggttgacagccataaatggggtaccaaactttctactcattggattacaagttctcaggcatccagcctgggtgacagagcaagactccatctaaaaaaagaaagaaagaaagaaagaaaagctgg

SEQ ID NO: 275051 - DNA, 297 bp, Homo sapiens
aacaaaacagccagtgaaatggaaaataagaaatcatagagaaaatcaacaaaaccaaaagctggttctttgaagagattaataaaattgatgtgcttccagctaggctaactaaggaaaaaggatacgctaatattactaatagaagacatgaaagtagaaatcataacagatttccatttatattaaaaatataaaggaatattatgaacaactctgtgcccacgaatttgataacctagatgaaatggaccaattccttgaaggacgcaatctgccaaaagtcatacaagaagt

SEQ ID NO: 275052 - DNA, 1279 bp, Homo sapiens
caggaaaagaggaggagaaagaacactctaggcagagggcacagactaagccaagaccaagaagagagaaggcaggtgcatggggtgtggaggaagctattaatacaagcagttagatgttgctggaacgtcatgtgggaggcagggagaggtgaggggaggcaggtgatggaagggttcattttcctctccaggataggatagatgggggtttcaagagtacttttcaactagatggcagggaaaggtttctaagtcatgaagtagacaccaaaatctctggagggttcaaattgtgaactatgcttgaaatcatgggtgggctagacactggggaggcaggatttcctcttggagacaagttctcacatggtttgacttcatctattgccaataatatcctttctctccttcttccatagtaatagaatttttagcatcactaaaaggctacattttctttaacagcctatacttctcagccacctttccacttagatatggtcaatggatgtaactgggagaatttcacagaggctctgggacacctaaaaaacactcttttataccaaaagccattgaattgtgtaaacttgaaatggataagttgtacgctttgtaaattatatctcaataaagctcttgtaaaaaccttgcttttgactcctttgtgtacatcttttactacattgtgcttcctggaataaagatgtgatggctagtcctctagctgccatcttggactatgaggatgagggtcacaccccaagatggcagagcagtgaactggaaggagctggggcctggaggacttcactgaccaaagctgtctagccggtttttgggttacatatatctttggaatattttgcgaaatgaaaacaaatttctgttttctttgaaccactgctaatttgagtctctgttatttgctgctgaacttaaaccttgctgatacaacatttcattgggagtccattcttctggcttcctatgtccccctgtgtgtaacatgcagattcaggaaggaggcttcttcctgcacggactgcaatcccttgtgggccccaatgggctgtgtgacctctttgagccacattctatctgaaacatggagataattatattttctcacgctgcttactcatggaatcgagataatcaatgagctaatgcgtggggaagcacttggaaaattagaacgtgcttcataaacattatgcatggagttgttatcaccagctccctatctttttatgaacatgaacacgctagaaag

SEQ ID NO: 275053 - DNA, 435 bp, Homo sapiens
ttaaatacaaactatcttatatgaccatctattcaataactcagccatcccactcagcaccctcagcacacttggctgtagctggccaaagtgttgccacatgtcctacagacaactgccttggacagatgtttcttctacccccataatcccttctggacacagcccaagtcttccttccctcataaccggcttgattctgaccacttttgctttgatttttttccaatttaagatgtattcttcttggaaagatggtacaacattgatagaaagttttttttaccagctatcattccatcaccaagacccagtgggattcaattctggcttcacattggaatcccctgtgaagctgtaaagataccgatgcttgagtccctccactagattcggatttattggtctggggtgtgacctgagcatggaatttta

SEQ ID NO: 275054 - DNA, 769 bp, Homo sapiens
tcaaagacaggaaaaatgaaaagaaactgaagtggtctgaaaccatgactttcattttccttaagttcagagagtgaggtggctggagatacagcacgttgattatctgtgacacgatcagtcagaagcaggaccacatgaattctccatcagcaaacaaaatgactggctttctgtgtgattcttcacactgtgaatgcagctactaataacaccgattttacttcaggcaagagaaacagagcctctcattttcccttgagaataatgattgtttcttaatacttttctttttccccatttccttacagaggagttccctgtgcaagggaagcacatggtagggttaatgctacacggaacatgaactctgaagaccctcattttggtttccatgaaggtggtgaaggttctccaaataaaagcatttccaataagggtgaagagtagagagcagtgatgtttccaaaaagtttagaattcctccttcaaatgacttcctaatgaatatcagaaggcaatgtgtggagtcacaagtcattggaatggcacccactgtgtaatttcaacaaaacacttcatccctctgagcctctggtggctcatctgtaaattaaggcaaattctatcttcaaatttcttcactctttgatcaacaacttttattcaactttgttgaaaagaacaaaaaaattgcatctctggttgaatttggtggctctttttctggttaatataaaacgtgactgtcagaatcccatctctaaat

SEQ ID NO: 275055 - DNA, 587 bp, Homo sapiens
cagccgagtgtttccatgataccagccatacctgatgccaggagactcgctacacttggaagctcttcaaggtttaacagcctcccaggatgtcaactggaagatcatgccactcctgacaatgagaagaggagttccctgtgcaagggaagcacatggtagggttaatgctacacggaacatgaactctgaagaccctcattttggtttccatgaaggtggtgaaggttctccaaataaaagcatttccaataagggtgaagagtagagagcagtgatgtttccaaaaagtttagaattcctccttcaaatgacttcctaatgaatatcagaaggcaatgtgtggagtcacaagtcattggaatggcacccactgtgtaatttcaacaaaacacttcatccctctgagcctctggtggctcatctgtaaattaaggcaaattctatcttcaaatttcttcactctttgatcaacaacttttattcaactttgttgaaaagaacaaaaaaattgcatctctggttgaatttggtggctctttttctggttaatataaaacgtgactgtcagaatcccatctctaaat

SEQ ID NO: 275056 - DNA, 1509 bp, Homo sapiens
gcaatcaggtggagtcgagaggccggaggaggggcaggaggaaggggtgcggtcgcgatccggacccggagccagcgcggagcacctgcgcccgcggctgacaccttcgctcgcagtttgttcgcagtttactcgcacaccagtttcccccaccgcgctttggattagtgtgatctcagctcaaggcaaaggtgggatatcatggcatctatctgggttggacaccgaggaacagtaagagattatccagactttagcccatcagtggatgctgaagctattcagaaagcaatcagaggaattggaactgatgagaaaatgctcatcagcattctgactgagaggtcaaatgcacagcggcagctgattgttaaggaatatcaagcagcatatggaaaggagctgaaagatgacttgaagggtgatctctctggccactttgagcatctcatggtggccctagtgactccaccagcagtctttgatgcaaagcagctaaagaaatccatgaagggcgcgggaacaaacgaagatgccttgattgaaatcttaactaccaggacaagcaggcaaatgaaggatatctctcaagcctattatacagtatacaagaagagtcttggagatgacattagttccgaaacatctggtgacttccggaaagctctgttgactttggcagatggcagaagagatgaaagtctgaaagtggatgagcatctggccaaacaagatgcccagattctctataaagctggtgagaacagatggggcacggatgaagacaaattcactgagatcctgtgtttaaggagctttcctcaattaaaactaacatttgatgaatacagaaatatcagccaaaaggacattgtggacagcataaaaggagaattatctgggcattttgaagacttactgttggccatagttaattgtgtgaggaacacgccggcctttttagccgaaagactgcatcgagccttgaagggtattggaactgatgagtttactctgaaccgaataatggtgtccagatcagaaattgaccttttggacattcgaacagagttcaagaagcattatggctattccctatattcagcaattaaatcggatacttctggagactatgaaatcacactcttaaaaatctgtggtggagatgactgaaccaagaagataatctccaaaggtccacgatgggcttttccaacagctccaccttacttcttctcatactatttaagagaacaagcaaatataaacagcaacttgtgttcctaacaggaattttcattgttctataacaacaacaacaaaagcgattattattttagagcatctcatttataatgtagcagctcataaatgaaattgaaaatggtattaaagatctgcaactactatccaacttatatttctgctttcaaagttaagaatctttatagttctaatccattaaatataaagcaagataataaaaattgttgcttttgttaaaagtaa

SEQ ID NO: 275057 - DNA, 787 bp, Homo sapiens
  misc_feature (710)..(710): n is a, c, g, or t
  misc_feature (727)..(727): n is a, c, g, or t
  misc_feature (765)..(765): n is a, c, g, or t
gcaatcaggtggagtcgagaggccggaggaggggcaggaggaaggggtgcggtcgcgatccggacccggagccagcgcggagcacctgcgcccgcggctgacaccttcgctcgcagtttgttcgcagtttactcgcacaccagtttcccccaccgcgctttggattagtgtgatctcagctcaaggcaaaggtgggatatcatggcatctatctgggttggacaccgaggaacagtaagagattatccagactttagcccatcagtggatgctgaagctattcagaaagcaatcagaggaattggaactgatgagaaaatgctcatcagcattctgactgagaggtcaaatgcacagcggcagctgattgttaaggaatatcaagcagcatatggaaaggagctgaaagatgacttgaagggtgatctctctggccactttgagcatctcatggtggccctagtgactccaccagcagtctttgatgcaaagcagctaaagaaatccatgaagggcgcgggaacaaacgaagatgccttgattgaaatcttaactaccaggacaagcaggcaaatgaaggatatctctcaagcctattatacagtatacaagaagagtcttggagatgacattagttccgaaacatctggtgacttccggaaagctctgttgactttggcagatggcagaaagaaatgaaaaagtcttgnaaaagttgggattgaancatctggggccaaaaacaaagaattgcccccagaattnctcttattaaaaagccttgggt

SEQ ID NO: 275058 - DNA, 502 bp, Homo sapiens
gcatccttacaccatccaggttgaaagccaagttttacctcctgtgaagtcttttgcgttacaaacttggtatctttgccctttaagcctcaacctcacgtagtatcttttctggacaacagtctatttttggttggccttgggaaaaggaactgataaacatattctttaaaaatgtggttcatttcactttcctaagttaggcagtgtagccgggtattaaggagcccggatatagggattccaatcctgcttttgtcacttattctcgataagatttgaggccagtttcctaacctgtctttctcattttacttatctgttaaatgggggatacgtatagtacctattgcagagagcttttaaaagggttaaagtagttaatacacattaagccttttgaatagccagtgttcgataaatattattaaaactaaaatttgaagtttttatagaaatcaatattatgtaagtgatgctcgtccgggatcctctagatcga

SEQ ID NO: 275059 - DNA, 1024 bp, Homo sapiens
tgaaaaacaaaacccagataaccctaggtctctctccaaaatttctttttttaaaaatgtattgggggaaaaatatacttggcttacaaaatatgcctgtatacttggtgacatatgtacaggttttgcttggggcaaatactgatcaagaaattcaaatgccttctgggaggtgtgaagtaggccatgccaccttaggaaatgattcagcacaaggaagtcttcagaattaagatttctttaccagagaaaacatatttgactagtgattatagtatcatttcccaggtgctgctataaataaaatttaaaatagcccaacttactggataaattatttattatttaactatttaggctatttaaaatgcttactgcttgagagaaggggaaagagaaagagagatcattgaagaaaatcatctagggagtttgggttttgttgtagatgatttccttaaaaaggaacaaaagaaaaacaaaaacttctgtgcccagattttcatggtttaaagagggagttttttagcttgctacttgatcttctgcatatcaaataaaaaactagaatatattcaaatgtgctcaactgcgttgctttaaataattttgtggtgcttctttttagcatttgatgaatacagaaatatcagccaaaaggacattgtggacagcataaaaggagaattatctgggcattttgaagacttactgttggccatagttaattgtgtgaggaacacgccggcctttttagccgaaagactgcatcgagccttgaagggtattggaactgatgagtttactctgaaccgaataatggtgtccagatcagaaattgaccttttggacattcgaacagagttcaagaagcattatggctattccctatattcagcaattaaatcggatacttctggagactatgaaatcacactcttaaaaatctgtggtggagatgactgaaccaagaagataatctccaaaggtccacgatgggcactcattatgaggggtaggagct

SEQ ID NO: 275060 - DNA, 286 bp, Homo sapiens
ctgaacattatttgctttttgttacagtttaattgtgtgaggaacacgccggcctttttagccgaaagactgcatcgagccttgaagggtattggaactgatgagtttactctgaaccgaataatggtgtccagatcagaaattgaccttttggacattcgaacagagttcaagaagcattatggctattccctatattcagcaattaaatcgatacttctggagactatgaaatcacactctgtaaaatctgtggtgtatagtaatcctgggagtacctgcagca

SEQ ID NO: 275061 - DNA, 1388 bp, Homo sapiens
gcaatcaggtggagtcgagaggccggaggaggggcaggaggaaggggtgcggtcgcgatccggacccggagccagcgcggagcacctgcgcccgcggctgacaccttcgctcgcagtttgttcgcagtttactcgcacaccagtttcccccaccgcgctttggattagtgtgatctcagctcaaggcaaaggtgggatatcatggcatctatctgggttggacaccgaggaacagtaagagattatccagactttagcccatcagtggatgctgaagctattcagaaagcaatcagaggaattggaactgatgagaaaatgctcatcagcattctgactgagaggtcaaatgcacagcggcagctgattgttaaggaatatcaagcagcatatggaaaggagctgaaagatgacttgaagggtgatctctctggccactttgagcatctcatggtggccctagtgactccaccagcagtctttgatgcaaagcagctaaagaaatccatgaagggcgcgggaacaaacgaagatgccttgattgaaatcttaactaccaggacaagcaggcaaatgaaggatatctctcaagcctattatacagtatacaagaagagtcttggagatgacattagttccgaaacatctggtgacttccggaaagctctgttgactttggcagatggcagaagagatgaaagtctgaaagtggatgagcatctggccaaacaagatgcccagattctctataaagctggtgagaacagatggggcacggatgaagacaaattcactgagatcctgtgtttaaggagctttcctcaattaaaactaacatttgatgaatacagaaatatcagccaaaaggacattgtggacagcataaaaggagaattatctgggcattttgaagacttactgttggccatagttaattgtgtgaggaacacgccggcctttttagccgaaagactgcatcgagccttgaagggtattggaactgatgagtttactctgaaccgaataatggtgtccagatcagaaattgaccttttggacattcgaacagagttcaagaagcattatggctattccctatattcagcaattaaatcggatacttctggagactatgaaatcacactcttaaaaatctgtggtggagatgactgaaccaagaagataatctccaaaggtccacgatgggcttttccaacagctccaccttacttcttctcatactatttaagagaacaagcaaatataaacagcaacttgtgttccttaaccagggaaatttttcatattggtttttattaaccaaccacccaacctgaaggccggattatttttttttttaagagacccttccttcatttttattaaat

SEQ ID NO: 275062 - DNA, 1436 bp, Homo sapiens
gcaatcaggtggagtcgagaggccggaggaggggcaggaggaaggggtgcggtcgcgatccggacccggagccagcgcggagcacctgcgcccgcggctgacaccttcgctcgcagtttgttcgcagtttactcgcacaccagtttcccccaccgcgctttggattagtgtgatctcagctcaaggcaaaggtgggatatcatggcatctatctgggttggacaccgaggaacagtaagagattatccagactttagcccatcagtggatgctgaagctattcagaaagcaatcagaggaattggaactgatgagaaaatgctcatcagcattctgactgagaggtcaaatgcacagcggcagctgattgttaaggaatatcaagcagcatatggaaaggagctgaaagatgacttgaagggtgatctctctggccactttgagcatctcatggtggccctagtgactccaccagcagtctttgatgcaaagcagctaaagaaatccatgaagggcgcgggaacaaacgaagatgccttgattgaaatcttaactaccaggacaagcaggcaaatgaaggatatctctcaagcctattatacagtatacaagaagagtcttggagatgacattagttccgaaacatctggtgacttccggaaagctctgttgactttggcagatggcagaagagatgaaagtctgaaagtggatgagcatctggccaaacaagatgcccagattctctataaagctggtgagaacagatggggcacggatgaagacaaattcactgagatcctgtgtttaaggagctttcctcaattaaaactaacatttgatgaatacagaaatatcagccaaaaggacattgtggacagcataaaaggagaattatctgggcattttgaagacttactgttggccatagttaattgtgtgaggaacacgccggcctttttagccgaaagactgcatcgagccttgaagggtattggaactgatgagtttactctgaaccgaataatggtgtccagatcagaaattgaccttttggacattcgaacagagttcaagaagcattatggctattccctatattcagcaattaaagtaagtctacttttaaaaatagcaaaacatattttgcccttctctacccatctccttactcttatatgccttaaaatataaagatatttgacttaaatttctctctccttgtcaatgtataaatgtgttgtctgagcttaaaatagtagcagcaaaatatcccttattttcagctctaaaatcccaggcatataatagacactcaatatttttttaggggtactagccactaatttttcttcttttgtgaattacatatgcaagttgtttacctgttttttatattgcactggttttatttatttcagtctttatgacaatgt

SEQ ID NO: 275063 - DNA, 1152 bp, Homo sapiens
gcaatcaggtggagtcgagaggccggaggaggggcaggaggaaggggtgcggtcgcgatccggacccggagccagcgcggagcacctgcgcccgcggctgacaccttcgctcgcagtttgttcgcagtttactcgcacaccagtttcccccaccgcgctttggattagtgtgatctcagctcaaggcaaaggtgggatatcatggcatctatctgggttggacaccgaggaacagtaagagattatccagactttagcccatcagtggatgctgaagctattcagaaagcaatcagaggaattggaactgatgagaaaatgctcatcagcattctgactgagaggtcaaatgcacagcggcagctgattgttaaggaatatcaagcagcatatggaaaggagctgaaagatgacttgaagggtgatctctctggccactttgagcatctcatggtggccctagtgactccaccagcagtctttgatgcaaagcagctaaagaaatccatgaagggcgcgggaacaaacgaagatgccttgattgaaatcttaactaccaggacaagcaggcaaatgaaggatatctctcaagcctattatacagtatacaagaagagtcttggagatgacattagttccgaaacatctggtgacttccggaaagctctgttgactttggcagatggcagaagagatgaaagtctgaaagtggatgagcatctggccaaacaagatgcccagattctctataaagctggtgagaacagatggggcacggatgaagacaaattcactgagatcctgtgtttaaggagctttcctcaattaaaactaacatttgatgaatacagaaatatcagccaaaaggacattgtggacagcataaaaggagaattatctgggcattttgaagacttactgttggccatagttaattgtgtgaggaacacgccggcctttttagccgaaagactgcatcgagccttgaagggtattggaactgatgagtttactctgaaccgaataatggtgtccagatcagaaattgaccttttggacattcgaacagagttcaagaagcattatggctattccctatattcagcaattaaatcggatacttctggagaccctgggcaaaccaccttcgtg

SEQ ID NO: 275064 - DNA, 1652 bp, Homo sapiens
gcaatcaggtggagtcgagaggccggaggaggggcaggaggaaggggtgcggtcgcgatccggacccggagccagcgcggagcacctgcgcccgcggctgacaccttcgctcgcagtttgttcgcagtttactcgcacaccagtttcccccaccgcgctttggattagtgtgatctcagctcaaggcaaaggtgggatatcatggcatctatctgggtacacggtctcactctgtcacctagactacagtgcagtgacacaatcacagctcactgcagccttgaccttctgcgctcaagtggtcctcccacctcagcctcccaagtagctgggaccacacctgcacaccaccacacctggttggacaccgaggaacagtaagagattatccagactttagcccatcagtggatgctgaagctattcagaaagcaatcagaggaattggaactgatgagaaaatgctcatcagcattctgactgagaggtcaaatgcacagcggcagctgattgttaaggaatatcaagcagcatatggaaaggagctgaaagatgacttgaagggtgatctctctggccactttgagcatctcatggtggccctagtgactccaccagcagtctttgatgcaaagcagctaaagaaatccatgaagggcgcgggaacaaacgaagatgccttgattgaaatcttaactaccaggacaagcaggcaaatgaaggatatctctcaagcctattatacagtatacaagaagagtcttggagatgacattagttccgaaacatctggtgacttccggaaagctctgttgactttggcagatggcagaagagatgaaagtctgaaagtggatgagcatctggccaaacaagatgcccagattctctataaagctggtgagaacagatggggcacggatgaagacaaattcactgagatcctgtgtttaaggagctttcctcaattaaaactaacatttgatgaatacagaaatatcagccaaaaggacattgtggacagcataaaaggagaattatctgggcattttgaagacttactgttggccatagttaattgtgtgaggaacacgccggcctttttagccgaaagactgcatcgagccttgaagggtattggaactgatgagtttactctgaaccgaataatggtgtccagatcagaaattgaccttttggacattcgaacagagttcaagaagcattatggctattccctatattcagcaattaaatcggatacttctggagactatgaaatcacactcttaaaaatctgtggtggagatgactgaaccaagaagataatctccaaaggtccacgatgggcttttccaacagctccaccttacttcttctcatactatttaagagaacaagcaaatataaacagcaacttgtgttcctaacaggaattttcattgttctataacaacaacaacaaaagcgattattattttagagcatctcatttataatgtagcagctcataaatgaaattgaaaatggtattaaagatctgcaactactatccaacttatatttctgctttcaaagttaagaatctttatagttctaatccattaaatataaagcaagataataaaaattgttgcttttgttaaaagtaa

SEQ ID NO: 275065 - DNA, 1455 bp, Homo sapiens
gcaatcaggtggagtcgagaggccggaggaggggcaggaggaaggggtgcggtcgcgatccggacccggagccagcgcggagcacctgcgcccgcggctgacaccttcgctcgcagtttgttcgcagtttactcgcacaccagtttcccccaccgcgctttggattagtgtgatctcagctcaaggcaaaggtgggatatcatggcatctatctgggttggacaccgaggaacagtaagagattatccagactttagcccatcagtggatgctgaagctattcagaaagcaatcagaggaattggaactgatgaggttaaggaatatcaagcagcatatggaaaggagctgaaagatgacttgaagggtgatctctctggccactttgagcatctcatggtggccctagtgactccaccagcagtctttgatgcaaagcagctaaagaaatccatgaagggcgcgggaacaaacgaagatgccttgattgaaatcttaactaccaggacaagcaggcaaatgaaggatatctctcaagcctattatacagtatacaagaagagtcttggagatgacattagttccgaaacatctggtgacttccggaaagctctgttgactttggcagatggcagaagagatgaaagtctgaaagtggatgagcatctggccaaacaagatgcccagattctctataaagctggtgagaacagatggggcacggatgaagacaaattcactgagatcctgtgtttaaggagctttcctcaattaaaactaacatttgatgaatacagaaatatcagccaaaaggacattgtggacagcataaaaggagaattatctgggcattttgaagacttactgttggccatagttaattgtgtgaggaacacgccggcctttttagccgaaagactgcatcgagccttgaagggtattggaactgatgagtttactctgaaccgaataatggtgtccagatcagaaattgaccttttggacattcgaacagagttcaagaagcattatggctattccctatattcagcaattaaatcggatacttctggagactatgaaatcacactcttaaaaatctgtggtggagatgactgaaccaagaagataatctccaaaggtccacgatgggcttttccaacagctccaccttacttcttctcatactatttaagagaacaagcaaatataaacagcaacttgtgttcctaacaggaattttcattgttctataacaacaacaacaaaagcgattattattttagagcatctcatttataatgtagcagctcataaatgaaattgaaaatggtattaaagatctgcaactactatccaacttatatttctgctttcaaagttaagaatctttatagttctaatccattaaatataaagcaagataataaaaattgttgcttttgttaaaagtaa

SEQ ID NO: 275066 - DNA, 1302 bp, Homo sapiens
tgaaaaacaaaacccagataaccctaggtctctctccaaaatttctttttttaaaaatgtattgggggaaaaatatacttggcttacaaaatatgcctgtatacttggtgacatatgtacaggttttgcttggggcaaatactgatcaagaaattcaaatgccttctgggaggtgtgaagtaggccatgccaccttaggaaatgattcagcacaaggaagtcttcagaattaagatttctttaccagagaaaacatatttgactagtgattatagtatcatttcccaggtgctgctataaataaaatttaaaatagcccaacttactggataaattatttattatttaactatttaggctatttaaaatgcttactgcttgagagaaggggaaagagaaagagagatcattgaagaaaatcatctagggagtttgggttttgttgtagatgatttccttaaaaaggaacaaaagaaaaacaaaaacttctgtgcccagattttcatggtttaaagagggagttttttagcttgctacttgatcttctgcatatcaaataaaaaactagaatatattcaaatgtgctcaactgcgttgctttaaataattttgtggtgcttctttttagcatttgatgaatacagaaatatcagccaaaaggacattgtggacagcataaaaggagaattatctgggcattttgaagacttactgttggccatagttaattgtgtgaggaacacgccggcctttttagccgaaagactgcatcgagccttgaagggtattggaactgatgagtttactctgaaccgaataatggtgtccagatcagaaattgaccttttggacattcgaacagagttcaagaagcattatggctattccctatattcagcaattaaatcggatacttctggagactatgaaatcacactcttaaaaatctgtggtggagatgactgaaccaagaagataatctccaaaggtccacgatgggcttttccaacagctccaccttacttcttctcatactatttaagagaacaagcaaatataaacagcaacttgtgttcctaacaggaattttcattgttctataacaacaacaacaaaagcgattattattttagagcatctcatttataatgtagcagctcataaatgaaattgaaaatggtattaaagatctgcaactactatccaacttatatttctgctttcaaagttaagaatctttatagttctaatccattaaatataaagcaagataataaaaattgttgcttttgttaaaagtaa

SEQ ID NO: 275067 - DNA, 1255 bp, Homo sapiens
tgaaaaacaaaacccagataaccctaggtctctctccaaaatttctttttttaaaaatgtattgggggaaaaatatacttggcttacaaaatatgcctgtatacttggtgacatatgtacaggttttgcttggggcaaatactgatcaagaaattcaaatgccttctgggaggtgtgaagtaggccatgccaccttaggaaatgattcagcacaaggaagtcttcagaattaagatttctttaccagagaaaacatatttgactagtgattatagtatcatttcccaggtgctgctataaataaaatttaaaatagcccaacttactggataaattatttattatttaactatttaggctatttaaaatgcttactgcttgagagaaggggaaagagaaagagagatcattgaagaaaatcatctagggagtttgggttttgttgtagatgatttccttaaaaaggaacaaaagaaaaacaaaaacttctgtgcccagattttcatggtttaaagagggagttttttagcttgctacttgatcttctgcatatcaaataaaaaactagaatatattcaaatgtgctcaactgcgttgctttaaataattttgtggtgcttctttttagcatttgatgaatacagaaatatcagccaaaaggacattgtggacagcatttaattgtgtgaggaacacgccggcctttttagccgaaagactgcatcgagccttgaagggtattggaactgatgagtttactctgaaccgaataatggtgtccagatcagaaattgaccttttggacattcgaacagagttcaagaagcattatggctattccctatattcagcaattaaatcggatacttctggagactatgaaatcacactcttaaaaatctgtggtggagatgactgaaccaagaagataatctccaaaggtccacgatgggcttttccaacagctccaccttacttcttctcatactatttaagagaacaagcaaatataaacagcaacttgtgttcctaacaggaattttcattgttctataacaacaacaacaaaagcgattattattttagagcatctcatttataatgtagcagctcataaatgaaattgaaaatggtattaaagatctgcaactactatccaacttatatttctgctttcaaagttaagaatctttatagttctaatccattaaatataaagcaagataataaaaattgttgcttttgttaaaagtaa

SEQ ID NO: 275068 - DNA, 682 bp, Homo sapiens
  misc_feature (682)..(682): n is a, c, g, or t
cctagttttagaagtttcaagagcaagataatctccaaaggtccacgatgggcttttccaacagctccaccttacttcttctcatactatttaagagaacaagcaaatataaacagcaacttgtgttcctaacaggaattttcattgttctataacaacaacaacaaaagcgattattattttagagcatctcatttataatgtagcagctcataaatgaaattgaaaatggtattaaagatctgcaactactatccaacttatatttctgctttcaaagttaagaatctttatagttctaatccattaaatataaagcaagataataaaaattgttgcttttgttaaaagtaaaaaaaaaaaaaaaaaaaaaaaaaaaatttggggggggcttgggcctcgagaaaagggttttgaacaaccccaaatcgtgtggaggcggccgcggccccccggtaagtatagtggacatgagtgcgcgaatgagccgtgtccacgagaagaaacaccgggactgagaacaaggatgcgtgaattactacaacccaatgtaagaagaagcgcggggggaagccacggaagcggtcgtggaacacattccagagggagatacgaaaggcccacagcgggctcacaccgaggcgtcacagggcagtcgaaataaaatagcgccgccgtgagn

SEQ ID NO: 275069 - DNA, 719 bp, Homo sapiens
atgtggttcatttcactttcctaagttaggcagtgtagccgggtattaaggagcccggatatagggattccaatcctgcttttgtcacttattctcgataagatttgaggccagtttcctaacctgtctttctcattttacttatctgttaaatgggggatacgtatagtacctattgcagagagcttttaaaagggttaaagtagttaatacacattaagccttttgaatagccagtgttcgataaatattattaaaactaaaatttgaagtttttatagaaatcaatattatgtaagtgatgcaatcttattttattaaaccaaaattgaaatttaactgcagtatatcaggaagaatctaaatattacttacagtgaagaagatgctggtcagaacgtaattacactcaggtatgaatgaatgatggaattgcaggtatgttttactaaatggtatagctcatgagtctcacacccaggtgaattccctagtgctataggatttgattcatttatggtctcccattatttatactgtatttgttcttcattgattttattctttgcagtcggatacttctggagactatgaaatcacactcttaaaaatctgtggtggagatgactgaaccaagaagataatctccaaaggtccacgatgggcttttccaacagctccaccttacttcttctcatactatttaagagaacaagcaa

SEQ ID NO: 275070 - DNA, 655 bp, Homo sapiens
ccagacccgggtccttcactgacagattaatctgggccagcttctcctttaacatcaggaagtcttcaggaagcagctgctggaggaggctcttcctctccagcagggccttaagccgttcctggctggttgctatttcccctgctgagccctggatcttttccttgatgatttcaatctcttctagccgctgttttatgctagttccatacctcaggtttttgcggatgggcacctgtccgatagggcagactttcaatctgatgggagaagactgcgcacgtctttgatgcaaagcacgctaaagaaatccatgaagggcgcgggaacaaacgaagatgccttgattgaaatcttaactaccaggacaagcaggcaaatgaaggatatctctcaagcctattatacagtatacaagaagagtcttggagatgacattagttccgaaacatctggtgacttccggaaagctctgttgactttggcagatgggagaagactggccatcttctcccatcaggtgggtatatatgccactaatttgtttgattgtgtttttcccttgttcctcattttgttttggcctagtaatatcctattgattgtatgattatcacacactgatatccattttacctgatggacgcaagcctgg

SEQ ID NO: 275071 - DNA, 1837 bp, Homo sapiens
  misc_feature (1837)..(1837): n is a, c, g, or t
gcaatcaggtggagtcgagaggccggaggaggggcaggaggaaggggtgcggtcgcgatccggacccggagccagcgcggagcacctgcgcccgcggctgacaccttcgctcgcagtttgttcgcagtttactcgcacaccagtttcccccaccgcgctttggattagtgtgatctcagctcaaggcaaaggtgggatatcatggcatctatctgggttggacaccgaggaacagtaagagattatccagactttagcccatcagtggatgctgaagctattcagaaagcaatcagaggaattggaactgatgagaaaatgctcatcagcattctgactgagaggtcaaatgcacagcggcagctgattgttaaggaatatcaagcagcatatggaaaggagctgaaagatgacttgaagggtgatctctctggccactttgagcatctcatggtggccctagtgactccaccagcagtctttgatgcaaagcagctaaagaaatccatgaagggcgcgggaacaaacgaagatgccttgattgaaatcttaactaccaggacaagcaggcaaatgaaggatatctctcaagcctattatacagtatacaagaagagtcttggagatgacattagttccgaaacatctggtgacttccggaaagctctgttgactttggcagatggcagaagagatgaaagtctgaaagtggatgagcatctggccaaacaagatgcccagattctctataaagctggtgagaacagatggggcacggatgaagacaaattcactgagatcctgtgtttaaggagctttcctcaattaaaactaacatttgatgaatacagaaatatcagccaaaaggacattgtggacagcataaaaggagaattatctgggcattttgaagacttactgttggccatagttaattgtgtgaggaacacgccggcctttttagccgaaagactgcatcgagccttgaagggtattggaactgatgagtttactctgaaccgaataatggtgtccagatcagaaattgaccttttggacattcgaacagagttcaagaagcattatggctattccctatattcagcaattaaatcggatacttctggagactatgaaatcacactcttaaaaatctgtggtggagatgactgaaccaagaagataatctccaaaggtccacgatgggcttttccaacagctccaccttacttcttctcatactatttaagagaacaagcaaatataaacagcaacttgtgttcctaacaggaattttcattgttctataacaacaacaacaaaagcgattattattttagagcatctcatttataatgtagcagctcataaatgaaattgaaaatggtattaaagatctgcaactactatccaacttatatttctgctttcaaagttaagaatctttatagttctaatccattaaatataaagcaagataataaaaattgttgcttttgttaaaagtaaaaaaaaaaaaaaaaaaaaaaaaaaaatttggggggggcttgggcctcgagaaaagggttttgaacaaccccaaatcgtgtggaggcggccgcggccccccggtaagtatagtggacatgagtgcgcgaatgagccgtgtccacgagaagaaacaccgggactgagaacaaggatgcgtgaattactacaacccaatgtaagaagaagcgcggggggaagccacggaagcggtcgtggaacacattccagagggagatacgaaaggcccacagcgggctcacaccgaggcgtcacagggcagtcgaaataaaatagcgccgccgtgagn

SEQ ID NO: 275072 - DNA, 1784 bp, Homo sapiens
  misc_feature (1784)..(1784): n is a, c, g, or t
gcaatcaggtggagtcgagaggccggaggaggggcaggaggaaggggtgcggtcgcgatccggacccggagccagcgcggagcacctgcgcccgcggctgacaccttcgctcgcagtttgttcgcagtttactcgcacaccagtttcccccaccgcgctttggattagtgtgatctcagctcaaggcaaaggtgggatatcatggcatctatctgggttggacaccgaggaacagtaagagattatccagactttagcccatcagtggatgctgaagctattcagaaagcaatcagaggaattggaactgatgagaaaatgctcatcagcattctgactgagaggtcaaatgcacagcggcagctgattgttaaggaatatcaagcagcatatggaaaggagctgaaagatgacttgaagggtgatctctctggccactttgagcatctcatggtggccctagtgactccaccagcagtctttgatgcaaagcagctaaagaaatccatgaagggcgcgggaacaaacgaagatgccttgattgaaatcttaactaccaggacaagcaggcaaatgaaggatatctctcaagcctattatacagtatacaagaagagtcttggagatgacattagttccgaaacatctggtgacttccggaaagctctgttgactttggcagatggcagaagagatgaaagtctgaaagtggatgagcatctggccaaacaagatgcccagattctctataaagctggtgagaacagatggggcacggatgaagacaaattcactgagatcctgtgtttaaggagctttcctcaattaaaactaacatttgatgaatacagaaatatcagccaaaaggacattgtggacagcataaaaggagaattatctgggcattttgaagacttactgttggccatagttaattgtgtgaggaacacgccggcctttttagccgaaagactgcatcgagccttgaagggtattggaactgatgagtttactctgaaccgaataatggtgtccagatcagaaattgaccttttggacattcgaacagagttcaagaagcattatggctattccctatattcagcaattaaatcggatacttctggagactatgaaatcacactcttgatgggcttttccaacagctccaccttacttcttctcatactatttaagagaacaagcaaatataaacagcaacttgtgttcctaacaggaattttcattgttctataacaacaacaacaaaagcgattattattttagagcatctcatttataatgtagcagctcataaatgaaattgaaaatggtattaaagatctgcaactactatccaacttatatttctgctttcaaagttaagaatctttatagttctaatccattaaatataaagcaagataataaaaattgttgcttttgttaaaagtaaaaaaaaaaaaaaaaaaaaaaaaaaaatttggggggggcttgggcctcgagaaaagggttttgaacaaccccaaatcgtgtggaggcggccgcggccccccggtaagtatagtggacatgagtgcgcgaatgagccgtgtccacgagaagaaacaccgggactgagaacaaggatgcgtgaattactacaacccaatgtaagaagaagcgcggggggaagccacggaagcggtcgtggaacacattccagagggagatacgaaaggcccacagcgggctcacaccgaggcgtcacagggcagtcgaaataaaatagcgccgccgtgagn

SEQ ID NO: 275073 - DNA, 1472 bp, Homo sapiens
cctcctcaaagagcagatgtgtctttataacagactgtaggcttggagccttgtaaaatgtacatggagtttcacaatcaagcacaaggaatccaactgaaggcagctaaactttgtgttgatttgattagtgtgatctcagctcaaggcaaaggtgggatatcatggcatctatctgggttggacaccgaggaacagtaagagattatccagactttagcccatcagtggatgctgaagctattcagaaagcaatcagaggaattggaactgatgagaaaatgctcatcagcattctgactgagaggtcaaatgcacagcggcagctgattgttaaggaatatcaagcagcatatggaaaggagctgaaagatgacttgaagggtgatctctctggccactttgagcatctcatggtggccctagtgactccaccagcagtctttgatgcaaagcagctaaagaaatccatgaagggcgcgggaacaaacgaagatgccttgattgaaatcttaactaccaggacaagcaggcaaatgaaggatatctctcaagcctattatacagtatacaagaagagtcttggagatgacattagttccgaaacatctggtgacttccggaaagctctgttgactttggcagatggcagaagagatgaaagtctgaaagtggatgagcatctggccaaacaagatgcccagattctctataaagctggtgagaacagatggggcacggatgaagacaaattcactgagatcctgtgtttaaggagctttcctcaattaaaactaacatttgatgaatacagaaatatcagccaaaaggacattgtggacagcataaaaggagaattatctgggcattttgaagacttactgttggccatagttaattgtgtgaggaacacgccggcctttttagccgaaagactgcatcgagccttgaagggtattggaactgatgagtttactctgaaccgaataatggtgtccagatcagaaattgaccttttggacattcgaacagagttcaagaagcattatggctattccctatattcagcaattaaatcggatacttctggagactatgaaatcacactcttaaaaatctgtggtggagatgactgaaccaagaagataatctccaaaggtccacgatgggcttttccaacagctccaccttacttcttctcatactatttaagagaacaagcaaatataaacagcaacttgtgttcctaacaggaattttcattgttctataacaacaacaacaaaagcgattattattttagagcatctcatttataatgtagcagctcataaatgaaattgaaaatggtattaaagatctgcaactactatccaacttatatttctgctttcaaagttaagaatctttatagttctaatccattaaatataaagcaagataataaaaattgttgcttttgttaaaagtaa

SEQ ID NO: 275074 - DNA, 1423 bp, Homo sapiens
gcaatcaggtggagtcgagaggccggaggaggggcaggaggaaggggtgcggtcgcgatccggacccggagccagcgcggagcacctgcgcccgcggctgacaccttcgctcgcagtttgttcgcagtttactcgcacaccagtttcccccaccgcgctttggattagtgtgatctcagctcaaggcaaaggtgggatatcatggcatctatctgggtgaactgatgagaaaatgctcatcagcattctgactgagaggtcaaatgcacagcggcagctgattgttaaggaatatcaagcagcatatggaaaggagctgaaagatgacttgaagggtgatctctctggccactttgagcatctcatggtggccctagtgactccaccagcagtctttgatgcaaagcagctaaagaaatccatgaagggcgcgggaacaaacgaagatgccttgattgaaatcttaactaccaggacaagcaggcaaatgaaggatatctctcaagcctattatacagtatacaagaagagtcttggagatgacattagttccgaaacatctggtgacttccggaaagctctgttgactttggcagatggcagaagagatgaaagtctgaaagtggatgagcatctggccaaacaagatgcccagattctctataaagctggtgagaacagatggggcacggatgaagacaaattcactgagatcctgtgtttaaggagctttcctcaattaaaactaacatttgatgaatacagaaatatcagccaaaaggacattgtggacagcataaaaggagaattatctgggcattttgaagacttactgttggccatagttaattgtgtgaggaacacgccggcctttttagccgaaagactgcatcgagccttgaagggtattggaactgatgagtttactctgaaccgaataatggtgtccagatcagaaattgaccttttggacattcgaacagagttcaagaagcattatggctattccctatattcagcaattaaatcggatacttctggagactatgaaatcacactcttaaaaatctgtggtggagatgactgaaccaagaagataatctccaaaggtccacgatgggcttttccaacagctccaccttacttcttctcatactatttaagagaacaagcaaatataaacagcaacttgtgttcctaacaggaattttcattgttctataacaacaacaacaaaagcgattattattttagagcatctcatttataatgtagcagctcataaatgaaattgaaaatggtattaaagatctgcaactactatccaacttatatttctgctttcaaagttaagaatctttatagttctaatccattaaatataaagcaagataataaaaattgttgcttttgttaaaagtaa

SEQ ID NO: 275075 - DNA, 427 bp, Homo sapiens
tctcctttcctttctttcttctacaattcctactagttgggtaccatattctctggaataattctccaactttcttttctctcattttttcatctctttgactttttgttctagtatttgtgaaatgtcctcaactttatcttccaaaacttctatttgaagtttcttacttcaaataactgtttcctgaaactttaaattttattttctatgtacaatcaatattgagacatttcttagacctatgatgtcattcatctgtgacaaaatgtgcttcttcagaaaaaattttaccaacacaaataatttttgttatatagggtttaatcaggccaaaacaaaaatgtgcctttcagttcccatgttaattaaatttagtgcaaaataatttctttgaaacttgtcaaatatcacaaaatattggcca

SEQ ID NO: 275076 - DNA, 560 bp, Homo sapiens
ctggagaggatgtggagaaataggaacacttttatactgttggtgggactgtaaactagttcaaccattgtggaagtcagtggggcgattcctcagggatctagaactagaaataccatttgacccagccatcccattactgggtatatacccaaaggactataaatcatgctgctataaagacacatgcacacgtatgtttattgcggcactattcacaatagcatttactgtttttctttccttgtatcctatttactactcaatcttctgccttccagtttcccttcccaccagtctaccaaaactgttcaggcaaaattcaccaaggaactcactggccaattgccaaatcctgtggccactttcagttcccatcttctgccacctctcggtggagcacagtgaatacttcctaaacttccttccccagttgtcaattcactgttctcaccactcttgctgcctcttcacaagttcctttgctgcccacctcttcctactggtgtgtcacagggcaccatccggcatgcctggtctcccctttctctttcctccac

SEQ ID NO: 275077 - DNA, 443 bp, Homo sapiens
agctctgtctgctagccctcatggggctcgggctccaggctctttgccaccctgtatgcctcttttcaaataaatgtgagtttgcccatgttccttttaggagtggtgtcagaaatgaagcctactttgaatgtggtctggtcaacattttggtacagctgtcatctccattaaataggataccctacaaatggtgtctctattaaaacacattagcatttttgtgcagctggttcatattcttggtccaaaactatgacctctaggtcatttaaacagaagctgttttaaaggcagttcaccctcctcattttgcacttggagaattaacatttctaatctaaacatacagagatttatatggcctgttcagtttcattttgttaattttagcccaatattgagcttaagatgctctggagttcttatataatattagccat

SEQ ID NO: 275078 - DNA, 272 bp, Homo sapiens
tcttgctcttcacccatgttagagtgaagtggcgtgatcacttttcactgtagcctcgactcccaagtgattctcgcacttcagcttcctgagtagctgggactacaagcacaagccaccagacccaagtaattattttttgtagagacaggatctcactgtgtagcccaggctggtttcaaaactccttggctcatgtgatcctcctgtctcagactccagaagtgctggggaccatcatgccccggcagaaaatcactttgccacaaagg

SEQ ID NO: 275079 - DNA, 524 bp, Homo sapiens
ataaaggaaacctactaatttgacagtggagaaaccaatggatatcacattaacaaagtgatcatagttaccaccaccaatattgtaataaactttcatttcctgtgtctcctgatatgatgcatggagaaggacacagcatcgcctctgtaatattcccactaaaatgcgtgacctcaattgaattatgaggaaacatcagacaaattcaacatgtggtaaaaatttttaacaaaatgaccggcctacattcttcaaaagtgccaaagtcatgaaaaagaaagactaagtagtggttccatttttcaaaaaacttaaaaaaaaaaaaagtaggaaactgaagacacttaacaactaaatgtcatgtgataattgattggttcttggcctagggttttttttcaatctataaaatcccacaaagggcattgttgggacaattacaaaaattgaatagcgtatgtagattagatacattacttttttaatttgataagttgtattgtaattatgcaagagaatat

SEQ ID NO: 275080 - DNA, 433 bp, Homo sapiens
taaaacaaccaacaacataatcaaattcccagttctgtgctaaacctatggaatcagatcctccaagagagagctgaatggtgcctgcaacttctgtgaccattttgccatgttgggaccaagtgtgaatgcaaagtttgcacatagaggagaactgaccaatcggagaatggaaaacttcttgatcattgatgacagcagtcaaccagtgaagccatcaagcctggagtttttcctactgctggaattcttgtcattgcagaaaatcaatgttgtgttctgatttggggcattctagcttgcaaatagaggcatcttagctgacaccaaatgctccctaaggatattccaaagataaaattgatgtcttcattttgaagggcattgataaagttttacatttgtctttattgtagtgaagatttttaaattt

SEQ ID NO: 275081 - DNA, 326 bp, Homo sapiens
ctatgggaataaaaaattaaaatttttttaaaaaacaacttagactgtagtgatggttgtacaactttgtgagtataccaaaactactgaattggacattttaatgggtgatttttatggtatgtgatttatatttcagcaaaaatgttttttaaaaacttttttaaaaagaaaagacaccagaaaaagaaaaaccaacaactaaaatcatacttaatgatgacagaccatattattttttcccaagattggtaacaaggaaaagacatctactgttaccacttctattcactttatactggaggtcgtaggaagtgcaacaaggc

SEQ ID NO: 275082 - DNA, 206 bp, Homo sapiens
gcgtgaaccaccgtacccggcccccaaatgagttttattctggtctgggtatcctggcaggaacccttgtagagcagtcaaagtgaaagttactcaaaactagaaatacctgaaaggccaccaagcacagaaaaaaaaccttaagttggaagcgggggcaaggtgccattttgtagcctcattcattctttagggatctggagttt

SEQ ID NO: 275083 - DNA, 424 bp, Homo sapiens
tagaatagaagtgaatgtggttataaaagggcaacataagggatatttagggagatggaactgttctgtgtgttggctgtggtgggagatacatgaaactgcacgtcataaactagcatagacctaactacacacagacacacacacacacaaagtaaatttgggaaaacccgaataagactgatggcttgtatcaaggtcaacatcctggctgtgatattgtactctagttctgcaagatgttggtattgagttaacatagaatttctttgtttttttttttttttataactgcatgtgaatttacaattgtctcaaaggcaaaggctaacttttttttttaaaaggaaagaaaatggccctctgatttggaggacagagaaatcccagccacattctgacactaaatctaattttttttttt

SEQ ID NO: 275084 - DNA, 360 bp, Homo sapiens
tttaatacaatgttacttggcacacagaattttgtaagttttccattttccttttgcatatctctttaatagtataaaattatcacatttatctcattcagcatcttttgccttgaattctgtttttatattggtttgaatttgcttgatgtatgtttgctttttttttcataaataagaggttggattttgttgtttgatcatttgtcttttaatagaggagtttaacctgtttaaaattcttacaattgatgtgtttgggtttttatgctttctatttttgtacttctttattgttttctttattttttatttagtgtgacacttattttagctgtggaatccaaaatgtaaaatgca

SEQ ID NO: 275085 - DNA, 596 bp, Homo sapiens
ataactgtgccacatacttatataaaatataagctctcacttatgttttgaagaattatgattatttttacagaggagattcagagaggttaagaaatatgcccaaagtgatactgctcctaagtagctatgctgatatataaactcaggacacaggactctcagatatgttcatttccccaaatcaactcccttgggtcaaggacaagccactgtgttattacgagtcaatggctctgtgactgtaggtttccatttttaaactgaaaactgccactaagatctactaactaatggctcccattggtttaattaccactaccctttatccaagtttccctgtcacaaagcccaggcctctcaggcccctctcatcccagcgtgaatgtcctataggcagtcttccgtcgctgccctgctctatctacccaggatcacggactgacacgctaccaacttcacttatttaactagtcctgcgaggggcatcatccgctccatgtccacggccagtccccagagcccaggagggctcgcacacaggcgctcggcagatactgagaaacaggaaagtggccgttcaccgggctgcttcc

SEQ ID NO: 275086 - DNA, 390 bp, Homo sapiens
ataactgtgccacatacttatataaaatataagctctcacttatgttttgaagaattatgattatttttacagaggagattcagagaggttaagaaatatgcccaaagtgatactgctcctaagtagctatgctgatatataaactcaggacacaggactctcagatatgttcatttccccaaatcaactcccttgggtcaaggacaagccactgtgttattacgagtcaatggctctgtgactgtaggtttccatttttaaactgaaaactgccactaagatctactaactaatggctcccattggtttaattaccactaccctttaaaagccaagtaaaccaaaatgacacaaggttaagtgacttagtcagattcctttgaaagact

SEQ ID NO: 275087 - DNA, 598 bp, Homo sapiens
cttctctggaacactgggagaatgatccgaggtgtgactccattgagcatatgttaattgaacattccctgtgcgctgggcactgtgccaagacttgcagggacatatccctccaccaattcttgcaaaaggactgggaagtattagattaatatcatgccattttcaagataaggaaatgaggtcagaaaggtcaagtaagttgctcaaagccacagagcgatcagcacagccagattcaaacctgtgcaatggactttctgaattccactttttcacctctgacccacagcagagcaagtgctgagatcataggctctgttagcagctagagaggatttttttttttaaactgtggatccagaagatacattaatgagctgagctcaacatttaaaaataaaatagattacaatagaaaatatcagagtaggggccgggtgtggtggctcatgcctgtaatcccagcactttgggaggccgaggtgggcagatcacgagatcaggagttcgagaccagcctggccaacatggtgaaaccccatctctactataaaatacaaaaattagccaagcatggtggtgtgcacctataatc

SEQ ID NO: 275088 - DNA, 402 bp, Homo sapiens
taggacagggaacccccgtggacggctggccattgagacacagtggagaggaaggagaccatggtgtgaagtctacgaatgagagtgaggaaaaggaagaggtgggaagaagtggtacccaaggataaggctttatggaatctaagcatcccacatttactgtttttaaaaatgagcttgaaaaattagggtgtccgtcctgtgaaatggaatcccacagccacagatctgctaacatttgtttatatttgttgtcaaagaatagcttgatttttttttttttggttattaacataacttaagtggaataaaagtataaaggagcaagcaccatggttttctgtcatctcctctcctcttttcttttttcttttctgagacagagtgttgctctgtcaccca

SEQ ID NO: 275089 - DNA, 184 bp, Homo sapiens
cccacagcccatttcatctggtacctaacaggtcttgtgcagctttctgggtcattaaagattcttctagatccctctgagtagcgagttgatagtcggttgtctggacacgcttatctggccaaatcccctatcattggtttttgtttgtttgtttgttttgagacagagtctcgctctgttg

SEQ ID NO: 275090 - DNA, 510 bp, Homo sapiens
ccttttttgtccttcagatttggagaaggggaaagcagtttctctttgaaaagaagcagcgaatcgtggcttaagcaaaatttgtaatccttaaaactggccaggctctggagctgagttcaatttgacatgtctaaactttcttcttgagtaaccagattttcccttacagtcttttgtcacttaagagaactcataggcaatcgtccatccaaaacaagtctttctccttcagggaggacccatctttggaaactccagctggtttcctgtgcagtgcttatggtgccacctctcgttatatttagaaaaatggtctcacgtaacttgagaaaaaacatttcagtgaccaaagccgggtaccattggaacaccaaggtaatttacttgtttgctcaattggaaaacgctggctctaggataaaacggaatctttgggagagttattttttatggtagttggaagcatccaaaagaagttctaataaaggtatttatgagagaaaaaca

SEQ ID NO: 275091 - DNA, 366 bp, Homo sapiens
tgaagggctaggcagggctttggcggtgtgaggggaggaaaggtggtgagctccggaaaggctgctagagggaaagcaggatgggtcctccgagcccagccccaggagccgggtgtctccgtttccgtcacttcccagcactaggtagggaggtgggtaaaagtaggctgcgttcctcagcccaccccttggctccccgggagcctgaggcggggagcttcgggttaggtgaggtttgggggaggcggagtttgctggtaattgcccatccctcccctccaaaaaaccccacacaacttaaagattttaatattaactgtaaggatgttggttattcaataaataggcacaagttgaaaagtatga

SEQ ID NO: 275092 - DNA, 406 bp, Homo sapiens
acatttaggccgctcgacttggattcacctggattttctgcaacggacatgtatcgataaaatacatggtgcttttaagaaattgccccatcatcatgttgctgttgttgttattgatattgttgtttctgatggatagagatctaggcctgacactccaagcagtgtgaacagcatttaccttgataagcattcttacatcttaactctcgggaattttaaatagaagtgttccgtgtgattaaattaacaggtttagagatgagtgtcctggttatttcctttgttctcctcctggtagctgcctgcactcacagcatgttgggaatggtgattataaatgtaaccatgctctcttcttgtaagtggagagcccaggtacctcttatccagcatgtgaccctct

SEQ ID NO: 275093 - DNA, 445 bp, Homo sapiens
aaaaagttcagttttctgtgaaattaagttagttcctttctaaggttgttggaggattaagtgaattactatttacaacaatatctgacatgagtaagtattccataaatgatagctattattgttgttcattttgagggaagagagagaccctctcatattgttctatactcagaaaaggaaagagaagagaaactaaaggcaggtagcccagtgcctaggaaccacacctgaaaccaggcctaggcctgcctgacctaagcctggtagttaaaattcgacccgtgacttagcaactgatgttatctatagattccatatattgtatggaaagacattgtgaaacctccagttctgttctgtttcgctctgaccactggtgcttgcagcccctgtcatgtaccccctagcttgctcaatcgatcatgaccctctcatgtggatc

SEQ ID NO: 275094 - DNA, 206 bp, Homo sapiens
attggtgtggctgactcaggatgtcagccaactcttggtttgggaatcataggacttattaatggaacccacgctcctcaggactaagatgctgtgatgaaaattcaggcagatgcctaaccctcgtgatccgcccgcctcggcctcccaaagtactgggattacaggcgtgacgacccgtgcccggcctacagtatattcttatg

SEQ ID NO: 275095 - DNA, 386 bp, Homo sapiens
tcttacattttaattagcgctttatctaaaatattgaatctgaaatcacatattttccatctctcttttctttcaaaaatataatttattttaaaatctaagtcaaacattggtctttgacttatcaattggccttcattattactaatgaaaatatattgaccagccttgcatgctgagagaaaattagaatgtaaagggattaaaagtcagtgcatgtcacttccttggtccagaaccttttttagcatattaaaaaattttttttaatttttaatttttgtgggtatatagtaggtgtatatatttacagggcagggtccagaatctttaaaaccactggaatattctgagatcgggttgcctatcaaaatatatatgcatca

SEQ ID NO: 275096 - DNA, 385 bp, Homo sapiens
tctcctttctctctctttcgcttccccctcttgcctttttcctttctcccccctccccttttctccctcagttaagatgctacttcttccatgacaaatgatgctataggaggaagtcatttctttctctgcgtttgctttgaacctctcctattgctttgtcttttttttcttaccatggattaaaatatctgtgtacatgttttctgttgaattaggagcatctaattcagtgttagacacggttctacgtgttagcagtatcatctggaataagacagcctctgttcttggggagggagggtccttgtctttttcattcttggaactttttagaggtgatttgacaaataaataaatgtctatttaaaagttactaaaaaaa

SEQ ID NO: 275097 - DNA, 459 bp, Homo sapiens
tatatggtacttttcaagtctagaatttctatttctatttggttcttgtttagagtttccacttctttgctgtgattttccctctattcattcattataaacatttttgttctttaagtccttgagcatatttataaagtctgctttaaattccctgtgctaattctaacatctttgacatgagtggttctattgcacttcccctgagaattgggacaaggatgcccatttttaccacttctattcaacatagtactggaagtcctggccagagcaaccagacaagaggaagaaataaagggcatccagattgaaaaagaggaagtcaaactttcactattcactgatgatatgactgtatacctagaaaactctaaagacttatccaaaaagctcctagatctgataaacaaatccagtagagcctcaggatacaaaatcaatgtgattttttgtaaa

SEQ ID NO: 275098 - DNA, 162 bp, Homo sapiens
caactcttggcctcaagcactcctcctctcttagcctcccaaagtgctaagattataggctgggaggcacccaaaaccctgtcaatttacatcaagggtaatgagaatgtccattcaccatgtctcacagtaatcttacttctggggagataattcaatcta

SEQ ID NO: 275099 - DNA, 323 bp, Homo sapiens
gttcttaggagatctgaccattttaaagtgtgtggcacctccccctgccccagccctttgcttgtacctgctttcaccatgtgacatgcctgtcccccattttgcctttgtccatgagtaaaagctcactaaggcctccccagaggcaaagcagatgccagcaccatgctttctgtaaagtttgcagtacgatgagtcaattaaacttctttcctttataaattaccagtctgagctatttatttatagcaatacaagaatgacttaacacagatactaagggactactatgaacaattctacctacataaatttgacaacat

SEQ ID NO: 275100 - DNA, 344 bp, Homo sapiens
ccaaagccctgggaacttcagctcttccttcctgcctattggcatttctgttacactccgctagataatagaaagccaggagcagaagcttgagaaacatttaagaatcactcaagcagatctttggactccaggcaagactcaactaaatcatccaagaagagtcaccgttatagcagcaggtgaactcaggagtggtttcgaaacccgggagtggaataatggcctcttgggccctttccccactttcccacacctaagttaagggaaagccccagcccaggctctcaggagacagtaataaccaccaagggccatattccctcctcattagcctaccagat

SEQ ID NO: 275101 - DNA, 181 bp, Homo sapiens
tgtgaattctttaataattatataacctacaaagatctttcagtgaagacttaatttttgactcattttattgtgccttttgttgaatagagtttcttaattttaagttactcaaatttattattttattttatggcttctgctttttgtgtcttgttaaataaatccttactttgagtac

SEQ ID NO: 275102 - DNA, 230 bp, Homo sapiens
cgacctcctgcaggtccccgccagtgtgaagatcccagttccaggttgggtccgggggtcccagtctctgccctctccagcctgggaccctctcttgggcccctgttcccccctaaatatcactgaggccctccctcaaagcagcgaggcccggggtgatgtcagccaaggaaagcccccgtgagaggactgtggccgcgttttacagatgagaatgccggggcccagag

SEQ ID NO: 275103 - DNA, 311 bp, Homo sapiens
aagctcccagccagaagtaatatttctactcgtagagttccttatcactgggtgttcacattttcttatttttgtctctcattttatatagtgattatttggtatgtattttatacattttatttacattagaatatggttttgttcaatgtccattctttaaccaacaccacattgtcttgattactagtagctttatagtaagtcttttttatttatttatttattttttgagacagagtctcgctctgtcactgggctggagtgcagtggcaccatcttggttcactgcaaccaacctctgcctcccg

SEQ ID NO: 275104 - DNA, 816 bp, Homo sapiens
gctggagtgcattggcactatcttggctcactgcaacctccacctcccgggttcaagctattgtctgcctcagcctccagtagctgggattccaggtgcatgccaccacgcccagctaattttgtatttttagtagagacggggttttaccatgttggccaggctggtctttaactcttgacctccaataatccacccacttcagcctcccaaagtcctgggattataggcatgagccagtatgcccagctgttacttttttttaagccattgggaaaagtgttttaagttacatcttgtttgctgatatataaactacaagttttctgttttgactttgtattcacaatctttctaaacttaattaattctaatttatctatttctatctacataatatctgtgaatgagttttcttttagaatcttacagcttttttgttcttacaatattgcatttctaagattgccagtctagtacagtgttgaataaaagcaatggtagggggcatatttgtttcattgctgataataggtaaagttttcaacattttactattaaatataaggtttatagtttctttgtagataaatttctaatattaaggaagttcctctgtctattcctaggtttctaggaagctctcaaacatcttgaacagatactcagattttataaaaagtctttcttctatctttggagatgattttgatttttctttattgttaatatggcggttacattgttctttgaatgttaaagcaatctagcctccctgaactaaataaaccaaacccaatttggtcttgaagtttt

SEQ ID NO: 275105 - DNA, 427 bp, Homo sapiens
agagtgactctagattatcccgagtgtcttcaagaatctattgcttttttgttcttacaatattgcatttctaagattgccagtctagtacagtgttgaataaaagcaatggtagggggcatatttgtttcattgctgataataggtaaagttttcaacattttactattaaatataaggtttatagtttctttgtagataaatttctaatattaaggaagttcctctgtctattcctaggtttctaggaagctctcaaacatcttgaacagatactcagattttataaaaagtctttcttctatctttggagatgattttgatttttctttattgttaatatggcggttacattgttctttgaatgttaaagcaatctagcctccctgaactaaataaaccaaacccaatttggtcttgaagtttt

SEQ ID NO: 275106 - DNA, 521 bp, Homo sapiens
gaaatatattcacagagaagagggcaccaagaattaacaacctgaccagcacacacagtctatcagaaatacagaaaatcaccacaatgcagttgccaacaaaggaccaaagtaagtctgttcaattcaataataatgttactttatgataaagattattttgaatatttctaggacaaaaagatcataaggaaagggaattcactggaacagcttctaaaacaagaatccacccgatttttcaagtgctaaagctgtctatactttatgtcaacaaatacaaacattcagttatataactctattttccattttttaaactatttttaatatacccatcaccattatcacaaaattagcaaaatcattataaatttatctttccctctataatctagcttctttcaaatatacgaatatgaagggcggggtgagggggattccaaactcattaaataagtcatattggggccaggcatggtggctcatgcctgtaatcccagcactttgggaggacaagg

SEQ ID NO: 275107 - DNA, 542 bp, Homo sapiens
ttttgttagacgtaagaaactgcccactgacagaactttttcttgtttctaaatttaaccatttaagttgctaattcttctttccctctttgaggtgaacccagggcagcaagcaacagtgtgatcttctactcaccaaatccagaagtaagaccagggcagtccagtcaaggctgcccaacacctgccatttccatatggttcaccccactgctgaatttcccacatggctggaccagagacatgtatgggcactttggtttggacaaaccacacaccaaagcaaatgcatactgacatacatttaatttgagcatgttctgaatgttgtctgacaccatgaaatactgttcttccagggaggtcaaggaaacggctgtagcaaatgcaaggaaagggcttcccattgccctccttagagagaacaggaggcactgataactcccagcaacaagacactgtctacaagggattatttcctctgtgatatcctagcactgcaccacagaggttaacttctgaagcagtataagaggaagtag

SEQ ID NO: 275108 - DNA, 623 bp, Homo sapiens
catgagctgctcgctctgacttagagccctgcccttgcacggtgtacttgaacctccaagctaatattctgcttttccacgtgccccattcaggtttagccactcagctgtgcaaaatcttattcccaatttagggtcaccatgtgctctgacctctacctggagtgctttgcccctgcccttagctcagtgtcacatatgccctcttgtctctcttagcactccgatgttttctctgttacctgcctcccctagagaagccaacttgccctgagatgaaggaccccacctgtcatggccatggcagtagccttggtgcttagagcacagcctggcacatggtggtgctcaataaatagctggcaagagagtcactaaagaacgaggaacagagaaaatggcacaggcgtggggagtaaaaatgatgcatctgattgcgcttgaagtgcctgtgggatgcctggtctcaggcttagaaaggtctgagctgacctcacaccgtggctcatgtctgtaatcccagcactttgggagactgaggcaggcagatcacttgaggttaggagctcgagaccagcctggccgacatagtgaaaccttgtctctaccaaaaatacaaaaaa

SEQ ID NO: 275109 - DNA, 5668 bp, Homo sapiens
atacatgttcaatttgatgtttataccgagtccaccaccacacgtgaaatttaataggggtaaataatctcgaccacctctaaaggggtgggtgataaaagctttctgtgatctcaccggctcaagtgtcctctttaatctgaattcatctggagaataactgccctatgatgttcttataaaattacttgtttcctgtgcttagaacttgtctctgggtagagtgtacgcgtctcaagggcaaagactcagtcttgttcgttgacttcacacactgccagcaaataatgtgaatcaatagacctttaacggatgaagaaaaattagcagtttgggagaaggtccttgaaggtagcaaagcgaaaagaagaagggggcgcttgcgcataaacagctgcttctgagaacgaaaactacgtagcatttccgagtcccggtggccgctcaggctgccctttaaagagacgtgtaggaagcccaccctggggcggccgtgggcggagccgcgacctgaacgccgggagacctcaccaggcggaggcggtgtctacctcaccaggcggaggcggtgtctgcctcgcgctgtcctctgaccgccagggggagccctgccgcgcgctgcgctccgggccgcgccgccacgctctctcgacccgcgcgcccgccgcgcaccacccgtcgccacgcccgccgcaggccaagggccagtcacttgcgggccggcgtcccgcagcccattcgcgccccgcccctgccccgccgcgggatgagtaacggttacgaagcactttctcggctacgatttctgcttagtcattgtcttccaggaaacagctccctcagtttggaatcagctctcccgctgcggccgcagtagccggagccggagccgcagccaccggtgccttcctttcccgccgccgcccagccgccgtccggcctccctcgggcccgagcgcagaccaggctccagccgcgcggcgccggcagcctcgcgctccctctcgggtctctctcgggcctcgggcaccgcgtcctgtggggcggccgcctgcctgcccgcccgcccgcagccccttcgctgcgcggcccctgggcggccgctgccatgggcaccgacagccgcgcggccaaggcgctcctggcgcgggcccgcaccctgcacctgcagacggggaacctgctgaactggggccgcctgcggaagaagtgcccgtccacgcacagcgaggagcttcatgattgtatccaaaaaaccttgaatgaatggagttcccaaatcaacccagatttggtcagggagtttccagatgtcttggaatgcactgtatctcatgcagtagaaaagataaatcctgatgaaagagaagaaatgaaagtttctgcaaaactgttcattgtagaatcaaactcttcatcatcaactagaagtgcagttgacatggcctgttcagtccttggagttgcacagctggattctgtgatcattgcttcacctcctattgaagatggagttaatctttccttggagcatttacagccttactgggaggaattagaaaacttagttcagagcaaaaagattgttgccataggtacctctgatctagacaaaacacagttggaacagctgtatcagtgggcacaggtaaaaccaaatagtaaccaagttaatcttgcctcctgctgtgtgatgccaccagatttgactgcatttgctaaacaatttgacatacagctgttgactcacaatgatccaaaagaactgctttctgaagcaagtttccaagaagctcttcaggaaagcattcctgacattcaagcgcacgagtgggtgccgctgtggctactgcggtattcggtcattgtgaaaagtagaggaattatcaaatcaaaaggctacattttacaagctaaaagaaggggttcttaactgacttaggagcataacttacctgtaatttccttcaatatgagagaaaattgagatgtgtaaaaatctagttactgcctgtaaatggtgtcattgaggcagatattctttcgtcatatttgacagtatgttgtctgtcaagttttaaatacttatcttgcctccatatcaatccattctcatgaacctctgtattgctttccttaaactattgttttctaattgaaattgtctataaagaaaatacttgcaatatatttttcctttatttttatgactaatataaatcaagaaaatttgttgttagatatattttggcctaggtatcagggtaatgtatatacatattttttatttccaaaaaaaattcattaattgcttcttaactcttattataaccaagcaatttaattacaattgttaaaactgaaatactggaagaagatatttttcctgtcattgatgagatatatcagagtaactggagtagctgggatttactagtagtgtaaataaaattcactcttcaatacatgaatggaaacttaaatttttttttatgtgtccttgcttatagtttagctgtaataatttaaccttgtattcttgtgccatattctgtctttttattacttataaagacaaaccaaagtaaatctgaaaggagactagaagctttgaaattattgttgggggttttataaaagcaactactgtcacctccatccagattcttttaaattattgatccatccatagtatatattgctactcattcaagaatcctcaataagtattgagtatttaccatatgttgggatactgtgggctctggagagaggagggggcaatagagctaggaattaagaatcagttgagtaaaatgtgtaatatttattccccattaataactgactaggaaggactaaaagccagaaaggggatgaaaaaaaaatccttaattcagggccgacattatctacttaaacaactttgagatatggtcttaattattttaaagcagaataatataattgaaagtttatagctaaaagagactatataggtcatttagtataattcttcattagtttacgaaccacaaaattgcaaataaataagctatgaactttgatgtacactataaatctccttaattctataaatttgtgtctgtaacctgaatagtttgaaaacttctttaaaaatctcttgtatttcatccgggcgcagtggctcacacctgtaatcccagcactttgggaggccgaggtgggcagatcacgaggtcaggagtttgagaccagcctgaccaacatggtaaaaccccatctctactaaaatacaaaaattggctgggcgtggtggcactcgcctgtaatctcagctacttgggaggctgaggcaggagaatcgcttgaacccgggaggcggaggttacagtgagccgagatcacatcactgcactccagcctgggcgacagagcgagactccatctcaaaaaaaaaaaaaaactcttgtatctcaatatttttaaaccacaggcctaaataaaactaattttgctcaagttttctcaacctagggaaaaagaactatggttccatattcaaaataaatattatagacccttttcctaagtaggattttgtggtttactgattgggtaatttgatcattaaaattatgtgaaatctgcccgggcacacctcatgcctgtaatcccagcactctgggaggccaaggcagatgatcacctgaggtcaggagttctagaccagcctggctaacatggtgaaaccctgtatctgctaaaaatacaaaaattagccaggcgtggtggcgggctcctgtaatcccagctactttggaggcgaggcacgagaatcgcttgaacctgggaggcggagtttgcagtgagccgagatcacgccattgcactccagcctgggcgacagagcgagactgcgtctcaaaaaaaaaaaaaaaagaaaaattatgtgaaatcatgtgatttgcctgggaaaacttgtttagatattgagctacttatgccttctagcctttatattaattgtatgtaatgttattaaatatatatatagttcatctttacatttggaaatgcccaacatttttttcatataagtccttaaacaagcgttcattttattttaaatctatacagtgaactggccaagatattttaagagggaactttaatatcccatttattgtttttataaccctggacttataaaaatgggttgtttgaagggttattttgaaagtgggggaaaaaaaaacttagttgctaatgtatctaaacttcagcagagctttttggtgatctcctacctgcaccctcaactcttgacaaagaagcaagactatagattcattttctgaaggggatcatgtatggaatttttgatgagtttttacttttacctctctactcttgattttctattattgaatactcttttttttttcatgaactatcagaatatagtgaacacttttcaaatatttaaggacttaatgtttaaaaagccataaaatagagagtggtaatactaccaaataattacttaaaactgaaagctaagttatcaatagtttatataagagatgttttctgaggagatgtgcatccagtgagaccaaggtagaaagtttatataattgttttttttccagtaaatatgaaaaaaaaagctgtagcttgtttattacatgtccaaaatacagtggagccttactttaacacaatgtactgtaacttggaatttgttctgttatgagtctatcttgaattcccatccatgaaactgtagtcaccaaaagcaacaagtattttcacatgatgtaaaagaccatactatgatggccattgctagaaattgaatcacaaataatagctaataatttttcatttttcaaaaaagatcatttggatagcagctatgtataaaatggaaaataaaaaattattctattttgcatgaatagttcagactttcccataccacagccaagcagtaactaaaattaggatcttaattttcaatgataaaaggtctaaggttcatttaattatgctcctttaacactgtctttctagatttttcacccagtattttcaaaatttgggaatgtaaacaattgatatatttattgtatgttggctagcagttcatccttctgcaaaatatgcattcagagaaatgtgaagcttgttttaatgaagacttaaaccatttgtgtcatttgtgttttcatattcaaatacaccaaattaaaattctgaacctatatttttcatcattaacttcctaatataccagaacatatacctttttcatgtaaagttggcaatgggatatggcagttttatttttgaaaaatatgtaacatgactttaatatttttatagttttcagaattagaaacataggaagggaaaatgttttaattagataagtcaactttttatgtgtctgtagtggtgtactataatagcaaattataaagcattattaaatgtttataataatttttaatattacctacattatgaatttaactaaaataaagtgtgagttgtatattttttaattgggttgtttcaatagctggaagcatcctgaagcattatattgatttttgaactatttgaactcaaactgagtatgatttgaaaataaattaataatttaaaaacatccaaa

SEQ ID NO: 275110 - DNA, 5682 bp, Homo sapiens
atacatgttcaatttgatgtttataccgagtccaccaccacacgtgaaatttaataggggtaaataatctcgaccacctctaaaggggtgggtgataaaagctttctgtgatctcaccggctcaagtgtcctctttaatctgaattcatctggagaataactgccctatgatgttcttataaaattacttgtttcctgtgcttagaacttgtctctgggtagagtgtacgcgtctcaagggcaaagactcagtcttgttcgttgacttcacacactgccagcaaataatgtgaatcaatagacctttaacggatgaagaaaaattagcagtttgggagaaggtccttgaaggtagcaaagcgaaaagaagaagggggcgcttgcgcataaacagctgcttctgagaacgaaaactacgtagcatttccgagtcccggtggccgctcaggctgccctttaaagagacgtgtaggaagcccaccctggggcggccgtgggcggagccgcgacctgaacgccgggagacctcaccaggcggaggcggtgtctacctcaccaggcggaggcggtgtctgcctcgcgctgtcctctgaccgccagggggagccctgccgcgcgctgcgctccgggccgcgccgccacgctctctcgacccgcgcgcccgccgcgcaccacccgtcgccacgcccgccgcaggccaagggccagtcacttgcgggccggcgtcccgcagcccattcgcgccccgcccctgccccgccgcgggatgagtaacggttacgaagcactttctcggctacgatttctgcttagtcattgtcttccaggaaacagctccctcagtttggaatcagctctcccgctgcggccgcagtagccggagccggagccgcagccaccggtgccttcctttcccgccgccgcccagccgccgtccggcctccctcgggcccgagcgcagaccaggctccagccgcgcggcgccggcagcctcgcgctccctctcgggtctctctcgggcctcgggcaccgcgtcctgtggggcggccgcctgcctgcccgcccgcccgcagccccttcgctgcgcggcccctgggcggccgctgccatgggcaccgacagccgcgcggccaaggcgctcctggcgcgggcccgcaccctgcacctgcagacggggaacctgctgaactggggccgcctgcggaagaagtgcccgtccacgcacagcgaggagcttcatgattgtatccaaaaaaccttgaatgaatggagttcccaaatcaacccagatttggtcagggagtttccagatgtcttggaatgcactgtatctcatgcagtagaaaagataaatcctgatgaaagagaagaaatgaaagtttctgcaaaactgttcattgtagaatcaaactcttcatcatcaactagaagtgcagttgacatggcctgttcagtccttggagttgcacagctggattctgtgatcattgcttcacctcctattgaagatggagttaatctttccttggagcatttacagccttactgggaggaattagaaaacttagttcagagcaaaaagattgttgccataggtacctctgatctagacaaaacacagttggaacagctgtatcagtgggcacaggtaaaaccaaatagtaaccaagttaatcttgcctcctgctgtgtgatgccaccagatttgactgcatttgctaaacaatttgacatacagctgttgactcacaatgatccaaaagaactgctttctgaagcaagtttccaagaagctcttcaggaaagcattcctgacattcaagcgcacgagtgggtgccgctgtggctactgcggtattcggtcattgtgaaaagtagaggaattatcaaatcaaaaggctacattttacaagctaaaagaaggggttcttaactgacttaggagcataacttacctgtaatttccttcaatatgagagaaaattgagatgtgtaaaaatctagttactgcctgtaaatggtgtcattgaggcagatattctttcgtcatatttgacagtatgttgtctgtcaagttttaaatacttatcttgcctccatatcaatccattctcatgaacctctgtattgctttccttaaactattgttttctaattgaaattgtctataaagaaaatacttgcaatatatttttcctttatttttatgactaatataaatcaagaaaatttgttgttagatatattttggcctaggtatcagggtaatgtatatacatattttttatttccaaaaaaaattcattaattgcttcttaactcttattataaccaagcaatttaattacaattgttaaaactgaaatactggaagaagatatttttcctgtcattgatgagatatatcagagtaactggagtagctgggatttactagtagtgtaaataaaattcactcttcaatacatgaatggaaacttaaatttttttttatgtgtccttgcttatagtttagctgtaataatttaaccttgtattcttgtgccatattctgtctttttattacttataaagacaaaccaaagtaaatctgaaaggagactagaagctttgaaattattgttgggggttttataaaagcaactactgtcacctccatccagattcttttaaattattgatccatccatagtatatattgcatatgttgggatactgtgggctctggagagaggagggggcaatagagctaggaattaagaatcagttgagtaaaatgtgtaatatttattccccattaataactgactaggaaggactaaaagccagaaaggggatgaaaaaaaaatccttaattcagggccgacattatctacttaaacaactttgagatatggtcttaattattttaaagcagaataatataattgaaagtttatagctaaaagagactatataggtcatttagtataattcttcattagtttacgaaccacaaaattgcaaataaataagctatgaactttgatgtacactataaatctccttaattctataaatttgtgtctgtaacctgaatagtttgaaaacttctttaaaaatctcttgtatttcatccgggcgcagtggctcacacctgtaatcccagcactttgggaggccgaggtgggcagatcacgaggtcaggagtttgagaccagcctgaccaacatggtaaaaccccatctctactaaaatacaaaaattggctgggcgtggtggcactcgcctgtaatctcagctacttgggaggctgaggcaggagaatcgcttgaacccgggaggcggaggttacagtgagccgagatcacatcactgcactccagcctgggcgacagagcgagactccatctcaaaaaaaaaaaaaaactcttgtatctcaatatttttaaaccacaggcctaaataaaactaattttgctcaagttttctcaacctagggaaaaagaactatggttccatattcaaaataaatattatagacccttttcctaagtaggattttgtggtttactgattgggtaatttgatcattaaaattatgtgaaatctgcccgggcacacctcatgcctgtaatcccagcactctgggaggccaaggcagatgatcacctgaggtcaggagttctagaccagcctggctaacatggtgaaaccctgtatctgctaaaaatacaaaaattagccaggcgtggtggcgggctcctgtaatcccagctactttggaggcgaggcacgagaatcgcttgaacctgggaggcggagtttgcagtgagccgagatcacgccattgcactccagcctgggcgacagagcgagactgcgtctcaaaaaaaaaaaaaaaagaaaaattatgtgaaatcatgtgatttgcctgggaaaacttgtttagatattgagctacttatgccttctagcctttatattaattgtatgtaatgttattaaatatatatatagttcatctttacatttggaaatgcccaacatttttttcatataagtccttaaacaagcgttcattttattttaaatctatacagtgaactggccaagatattttaagagggaactttaatatcccatttattgtttttataaccctggacttataaaaatgggttgtttgaagggttattttgaaagtgggggaaaaaaaaacttagttgctaatgtatctaaacttcagcagagctttttggtgatctcctacctgcaccctcaactcttgacaaagaagcaagactatagattcattttctgaaggggatcatgtatggaatttttgatgagtttttacttttacctctctactcttgattttctattattgaatactcttttaaaacactgatttttaaggctttatatatgttttccaggctgatgttcacatctttttttcatgaactatcagaatatagtgaacacttttcaaatatttaaggacttaatgtttaaaaagccataaaatagagagtggtaatactaccaaataattacttaaaactgaaagctaagttatcaatagtttatataagagatgttttctgaggagatgtgcatccagtgagaccaaggtagaaagtttatataattgttttttttccagtaaatatgaaaaaaaaagctgtagcttgtttattacatgtccaaaatacagtggagccttactttaacacaatgtactgtaacttggaatttgttctgttatgagtctatcttgaattcccatccatgaaactgtagtcaccaaaagcaacaagtattttcacatgatgtaaaagaccatactatgatggccattgctagaaattgaatcacaaataatagctaataatttttcatttttcaaaaaagatcatttggatagcagctatgtataaaatggaaaataaaaaattattctattttgcatgaatagttcagactttcccataccacagccaagcagtaactaaaattaggatcttaattttcaatgataaaaggtctaaggttcatttaattatgctcctttaacactgtctttctagatttttcacccagtattttcaaaatttgggaatgtaaacaattgatatatttattgtatgttggctagcagttcatccttctgcaaaatatgcattcagagaaatgtgaagcttgttttaatgaagacttaaaccatttgtgtcatttgtgttttcatattcaaatacaccaaattaaaattctgaacctatatttttcatcattaacttcctaatataccagaacatatacctttttcatgtaaagttggcaatgggatatggcagttttatttttgaaaaatatgtaacatgactttaatatttttatagttttcagaattagaaacataggaagggaaaatgttttaattagataagtcaactttttatgtgtctgtagtggtgtactataatagcaaattataaagcattattaaatgtttataataatttttaatattacctacattatgaatttaactaaaataaagtgtgagttgtatattttttaattgggttgtttcaatagctggaagcatcctgaagcattatattgatttttgaactatttgaactcaaactgagtatgatttgaaaataaattaataatttaaaaacatccaaa

SEQ ID NO: 275111 - DNA, 4186 bp, Homo sapiens
tgggcaagctaaaagaaggggttcttaactgacttaggagcataacttacctgtaaaatgtacctctgatctagacaaaacacagttggaacagctgtatcagtgggcacaggtaaaaccaaatagtaaccaagttaatcttgcctcctgctgtgtgatgccaccagatttgactgcatttgctaaacaatttgacatacagctgttgactcacaatgatccaaaagaactgctttctgaagcaagtttccaagaagctcttcaggaaagcattcctgacattcaagcgcacgagtgggtgccgctgtggctactgcggtattcggtcattgtgaaaagtagaggaattatcaaatcaaaaggctacattttacaagctaaaagaaggggttcttaactgacttaggagcataacttacctgtaatttccttcaatatgagagaaaattgagatgtgtaaaaatctagttactgcctgtaaatggtgtcattgaggcagatattctttcgtcatatttgacagtatgttgtctgtcaagttttaaatacttatcttgcctccatatcaatccattctcatgaacctctgtattgctttccttaaactattgttttctaattgaaattgtctataaagaaaatacttgcaatatatttttcctttatttttatgactaatataaatcaagaaaatttgttgttagatatattttggcctaggtatcagggtaatgtatatacatattttttatttccaaaaaaaattcattaattgcttcttaactcttattataaccaagcaatttaattacaattgttaaaactgaaatactggaagaagatatttttcctgtcattgatgagatatatcagagtaactggagtagctgggatttactagtagtgtaaataaaattcactcttcaatacatgaatggaaacttaaatttttttttatgtgtccttgcttatagtttagctgtaataatttaaccttgtattcttgtgccatattctgtctttttattacttataaagacaaaccaaagtaaatctgaaaggagactagaagctttgaaattattgttgggggttttataaaagcaactactgtcacctccatccagattcttttaaattattgatccatccatagtatatattgctactcattcaagaatcctcaataagtattgagtatttaccatatgttgggatactgtgggctctggagagaggagggggcaatagagctaggaattaagaatcagttgagtaaaatgtgtaatatttattccccattaataactgactaggaaggactaaaagccagaaaggggatgaaaaaaaaatccttaattcagggccgacattatctacttaaacaactttgagatatggtcttaattattttaaagcagaataatataattgaaagtttatagctaaaagagactatataggtcatttagtataattcttcattagtttacgaaccacaaaattgcaaataaataagctatgaactttgatgtacactataaatctccttaattctataaatttgtgtctgtaacctgaatagtttgaaaacttctttaaaaatctcttgtatttcatccgggcgcagtggctcacacctgtaatcccagcactttgggaggccgaggtgggcagatcacgaggtcaggagtttgagaccagcctgaccaacatggtaaaaccccatctctactaaaatacaaaaattggctgggcgtggtggcactcgcctgtaatctcagctacttgggaggctgaggcaggagaatcgcttgaacccgggaggcggaggttacagtgagccgagatcacatcactgcactccagcctgggcgacagagcgagactccatctcaaaaaaaaaaaaaaactcttgtatctcaatatttttaaaccacaggcctaaataaaactaattttgctcaagttttctcaacctagggaaaaagaactatggttccatattcaaaataaatattatagacccttttcctaagtaggattttgtggtttactgattgggtaatttgatcattaaaattatgtgaaatctgcccgggcacacctcatgcctgtaatcccagcactctgggaggccaaggcagatgatcacctgaggtcaggagttctagaccagcctggctaacatggtgaaaccctgtatctgctaaaaatacaaaaattagccaggcgtggtggcgggctcctgtaatcccagctactttggaggcgaggcacgagaatcgcttgaacctgggaggcggagtttgcagtgagccgagatcacgccattgcactccagcctgggcgacagagcgagactgcgtctcaaaaaaaaaaaaaaaagaaaaattatgtgaaatcatgtgatttgcctgggaaaacttgtttagatattgagctacttatgccttctagcctttatattaattgtatgtaatgttattaaatatatatatagttcatctttacatttggaaatgcccaacatttttttcatataagtccttaaacaagcgttcattttattttaaatctatacagtgaactggccaagatattttaagagggaactttaatatcccatttattgtttttataaccctggacttataaaaatgggttgtttgaagggttattttgaaagtgggggaaaaaaaaacttagttgctaatgtatctaaacttcagcagagctttttggtgatctcctacctgcaccctcaactcttgacaaagaagcaagactatagattcattttctgaaggggatcatgtatggaatttttgatgagtttttacttttacctctctactcttgattttctattattgaatactcttttaaaacactgatttttaaggctttatatatgttttccaggctgatgttcacatctttttttcatgaactatcagaatatagtgaacacttttcaaatatttaaggacttaatgtttaaaaagccataaaatagagagtggtaatactaccaaataattacttaaaactgaaagctaagttatcaatagtttatataagagatgttttctgaggagatgtgcatccagtgagaccaaggtagaaagtttatataattgttttttttccagtaaatatgaaaaaaaaagctgtagcttgtttattacatgtccaaaatacagtggagccttactttaacacaatgtactgtaacttggaatttgttctgttatgagtctatcttgaattcccatccatgaaactgtagtcaccaaaagcaacaagtattttcacatgatgtaaaagaccatactatgatggccattgctagaaattgaatcacaaataatagctaataatttttcatttttcaaaaaagatcatttggatagcagctatgtataaaatggaaaataaaaaattattctattttgcatgaatagttcagactttcccataccacagccaagcagtaactaaaattaggatcttaattttcaatgataaaaggtctaaggttcatttaattatgctcctttaacactgtctttctagatttttcacccagtattttcaaaatttgggaatgtaaacaattgatatatttattgtatgttggctagcagttcatccttctgcaaaatatgcattcagagaaatgtgaagcttgttttaatgaagacttaaaccatttgtgtcatttgtgttttcatattcaaatacaccaaattaaaattctgaacctatatttttcatcattaacttcctaatataccagaacatatacctttttcatgtaaagttggcaatgggatatggcagttttatttttgaaaaatatgtaacatgactttaatatttttatagttttcagaattagaaacataggaagggaaaatgttttaattagataagtcaactttttatgtgtctgtagtggtgtactataatagcaaattataaagcattattaaatgtttataataatttttaatattacctacattatgaatttaactaaaataaagtgtgagttgtatattttttaattgggttgtttcaatagctggaagcatcctgaagcattatattgatttttgaactatttgaactcaaactgagtatgatttgaaaataaattaataatttaaaaacatccaaa

SEQ ID NO: 275112 - DNA, 2902 bp, Homo sapiens
tgttctacaacctattgaatgtccaatattaggagaaaactcaacggatccgaggagttgtttattctatcttaattcagggccgacattatctacttaaacaactttgagatatggtcttaattattttaaagcagaataatataattgaaagtttatagctaaaagagactatataggtcatttagtataattcttcattagtttacgaaccacaaaattgcaaataaataagctatgaactttgatgtacactataaatctccttaattctataaatttgtgtctgtaacctgaatagtttgaaaacttctttaaaaatctcttgtatttcatccgggcgcagtggctcacacctgtaatcccagcactttgggaggccgaggtgggcagatcacgaggtcaggagtttgagaccagcctgaccaacatggtaaaaccccatctctactaaaatacaaaaattggctgggcgtggtggcactcgcctgtaatctcagctacttgggaggctgaggcaggagaatcgcttgaacccgggaggcggaggttacagtgagccgagatcacatcactgcactccagcctgggcgacagagcgagactccatctcaaaaaaaaaaaaaaactcttgtatctcaatatttttaaaccacaggcctaaataaaactaattttgctcaagttttctcaacctagggaaaaagaactatggttccatattcaaaataaatattatagacccttttcctaagtaggattttgtggtttactgattgggtaatttgatcattaaaattatgtgaaatctgcccgggcacacctcatgcctgtaatcccagcactctgggaggccaaggcagatgatcacctgaggtcaggagttctagaccagcctggctaacatggtgaaaccctgtatctgctaaaaatacaaaaattagccaggcgtggtggcgggctcctgtaatcccagctactttggaggcgaggcacgagaatcgcttgaacctgggaggcggagtttgcagtgagccgagatcacgccattgcactccagcctgggcgacagagcgagactgcgtctcaaaaaaaaaaaaaaaagaaaaattatgtgaaatcatgtgatttgcctgggaaaacttgtttagatattgagctacttatgccttctagcctttatattaattgtatgtaatgttattaaatatatatatagttcatctttacatttggaaatgcccaacatttttttcatataagtccttaaacaagcgttcattttattttaaatctatacagtgaactggccaagatattttaagagggaactttaatatcccatttattgtttttataaccctggacttataaaaatgggttgtttgaagggttattttgaaagtgggggaaaaaaaaacttagttgctaatgtatctaaacttcagcagagctttttggtgatctcctacctgcaccctcaactcttgacaaagaagcaagactatagattcattttctgaaggggatcatgtatggaatttttgatgagtttttacttttacctctctactcttgattttctattattgaatactcttttaaaacactgatttttaaggctttatatatgttttccaggctgatgttcacatctttttttcatgaactatcagaatatagtgaacacttttcaaatatttaaggacttaatgtttaaaaagccataaaatagagagtggtaatactaccaaataattacttaaaactgaaagctaagttatcaatagtttatataagagatgttttctgaggagatgtgcatccagtgagaccaaggtagaaagtttatataattgttttttttccagtaaatatgaaaaaaaaagctgtagcttgtttattacatgtccaaaatacagtggagccttactttaacacaatgtactgtaacttggaatttgttctgttatgagtctatcttgaattcccatccatgaaactgtagtcaccaaaagcaacaagtattttcacatgatgtaaaagaccatactatgatggccattgctagaaattgaatcacaaataatagctaataatttttcatttttcaaaaaagatcatttggatagcagctatgtataaaatggaaaataaaaaattattctattttgcatgaatagttcagactttcccataccacagccaagcagtaactaaaattaggatcttaattttcaatgataaaaggtctaaggttcatttaattatgctcctttaacactgtctttctagatttttcacccagtattttcaaaatttgggaatgtaaacaattgatatatttattgtatgttggctagcagttcatccttctgcaaaatatgcattcagagaaatgtgaagcttgttttaatgaagacttaaaccatttgtgtcatttgtgttttcatattcaaatacaccaaattaaaattctgaacctatatttttcatcattaacttcctaatataccagaacatatacctttttcatgtaaagttggcaatgggatatggcagttttatttttgaaaaatatgtaacatgactttaatatttttatagttttcagaattagaaacataggaagggaaaatgttttaattagataagtcaactttttatgtgtctgtagtggtgtactataatagcaaattataaagcattattaaatgtttataataatttttaatattacctacattatgaatttaactaaaataaagtgtgagttgtatattttttaattgggttgtttcaatagctggaagcatcctgaagcattatattgatttttgaactatttgaactcaaactgagtatgatttgaaaataaattaataatttaaaaacatccaaa

SEQ ID NO: 275113 - DNA, 414 bp, Homo sapiens
atgtgtatccaaatgtagtaatcagttttgttttctttgttacccagcaaaactgttcattgtagaatcaaactcttcatcatcaactagaagtgcagttgacatgggtaagcaaaaactgaattttttatcttaatagtggactttaaattagtataggtgtattagttataacttgtgcttaggtccaggtaaaaagaaaatgagttgattccaattttaccttttaaagttctagcttagtttcttaaggcttctgtaaaatcatactgacttatgtagggtcatattttgatatgcaagaggaatgtaaaaggtgtaatgtacttaaatgttcactatccgtttggagatagaagttcttattcttagcccttttagtactagaggtgaaatatcaaaaccaaacaacgg

SEQ ID NO: 275114 - DNA, 5722 bp, Homo sapiens
atacatgttcaatttgatgtttataccgagtccaccaccacacgtgaaatttaataggggtaaataatctcgaccacctctaaaggggtgggtgataaaagctttctgtgatctcaccggctcaagtgtcctctttaatctgaattcatctggagaataactgccctatgatgttcttataaaattacttgtttcctgtgcttagaacttgtctctgggtagagtgtacgcgtctcaagggcaaagactcagtcttgttcgttgacttcacacactgccagcaaataatgtgaatcaatagacctttaacggatgaagaaaaattagcagtttgggagaaggtccttgaaggtagcaaagcgaaaagaagaagggggcgcttgcgcataaacagctgcttctgagaacgaaaactacgtagcatttccgagtcccggtggccgctcaggctgccctttaaagagacgtgtaggaagcccaccctggggcggccgtgggcggagccgcgacctgaacgccgggagacctcaccaggcggaggcggtgtctacctcaccaggcggaggcggtgtctgcctcgcgctgtcctctgaccgccagggggagccctgccgcgcgctgcgctccgggccgcgccgccacgctctctcgacccgcgcgcccgccgcgcaccacccgtcgccacgcccgccgcaggccaagggccagtcacttgcgggccggcgtcccgcagcccattcgcgccccgcccctgccccgccgcgggatgagtaacggttacgaagcactttctcggctacgatttctgcttagtcattgtcttccaggaaacagctccctcagtttggaatcagctctcccgctgcggccgcagtagccggagccggagccgcagccaccggtgccttcctttcccgccgccgcccagccgccgtccggcctccctcgggcccgagcgcagaccaggctccagccgcgcggcgccggcagcctcgcgctccctctcgggtctctctcgggcctcgggcaccgcgtcctgtggggcggccgcctgcctgcccgcccgcccgcagccccttcgctgcgcggcccctgggcggccgctgccatgggcaccgacagccgcgcggccaaggcgctcctggcgcgggcccgcaccctgcacctgcagacggggaacctgctgaactggggccgcctgcggaagaagtgcccgtccacgcacagcgaggagcttcatgattgtatccaaaaaaccttgaatgaatggagttcccaaatcaacccagatttggtcagggagtttccagatgtcttggaatgcactgtatctcatgcagtagaaaagataaatcctgatgaaagagaagaaatgaaagtttctgcaaaactgttcattgtagaatcaaactcttcatcatcaactagaagtgcagttgacatggcctgttcagtccttggagttgcacagctggattctgtgatcattgcttcacctcctattgaagatggagttaatctttccttggagcatttacagccttactgggaggaattagaaaacttagttcagagcaaaaagattgttgccataggtacctctgatctagacaaaacacagttggaacagctgtatcagtgggcacaggtaaaaccaaatagtaaccaagttaatcttgcctcctgctgtgtgatgccaccagatttgactgcatttgctaaacaatttgacatacagctgttgactcacaatgatccaaaagaactgctttctgaagcaagtttccaagaagctcttcaggaaagcattcctgacattcaagcgcacgagtgggtgccgctgtggctactgcggtattcggtcattgtgaaaagtagaggaattatcaaatcaaaaggctacattttacaagctaaaagaaggggttcttaactgacttaggagcataacttacctgtaatttccttcaatatgagagaaaattgagatgtgtaaaaatctagttactgcctgtaaatggtgtcattgaggcagatattctttcgtcatatttgacagtatgttgtctgtcaagttttaaatacttatcttgcctccatatcaatccattctcatgaacctctgtattgctttccttaaactattgttttctaattgaaattgtctataaagaaaatacttgcaatatatttttcctttatttttatgactaatataaatcaagaaaatttgttgttagatatattttggcctaggtatcagggtaatgtatatacatattttttatttccaaaaaaaattcattaattgcttcttaactcttattataaccaagcaatttaattacaattgttaaaactgaaatactggaagaagatatttttcctgtcattgatgagatatatcagagtaactggagtagctgggatttactagtagtgtaaataaaattcactcttcaatacatgaatggaaacttaaatttttttttatgtgtccttgcttatagtttagctgtaataatttaaccttgtattcttgtgccatattctgtctttttattacttataaagacaaaccaaagtaaatctgaaaggagactagaagctttgaaattattgttgggggttttataaaagcaactactgtcacctccatccagattcttttaaattattgatccatccatagtatatattgctactcattcaagaatcctcaataagtattgagtatttaccatatgttgggatactgtgggctctggagagaggagggggcaatagagctaggaattaagaatcagttgagtaaaatgtgtaatatttattccccattaataactgactaggaaggactaaaagccagaaaggggatgaaaaaaaaatccttaattcagggccgacattatctacttaaacaactttgagatatggtcttaattattttaaagcagaataatataattgaaagtttatagctaaaagagactatataggtcatttagtataattcttcattagtttacgaaccacaaaattgcaaataaataagctatgaactttgatgtacactataaatctccttaattctataaatttgtgtctgtaacctgaatagtttgaaaacttctttaaaaatctcttgtatttcatccgggcgcagtggctcacacctgtaatcccagcactttgggaggccgaggtgggcagatcacgaggtcaggagtttgagaccagcctgaccaacatggtaaaaccccatctctactaaaatacaaaaattggctgggcgtggtggcactcgcctgtaatctcagctacttgggaggctgaggcaggagaatcgcttgaacccgggaggcggaggttacagtgagccgagatcacatcactgcactccagcctgggcgacagagcgagactccatctcaaaaaaaaaaaaaaactcttgtatctcaatatttttaaaccacaggcctaaataaaactaattttgctcaagttttctcaacctagggaaaaagaactatggttccatattcaaaataaatattatagacccttttcctaagtaggattttgtggtttactgattgggtaatttgatcattaaaattatgtgaaatctgcccgggcacacctcatgcctgtaatcccagcactctgggaggccaaggcagatgatcacctgaggtcaggagttctagaccagcctggctaacatggtgaaaccctgtatctgctaaaaatacaaaaattagccaggcgtggtggcgggctcctgtaatcccagctactttggaggcgaggcacgagaatcgcttgaacctgggaggcggagtttgcagtgagccgagatcacgccattgcactccagcctgggcgacagagcgagactgcgtctcaaaaaaaaaaaaaaaagaaaaattatgtgaaatcatgtgatttgcctgggaaaacttgtttagatattgagctacttatgccttctagcctttatattaattgtatgtaatgttattaaatatatatatagttcatctttacatttggaaatgcccaacatttttttcatataagtccttaaacaagcgttcattttattttaaatctatacagtgaactggccaagatattttaagagggaactttaatatcccatttattgtttttataaccctggacttataaaaatgggttgtttgaagggttattttgaaagtgggggaaaaaaaaacttagttgctaatgtatctaaacttcagcagagctttttggtgatctcctacctgcaccctcaactcttgacaaagaagcaagactatagattcattttctgaaggggatcatgtatggaatttttgatgagtttttacttttacctctctactcttgattttctattattgaatactcttttaaaacactgatttttaaggctttatatatgttttccaggctgatgttcacatctttttttcatgaactatcagaatatagtgaacacttttcaaatatttaaggacttaatgtttaaaaagccataaaatagagagtggtaatactaccaaataattacttaaaactgaaagctaagttatcaatagtttatataagagatgttttctgaggagatgtgcatccagtgagaccaaggtagaaagtttatataattgttttttttccagtaaatatgaaaaaaaaagctgtagcttgtttattacatgtccaaaatacagtggagccttactttaacacaatgtactgtaacttggaatttgttctgttatgagtctatcttgaattcccatccatgaaactgtagtcaccaaaagcaacaagtattttcacatgatgtaaaagaccatactatgatggccattgctagaaattgaatcacaaataatagctaataatttttcatttttcaaaaaagatcatttggatagcagctatgtataaaatggaaaataaaaaattattctattttgcatgaatagttcagactttcccataccacagccaagcagtaactaaaattaggatcttaattttcaatgataaaaggtctaaggttcatttaattatgctcctttaacactgtctttctagatttttcacccagtattttcaaaatttgggaatgtaaacaattgatatatttattgtatgttggctagcagttcatccttctgcaaaatatgcattcagagaaatgtgaagcttgttttaatgaagacttaaaccatttgtgtcatttgtgttttcatattcaaatacaccaaattaaaattctgaacctatatttttcatcattaacttcctaatataccagaacatatacctttttcatgtaaagttggcaatgggatatggcagttttatttttgaaaaatatgtaacatgactttaatatttttatagttttcagaattagaaacataggaagggaaaatgttttaattagataagtcaactttttatgtgtctgtagtggtgtactataatagcaaattataaagcattattaaatgtttataataatttttaatattacctacattatgaatttaactaaaataaagtgtgagttgtatattttttaattgggttgtttcaatagctggaagcatcctgaagcattatattgatttttgaactatttgaactcaaactgagtatgatttgaaaataaattaataatttaaaaacatccaaa

SEQ ID NO: 275115 - DNA, 2296 bp, Homo sapiens
atacatgttcaatttgatgtttataccgagtccaccaccacacgtgaaatttaataggggtaaataatctcgaccacctctaaaggggtgggtgataaaagctttctgtgatctcaccggctcaagtgtcctctttaatctgaattcatctggagaataactgccctatgatgttcttataaaattacttgtttcctgtgcttagaacttgtctctgggtagagtgtacgcgtctcaagggcaaagactcagtcttgttcgttgacttcacacactgccagcaaataatgtgaatcaatagacctttaacggatgaagaaaaattagcagtttgggagaaggtccttgaaggtagcaaagcgaaaagaagaagggggcgcttgcgcataaacagctgcttctgagaacgaaaactacgtagcatttccgagtcccggtggccgctcaggctgccctttaaagagacgtgtaggaagcccaccctggggcggccgtgggcggagccgcgacctgaacgccgggagacctcaccaggcggaggcggtgtctacctcaccaggcggaggcggtgtctgcctcgcgctgtcctctgaccgccagggggagccctgccgcgcgctgcgctccgggccgcgccgccacgctctctcgacccgcgcgcccgccgcgcaccacccgtcgccacgcccgccgcaggccaagggccagtcacttgcgggccggcgtcccgcagcccattcgcgccccgcccctgccccgccgcgggatgagtaacggttacgaagcactttctcggctacgatttctgcttagtcattgtcttccaggaaacagctccctcagtttggaatcagctctcccgctgcggccgcagtagccggagccggagccgcagccaccggtgccttcctttcccgccgccgcccagccgccgtccggcctccctcgggcccgagcgcagaccaggctccagccgcgcggcgccggcagcctcgcgctccctctcgggtctctctcgggcctcgggcaccgcgtcctgtggggcggccgcctgcctgcccgcccgcccgcagccccttcgctgcgcggcccctgggcggccgctgccatgggcaccgacagccgcgcggccaaggcgctcctggcgcgggcccgcaccctgcacctgcagacggggaacctgctgaactggggccgcctgcggaagaagtgcccgtccacgcacagcgaggagcttcatgattgtatccaaaaaaccttgaatgaatggagttcccaaatcaacccagatttggtcagggagtttccagatgtcttggaatgcactgtatctcatgcagtagaaaagataaatcctgatgaaagagaagaaatgaaagtttctgcaaaactgttcattgtagaatcaaactcttcatcatcaactagaagtgcagttgacatggcctgttcagtccttggagttgcacagctggattctgtgatcattgcttcacctcctattgaagatggagttaatctttccttggagcatttacagccttactgggaggaattagaaaacttagttcagagcaaaaagattgttgccataggtacctctgatctagacaaaacacagttggaacagctgtatcagtgggcacaggcgtggggagtaaaaatgatgcatctgattgcgcttgaagtgcctgtgggatgcctggtctcaggcttagaaaggtctgagctgacctcacaccgtggctcatgtctgtaatcccagcactttgggagactgaggcaggcagatcacttgaggttaggagctcgagtgatcagtctgcctcggctgcccaaagtgctgcgattacaagtgtgagccaccgcgctggcctataatgtgttctttactcatgtatatgttttttaatttccataataaagttttttttaaccaaacgctaaaaaaaataaaaaacagaaaaggaaaacacagaacagagaacacaacaaacacacgagaaaacagaacaacaagaacaggacaagaaaaagaagacaagaaagaagaaacaaaaaaaataagaaacacaaagacacaaagaaacacagaaaacaaaaaagatcatcaaaaagaaaaaaaaaaaaagaaaaaatagatagtgcaggggggcggcggcgcagtcgataagttaatatcatatacgcagaggggcgggcgagcaaaattgagcatcattacccacgcgcgtggttttttttatggataggggagggcttggatattatagtgagcagtggctttgtatttacc

SEQ ID NO: 275116 - DNA, 1590 bp, Homo sapiens
gcaagagaaccaaatttcttttgaagctggagaaactgcattatgctttcctggccttcaagaatattttcttaggtatttggaaaggttaagtgttgatttttgaggattaggatagcagaaaaatttgaatgcttttttcccactgagtacctgctgaatacggtctatttgcgtacaactctgccatgtgaactttgagaaaggcatttttataaattaaagcctttatttggttattataattttgtcactctaagtggtctccttttgtatgatctctgcaagattcaaatgcatcagaatatagtatttcatattagattgtggtgagaaacttcttgctttgttttattgtatccttgaattcttttctgtagtgcaatagcatgttattcttttttactcccactgaaggttaaatatatttcttgctaatttttcccctgcatgggcgatagcgattttaaatcttgaacgtgtatgttgagttttcctagatgtggaagtaatcataatttgatatttttagaaagataaattaggtaatgtggctttgtgtatgcagtagagttaatatgcttttattcacctcatggtttctatgtcattaccacctgttggtttttattttttaatggaaaacttgaacttctccaaagtgactagttttaaaataacatttatgtaaggattgtttatacagagaaattgaaaaccagaaggtataaagacaattaaaattatctaaaattctactagttagaagtaactactattaatattttgttctatatccttccaatattttttcatatgtattttttttacatagttggaattgtgcatccatattattttgtaatatgttttattatttaatatattatgaaataaatgtttgtgatttaaaaaatcaatatagaatttcagtgtacaggtgtgctattatctgtttaccattctgtgttgaaggtcttttaggcagtttgcaattttgggatattgtaagttgatggacatccttatacattaaaaaaaattatatggctgattatttcattacaataaattcctagaagtagaattacttaaaagatataaacattttgaaagcttttgatacatatttccaaactgttctcttgaaagattttttaaaataatagttttattgagatataattcacatacccaaaatttatccatttaaagtatacaatgcagtggcttttagtatgttgacggggttatataaccatcaccacaatcaattttagaacatttccagaaaggtttgaaccagtttaaacccagcaatattataaagttttgttttaaaaacagcatttattcataacatttaaagtagtacagtatacaggaacacaacagcttgtgtgatatatactttatatgcatttgagagagattttagaaagtccttcatgagaagatgatgctcctacgtcccattttaagaaaacctgacatattaagcttaagctgattaaacaaaatatgaggtatatttttttgaattataaaattattctcctgagcctgggcgacagagcgagactctgtctc

SEQ ID NO: 275117 - DNA, 1342 bp, Homo sapiens
gacttggtgagcgcgcggcagctttattaaaccacgggataacggctgcccgcagcctccggatcggtgggcgcttgcggaaggggacccggctcagggcccaggctgggactcagccactctgacaggttggagacctcctgcagccacagcacgtcctgcgggaacaagggggcccggggtgaggacctctcagcagcggcccgtggcctgcacctcctgctgagcccttccctgcgcggccctcgcccagttacctccaggcggcttccgaggctcgccctgcccggcgccagggccctgccgtgagcctcgcggtgctcccttcctctaggagtgaggggggccgcggtggcttccgggcggcgcggggcggcctctgacgggctcggggccctggcagagcgcagagctcgcatctcctctatgcgggggctgcccctcttgagcctcttgttttctgcttgcccgctggtatctaggagaaaaacaagcctcttcatcttactttcatggccctgtgctaggagcacccttggccaaggggaagcctgggagaacgggcgccgaggggctcttcccaccgcatccctgtcagcaggtcccatccacaccaaaaccctgcagctgtgggcgcttctggagcagcccgaggctgcagagacgtttcagggtctccctattctctcacccaggcgggagattgtcccgagccctcacttgggggactcaggccgctcagtaactttctgtatagattcttcctggagtctgcactgacaagctcccctccctgccagcctctgtcccccctcacctttctggcctcagttctgtctccctttgttgctcacgttgcattgagcagtgcccataggcagctttcctactcttaactgattcatttgtcaaattaaagcgagtttagatggatagattcttccccagcaggtcttggggatgcagatcaatgagcttttccctgagagaagctcacagatgctaggaggggatgcagacctgtgtacaaagcccagggttagaatagagaaggaagccgaccacctctggatgtgaagaagggtttccatgaggagatacctgagctgaccttttgtttttttgagacaaggtcttgctctgttgcccaggctggagtgcagtggctcagtcctggctcactgcagcctcgacctcctgagttcgagattctcctgtctcagccaccccagtaactgtgattatggccacctgccaccacgcccggctaatttttgtatttttagtagagacggggtgattcatgctcagccaagctgtactcgactcccaaactgtaagg

SEQ ID NO: 275118 - DNA, 282 bp, Homo sapiens
tctccctaattcaggcactgtgttcactgatcccttttgtcactgttttcttttctcctcattttgtctttttatttttttttggccagcctcttagaagttttgtcaatcaattctgactttttcctaaagttgatatttggtttgtcagtagcgtattggagaggcttacagtagtatccagaagaaatggaggtgaagctctgtgtgtactctctgtactccctttaacaaatagattcttaagtgtttctgaaagaaaaagtccttttgtagggctcc

SEQ ID NO: 275119 - DNA, 462 bp, Homo sapiens
ttatatatattggaaattggcatttattattctgtgaattgcctattcatcatatcatttcctcatttatttaattagattgttcattagcttcttattgatttgtaagagcacatttttaaggaaactagctcttatgtgctatgaatatttttcactttgttatgtctttcgatttttgcataaaatttttttctaaaatttccacatggaaattttatataatattatataattgggtcaatcagtcttcattcatttagcatttattgctcgcttaaaaaggttcaggtactgtaggtgtgagaataaagagatgaataaaagacagggagtttcttcgaagggctacactactgggttaaaaagatgagaaagttgcctattaccagatggtgtcatgtaaggctttacagatgcaatttgaaaaacctccaaaataatgagttgaagttccttaga

SEQ ID NO: 275120 - DNA, 535 bp, Homo sapiens
agacaagaaggcctagaattgtctttcagggattgggggcaacatggcaggtgcaaggctgtgaagaccacgtggtttgacccagacaccagcagagctacagctcacagaagtcccgctgaagcaggctgagcagcacctgaggatcccagcagaaggaacaggtgctgggatttattgggttcccaccccatgccagacgcttgattgatgagatgccattattagacccatttcagagaagaaaataaggctcaaagcaggagagtggtctgtgtagggtcatgtggccagaggtagggctgaagttcagctcagcctctcatggcacttcactgaggacacgtgctgggagatcaaggtcagtgaggaaccgagctctgtgggcaaaagagaaacaggatggtctggggagctgaaagatccagtggtgtgcagaagttggggagaggcatctggggccaccaaataagaggagggaagtcggcacctgcctgctgtgcgggggagagagttcctgggagagacagtggga

SEQ ID NO: 275121 - DNA, 485 bp, Homo sapiens
acacatctgtctccaaaaatgccctttctttctctataaaatctgagaggagacttcaggtggcctccactaaccatcttgcttttgtgtctttattctgtctacaattaaaataagttgcatagaattgttttaaaaataatagagaaattctaagcctccgtggtagtcacctgagtgtcttcttttttttttttttgagatggagtctcactctgtcacccaggctggagtgcagtggcacaatctcggttcactgcaacctccgccccccggggttcaagtgattctcctgcctcagcctcccggatagctgggattacaggcacccatcaccacgcccagctaatttttgtatttttattattattattattttttgagatggagtcttgctctgtcgccaggctggagtgcaagtggtgccatcttggctcactgcaacctccgcctcccaggttcaagcaattcccctgcctcagcct

SEQ ID NO: 275122 - DNA, 538 bp, Homo sapiens
gcacttttaaactctgtatcagaattttatattttatcatctacattaatacatacaaaaattacacaaatgtacaaaaatgtaatatttctttatatgagagcattcaagagtcctgtgaagtacattattaatagaactcataggaccaatagcactaattaaaacagatatgacctatattcaagaaaaaaataacaatgacgtgtttctacctgtcccatattacagtaggatatttttattctttttgtttctttttctaataatacttctctaaacttcctgcagccttcaggacaccttacatttatttaatgtgatggaaaactaaatgtagccatgtaaaatttactttatcctacagatctgcttttatataaagtccacatttcagtgatacctggtgtctttctattgtgatgatatcaagctaaatatactctctaaaaaagtatttgagcatgggatagttaggacttttacttacctccaacagtggacttttagacttatgggaacttgtttcctgatttcc

SEQ ID NO: 275123 - DNA, 442 bp, Homo sapiens
gcttataatgagtattaccctgggtcctttattttctctggggagggaataggggaaccctcctgtcccagggcccactaagctgctatgcagctttctccccgccccccaccaacccccagagttatcgctactgctctgtaggaagacagtactcaaaaagtacatttttgcatttccattttgattcttgattctttcgatcatcatttattcatgtagtcaaatattcgttcattcactcaataaatagtgtgtgtctggcaaagagtaaacaagagatcctttaattcacaaatgttattatttgcttaaaaaatcaccatccctttgggttatttttctatgccagtacctttctgtattatctgaattctttctcagacaagcactccttatttgtatagggaaagaaaacaataaaatgtatttccacctagga

SEQ ID NO: 275124 - DNA, 459 bp, Homo sapiens
aaatttctttggttcatgaaatgctgcaaatattacacaattccatgtttcttctttttctaaagagggcagcaactgagtaggcattgaggttgagtgtaagaaaattctcccctactccataggtgctttcaggcatcatggctaatcagctagaggccacatttcccagtctcccttgaagcttgttgtggccatgtgatcagcttcttgtgaatgggagcttgagtagaacacatgactggttaactcttaaatcgtgctagacaaacctctccactgaagtactaatcaacttaaaatatcaacgtacccatggagccaaagcagcttggggagtcagaggaggtctcagggaaatagcgatgcttcaagagagttaaaggctataccagcctcttcccagagccacctttgcacaccttcatttgtgcacaaataaatctattatgattatat

SEQ ID NO: 275125 - DNA, 362 bp, Homo sapiens
aggacccctgctgctccccagcattctttcactgcccaactagcatgtttttgatgtttcagctacactccattacttaatattttttcaacgagccatgcctttacctgagctattctttatctttgttttcctccattgcattaatgcgcattattccttcaagagctagtccacacatctcctctgaaaaagcttcccgggctgtctcttccagagactagttagctgtcaggcaaggcccccaccagtgaagttggtgaacccctcacagagcgggactgggttcttgttttgcaggtccagaaacgtgtgttgccagtgccctcagtgattatcagtattctcaggactgacatgaa

SEQ ID NO: 275126 - DNA, 441 bp, Homo sapiens
atctaggctgcggactaacaataaccgaagatggaaatgtgacagcttttcctccacacccccacccaaggaaaaaatcctaacgcagacaattaacactgggaaaaaagccccaacaaaatactgcatgtttcagacagttttaattgtctgcgttaggatttttcccctggaccggtgatgcttgggaatctaggctgcggactaacaataaccgaagatggaaatgtgacagcttctcctccacacccccacccaaggaaaaaaaaaaaaaaagccatacaatctggagtgggggtggggtctctcttccttgtcagactggggtaaatcaaaagctggtcacgctgggtttttcaaaagcttctcatttaacaagtcctatttgcttttatctttttgttatggaaaaatatattatacaaatgatttcttccttta

SEQ ID NO: 275127 - DNA, 650 bp, Homo sapiens
tcaacctttcactcaggtccaccactgctctttcctccactgaccctctaccccaatttctttttgtttgaagagtgaatagatctctcttcttcactctttctattccccacaccaaggcaaagagaatggggaggtatgactttttggatgtaataatttcagaaatgtgttgtcctaatttaagtttggagaggagaggattgttagtaaatctggaacaagcggttttagagggagcgtttgagggacagactgtcagaggcaatctatagccctagccgattgagtctcgatgaaattaacactgggaaaaaagccccaacaaaatactgcatgtttcagacagttttaattgtctgcgttaggatttttcccctggaccggtgatgcttgggaatctaggctgcggactaacaataaccgaagatggaaatgtgacagcttctcctccacacccccacccaaggaaaaaaaaaaaaaaagccatacaatctggagtgggggtggggtctctcttccttgtcagactggggtaaatcaaaagctggtcacgctgggtttttcaaaagcttctcatttaacaagtcctatttgcttttatctttttgttatggaaaaatatattatacaaatgatttcttccttta

SEQ ID NO: 275128 - DNA, 385 bp, Homo sapiens
atcttctaaacttcaaattacttaatcttccaatacactctgaaacaggtactatttagtaccccatttgacagatgagaaaattaagtcatagggaaatacacatgactgcaggggcagggtttatatatcgcatgaaaatgaaaaagtttgagaaagcctataaaaagttcagtcattgtgtacactgttaaaggtcttggttacttggatttctccttaatttccctgcttgattcttctttatacacaaaattataacagcagtctcttcttcataatatagagcttctggtgagaaccttggaatcttaaaactgtatgttatttttcatattacctggtgagataagtgttatctttattaaagctacgaaatctagga

SEQ ID NO: 275129 - DNA, 339 bp, Homo sapiens
caaatccaaaacttcagtagttactgattccagtaccatatctaattttccttcaacatttttctttaatgacactacctcccatccacctatttacaacaaaaaattgagcaaagctccttcctccctcaagcgttcacatcttagtataactctcattgattctaagttctaaatatttcttaaatttgttctctccttcattctagctacaattgccttcacaattcattatttcttttctgggtcactaaaataatctgtttccatgcttacctcccacaaatccattctttacatagctgtcagcaaaacctatttaaaataaaaattggatca

SEQ ID NO: 275130 - DNA, 799 bp, Homo sapiens
agaaaggcaatgaggttttcaacgacctcatgaaaagcttgttagggccagcatagtttttatttgtactctgagcttgtgtgttttccactacactggtgatagaaacgcctttctttaatgcaaagatggtaaggcagtgttctttgtgttggaaagttattgtgtcgattccttgaaattttttttaatctgatctgtgaaatccagaagtctgggaatgtcaggagacgtctggtggcattctgtaggtgggagtgtcacggtgtcgtaggaagttcaggaatctgaagtctgtgtcccagccatcctctgttccagacatgctgggtgacagtaggcaaggaatttctatttctgggtttcacttttctagtctctaaaattgagagagcagctttaaagaatcctgaaccgacgagggcatgaaggacatggaaagcctgagaggaaagtcaaggagtcaggcaggtggacttcccggaggaggggacctggggagctgctctgggcaggctctttgtgaagggagagcagccctgctcagtttctccgtggaaagtctcagggttaccatctccgcctcaaattttcaaaaagaaacagaaatcatggtttttatgttaaatctctccgttcataaatattagcaaccgctttaattaaaaactaaacaaggccaggcattgtggctcacacctgtgatcccagcactttggaagaccgaggcagacggatagattgagcccaggagtttgagaccagcctgggcaacatagcaagaccccatctctacaaa

SEQ ID NO: 275131 - DNA, 404 bp, Homo sapiens
cagcatcaggtcagatgtgtttccattttcttggcctttccctcatgatcacaagatggctgctgcagctccttaagtcatcaatcacatctgtgttccaggcagaaggaaggtagcaaagactttcccagaaatccccagcaggtttctgattgtgttattggcaagagctgtgtcttaattacccccagctgcaagggagtttaagatggtgagagtttttcttttttttagcttttcagcctgtatagtagaaagtcaagataaaggaggttgggatgggtgtcaagtggtcagtatccaccatggtccccgttccctgtcccacctctccttatcctgagttctcactctcctgaagtaattctcttcctccatttttctaaataaaatgtttattctgt

SEQ ID NO: 275132 - DNA, 423 bp, Homo sapiens
gggcggaaggggcagcctgagatggagccaggcctgtgcctccactagaaggtgcagggtatggacggtacagggaggctgtgttcacacccagccgtgtagttgccaagggaccatactcagatttgtattaaaaacaaacaggccaggcacagtggctcacgcctgtaatcccagcactttgggaggccgaggcaggcagatcacctgaggtcaggagttcgagaccagcctggccaacatggtgaacccgtctctactaaaaatacaaaaattagccaggtttggtggctcatggctgtagtcacagctactcaggaggctgaggcaggagaattgcttgaatccaggaggcagaggttgcagtgggccaagatggcaccattgtactccagcctgggcgacagagccagactctggctc

SEQ ID NO: 275133 - DNA, 583 bp, Homo sapiens
gaggccccgtgttaggaaggcagggctgggctacaccaaaaagagtctttgggccgggcgccgtggctcacacctgtaatcccagcactttgggaggccgaggcgggtggatcacgaggtcaggagttcgagaccagccttaccaacatggtgaaaccctgtctctacttaaaaaaattaaaaaattagccgggcgtggtggcgcatgcctgtaatcccagccactcaggaggctaaggcaggagaatcacttgaacccgggaggcagaggttgtggtgagctgagactgcgccactgcactccagcctgggcaacagagcgagactccatctcaaaaaaaaaaaaaaaaagaggctttgaaaccaaccaagaggccagaggcagtgggcagagcgggagggttatggggacaccttcagaatcagagctgagaacttccagagggtaccacgtattatgacacacaaacacctccaggatcccaggtggcacctgcacaatcacttgtggcgtgtgcgattactcacaggaaaagatgacgattatgcgtaatctcatggtgactcctagcaggtggggagt

SEQ ID NO: 275134 - DNA, 382 bp, Homo sapiens
ggttttgtgaaggcagtctaatttctgcaaaagaaatcttatagtatttcacatctttcaaaaatctcccaagccctgatgcaaataaaagctacagaaattaaaattacagtacttaggcatgacatcaaccccaaagtgtgaaccattttcattgttgaattttggatccaattgaaatggagatcttacagactactgcaacaaaataaacattgagaaaattcatattaaggaattgttaattgttaatcttgttgaatgtgatactgtattgtggctatgttgataaagtctttattatataactataatgaagttcttatgagtggaatgatatgacttctaagatgttttaaataaacaaatatttttacttatt

SEQ ID NO: 275135 - DNA, 494 bp, Homo sapiens
aaagagataacaatttttttgtcacaggggcttctccataggatagctcactacatggcagctggctgcctctcaaaaggaacaagtaagaaagcaagagaggatattgaagacagaagtcacatgttctttgtaacttcatcttggaaattatatcctaaaacttttgctgttttctgtttgttagaagcacatcattggttcattccacactcagaattgcacaagggtttgaatactaagaggcggggatctttggaggccatcttagaacttgcctattaacagcgtttgttagttatatatatttaaatgaacatgttagtcttccttcatggtcagattaaacaaaagggtgttgggttccatgtaaaagccagtcttctctgtgcaaatttgtaccagcatttgaatgattcccttctgtttcatttgatttaattttaaaatgtacttttggaaatttttgatacctattaaatttactgtaatat

SEQ ID NO: 275136 - DNA, 292 bp, Homo sapiens
attttttgagagatccaaaatgcttccaaaatacagtgatctttaaactaagacctcaagtataaaggagggaagagcattccaggcagaagaaagatcaagcacaaaagatgaagaggccagagagagcagggtgagtggaggactcgaaagacactcagtcttcaagatgagaggtgaggagaatctgaacagggttaatgaccatggggagaagaggggatacatgcgcatgccattgtggagataatggtacagtgttagaaaatgtgctgacacactgggcatgcag

SEQ ID NO: 275137 - DNA, 1439 bp, Homo sapiens
cttttacaggaatgttcataaacagcaggttctcctaggctttgaacaaaatttagcttctccaaggccaaaagcctcattgtgaagagaaagaaaggtatagcagtcttggcagttgctgaactgaattcctggctgatttccttactgcataaactcaactgctctcactgaggtcgtcattaagtcctgtgtgtgtttgggcaggccgacttgatttacagccagcactccactgcggaaacggcttacaaaatatacagatcttggtagacaacgtggctgcaggctgttgaattggaattccctgtggctgtccgaaggcagggtgtccggagagcggtgggctgacctgttcctacaccttgcatcatgccagctttgtcaacgggatctgggagtgacactggtctgtatgagctgttggctgctctgccagcccagctgcagccacatgtggatagccaggaagacctgaccttcctctgggatatgtttggtgaaaaaagcctgcattcattggtaaagattcatgaaaaactacactactatgagaagcagagtccggtgcccattctccatggtgcggcggccttggccgatgatctggccgaagagcttcagaacaagccattaaacagtgagatcagagagctgttgaaactactgtcaaaacccaatgtgaaggctttgctctctgtacatgatactgtggctcagaagaattacgacccagtgttgcctcctatgcctgaagatattgacgatgaggaagactcagtaaaaataatccgtctggtcaaaaatagagaaccactgggagctaccattaagaaggatgaacagaccggggcgatcattgtggccagaatcatgagaggaggagctgcagatagaagtggtcttattcatgttggtgatgaacttagggaagtcaacgggataccagtggaggataaaaggcctgaggaaataatacagattttggctcagtctcagggagcaattacatttaagattatacccggcagcaaagaggagacaccatcaaaagaaggcaagatgtttatcaaagccctctttgactataatcctaatgaggataaggcaattccatgtaaggaagctgggctttctttcaaaaagggagatattcttcagattatgagccaagatgatgcaacttggtggcaagcgaaacacgaagctgatgccaaccccagggcaggcttgatcccctcaaagcatttccaggaaaggagattggctttgagacgaccagaaatattggttcagcccctgaaagtttccaacaggaaatcatctggttttagaaaaagttttcgtcttagtagaaaagataagaaaacaaataaatccatgtatgaatgcaagaagagtgatcagtacgacacagctgacgtacccacatacgaaga

SEQ ID NO: 275138 - DNA, 744 bp, Homo sapiens
cttttacaggaatgttcataaacagcaggttctcctaggctttgaacaaaatttagcttctccaaggccaaaagcctcattgtgaagagaaagaaaggtatagcagtcttggcagttgctgaactgaattcctggctgatttccttactgcataaactcaactgctctcactgaggtcgtcattaagtcctgtgtgtgtttgggcaggccgacttgatttacagccagcactccactgcggaaacggcttacaaaatatacagatcttggtagacaacgtggctgcaggctgttgaattggaattccctgtggctgtccgaaggcagggtgtccggagagcggtgggctgacctgttcctacaccttgcatcatgccagctttgtcaacgggatctgggagtgacactggtttgagcaaagcacagaagacaagagtctctgcatttacagaagccgcaaagtacggcgtatgcatcagatgtttgcaactggccagtcgggtcatttttcccataagcagcgttgcttagcagtgtcgctgacgtcgtcccattagttccaggggaacagagttgaagtcagacccttgtgccacaggagcaaggcacccgactcacagcagcctagatgcatggattgctcatttgggaaaatacgttctgtgtaaaacttttaccacttcttctttcccttcttgcttatttcacgaagaaaaaaaaaactaattatacaagtaatacata

SEQ ID NO: 275139 - DNA, 1336 bp, Homo sapiens
cttttacaggaatgttcataaacagcaggttctcctaggctttgaacaaaatttagcttctccaaggccaaaagcctcattgtgaagagaaagaaaggtatagcagtcttggcagttgctgaactgaattcctggctgaaacggcttacaaaatatacagatcttggtagacaacgtggctgcaggctgttgaattggaattccctgtggctgtccgaaggcagggtgtccggagagcggtgggctgacctgttcctacaccttgcatcatgccagctttgtcaacgggatctgggagtgacactggtctgtatgagctgttggctgctctgccagcccagctgcagccacatgtggatagccaggaagacctgaccttcctctgggatatgtttggtgaaaaaagcctgcattcattggtaaagattcatgaaaaactacactactatgagaagcagagtccggtgcccattctccatggtgcggcggccttggccgatgatctggccgaagagcttcagaacaagccattaaacagtgagatcagagagctgttgaaactactgtcaaaacccaatgtgaaggctttgctctctgtacatgatactgtggctcagaagaattacgacccagtgttgcctcctatgcctgaagatattgacgatgaggaagactcagtaaaaataatccgtctggtcaaaaatagagaaccactgggagctaccattaagaaggatgaacagaccggggcgatcattgtggccagaatcatgagaggaggagctgcagatagaagtggtcttattcatgttggtgatgaacttagggaagtcaacgggataccagtggaggataaaaggcctgaggaaataatacagattttggctcagtctcagggagcaattacatttaagattatacccggcagcaaagaggagacaccatcaaaagaaggcaagatgtttatcaaagccctctttgactataatcctaatgaggataaggcaattccatgtaaggaagctgggctttctttcaaaaagggagatattcttcagattatgagccaagatgatgcaacttggtggcaagcgaaacacgaagctgatgccaaccccagggcaggcttgatcccctcaaagcatttccaggaaaggagattggctttgagacgaccagaaatattggttcagcccctgaaagtttccaacaggaaatcatctggttttagaaaaagttttcgtcttagtagaaaagataagaaaacaaataaatccatgtatgaatgcaagaagagtgatcagtacgacacagctgacgtacccacatacgaaga

SEQ ID NO: 275140 - DNA, 326 bp, Homo sapiens
ctgaaattctcagtaatttcactgggttttgttttgggaagaagctggtatatcgctgctgtttttgttcgtatgctgtcaaggagattgaagtttatttgaaatgttccttttatttttaaatggcacttgggacttttcatccttagaagccctgtttttcttcccctttaaattagggactaaggttagaggaggagttggatttattttctgacactttctgaataattagttattatgtctcagaaagaatcacaatatcaatagtatatgttctggaattacgaagtattatattagagggctttacctctctaccttct

SEQ ID NO: 275141 - DNA, 633 bp, Homo sapiens
gctaggaaaagaatttagtgatgtctctcctacttgcaggtccatttatagcctctctgcaagaagaaaaatatggctgtttttgccagatcccacaggcggtcagaccttatgtatgtcttcccttgttccataaaaatcgctgttatactgttctttttcaaggtgcactgatttcatattgttcaaacacacatgttttactatcaatttgtagagttaacacaattatcacagtggtcctgaggtaatgtacatcctcagcttatgaagatataagtgattaaagtaaacacaggcataagaaattataaaactatgatttgggaactgataaatgtccatgaaatcttcacaatttatgtccctctgctgctgatccagctggtccctctgttcagggtccctgacttcacacaacaaatatgcatgtgaatccttcactggcaaccaaggtatccaggttctctcaccagaactgattaggacgctggtttgacccactgagagaaggaagaacagtgtagtatggtggcccacctgagagccacatggggctggggagccccctctgcctagccaaggggggcggtgagcgtattacccagctgggaaaactgtgcttttcccatg

SEQ ID NO: 275142 - DNA, 356 bp, Homo sapiens
atgtgtgacgttccccatcctttgtccaagtgttctcattgtgcatgttctcactcataagtgggagctgaacaatgagaacacatgaacacagggagggggacatcacacatcggggcctgtcagggggtgtgggactaggggagggatagcattaggagaaatacctaatgtagatgatgggttgatgggtgcagcaaaccaccagggcacgtgtatacctatgtaacaaagctgcatgttgtgcacatgtatcccagaacttaaagtataataatgaaaaaaagtgttatcacccatcaccaccacaatactctagccttctcccataaatatgtagcatttatcactaaaaa

SEQ ID NO: 275143 - DNA, 387 bp, Homo sapiens
ggattcacaatgtatataagcagttaatggtgtgctcagaaatcctataacatagaatattgtatgactttatacagtactagcattaacaaacttcttgatcttgggggcctctcatttgagccaagtctgttaatatcctgaggagcgcattcagggaaacattctattggcttgacttactcagatgacagcggtctcagctgagcatttgataggggccagtagaatcaattcagagttgttttctaacttttactaaatctatgttatagattttcttggaggaaaagtagaccttgtcagagagccttaattaaagtccagaacctagaaacatatgcatcaccagatcaacaactgaaatgggaatagcagacaaaggtg

SEQ ID NO: 275144 - DNA, 389 bp, Homo sapiens
tgaaaactcagtgagagtgcacctgtacacagcctttctggaacatttgggggtgactgcgtccccaagggaggtgtgccctccaggttcaggcttgcaagaggggtggagttccactccccctctacatgaatatcagtattcctgcagatggaccgaggtgcctatctgatctgaatataaaaaatcctgggatgggggcatgataggaaggtaggtcacttttgtgctggcctcatagtggagctgaggtgactccctccctcccctgtaaagatttcaatgtatttcgctgggagctcctccagcccgcctctatcagagctgggacttttgcccactattgggttttgcatttacccagctgcttcagccacaggcagttctta

SEQ ID NO: 275145 - DNA, 343 bp, Homo sapiens
gaaagccagctgcccggtgatccctcactacctctccaggcagctcagagatgccctctgagcttcttcctcctgggttcatctggaagcaatctaacattgtttaaaagctagccttgacaggcagatcaattgaggtcaggagtttgagaccagcctggccaacatggagaaaccctgcctctactgaaaaatacaataattagccgggtgtggtggtgcatgcctgtaatcccagctactctggaggctaaggcacgagaatcacttgaacccaggaggcggaggttgcagtgagccaagatagcaccactgcactccagcctgggtgatagagtgagac

SEQ ID NO: 275146 - DNA, 615 bp, Homo sapiens
gctatctgtgtgaacaatgtgctgtggaaacaggagcaagcagctgattgccccagtggatatctaagaaaggcttcattaaggagtgacttatgaaataggtcatatggaatgaatgagaatatcccaggcataagagagaagggcattcctgacagaatgaactgcatatgcaaagtcagggaggtttgaaagcgttgaacttgttccagcaacagtaagaaagaagtttagtgtagcaagagtataggtatatatagagaagtgaggtggagcccattgaagacctatgcaccttgctaaggaggttagactttcttcttatatggtgagaagcccagagaggttccgaatctaggatatgtaagataggatatatgtgctttaggatgaccattctgtcggctgtttaaaggatggtgtgaagaaaagagagattagagttaggaaatcctttgcattgcttcaaatgggaaataaggacttcaactaagacaggagtgatgggtatggaaaagatggtctagattccagagctcaattccattcagtttgtggaacatttactgacatttaccatatagcaggctgctaaacactgtgatacaaaaaaaa

SEQ ID NO: 275147 - DNA, 612 bp, Homo sapiens
cactcaagtgggacagtaagattttctctgaggctggcactggtgcctgcctctgctccggggaatccagacgtggcacccggagttgggcctcatccatcctcagctttcatttgtgaccaagcctgactcagaatgggctggcagttttcctgagtacatgggagttagggcagagaacatgatgtggtgctggtagtcaacgcaagctggcacggcctcagccagaagactggagctaggagcaagcaaagcaccaagtaaatgaatcaaattaaaaaacaactacaacaacaacaacaaaggaggaaactagagaacatcttgggaactatccgcttttggaacttatcccatgctggaacattgccctgagacagacatccatgaagaagcctgggatgaaagaccacatggagagaaaggcccaccatcattctgcaccaactaccaacggcgtaagggaggttgacttggatctcccaccccagttgactctccagctgaaagcaactgcctgagcccaaacaaaacctgctgaggaacctccctgctagcaaatggaatcaggagaaataataaatagttctgttgttttaagtcaccaactca

SEQ ID NO: 275148 - DNA, 505 bp, Homo sapiens
cactcaagtgggacagtaagattttctctgaggctggcactggtgcctgcctctgctccggggaatccagacgtggcacccggagttgggcctcatccatcctcagctttcatttgtgaccaagcctgactcagaatgggctggcagttttcctgagtacatgggagttagggcagagaacatgatgtggtgctggtagtcaacgcaagctggcacggcctcagccagaagactggagctaggagcaagcaaaggaacattgccctgagacagacatccatgaagaagcctgggatgaaagaccacatggagagaaaggcccaccatcattctgcaccaactaccaacggcgtaagggaggttgacttggatctcccaccccagttgactctccagctgaaagcaactgcctgagcccaaacaaaacctgctgaggaacctccctgctagcaaatggaatcaggagaaataataaatagttctgttgttttaagtcaccaactca

SEQ ID NO: 275149 - DNA, 381 bp, Homo sapiens
cagttttcctgagtacatgggagttagggcagagaacatgatgtggtgctggtagtcaacgcaagctggcacggcctcagccagaagactggagctaggagcaagcaaaggtgagtggaggaggggatggggaaggctgagacttcctggtctctatgttctgagctcaattctagaatagccaaaaggtgggagcctgactcgggctaagttagtcatgcgttctgagcctttgaccgtgctgggtgagatgagggatggctgagcaggttcagtgagcaacttggtcgaggtcaccttggctggcagaggaagggcacctgccctcctgtggaaaagacgggaaatggctttcctgtcactcctagggtagcgctcaat

SEQ ID NO: 275150 - DNA, 678 bp, Homo sapiens
tgattctgttgggttttccagatggaaaattatattacttacaaatcagggtgatttttggctctatttttatatgacttttttctatttttatatgactttttttcctgttgtaatattttgcttgtaatttctagaatgatactgaatagcacttttggtgagcatctttggcttaatcctccctttagcctttagcactgttggctttagtcactttctgcatattgccaaattgctttttggaaagctgcactagaattggagagtgcttgtcacccatgtccacacccaagcttagtgaccagagcattgtgaagggtctttccaatttgtggctcttgtcattttaaaattaaatttgggtttgccatttattatttttttctagaaattctcgagtctgagaatatgagaatagagttggcctaggttcatacattgttttgttctcaccagataattacacaactttttcttcctattccaaagtaacagtgttgtggagtggaaattactgttgttaattttagcaccatagtttggtggaaaaaagtatgggtcttggagccagatatcagaactaagctatgtcactaatagcctagtgacttttcataaccttacttaaactctttgaactttagtttcagcatttgtaaaaaaaaaaaaaaaaaa

SEQ ID NO: 275151 - DNA, 1141 bp, Homo sapiens
agcgggcttcgcggcggaggcccgggcaactcttttgaatggaatcgggctgattcatcgccggtttgcagactgagccgcgtcgggtgtgcgccgctgctgctgttgcctctgtcttcgcgtcaccacagaggcaagacaagggtccatatcgcggcatccggctcccgcccgtcttcaggagagaaagaaaaaataaaatatacttggggaagttgtacctgccagaattagcaagagctttctttaagaagacatttgtcaaactcaacaaattgaaggttaacaccttaagagttgtagttactgaccagaaatatggacagacttcttagacttggaggaggtatgcctggactgggccagggccacctacagatgctcctgcagtggacacagcagaacaagtctatatctcttccctggcactgttaaaaatgttaaaacatggccgtgctggagttccaatggaagttatgggtttgatgcttggagaatttgttgatgattataccgtcagagtgattgatgtgtttgctatgccacagtcaggaacaggtgtcagtgtggaggcagttgatccagtgttccaagctaaaatgttggatatgttgaagcagacaggaaggccggagatggttgtggttggtatcacagtcaccctggctttggttgttggctttctggtgtggatatcaacactcagcagagctttgaagccttgtcggagagagctgtggcagtggttgtggatcccattcagagtgtaaacggaaaggttgttattgatgccttcagattgatcaatgctaatatgatggtcttaggacatgaaccaagacaaacaacttcgaatctgggtcacttaaacaagccatctatccaggcattaattcatggactaaacagacattattactccattactattaactatcggaaaaatgaactggaacagaagatgttgctaaatttgcataagaagagttggatggaaggtttgacacttcaggactacagtgaacattgtaaacacaatgaatcagtggtaaaagagatgttggaattagccaagaattacaataaggctgtagaagaagaagatcagatgacacctgaacagttggcaataaaagaatgt

SEQ ID NO: 275152 - DNA, 990 bp, Homo sapiens
atgagttttatgagttctttatatgttctgagatagaagttctttatgcgatatataattcgcagatatggtctcccagtacatgggcttggctttggtatgttcttgacggttttttgaagaccagaggtttgaatgttggtagtgtaatttgtaaaaatttgggccgggcacggtggctcacgcctgtaatgccatcatgttgtgggggcgagggccacctacagatgctcctgcagtggacacagcagaacaagtctatatctcttccctggcactgttaaaaatgttaaaacatggccgtgctggagttccaatggaagttatgggtttgatgcttggagaatttgttgatgattataccgtcagagtgattgatgtgtttgctatgccacagtcaggaacaggtgtcagtgtggaggcagttgatccagtgttccaagctaaaatgttggatatgttgaagcagacaggaaggccggagatggttgtggttggtatcacagtcaccctggctttggttgttggctttctggtgtggatatcaacactcagcagagctttgaagccttgtcggagagagctgtggcagtggttgtggatcccattcagagtgtaaacggaaaggttgttattgatgccttcagattgatcaatgctaatatgatggtcttaggacatgaaccaagacaaacaacttcgaatctgggtcacttaaacaagccatctatccaggcattaattcatggactaaacagacattattactccattactattaactatcggaaaaatgaactggaacagaagatgttgctaaatttgcataagaagagttggatggaaggtttgacacttcaggactacagtgaacattgtaaacacaatgaatcagtggtaaaagagatgttggaattagccaagaattacaataaggctgtagaagaagaagatcagatgacacctgaacagttggcaataaaagaatgt

SEQ ID NO: 275153 - DNA, 640 bp, Homo sapiens
cggacgcgtgggtcgacccacgcgtccggacccacgcgtccgcacagtcaggaacaggtgtcagtgtggaggcagttgatccagtgttccaagctaaaatgttggatatgttgaagcagacaggaaggccggagatggttgtggttggtatcacagtcaccctggctttggttgttggctttctggtgtggatatcaacactcagcagagctttgaagccttgtcggagagagctgtggcagtggttgtggatcccattcagagtgtaaacggaaaggttgttattgatgccttcagattgatcaatgctaatatgatggtcttaggacatgaaccaagacaaacaacttcgaatctgggtcacttaaacaagccatctatccaggcattaattcatggactaaacagacattattactccattactattaactatcggaaaaatgaactggaacagaagatgttgctaaatttgcataagaagagttggatggaaggtttgacacttcaggactacagtgaacattgtaaacacaatgaatcagtggtaaaagagatgttggaattagccaagaattacaataaggctgtagaagaagaagatcagatgacacctgaacagttggcaataaaagaatgt

SEQ ID NO: 275154 - DNA, 1120 bp, Homo sapiens
tctcggtgccaagtttatttaagatggagtcttgctctgtcgcccaggctggagtgcagtggcaccatcttggctcactgtaacctctgcctctggggttcaagcaattcttctgcctcagcctcctgagtagctgggattacaggtgacccgcccacctcggcctcccgaagtgctgggattgcaggtgtgagccactgcgtccagtctcggcgccaagtttaagaagagcatattgtcatggccttacatcagttatatgctcctgggtaacaaactaccccaaaatgaagcgacttaaaacagtaagtccttgttcatcatcatgtgggagtatggatgtgggcagggctcatctctgttcactgtgctggccacgctagcaagggcaattaacagttggcaggtaggctggcttgtgcttcccattgccctcacccacatgggctttcagccagggtgcctctgatctcctcagcctgcctctccaacagtctagctcaggcttcctcccatagtggctgaattccaaaagggcaggagcagagtttgacaggctacttgaggacatgtttagaagtcacagtgtcacctctgttgcattcccttgcttattgcaagttatgaggcctagcataggccaggagtgctgcctcatgcctgtaatcccagccctttgggaggccaaggtgggaggatggcttgaggccaggagtttgaaaccagcctggacaacatagtgagaccgcatctctaccgaaaatgaagaaaaaaaaaaaaacaaggcttagcacaggcttggagagtaggagatagactctggtccttaatggtgggacttgcagaaaccgtggccatttttcatcacagcctttcctatactgtgtgacctcaagaacttcctgctttaggatgcccagttaataatatggtatctgtgggatggagtgaactctttaacaaatatttaccaatacttactttgagcaagacactgtgcttggtgatggttgagtaccgagaagttgcaactggtggttcattctctgtggggagatggcgaactggaagaagcgaagtttgggcctgtggtaggtgctgtgagctgttgggtggagag

SEQ ID NO: 275155 - DNA, 401 bp, Homo sapiens
ccctgtctcaaaaataacaattaaaagattaaaaaaaaaaaacaacaaaaaacgagtgagagttatctgatgcttctcattctcctggtattaaatctgggaaaagttcatgtgaatttatgtgggaaacaggatcagtgaaagaactagggagagttgcctccgcatgagcacagaggctgcattatcatttacatagagcctctccattgtgccaggcaccgtgccagcctccaggtatgcaaaggtgaacaagcagacattgttctagcctttggtacttatgatttggaccctaataaatatttagttccaaattgtggatagtgttgcgaagggaaaagctcaagttcttagaataacagggaggcctggctgttgtgatctggaggatgagaaga

SEQ ID NO: 275156 - DNA, 145 bp, Homo sapiens
ggaataaggggtccagggagagaaagaaagaagggggaatagtcgatcagtggagcaatcagaacacacacaacatttatatattaagtttactatcttataatagtgtggctggtggtgccccaaaataattatattagtaaca

SEQ ID NO: 275157 - DNA, 417 bp, Homo sapiens
aaaataaggtaatgaagtttgccacatcactggactcttcctttcacaaaagattttgctgtagcatgagatgctgcttgataccattttacccacggtagaacttctttcaaaattggaatcaagcagcagtgcattcctgtactcccagctatttgggaggttgaggaaggaggattgcttgagtccaagagttctgggctgtagcacactacactgactggttgtctgcactaagttcggcatcagtatggtgacttcctgggagtagggaccaccaggttgcctaaggaagggtgaactagcccaagtcagaaatggagcaagtcaaaactccaacgctgatcagtactaggatagtgcctgtaaatagccactgcactccaacctggacaatagagcaagaccctgtctctt

SEQ ID NO: 275158 - DNA, 448 bp, Homo sapiens
cttgtgcaaactggcccttgtcccataactcttctctgggagaagcacagtgattgaggaggttggaaattgtactaggatggctgatgcagtttggatgtttgtcccctccaaatctcgtgttgaaatgtgatccccagtgttggaggaggacctcatgggaggtgattggatcatggagatggatctttcacgaatggcttaatgccatccacttggtgatgagtgagttttcactctagcagttcacgtgatatctggttgtttaaaagagcacgatatctcctccctctgtcttgttccctgtcttgccatgtggcatgcctgctcccccttcaccttctaccataattggaaatttactgaggtttcccagaagcagaagccggcactatgcctcctgtacagccaacagaatcatgagccaaaatagacctgttttctccat

SEQ ID NO: 275159 - DNA, 452 bp, Homo sapiens
tctgtaaatatatgtgctttcctgaccagcctctatcccagagttaccatggctactggtaagttttatcttctttgcaaccattttaacagtttttcttaagaaccaattgttttccttacaatagaagagtgtcttccaaaatagaccctgcgcatatccatgatgacagatcagtagataaactgtataattggcagcaggtaatgttttttctcactccactgtccacactcccctgtaaacaaacaatccacccccatagagagggggcacattttcttaagttctcaaatgtcacaagtatttttcctcccttttcaaagtcactatttagaaaatctctaatgggattttaaatgcttattttagtatatttggccaaggatattggcacttttcttccataaagtatttaaggtttgatcaagaccctcacagtgagcactgtg

SEQ ID NO: 275160 - DNA, 257 bp, Homo sapiens
attttaaatgtacaattcagagttatgataaatgcatattccaagtaaccaactactacctccccctactttaggtaaaatgcatatacagtgaagtacagatttttaatgtacaagtcaatgagtttttataaatgtatatacccgagtaatggctattcctctcccaaaaagatatagaacactgtcatcacatcaactctgtgttttggcccaactctataaatgccctttcacttttctactgcctttccaca

SEQ ID NO: 275161 - DNA, 514 bp, Homo sapiens
ctggcttgtgctgaactggacttgcaagtatttgtgtctgtgatttagcattatttctggggagagagtctccctgtttaatactaatagtcttcccaggaagtttcattagagtgaactacaatttttattgcccaggatttaacaaactccaatctaaagtctcagtgccactttcgtccaggctcccagtctcagatgaaattctaaattctaacaatgtcagcccaggactcagtgcatcacccaagtttctttgctgaatctcatacaccagagacctcacgcctcttctcttctcatgtgcacctttctcctgaaatttctctgctcaacactcctgacagcaacctgtctgcagatgcaccaacagctgctgctgctgaaaaatgggcttgtctctctcacgggggctatgatttctggcatatgcatgcctcctactgtctgtttggttttaaagcaattttcggcacacctgcttgcttgaactttactgagaagccctctcaag

SEQ ID NO: 275162 - DNA, 438 bp, Homo sapiens
ttgcctcctacctttttgcagtccacccctctgcgctccagacagacataggaaccctcgccctccttggtagtacatcggaggcagcaccctcgcacgtcagcgggtcctctccggggctcctccctcagaagcgggaaagtttgtcgtcctcaaactcctacccggctgcgcttatctgaggcgcacctggcgcccaggagaggcgagatggcgaatcccggccgcctagtgcccattctggctacggattaataaaagggcagtggggctgctgctgtgtcctttaatgctgaagacactggatgacattttttacagaattcacaaaaataagtttgtgaacctttggtgcctcttcctaatatcacttattgggatttttttttaaaccatttcattcattcgtgtaataaacgcacattgcaagatagtacg

SEQ ID NO: 275163 - DNA, 523 bp, Homo sapiens
aatactcacagaacattgtaggattatgaattagcttaatttcaatactgttgtgtcgcaggaagtaggaaggccaaagaggagggagagagacagagtacaggtcagtggagcagtcagaacacacacagcatgtatcaactaaactcactgtcttatatgagcacagttcttagaaccccaaaacaattaccatattatcagcaacgatcactcatcacagatcactataatcacagatatacaatgaaaacttctgaaatacttcaagaattaccaaactaacacagagacacaggctcttcaaaaaaaaaaaaaaaatggcacaaacagatttgcaagatgtagttgtcacaaaatttccatttgtattaaaaaaaaaacagcctggacaacatggtgcaagcctgtttctataaaacaaacaaacaaacaaaaaatatatataaaaaattagccaggcatggtggcacacacctgtggtcccagctactacccagaaggctgaggtaggaggatcact

SEQ ID NO: 275164 - DNA, 304 bp, Homo sapiens
catctttccattctgtgaggtcagtggtaagtaactcatggaccaagtccagttctgttaccattttgatttctatgaagaatcttcgttgtaaattttgaattaatggagttgaactgcatataatatgggactgtttttttgtttttcttgatgttatgtggccttacccacttatgtgttgaaggcttttcataaaggcaaggagataggttgttaggaacctacgaaacaaagttgaataggggaagccaacaagggatgccagcatctttcaatatgtagtaccacaagttttctgcca

SEQ ID NO: 275165 - DNA, 1831 bp, Homo sapiens
gccactgcactctagcctgggcgaaagagtgaaactccatctcaaaaaaaaaagtgaggaaagaaatggaaaaatggtccctcccattatgaagcctgttgtcctaaccgagtatgcatttatggaatccctgaaaaagacgaatcagtgtatatctgcatatctgtctatctcaactgtcacagccaaactccacaccaaaaatcataaccaggggcattgtaagcagtggtccttgtggatttttctcctgctgggccagttttttcccctataataattacaaacttcatacatgagtttggtactactctagaggaggctctagcaaaactaccctgctgtagaggagcaattataggaactctgcaattctgatgacagttctaaaaacataatgtgaaggtacgaactcattaatatacagttctctgtgccaggttctgtgctaagaccttcatgtagcttttcttatttagtgttcactacctatgatgtcgatattctgagcaccattttccagatgaggaagctcaaactcttctgccaatgaggccaacaccatagagtggtgtttgtttataaaatgtatattttattgcactcaaacgatgtacctggcactggtctagatgctggtgctataaagttaaataagacatgatccttgtcttgaagaagctcatagcctaatgaagctcatttccagttacatttgagaacttctgctctttggggctagtctaatagcacacaagagatttactcaggaacacgtatcttgaaggttgggaagggttggagaagaaatacgaggataggaaaagatatggctgaggttaaaactgaagggaaaaatcgaagatggacagaaagttggcactcacggtgtgtagaatacaatgggcacaagcatggatgagagagtgctgggttgtgcaaaagtgtcagccagcctggtgtttctctcttggatgaaggagttccacactgaggcacaatataaacaatgaacttggtgatataggacaatagtagaaaatcctaaaaaccaagcaaaggagtttggatgtagtgaacagataacgaagaactggtacaaaatctgctgatgcaaacactgctggctttttaatatcaccagattgtgaacacctattatgtaaaaagtgccagaggaaaagatttttgtcaaagtaacattgaccctgatggggggataatatgaactagaagatcagtctttggaaatccttggactaatcaatcaaagagtggcagtagccacagaggatacagcctgacctcagactaattcagagaaaacaatgggcttgactcagtgagtagatatgggagaagagaagaaggaaagaaaaccaaaaggatggtgggatccctagaactaaagagaagtctaaggcttagctacctggttaggtagaactgtggtggagctagtttgtcaacaaggtttagatcttgtaaattgtccacccaagtgagagtattccttggagatgttaaatatgtcacccaaactataaatcaagacacgttgggtctcagaaaagatgtactcttctgagagtacaggaagacaggggaacgatctggaaaacatcatttggatgctaaactattagaaatttcaaggtgttataattttttatggatacattagggttaactgggtagtcagaactttaggtgactcgcaggcctggttagaggggtattgctcccacaggtgcttgaaagagcatctctaagaatgagagagggacagaacagaagatctggagaccacagactgtatgacctgggtgat

SEQ ID NO: 275166 - DNA, 275 bp, Homo sapiens
cccacctgctcattactagcgaaatcagtcacatgtgaactgcacaaactggccagtgataaaaatgagccccatgtgagtatggaaccccaggaaataaatggtcgtaagttattctggagctaatataacaaagaactgatgataaatatagaatgctcaatatagttacagttataggaaaaaaatgaagaacccaaaacaggcatttcttttttttttttttttttttgagaaacgcgcatattataagcaggtggggatcccgagctcaa

SEQ ID NO: 275167 - DNA, 701 bp, Homo sapiens
cggcattgagtggcatgtgactgatttagccaatgaaatctgagcaaagtaatgtgtaataccccagatggacactttgagtgagtttgtatagacagtactttgccactgtttatcctcttgccatagtagcagctccttcagcctagatccttgaagacttggagcagagcctccagtcagtgctcagtggatgtataacatgaaagagaataaaatctttgttattataacctagtcaaatctgactgctacagttggtattaattaatgtcttctttaaaggaacatttatcaaataaacacatctcagataaaaacagttgttctcacatggccactcaataccggtattgagcggcaattgtgattgggagttcattcatgatttggctctctgcttgtctattgttggtttattcgaatgcttgtgatttttgcatattgattttgtatcctaagtaaatgtctccaaattgtatgccattaatttgcccttaaaccaaatttctattaattcctacatctgcttgcttgaagatatctgtggtagcagtggtaatagtgacagcagtagcagtggtaattaataagaccaaagaaattatattttacagactagaagtgcttttaaaataatgattaaatggattataatcagtttaaaataatgtggtatgtttacaaataataatagctga

SEQ ID NO: 275168 - DNA, 269 bp, Homo sapiens
ctttaatcacacataatctctccatccagagttcggtgtacccccacctccattatttgtcaagtttttcttaatttttcttagtggtgatgtgaaaattttgtcagatggaacaaagaaattctcaaagaaatggggttgtatgatttttgccattacttgtatttctagtgcctgtgtctctcatttagtaatcatttctcaaaaagcaaaagtcttcatattactataaagactttttatttttagagatcaagaatcaggaagcc

SEQ ID NO: 275169 - DNA, 431 bp, Homo sapiens
agagcagcagactccctgacttcatgccccagcccttccagggtcctgtaagcttctggctcccttctgtggcatgcatcgagggtctcaaatgtcatctgtttatttgatacactgatatggtttggctgtgtccccacccaaatctcatcttgaattcccacatgttgtgggagggacccggtggaaggaaattgaatcatgggggcaggtcctttcagtgttgttctcgtgatagtgaataagtctcatgagatctgatggttttaaaacgggggagtttccctgcacaagctctctttttgcctgctgccatccatgtaagacgggacttgttcctccttgccttctgccatgattgtgggctttcccagccacatagaactgtaagtaagtaagtccattataaacctcttttgcaaattgcctgg

SEQ ID NO: 275170 - DNA, 419 bp, Homo sapiens
acccacgcagaggtgtgccagctttctgggcatcccttgacagtcaaattgacacataaaagaaccattataccttcttgtccagaagtctttgcagataaccgtccatgaattctaatgaagcctgggaacctatccagagctggggcaagaaaggatccatgcaagtaggaaactagcaaaacctgcaggctccagcatcctgccagtcatctgcagaccccagaggggtccacaagcaagtgctcaacaacaccgtcctagttacattcgggtcatgtggcttcttgaccaggaagagagaaacctctcaaacaaaagctaaagagaatccacagctgccttctccaaacctgttacagctggaaaagcaagtgatgaggaaatcacatgagctcatgcttgtgaagcactctgta

SEQ ID NO: 275171 - DNA, 473 bp, Homo sapiens
acctaacactgaagttcccaaatcagcatgtgaaactttctctaagatagaccatatgataggacacaaaacaactcttaataaatttaagaaaatcaaaattatatcaagtagtctctcaaactacagggggataaaatcgaaaatcaactccaaaaggaaccttcaaaacaatgtaaatacatgaaaattgaataacatgctcctgagtgatcattgggtcaacaataaaatcaagatggaaatttaaaaattatttgaactgaacaataatagtgacacaacctatcaaaacatctgggatatggcaaaggtgaagctaagtggaaagtacatagccttaaatgcctacatcaaaaaatctgaaagagcacaaatagacaatctaaggtcacatctcaaggaacttgagaaacaaaaacaaaccaaacccaaacccagcagaagtaaagaaataaccaagatcagaaagg

SEQ ID NO: 275172 - DNA, 399 bp, Homo sapiens
ccatacttcttgattactgtaatttaatagtaacacttgaaattggatagtgaaagtttttctaactttgttctttttttcttttttattcctgtttatcattatctctactttttttcttctttccagcctcaggataagctattctttctccctcatagactatcctttaacagcccgaatcctagacttcagagtctatattcaccactttaatttctcattacctacttcctctttggtccttataggttggccttcttttgccctccccctcaagaaactcctttctcacagcatttgcttgtcaaaaatgtttccctttttcaaatccttgttttactgtatggctcaagcataggcactattgaccatctctgatgcttaaactcttctcct

SEQ ID NO: 275173 - DNA, 468 bp, Homo sapiens
agtaggagaggggccaaggactcatgctggcatcccgccagccttttgacacgagtcacccttccgccactttataaaaaaaggtaggcctcttatcagtggtaggcaatagcagggtagtgaaaaccgtttccccaccaccgccaaggcagggaatagaggctgcattgtccttagagaattgtaaatgagtaagcaaccgaaagttctttgttatcccctgggccagcaatcctaaacaatgtcagtgataaaacattcctccctgaaaaagtattttattggtctaagttctaaatctaaataaatgctgtcattaccactgagttttaattatatgtgaacttcggccgggcacagtggctcacgcctgtaatcccaaaatgttggtattacagttgtgagccgccacgcctggccctaaatgttttcttaaattaaacacttataaatcttccagaaataaaa

SEQ ID NO: 275174 - DNA, 875 bp, Homo sapiens
gaagtcaagttctcatgagttctcccaaaatccaccgctcttcctctttccctaagcagcctgaggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcagggcaagcaatggggctggacacacaggtcggtggcccaaaaagagtgctgaattattgctgcatcatgcttaaaaacgcagagagtaatgctgaacttaagggtttagatgtagattctctggtcattgagcatatccaagtgaacaaaggagctaagatgcgccggcggacctacagagctcatggtcggattaacccatacatgagctctccctggcagattgagatgatccttacggaaaaggaacagattgttcctaaaccagaagaggaggttgcccagaagaaaagatcttccctgaaggaacttgcagaaaccagacctgtggccgggagtaaatccgactaacacctctgttctcagatgacaaagcaacaaagaaccgttaggacacccgcccgaaaggtctaaacgcacagggggcgacacacagaggacagcgatgcctccaacaaaccgggcgacggggcgttaccaaaaccggggccaggctgaccaagtccgaccagcaccaagcccgcacatcccacggagaagacacgagccgggacagcagagaaacaaaactgcacaacacat

SEQ ID NO: 275175 - DNA, 288 bp, Homo sapiens
gaagtcaagttctcatgagttctcccaaaatccaccgctcttcctctttccctaagcagcctgaggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaaagatatcccagaagaaactgaagaaacaaaaacttatggcacgggagtaaattcagcattaaaataaatgtaattaacagg

SEQ ID NO: 275176 - DNA, 1042 bp, Homo sapiens
aggcccgtgtggctacttctgtggaagcagtgctgtagttactggaagataaaagggaaagcaagcccttggtgggggaaagtatggctgcgatgatggcatttcttaggacacctttggattaataatgaaaacaactactctctgagcagctgttcgaatcatctgatatttatactgaatgagttactgtaagtacgtattgacagaattacactgtactttcctctaggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcagggcaagcaatggggctggacacacaggtcggtggcccaaaaagagtgctgaattattgctgcatcatgcttaaaaacgcagagagtaatgctgaacttaagggtttagatgtagattctctggtcattgagcatatccaagtgaacaaaggagctaagatgcgccggcggacctacagagctcatggtcggattaacccatacatgagctctccctggcagattgagatgatccttacggaaaaggaacagattgttcctaaaccagaagaggaggttgcccagaagaaaagatcttccctgaaggaacttgcagaaaccagacctgtggccgggagtaaatccgactaacacctctgttctcagatgacaaagcaacaaagaaccgttaggacacccgcccgaaaggtctaaacgcacagggggcgacacacagaggacagcgatgcctccaacaaaccgggcgacggggcgttaccaaaaccggggccaggctgaccaagtccgaccagcaccaagcccgcacatcccacggagaagacacgagccgggacagcagagaaacaaaactgcacaacacat

SEQ ID NO: 275177 - DNA, 546 bp, Homo sapiens
gtagtaagggttaagttcccagttaaccctccaatgccaactaactcccctgcatcccaagacatagtgatcacagaactcaagcagtgctggcagctgtgtccagtgctgtttctagggacccaaattggcccccaccttagccagaggagctttgggttctgaagtgaagggtcattttaggtgcccccagaaggtgggcactgatggagacacatggctctccactctgccttctaacagacactgttcaccaccaggcatgagcaaaacacttaacagagcgcaatacctcacttaatctacaaaaccacttttggagcttccagatagctacatgcatggaggttcctggagggtggtgtgtccagggagggcatggaatctccgtgccccttccccactaaattaaaaggtaaataacggccgggcgcagtggctcacgcctgtaatcccagcactttgggaggccaaggcgggcggatcacctgaggtcaggagtttgagaccagcctgaccaacatggtgaaatccaatctctactaa

SEQ ID NO: 275178 - DNA, 130 bp, Homo sapiens
ctgctgagtgctccctgtcattcctatgttctaggttcttttctcttttctttatcctcaaaaattttataggtcttgtggtggcctttttttgagaaatcatatttgaataagtcatgctcaaaaggga

SEQ ID NO: 275179 - DNA, 495 bp, Homo sapiens
gaggttgcagtgagtcgagattgcaccactacactccagcctgggcaacagagagcgactctctcaaaaaaaaaaaaaaaaaaaaaaaaaaaagctaactttatgtcttgagagtttgtaccatttttctttgtagtggtcaccttgctaatgcattagttctgagatatttatctccctcacatgtgtgcaaggaagtccctgttatcgaatacagatactttaacaagcagacaaagcagaaacccaaagtccatactaggaacaccctaaattttccaaaagcaaaagttctcccgaaatggagacatacaagggacttttattattctgttactagtttctataacatttcttctttcaacagagtatatgtttcccatttaacccagagcaacattaacttccttagcaagtccagttctaacttccaacaagtccaaccactgtttttgaagagcatatcagtaactatattaagatgaaggtaaccac

SEQ ID NO: 275180 - DNA, 388 bp, Homo sapiens
tggaagcaagccaagtgttcatcagctggtgaatggatgagcaaaatgtggtccatccatcccacgccccagtggaatattactcagccttaaaaaggaaggagggctgggtgtgatggctcatgcctgtaatcccaacactttgggaggctgaggcaggtgaatcacaaggtcaggagatcgagacccgcctggccaacatggtgaaaccccatttctactaaaaattagttgggtgtggtggcatgcacccgtaatcccaactactcgggaggctgaggcagaagaattgattgaaccagggaggtggaggttgcagtgagctgagatcacgccattgcactgtagcctgggggacagagtgagacttcatctcgaaaaaaaaaaa

SEQ ID NO: 275181 - DNA, 355 bp, Homo sapiens
ggagcggcagcggcaaggcagcccagtttcgcgaaggctctcggcgcgccgcggcccgcaggcacccggcacgcgccttccccgcaggcacccggcacgcgccttccccgcaggcacccggcacgcgccttccccgccgccaggatgcccaagaggaaggtcagctccgccgaaggcgccgccaaggaagagcccaagaggagatcggcgcggttgtcagctaaacctcctgcaaaagtggaagcgaagccgaaaaaggcagcagcgaaggataaatcttcagacaaaaaagcgcaaacaaaagggaaaaggggagcaaagggaaaacaggccgaagtggctaaccaagaaacta

SEQ ID NO: 275182 - DNA, 347 bp, Homo sapiens
  misc_feature (224)..(224): n is a, c, g, or t
ggagcggcagcggcaaggcagcccagtttcgcgaaggctctcggcgcgccgcggcccgcaggcacccggcacgcgccttccccgccgccaggatgcccaagaggaaggtcagctccgccgaaggcgccgccaaggaagagcccaagaggagatcggcgcggttgtcagctaaacctcctgcaaaagtggaagcgaagccgaaaaaggcagcagcgaagtttagngtgagaagtttgagcactcacagttcatacagaagaggacaagattaattcccctgacattagaggagttgttggataatcactaaatttgctccttgttaaataaaggataaatcttcagac

SEQ ID NO: 275183 - DNA, 131 bp, Homo sapiens
cttgataaggacacgtcagccctcgaggctgctgacgggtgactgtgcttcggaggggaaaagtgatactacgctgatgtggttctcgtagaaggaacggggcgggtcgtaaccgtagctacaacgtcgcg

SEQ ID NO: 275184 - DNA, 853 bp, Homo sapiens
ggtctgagcagtaaagtgctagtcccaaagaaatgatataactgttactaacattagaataaggttcccatttcactttttgaagggcgtgaaaatcttactgctcctctgcaactgtgctcacttagtataatctaacagttaatattcttgtttaattggaaggatatatccagtgatttttaaacaacttttggaggtgtaattgacatacaataaactgccatatttaaattgaccaatctcacgagtttgataaatgtatatacccacaaagtcattaccacaatcaagagagtaaatgtttccatcagttctaaaattttccacgtcttcctttgataccctcccttgtctccctcctgcctcacattcctaacttcacagcaaaccttgctctgcattgatactttagattggtttgcattttctagttttatacaaatgaaaacatattgctatacactctttattggttggattaatttattgagagattcatccatgttctttgtatcagtagttcattttttttttggctgagtagtattccgttgtgtggatataccactatttatttatccttccatctgttagtggacatttgatttgtttctagttttctcatctacctcttgtcttttaacttctctttctttttcttccctttatccctcggtgatgcgttcttgcttactgccttagatcaggaattgtcaacatttgaccatttttgacctacaaaaactacagtttcatacagtagtgtttaataagtgtttttaattgaatattacttatttttacattcaagagtctctgcatgatacagaattgtttacatattgcttga

SEQ ID NO: 275185 - DNA, 433 bp, Homo sapiens
cataaaaaggaatgagatcatgtcctttgcagggacattgatgaagctggaagccattatcctcagcaaactaacacaggaacaaaaaaccaaacaccgcatgttctcacttataagtgggagctgaacagtgagaacacatggacacagggaggggaacaacactcactgaggcctgtaggaggagggtggggcaggagagagcattagggtaaaaagctaatgcatgctgggcttaatacctaggtgatgggttgatctgtgcagcaaaccaccatggcacgtttaactatgtaacaaacctgcacatcctgcacatgtaccccagaacttaaaaaaacaagcaataaaataattttaaaaaaacaaaagaagtgatcgtggacatggaaaactatttaccaagatggtcagtgcagccaggcaaaaaaaa

SEQ ID NO: 275186 - DNA, 1886 bp, Homo sapiens
atcatcaaaatcaagataattaacacattatcacctctccgtagttactattttgtggatgcatgtgtttttattttatttctgaaataattttagacttacagaaaatttgaagaaatagtacagagttcacatatttctaccactttgcttccctgatgttaaaaacttatataactgtagttcagtaatcaaaatgaggaaattaactttgatacaatactatgaattaaactatagccctttgattttcaccatctcctcccacccctaccatgcctttttaatattccaggatataatctaagatgccacgttgcattcattcgtgtcccctcagtttcctccaatctgtgacagttgttccgtatttccttgtctttcatggactcttgatgagtactggccagcttttttgtagaatgatcctcagtttggttttgtccacgttttcctcatgattagactaaggtgatgtgttgggggaagaagatcacaaggtgaaatgcccttgttatttcctatcggggtacaggatgccaacgtggcttattagtgatatttaccacgatcacttggttaaggtggaatctcccaggtttcattactgtaagttacttttctccctttgtaaatgataaacatcttggagagatgctttagactgtgctagcatcctgtttcttctcaaacttttgcctgctggttttctcattcattggtggatcttgtcaacagttactactgtggtggtctagtggggattttgtattttactcattccttctacattgattaattggaattctgtaaggaagaagtgtctcttctctcatacatttatttattgaattatttatttatgtccctatggatttatggatatttattttgtcctatgggattatgttatttcttgccttgctgtaaaggaatacctgacactgggtaattcctaaagaaaagagggccaggcatggtggctcactcctgtaatcccagcactttgggaggccaaagcgggccaatcgcttgaggtcaggagttcaagaccagcctggccaacatggtcaaaccccatctctaccacaaatacaaaaattagcagggcatagtagcacatgcctgtagtcccagctactcgtgaggcggaggcaggagaattgcttgaacctgggaggtggagggtgctgtgagctgagattgttccactgcactccagcctgggtgacagagtgagactccatcagaaaaaaaaaagaaaaatttattttggctcatggttctgcaggctgtacaggaagtgcttttttaactcctcaagctgcaacattaaatgcagagtccctacttagtgggcccaagtcaataaattcagcctgatctaaggaaggagaccacctctcttattgtctcatacctcagaaaaagaatgaggaagtaaaagttaaagaaaggcaaaaatgagatcaatagacagcccagcactgcacttcaggcctggtctggtagttaaaaatcaacccctgacctaaccacttgtattagctatagattccagacattgtatgaggaagcattgtgaaactttctgctctgttctgttctgtcttgattaccgatgcatgcagccccagccacgtaccccatgtttgctcaatcgatcacgaccttttcatgtggacctccttggaattgtaagcccttaaaaggggcaggaatttctctctcagggagcttggtttttgagacacaagtctgctgatgctcctggccgaataaagctacttcctttctcaacctggtgtctgaggggttttgtccacagcttgtcctgctacatttcttggttctctgactgggaagcgaggtgattagcagacagt

SEQ ID NO: 275187 - DNA, 638 bp, Homo sapiens
aggccacatagctacctacagtgacagaatcaaaattcaaactcaggtttatctagttccaaaacccatgttctttctgccacaccatgttagtagaaatggaaactattggatgaaatgaggaaaaacaggaaaagaattcactttttaaatgaagaaattagtgaaaaaattgacctaatgaaggaaacatttgtgctttcctatatttttaattttaagaataggatttcggaaggcgacagaaaatttagttcttagacatttaaatagaaagttgtgtgcccctatagaaaatatttgagaatttcttatactatcaagaaaaaattctgtgaattaagatgtaatttataaaataacatttcaatgggggtaaacaggccagaagagtgtgccaagttgtttgtgaatcattccaagcacctcagatgaaaactcacttttattaaaaaaaaaaaagacaagggtttatattcatatacactagtatatatgtacacagcagcatcctgcatgccaaagtagcttcaccgttagtaatccctcactttaatacctcttaggaaccaaagaatgcctctacaagcaaaaagatagttgaaaatagttaagatccaaagtcagaataggccaaa

SEQ ID NO: 275188 - DNA, 344 bp, Homo sapiens
cccaggctagagtgtagtggcgtgatctcggctaactgcaacctccacctcccaggttcaagtgattctcccgccccagcctcccaaatagctgggactataggcatgtgccaccacacccagctaatttttgtatttttagtagagacggggtttcaccgtgttagccaggatggtctcgatctcctgacctcgtgatccacccgcctcgacctcccaaagtgctgggattacaggcgtgagccactgcgcccagccttatagacataagtgaatatttgctgttactatgtttatatggctttttaaagtgatgttttaaaaggcttgtttataatgacaac

SEQ ID NO: 275189 - DNA, 520 bp, Homo sapiens
agctgcaaaaacatctgagcctccacttcacgcaggaattccctaccacttgtgagggagagcccataataagcggtgttcattaggattaatgcctgttgactgtgaaaacatgaaattgatcagaaagccagtttttgaaacaagactccaaggtgactgaggactaaggcaggaaggagggtgtctgctgggttcatcagaactgagtcctggtaactgcataaaagtgaaattgataatacaagagacatgattgctagaaagtgcaaacactgctgtggggggtgacaggcagcaaaatctgttttatttgctaccccagagaagtactgaagggcctagttctatccccagacactcccgtcctgttctaatgtggcatcttttatctacctactagggggagagggccacttcagacacctgagcatgttaataactggctgcctaccaaggtatgtgctatgaaagtgtaaagttgcatcttaacataagttttaaaattttcttggcatca

SEQ ID NO: 275190 - DNA, 492 bp, Homo sapiens
ttccatggcagaaggcccaaaccagagaactggccagacagttctgttgcacctaagcagcatgtgcacttttccaagcacatctcattcccttcctgactccaattatttcaacagcaccttctcatttgcaccagcccatttttgagccccaacaaactatgattttgaaatacctctgaagaccgcatgagctaaccactaagggtgacagtgctctagcctactcaatttcacctgagggcagaaacaaggcaggagagtcttgtcacctggattcggtgcttaggatactttacaatcttctttggatgcatggccaagtcagaagggtaacatcatctggggacagactcaagtaatatggcaccacgtctatggtagaaaaggttgaagaaaaacaggagaatcacatcacctaggtgttgggcttagcaatatgaaataatcccctcttttggccaactccagaataaagaagtgtgttgcatt

SEQ ID NO: 275191 - DNA, 453 bp, Homo sapiens
ccgagtagatcgcccaactgcactccagcctgggagcaagactctgtctcgaaaagaaaaaaaaaaagagagaaaaaaagaaaaaaaaagggcggccgcccatttttgagccccaacaaactatgattttgaaatacctctgaagaccgcatgagctaaccactaagggtgacagtgctctagcctactcaatttcacctgagggcagaaacaaggcaggagagtcttgtcacctggattcggtgcttaggatactttacaatcttctttggatgcatggccaagtcagaagggtaacatcatctggggacagactcaagtaatatggcaccacgtctatggtagaaaaggttgaagaaaaacaggagaatcacatcacctaggtgttgggcttagcaatatgaaataatcccctcttttggccaactccagaataaagaagtgtgttgcatt

SEQ ID NO: 275192 - DNA, 502 bp, Homo sapiens
aatgaaggataaaaaccatatgattttcttaatagatgcagaaaaagcatttgataaaattcaacaattcatgatgaaaactcaaactggacatagaacacacctaaaaacaataaaggccacatatgacaaacacatagctaacatcatacccaattggcaaaagttgaaagcctttactaagaactggaacaaggcaaaaatgaccacttttacccttttattcaacttcatactggaagtgttccctgagcaatcaggaaggagaaaaggcatccaaatttgcaaagaggaagtcaaattgttcttctttgctaatgggatgatcttatatctagacaaacctagagactccatgaaaaaaactcttagatcggacaaatgaattaaagttgcaggacacaaaattaggatacaaaaatcagtagcatttctattcactaatcatgtagctgagaaagaaatcccatttacaatagataagcgctccccctcccccacc

SEQ ID NO: 275193 - DNA, 117 bp, Homo sapiens
aaactatgccaggtgtgtagtgatatcctaaaatttggttttctcatgcctaatgtgcatttagatatcttcttatggaaaatatcttctcaaatttttatattcattgatatactg

SEQ ID NO: 275194 - DNA, 305 bp, Homo sapiens
tgcaggtggctggttccagatggagtccatgaccagaatgagaacttcatgcctgctctttcccaattggttatttctgaataatgcttttaaatcaatcaaatgttgcctttttcaaggctacctacagcccacacctccccagttctgagcctataaaaacctcacactcagccacatggggatactacctgcctttgggtggggacaatccaccttcaggttggggactacccacttctggtccatctctgctgagagctattctgtcactcaataaaacttctccacctttctcactctct

SEQ ID NO: 275195 - DNA, 323 bp, Homo sapiens
tattttttttaaattaccactatttaggcttggtcattcaattagctaagagtctggcaaaatccttgacatacagaagtctaaatagttgttgaaagaaggatgactaagatggacactattaattctatcctaactttcttgctacagtatatacaaattattacttgagcacctatgaaacatcaggcagtttcaatgctggagatacacagtaaattggcagacagacatccttagtatcatggaatttaggtatcggagtcaactcttaatcatattggaaagggaatacctgagttggtggtagtatgaaagcgggg

SEQ ID NO: 275196 - DNA, 571 bp, Homo sapiens
cacctcaattgtctttattatcatctgctgtcagatccttaatcagaaatgtgaacaggcttgatgatttattcaggagggaaaagaatctgtaggtcaagtgaaaaatttcacacacacacccatacacacactgcaccttcaaccttaggtactttcatttcattctgttctcagcagctctgggggcaactccagtgagatccaatattaaggctcaattaaaataagctccaattagtggagcttttttctctggggctagaaaagtcaggaaatggatattgggaaatgtaaaaagtcagctactgagaggaggctgcagacataaatgaacttatttgttgatttctacagttgctatgcagaggcctctgggagtaaaagcttaaccagtctaagctataaactaaaacccctgcagctaaacatgaactgtgtgaaacaagggctccattccagaacagaaaactgctgggcccagaaaattaaaagccagaggcattttccatttaaaactaaatcccagcaccgcctcccagccaaagaattataagcagtatcagattta

SEQ ID NO: 275197 - DNA, 1095 bp, Homo sapiens
gccatctttctccggttttcagcaatctcttctggtacctctccatctaaatctgtctttccagttcccaccaccaaagtacttggaattgttcaagccttagttcttgaggccccaaacactacatccacattgttcatggggcaatttttaaataaaaaatgtgtgaaagaattcctcttagaaatttaacatgtaacttttaatatgctactgaattgcagcaaacatgcggaaatactggcaaagacagctgtagatgaaacagccaagggagagccaacaattatggttggtgttaagttggatgaattgaaataagagacaaatacttcatagaattgtattaaggcatatgcatgaaaaaggagggaagcaattatttttgctttatttggcactgggcaggcttcagttggaacaaactatatttaattttacatgtcatactatataaagagaaaaaacttggagactgttcagagaacagcaactgatgaaaggtttgtgaaattagacctatgagaaattgtgaaaagaactgggcatgttcagtcaaatgcaggacatccaggtgtgatgaatggtgaacaattaactgtaagtatgtgaagagatggttaccaagtctcaggtataggggaaacagaaaggtaaatcatgggattaaaaaaacaaacaggccaggtgtggtggctcacacctacaatcccagcactttgggaggccgacgtggaaggattgcttgagcccaggagtttgagaccagcctaggcaacaaagcgagaccctatttctaccaaaaaataggaaaaattaactggtcatggtggtgcgcacctgtggtcccagctacttgagaggttgaagtagatggtcacttgggcctaggatgtcgagggggtagtgagctgtgattgcactactgcactccagagggacatcttgcctcaacaaaccgcatagcaatggaagtagagaccaaatattgtgaaaaggttaaactaaaaagctttgaagaaactgatggagttataatttagaattctgtatatactattattgaaacaattgaattcaattttatacttaatt

SEQ ID NO: 275198 - DNA, 218 bp, Homo sapiens
gagaaaagaaaactacctggtaattgaagcaggcaaattgctggaagcatgtaagcgatctgaaatctagttactttcacactgccattggatctcctctctactaaaaatacaaaaaattagccgggcgtggtggcgggcgcctgtaatcccagctacttgcggggctgaggcaggataatggcgtgaacccgggaggcagagctttcagtgagccg

SEQ ID NO: 275199 - DNA, 807 bp, Homo sapiens
aaatcaatgagcgttggccaggcacggtggctcacacctgtaatcccagctgtttgggaggctgaggcaggtggatcacctgaggtcaggagttcaagaccagcctggccaacatggagaaaccccatctctactaaaaatacaaaaattagcagggcatggtggtgcatgcctgtatcccagctacttgggaggctgaagcatgagaatcacttgaatcctggaggcagaggttgcagtgagctgagatcatgtcactgtactccagcctgggcaacagagtgagactgtctcaaaaagaagaagaagaaaaaaaatgcagtgagtttatgttgttacattgtaacatctcagcgtagctgtatgcattactctatagcatacctacttaagttttatgtcattcttgaactgtgatttttttttctatttgctttcatagtttggtgggccattgttatggactgaatgtttgtgtcccatcctcacccctaaattcccatgttgaagccccaaccttcactgtggagctggggctgctaaggaagtaattaaggttacacgaagtcacagtggagaatctgatctgctaagactggtgtccttatagggagagaccccagagagcttgttcccttcctccctgtgcacacaaacaagagggcatgggagcacacagagagatggcagccacctacaagccaagaggagaagcctcacaatgaacccccccccccaccctgctggcacctatgtcttcgacttccagcccccagactgtgagaaataaatttctgttggttcagc

SEQ ID NO: 275200 - DNA, 300 bp, Homo sapiens
actctgtttttcttttgttgcttgtactttgtgtgacatgtctaagcaggttttgtctaacccaaggtcacaaagatttactcccaggttttcttgtaagggttttctagttttagcactatgtaggtctatgatccattatgatttaatttttatgaatgttgtcaagtatgggtccaactttatttagagacagggtttcactctgtcactcaggttggaatgcagtagtgcaatctcaactcactgcagcctcagtttcctgggctcaagtgatccgcccaccccagtctcctgagt

SEQ ID NO: 275201 - DNA, 337 bp, Homo sapiens
gagcactgaggagcagtagtggctttgctggtggtggagatggtgatagtgattgtgaccatgaagataaaaagatgacaacgatgatgatggtaccgatggtgattgtagtggtgataatggtgatggttgtgatgatgaaaacgatgatcaggatggtaaggatgatgatggtaataatgatgaagatgatgatgatggtaatgtggtggtgacgatggtaatggtgataatgatgatgatgaagaggatgaagattatcacgatggtaatgatgatgatggtaatggtgatgaaggggttgatgatgatggtaatggtggtgaggatgatggtg

SEQ ID NO: 275202 - DNA, 483 bp, Homo sapiens
tcgtgcattggccactgagaaagaaaaatggaaaatagtttgttagttttttataaattgaagaatgaactttcaaaatgatccaccaatcccattattgggtattttttctatgggaataaaaacttgggtgcacatagctattataattgtttataatagcactatttataattgccaaaactggacacaagtcaaaagaccctcagtgggtgaaaggataaagaaactgtgttacatccatgcaatgaggtattaaccaacaaaaatgatgaatacatgacttatatgtgtacccagttggatgtatatcagaggattatgatgaacaaaatagaccagtttcaagagatttcatattctatgacgtcatttatatcctattttttaaaagataaaattatagtgtaggagaactatacagtgctcaagatcggtggtttccagaagttagagtaagagaatggtaaaactaaaaaggag

SEQ ID NO: 275203 - DNA, 403 bp, Homo sapiens
tgtaagggttgttttaagaggacctctggcctgggggtgagaggttgaacttggattagtggttctgtggctgagccaggtgccacagtgggtgccctgggccacaacagccatggagacctgaggcaccgccaaggggaagcctgagatcaacgaacctacctctccattttggcccagggctgcccctgatcccgggggtcccagacatgcacccaagtgctcggggcctgtgtgaactcacaggggtccctctggaggctttaaatactcaagggaaacacgacaatcctgaacccctgccacacaccacgcatgatttgctctggtaacagacatcccagcgtcagacagcactgccttatctttgcaaagctgggttttggtggctgctgtgattaaa

SEQ ID NO: 275204 - DNA, 214 bp, Homo sapiens
tgaaaaatgagggaaggaaattttggagagaatgaatgtttgtggcacagatggtggtggtgatggtttcctgggcttatccttatctcaaaacttattaagttgtatacattaagtaacagcttttgtcaattacactttgataaagtggtttaaaaacaaaaaacaaaaaacacagattttaataaacctattagattattcagcaacaaca

SEQ ID NO: 275205 - DNA, 507 bp, Homo sapiens
taatgactcataggtgaaatgaattgtaattgtgtaaatattaagtgctagaaataggctcaatttgaaaataaaatgatgcacagttgaaggaaaactcattttttaaagatggtggattctagatgaaaacaatggagggaaatggccaatatggctgtctagaagcagctactgtgtgtagctctcatggagagaaacgggaggggtgagtaaatacaacaccttcaactgaaacatcctagtattcacaaagggagtaatcaaggaaacaacttgactcatggagaacaaagaaaaccaagacaggacaaagcccatctgggagaaacacggagacaggggaccctcccccacctaaggaatccatgcttctttgacagatctttgcaacccttgggacaggagatatccttgtgaacgcagtctaccagggacttcagtctgacagagctacatggagtcttggcagagcaaccactcagacatgcgtggaatcactggagc

SEQ ID NO: 275206 - DNA, 678 bp, Homo sapiens
ggcaaaaagcaattgagattccaggaggcttgcgataaataaaaaggaaagttgggccagaggcgttggcaatcaagatcttaagggaggagcctctgatcaccccactaggtgaccgcagctttggtgaccactaatccaatgctctcacctccctacctctgtacgagggcccagcttacaaactaaatgtgccactgggtagaccgggaatgtcagtaacacctgaaggtcctttaaggagggataaagaacaataaaaacctttccctgaagaaaaacaaaacctttccctggacctcaagctctcccctgactattattctccaaatatttgctggccacaggtggctcaagactgcacccatgggaaggaccccacgatgacctatttctgtgatctaccacctgggcaactctccagacaatgtttcaaaagtggatttccccagcaccttgggaggctgaggagggaggactgcttgagcccaggagtttgagacccgcctgagcaacagcgtgagaccccgtctctactaatacaatatttagccaaggtgtggtagttatgcctgtaatacaccagcagcatcatgggaggctcgagcgaggtggatgagcattgaagtcaggtagattgaaaccagcctggaacatggcagaaacccggggatcctg

SEQ ID NO: 275207 - DNA, 146 bp, Homo sapiens
gacctcatcttcaccagttatatctgcaacagccctatttccaaataaggtcacgttaggaggcgccgagggttaggccttcagcatatcttttgtggggaggcacaattgaactcataacaaatgggaaaagtcatgctaagaag

SEQ ID NO: 275208 - DNA, 417 bp, Homo sapiens
cttgagcatttcacttatggtatgccagacactattcaaagcccttagcttaaatcatttaatcctcacaaacctgtgagttgggttgtcttattatccccattttgcagaagtgagttttgtgagagagaagctaaatacagcacagcaggagttgctcttggacctcaagcatcctggcccagagcccaggtgtcgccactgccctgggcttcctcttagtcataccagggacttgggcactgggcacaaaatctcctctttatataatgtagtggtaccaatagcttctattgattgagattcttttctgggcttggcactgtatgaggcacttggcttctggtttaatctttacatgatcactgtagttatagatgttattatcccagatttataaataaataaggaaacttc

SEQ ID NO: 275209 - DNA, 475 bp, Homo sapiens
  misc_feature (69)..(69): n is a, c, g, or t
cccacaccctcagcccacaccctatcaaacatgtagaatcagcagaggttgtggggaggggccccactncacacccagacagatgtgctctgttccccgcacagctgtccaggcggtagcccatctgcgctcacttcctgcctcccagctccagcccctcacacctcccacacaagggcggggaagtctggtcctgagattcatcccaaagccaatgttgaggcggccaccagcccggcaaagccccagaccctggctcccaccttcccctctcctccacaaggagtggtggaccaggaagggcttcagcaaggtggagactttgcctaagccactctggaggactctgccttgaagttcagcttcagtctcttggcagttgtgggagctgcctagctctgaagttctcccagcatcatgtgtccacatgaaacacgccaatatcactgatctgatttcattattttgtcaagat

SEQ ID NO: 275210 - DNA, 333 bp, Homo sapiens
aatagtttcatgcaggaactacttacatgaagtttgtatagactaaagtatttctgtttagtgccgaaattatgtctggattgtggaggcagattggccaccaccgttcaaaaacaacaacaacaaacaacaggcaacattttaaagcagggtagaaagtcagttgttcagtggttacaacacagactcctctatggttccagtcctggctctgacattcactatccatgagatcttggtctctggggataacaatgatagctatttccttgggttattttgaggataaagtgaaataaagcatgtgaagtgcttagcagggtgcacagtaag

SEQ ID NO: 275211 - DNA, 662 bp, Homo sapiens
atctttgatttgctctttgagagttcttgcttatagctgtgttagagttctgtagacaaaggactttctattcactacagtagtgagcataggatcaatatttgcaaatgctgttttacacttgggagctgtgttgtaggcagtttaaaccagcgttaagcatcctggccaaaagaaaatataagtgaaattagacatattttagcatgtagagatgacaatagtgtgacattggtttttaaagaccactggtagatgttcacatgcgtgatacactgcaattacctctgtcttccctcccatggtacctgattggagactcttactggagtaatagtttcagtttcagttatttaaacccagtgactattgtgatcagttatgggcagtaaaaaggtaaacacagaacctgtctataagtagcttgttctcgtgttggagagtaactaataagaattagtatgagaaagcattaagtcccctaagaggtgcacttatatgagttcagtcagggaatcaggaaaaccttcgtaaagaaggagatatttagctggctttaaaaaaatattggcaaggtttgaatggaggaatgattttttaggcagagagcagtcagtgtaagtcaatgctaagtcaaggatgtatgtagggaatggggagtg

SEQ ID NO: 275212 - DNA, 353 bp, Homo sapiens
tgtatttacgttggtcaaaagtaattgcgttttttaccattgcttttaatgtttaatccttagcttttcctttgagttgagagtgacccttatatccttccaacaaatttcttaagttaatctgttaaattaactgcttgtaaccagttgtagtatttatagcactgcctaaaaatccaggactcaaataacaggtaaactaaattgtggcatgattttgagagtttgttagagtttaagagaatgtattttactgactgtgatgcttagaacattctattttgaatagcatgagttggtgacagaggattaattttcttcctgtatctgtaataaataacatttccataata

SEQ ID NO: 275213 - DNA, 310 bp, Homo sapiens
tttttcatctttaaagctcctccttgctatgtcctaactgggaagtactcttactaactagatatcaaggtggtggggaaggggatgcaggggccatttcaacaaagcatctacagaaattagttgttctgttagaggtagcaaattttacccaactcagtctagcttcagtttctgaattgtttcttaaattagattgtaagctccctgagggcagctactaagtcatactgcttttgtattttcctgaagtattggacacatagtagattctcaataaatatttgttatttagttttttcagtgaaat

SEQ ID NO: 275214 - DNA, 642 bp, Homo sapiens
taccccctcacggattactcaaatatttattatttgttgtgttgggaacattcagaatcctctttgaaaatatacaatatttgaaaatatacaataatatacaataagtagacaataaataatcattaactgtagtcacctaccctgctttagaacactggaattcactcttcccatctttctagctgtaatttgtatccgttaactctcttttccctatgacccttgcccctctacccttcccagcctctagtagcctctattttactctctacttctatgagagtaactttttaaattttcccatatatgaaagaggacatgtggcatttgtgtttctgttcctgacttttttcacttaacgtaatgtcctccaggctcatccatgctgccatgaatgacaagatttcattctttttttttttatggctgtatagtattgtgttgcgtctatataccacattttctttatccattcatctgctaatgaacatttaggttgattccagattataatgtttatactgtgaatcatacatactttatgtacaatgtgtagcatagacaattcctcataatagaagctcaacaaatgttggtactataccattgcctttcctgctctccttttctcactcctcc

SEQ ID NO: 275215 - DNA, 272 bp, Homo sapiens
gttgttcaaggtcaactgtatatggttggctctcacgatctaatattttacataggaatcttatatctctgtctgtcataaataaaatgaacttaaaatttccttttcttttactttttgttttaccaatcaaggttatgctagcctcagaaatgactagagttgcttttattcttttctattttctggaacaatttacttagataaatcatctgaggtcaggagttcaagaccagactggccaacatggtgaaatgctgtctctactaaag

SEQ ID NO: 275216 - DNA, 428 bp, Homo sapiens
agagtaggtcttctggactgctaactttgactgacattactgatgaatcattttgacccattctttttgcctagcttgccaactggatgggtcctttggttatatatactttcattcaaagcattttataacattaacaacttggacaggcgcggtggatcacacctgtaatcccagcactctgggaggccaagggggcgtatccctgaggtcgggagtttgagaccagcctaaccaacatggagaaaccctgtctctactaaaaaatacaaaattagacgggcatggtggcgcatctggtgaatcccagctactcaggaggctgaggcaggagaatcgctcgaacccggaaggcggaggctgcggtgagccgagatcgtgccattgcctccatccagcctgggcaaaaaaagtgaaactccgtctca

SEQ ID NO: 275217 - DNA, 437 bp, Homo sapiens
gcaattcagtggaggggtaggtggctcgttcccccacgttgccccaggaagaggaccctgtccccggcatcctgacccacctcccttagagaccgagagcctctaaggataaacccattcacccgtgtttcagaggcttttttttcctcttataaaataacatttatacgttcgctgtagcaaggaaaacattataaaaaatagtgaagaaaatagaaattacccataattttgccacacagacttagttgtgtccatgtatcttgtgcaccttttttctgtttacggatcaaaatcgacttttagggtcaggcgcggtggctcacacctgtaatcccaacactttgggaggctggagttggggttggggggtggatcactgaagatcaggagtttgagaccagcctggccaacatggcgaaactccatctctacta

SEQ ID NO: 275218 - DNA, 422 bp, Homo sapiens
aacaggatacctggagaaaatttaacaaaggcaatatatacaaaggtgtgggcagcatcaaggaaaaccaacaggaatgatacaccatatacacataacctgaagaatcactgggaggaggattctcaagtaatacaccatggccatggcagtttgactacatcaaaaactttcatggaaagaggcacatgtgaagaagaagtgaggccctcagtttagccagcatcaacatgctagccatataaaccaccttggaaatgaagactcctgccccgatcaagccttcagatgagtgcagccctagccaacatatggttgcaactgactgagagtccaccaagtgagaactgtctagtggagcccttcctgaatttctaaccaacagagccctaagcgagaataaatagttattgttataagcc

SEQ ID NO: 275219 - DNA, 165 bp, Homo sapiens
gagcccaagcagcaaactgcaccttgaggtctcctcccgtgatgagaacatcacggcagaagccggcacttgggggaggcaggggaaccatgacaccagctctggacgtcccctcctgtctgggctggacaccgaacccaggcacttctcaccccgaagcacacc

SEQ ID NO: 275220 - DNA, 225 bp, Homo sapiens
tatgcacacaccaaaactacattaccttgttaaccttttgtgactatccttccaatctgtgtgtgtgtgtgagagagagagaaggagggaggggaagagggaagagagaaaaggactatattatgattattgttctgtaacctgctttaaagttcatctgtttaataaatgtttattgaaaagccgttttgtgcaaggcactgttctagttgctggaagagtgaa

SEQ ID NO: 275221 - DNA, 243 bp, Homo sapiens
ccggcgtgcgggaagccggaggggacgtgagattcaggggctctggaacacaggtgacgcctgggcttataatgcgggccagttaagaacaaatttggctatttaggctgaaaacacgagtagctgctctagcagactgaataagtaattatgaaaagaccttgaacttgggttataaattgaaaacctccccttcccaagccccctccagccccgcggccaactgcaggtgcgccacctggt

SEQ ID NO: 275222 - DNA, 1008 bp, Homo sapiens
aatcatacctaccagctcagatacactaccacagcccctatgcttcaggtggagagggcagtgattgcagaggcctgcggaagggacagcaggcgaagctcagcagaggtcctgcggaagggacagcgggtgaagctcagcacacaggagcaaagctgtagggcagaggtaggggtggaagccaggccttggccacacggcctcaggcaggtgccagaggcccagtttgcccaggacagtcttgatttataccaggtgagggtcctcgtgcagatggtgcattctctagtttccaaactggcagagagcttggatgttttccttgatgcagtgggaagccgttgaaaaattttaagcctcaagtgacaaaaggtgaattttaaaagattgttgaggctgggtgcagtggttcatgcttatagtcctaacagtttgggaggttgagacaggaagattgcttgagcccaggagttcaagactctgtctctacttaaaggaaaaaattagctgggcattgtagcatacacttgtagttccagctactggggaggctgaggagggagcatcgcttcagcccaggagttggagtttgcagtgagctatgatcacacaactgtactcgagtctgggcaacagagcgagaccctgtcttaagaaaaaaaaaaaagaaaaaagattgttcagattgctgaatgaaaaatggattgtcgggggcacagattgagacagaggtcattttaaggagactgttgatgagaaatggcgtggtttggctgaggatggagactaaggaaatgggaagaaatgggtggtagagtcagccaggttgctgatggaccgggtgtaggggagtagggaaaggacagaccccccgatcaactctaggggagcccccacacacccgtgggctgaccatgcggagccctgtggtgaggcaaatctattaagctatacagattcctcacattgcatgatatgaagcatggatatgtcgtagtacgcactagt

SEQ ID NO: 275223 - DNA, 132 bp, Homo sapiens
acatgtccgtgagtggacaagcaagtgtgatgtgtctgggtgggctggcaaacacaggacttttcaggtgggttttcaaatgcgcagcagggtcccttgggggagccagaaactgatcctggagtctgggtg

SEQ ID NO: 275224 - DNA, 364 bp, Homo sapiens
ctgtaactttcccagattgcttgtaagtacgtgcaacgctttaagacgtgacttagattctttcaaaaatgtagactcccccaggaaataactacttcatcttttagaattgcacataaatgatttttaagattcttgagtcttccagagtgggagaacgcacagaactggaaacctcggggagatgcgacaacctttgtgtccaccccactttgctgtgagccagttccctcaggaacaatgtagcccagtggtgtgccctgtgtttactgctgaaaattcaggagagaaacaaaccagccaacaatcagagtgagcaaatcacttctatcctacctctcatgaaataatagaattttttaaa

SEQ ID NO: 275225 - DNA, 225 bp, Homo sapiens
cagtacccagaattcccctccctcttggggaagaaatgtctcaattcagaaaggaatgaaaaatcagaactttctcctttaagaatcaaaggcagtttctcattaggaaaatacccaccatttaaggggaaaatctcaaagcaaacacattttaaagactacaacactataatcatggttccttaagccactaacattccaggaaaaggattttcctagctctaa

SEQ ID NO: 275226 - DNA, 114 bp, Homo sapiens
gggtgagattctaatcagataggatggtggctttattttattgtattttatttatttatgtttttgagacggagtctctctctgtcgcctaggctggagtgcatgatccacccg

SEQ ID NO: 275227 - DNA, 401 bp, Homo sapiens
ttaacgtatatgttcaatagacattgtctaaagtgctaaatctacaaaaagagtgttggggtgttttatggactgaatgcttgtgcctcctcctctctcaaatttgtatgttgaagccctaacttccagtgtggccgtatttaaaacaggaagtaattgaggttaaatgaggtcataagggtcaggcactgatctgataggagcagtgtccttagagacaccaaatatttttctataccctcacaatctccttccatgtgtgaacctggcaagagagccactgttttcaagccaggaagagatcctcccctataccagaaatcacctatgctggcaccttgatgtacttccagtctccggaactgtgagagaaagtaaatttctgttgtttaagtcaccca

SEQ ID NO: 275228 - DNA, 306 bp, Homo sapiens
ggactataagactccaagtgggcttcctggggtggagacacctcatacatgtgtctgtggttttgcattagtggaaaaatgcacgtccatgtgacccacacagggaaagggagggctggaaacctgtgtatgacctctcttgcctttgttagttcctactgttcctgagttacaaactttgctgtaaaccgtcaatacaactcgccaagtcatgtgactccttccggaaaatcgccaaaccagtgggtggttgtgggacccccaaaacagagacatgacaactaaatgctatgtgagattcctgaa

SEQ ID NO: 275229 - DNA, 420 bp, Homo sapiens
tactttgtactttgtacactccctttgtacttgaacttgaattcttgtttcacgatctacttttgggtgaaaccaacctaagacaggctttaacttatagttaaaagtcattaaaagtctcagtttcaggctgggcgcagtggctcatgcctgtaatcccagcactttgggaggccgaggtgggtggatcacctgaggtcaggagttcaagaccagcctgaccaacatggtgaaaccccgtctctactgaaaatacgaaaattatccgggcatggtggcgggcgcctgtaatcccacctactcaggagcctgaggcaggagaatcgcttgaacctggaaggcggaggttgcagtgagctgagatctcgccattgtgctccagccttggcaacaagaacaaaacttcctctcaaaaaaaag

SEQ ID NO: 275230 - DNA, 287 bp, Homo sapiens
gaagtgtgattaactgctcatttttataaatgtcatgaaagagtattggatttggagtttgaattgcatcttaccatttcctagctgtgggatactgaataatgtaatagatgctgtcagtctcctgcccatgttccactggtctcaaccaatgactgatgggagaaggtgtgcaaatactccagcttcctcgcctctcttttgagataagtttggggcatgttctgtgctgtctctaagaattcccttgcaggaccgaatctcaattgctcatagtgttagcttgc

SEQ ID NO: 275231 - DNA, 467 bp, Homo sapiens
ctggaattgtggcatgaaaagctttctcaaacctgactaagtgctgttttctttctctcaccaacagcattattccagttggagatataaagcagagaaccatcattctcaaaactgttctgagagtcagcatgtcacctctttcactcctcaagccttcagaattccaatgctaaacatttctctggcatctaaggaacaaaacgttcaggatagaaaggctgtgatactaccctgctagtatcaatccacatgcaccaggtcctgctgaagtgttaaataggttgatacagggatggaataaaacaataaagtgtctgagagaacttctgaggaaataatactgtgcaccgcttctagggaaggtggcccctagctctgcatgactaacagcagccatcacagacaccatggcacaagcagcccaaatactcagggagaccccacattgagtgagttgtatttta

SEQ ID NO: 275232 - DNA, 544 bp, Homo sapiens
agattttttttctaatagagcaatgagtgatccaaccaagatttatgtagaaggatgctaattgcaacaataagtgttacatttaaaagagaaaaactggaaacaactctaggatccaacaatggagaaaatggttaaataatgcattattccagttggagatataaagcagagaaccatcattctcaaaactgttctgagagtcagcatgtcacctctttcactcctcaagccttcagaattccaatgctaaacatttctctggcatctaaggaacaaaacgttcaggatagaaaggctgtgatactaccctgctagtatcaatccacatgcaccaggtcctgctgaagtgttaaataggttgatacagggatggaataaaacaataaagtgtctgagagaacttctgaggaaataatactgtgcaccgcttctagggaaggtggcccctagctctgcatgactaacagcagccatcacagacaccatggcacaagcagcccaaatactcagggagaccccacattgagtgagttgtatttta

SEQ ID NO: 275233 - DNA, 368 bp, Homo sapiens
tgtaatatataatgaaataattatacaactctccataatgtagaatcagtgggagccctgagcttgtttccctgcaactagatggtcccatctggggggatgggagacagtgacagatcatcaggcattaggttctcataaggagcgcacaacctacatcccttgcacgcgcagttcacaatagtgttcacgctcctatgagaatctaatgctgttgctgatctgacaggaggcagagctcaggcagtaataagagcaatggggaatggctgtaaatacagatgaagaagctttttgctcacttgcctgctactcacctcccgtgtgtggccccattcctaacaggtcacagaccagtaactgtccat

SEQ ID NO: 275234 - DNA, 204 bp, Homo sapiens
  misc_feature (148)..(148): n is a, c, g, or t
cctacgttagctaatgaatattgaaatttctaaaaagtgaaatttcggattcatttctatacatgacaaaagattcaagaaaattcgtttttcaatagaatgagactgtctcaaaaaacaaaaaaatcagtgttcatgtgaaaacctngtgcgtcaatgcttatatcaactttatttgtaaaaaataaaaataaaaaactggaa

SEQ ID NO: 275235 - DNA, 594 bp, Homo sapiens
tgcgaatcttggaagtgcccacgaaatgagatgttttccacccagtcacttctgcaaaggtttaaacctgtcagatctggtgcaggtgaggatggaaacggcccctccgcaccctggcaggtgtgtgactcagagcagccctctggacagatgatcagggtcctcagaacagaaccctcagactcaacaatcccactgctaggaactggctttcctaagaagcaatctcacacaagtgcacaaagacaaatttaaaaggattgaggcagcaatgcttatagcagcagagcattagaaacagacgggagtcggctaaatgatcaaacgttcacaaaacgcagcaccaagcagctgtgaaaaggatgagaccgcttcctatgtgcagcctgatacactgtgagattaaaaagcaaattgtgcttatggcctgatcccgtgttcgtaacatacaaagtcacatccacacgagagcatgcaggaaacctggaagggagcccataaaactcgccagtgtgaggaccagcactgagcagccggagactcatcttcacttacacttaagagcctccctcatgtgctttcagaggtgagctc

SEQ ID NO: 275236 - DNA, 4140 bp, Homo sapiens
  misc_feature (809)..(809): n is a, c, g, or t
tttaatagataagtaaattatatagtatattagaaggtgattattactaggaaaaaaaagttaaagcaggataaagggatggatttttaaaatatgaaataataatactatcttaatcataagtcaggtgaggattattgatcagttaaacaaaggatgatggccctctttgctgcttgttctctttctgccaaagacccaactcttcgtccttttcaatttcttcttcccattgtgttcacaggattgcaccatctttcccacagcctcttgattcaaagccattactcagccagcgggaggctgttcccccaggcaatataccacagcgtcctgaccggctgcccatgagtgatactttcactgacaactggactgatggctcgcattatgacaacacagggtttgttgctgaggaaaccacagccgagaatgccaacagtaatcctctcttaagttcgaaatctagaagcacatcttcgcatggacgcaggcctttgatcaggcaagacaggattgttggtgttcccctggaactcgagcagtctacacacagacacacaccagaaacagaagtgcctccttccaatccttggcagaattggaccagaacccctagtccgtttgaagacaggaccgcttttccttccaaattagagacaacccccactaccagcccattgcctgaaaggaaagaacatataaaggaatctactgaaatacctagtcctttttctccaggcgtaccatgggagtatcatgattccaatcccaacaggagtcttagtaatgtcttttctcaaatccantgccgcccggaatcttctaaaggtgttatttcaattagcaaaagcacagagaggctttcccccctaatgaaagatatcaagtctaataaattcaaaaagtcacagagtatcgatgagattgacattggtacatataaggtgtataacataccattagaaaactatgcttctgggagtgatcacttaggaagccacgaacgaccggataagatgctgggaccagagcatggtatgtccagtatgtctcgaagccagtcagtcccaatgctggatgatgagatgctcacctacggaagtagtaaggggccacaacaacaaaaagcttctatgacaaaaaaagtctatcagtttgaccaaagcttcaatcctcaaggatcagtggaagtgaaagccgaaaagaggataccacccccttttcaacacaatcccgagtacgtgcaacaggccagcaaaaacatcgccaaggatttgattagtcctagagcttacagaggatacccaccgatggagcaaatgttttcattttctcagccatctgtgaatgaggatgctgtggtgaatgcccagttcgcaagccaaggggccagggcgggcttcctgagaagggccgactccctggtgagcgccacagaaatggccatgtttagaagggtcaatgagcctcatgagctgcccccaactgataggtacggcagacccccatataggggagggctggatcgccaaagcagcgttacagtgactgagtcccagttcctgaaaaggaatggcaggtatgaagatgaacacccttcatatcaagaagtgaaagctcaggcgggaagttttccggttaaaaaccttacccaaaggaggccattgtctgcgagaagctacagtacagagagttacggtgcctcccaaaccaggccagtttcagctaggcctactatggcagctcttttggaaaaaataccatctgactataacttgggtaactatggtgacaagccatcagataacagtgatttaaagacgaggcctactcctgtgaagggagaggagagctgtggtaaaatgcctgcagactggagacaacagctgcttagacatatagaagctagacggttagacaggaccccgtcccagcaaagcaacattttagacaatggacaagaagatgtatctcctagtggccaatggaatccttatccacttgggaggcgggatgtacctccggacaccattactaagaaggcaggcagccacatccagacgttgatggggtcccaaagccttcagcatcgcagccgggagcagcagccgtatgaaggaaatataaacaaagtgaccatccagcaatttcagtcaccattgcctattcagatcccctcttcacaggccacccggggacctcagcctggacggtgcttaattcaaactaaagggcaaaggagtatggatggatatccagagcagttttgtgtgagaatagaaaagaatcctggccttggatttagtatcagtggtggaattagtggacaaggaaatccattcaaaccttctgacaagggtatctttgttactagggttcagcctgatgggccagcatcaaacctactgcagcctggtgataagatccttcaggcaaatggacacagttttgtacatatggaacatgaaaaagctgtattactactgaagagtttccagaacacagtagacctagttattcaacgtgagcttactgtctaaatattttttataaatagtgaagatacgtctagccagacctaatgttcaaaaataaatttatacatagaaacaaattttgccaattgctggaccaatggcaaacattagtgccaaatgtataatactatatgttagcactgaccatccttaaaaaatgttaactctataaatatgatgttcatgtggttatgtattagttttaattgtcagcctctggctgtgcattggtgcagttttgtttctgtttttgtttttgtttttaatcaaataagtttcttctcaaaatggatttcatataatttcggagcacggaagcacacacaagctctttatgaattctgctctccatcagaaacactgcctcaaagttgtatatgcctttatatagaaaatacaaatataaagaattgtaattcccataaaatatttctagcacaaggtatatgttggcatatatacaaaaagaatatagagaaaaacaatattttcataaactaaacatctcagatagagaaaaaatatatcttaaaataagactttactatatgatctttttcaataaaaattacatgataatgccttatgaaagtaactgtacatatggtataaagtgtttatatttggttccatattcatttgctaaattctcatgacacagagtgaaatatttcataaattagccatttatctctgggacccaaataaaaataggatgaactaatttgttcaatgcctttagctaattacaatacatgcagagtttagaaacagactaaaggtcattgtagttaagtctttttcaccacaaatttaagcagtggatgatgggtggcaggaaaggtattgctttatttctttcaagttcatgttgattataaactgtagcccctgtgatttctttacttgtaaatgtggaatttatttgtgtgttgcttaatctaatttgctgctttttaaattatttaaaacgaattttggaaattgataaaatttatcattacgaaagactgctgttagaaagttatggtaggtgattttaaatccttggtatttaaatatgaaacttcaaatataatttctcagagctgtggtctacctgtatcattaatttcaatggctgtttttctgggcagaaatagataaaatactttttttccaaaaacagtttcaaggtatgtaaaatcctgaatgctttttcactgaagagaaagacaagcatggttaatgtagaattatttacttttccattgaaactattttcctgcataaatgatcaaaatttattttataatcctttaaaatacttatctttcatattagtcattaatttaattacaatattaatttgaatttccaggataatttcccggagttggttgcatgcattatctttcataattttacatagttcttttgttatataatgaatttactttacatgctagtgtttcaagtattgtatgaggattttcacaatagtatcactgaatgatgtcaccagagctctgagaataatatttgtaagttaactgttttatggggacattgaaaatattgtatttttgtagggtctattaaaatgagtgtcacttattag

SEQ ID NO: 275237 - DNA, 489 bp, Homo sapiens
gccaaagcagcgttacagtgactgagtcccagttcctgaaaaggaatggcaggtatgaagatgaacacccttcatatcaagaagtgaaagctcaggcgggaagttttccggttaaaaaccttacccaaaggaggccattgtctgcgagaagctacagtacagagagttacggtgcctcccaaaccaggccagtttcagctaggcctactatggcagctcttttggaaaaaataccatctgactataacttgggtaactatggtgacaagccatcagataacagtgatttaaagacgaggcctactcctgtgaagggagaggagagctgtggtaaaatgcctgcagactggagacaacagctgcttagacatatagaagctagacggttagacagggtatgtctggtgtttctctgtaagaatatccctcctgcctttagtgttactttattggcatttctaagcacatgtagtgaagcatgaactacat

SEQ ID NO: 275238 - DNA, 4152 bp, Homo sapiens
  misc_feature (821)..(821): n is a, c, g, or t
gggaacttcacccttcattagctgagacccctctgtacccacccaaacttgttctgctagggaaggacaaaaaagaatcaactgatgagtctgaagttgacaaaactcactgtctgaataacagtgtttcctcaggcacttactcagactactcgccttcccaggcttcctcaggatcctctaatacccgggttaaagtggggtccttgcagacaacagctaaagatgcagtacataattctttgtggggtaacaggattgcaccatctttcccacagcctcttgattcaaagccattactcagccagcgggaggctgttcccccaggcaatataccacagcgtcctgaccggctgcccatgagtgatactttcactgacaactggactgatggctcgcattatgacaacacagggtttgttgctgaggaaaccacagccgagaatgccaacagtaatcctctcttaagttcgaaatctagaagcacatcttcgcatggacgcaggcctttgatcaggcaagacaggattgttggtgttcccctggaactcgagcagtctacacacagacacacaccagaaacagaagtgcctccttccaatccttggcagaattggaccagaacccctagtccgtttgaagacaggaccgcttttccttccaaattagagacaacccccactaccagcccattgcctgaaaggaaagaacatataaaggaatctactgaaatacctagtcctttttctccaggcgtaccatgggagtatcatgattccaatcccaacaggagtcttagtaatgtcttttctcaaatccantgccgcccggaatcttctaaaggtgttatttcaattagcaaaagcacagagaggctttcccccctaatgaaagatatcaagtctaataaattcaaaaagtcacagagtatcgatgagattgacattggtacatataaggtgtataacataccattagaaaactatgcttctgggagtgatcacttaggaagccacgaacgaccggataagatgctgggaccagagcatggtatgtccagtatgtctcgaagccagtcagtcccaatgctggatgatgagatgctcacctacggaagtagtaaggggccacaacaacaaaaagcttctatgacaaaaaaagtctatcagtttgaccaaagcttcaatcctcaaggatcagtggaagtgaaagccgaaaagaggataccacccccttttcaacacaatcccgagtacgtgcaacaggccagcaaaaacatcgccaaggatttgattagtcctagagcttacagaggatacccaccgatggagcaaatgttttcattttctcagccatctgtgaatgaggatgctgtggtgaatgcccagttcgcaagccaaggggccagggcgggcttcctgagaagggccgactccctggtgagcgccacagaaatggccatgtttagaagggtcaatgagcctcatgagctgcccccaactgataggtacggcagacccccatataggggagggctggatcgccaaagcagcgttacagtgactgagtcccagttcctgaaaaggaatggcaggtatgaagatgaacacccttcatatcaagaagtgaaagctcaggcgggaagttttccggttaaaaaccttacccaaaggaggccattgtctgcgagaagctacagtacagagagttacggtgcctcccaaaccaggccagtttcagctaggcctactatggcagctcttttggaaaaaataccatctgactataacttgggtaactatggtgacaagccatcagataacagtgatttaaagacgaggcctactcctgtgaagggagaggagagctgtggtaaaatgcctgcagactggagacaacagctgcttagacatatagaagctagacggttagacaggaccccgtcccagcaaagcaacattttagacaatggacaagaagatgtatctcctagtggccaatggaatccttatccacttgggaggcgggatgtacctccggacaccattactaagaaggcaggcagccacatccagacgttgatggggtcccaaagccttcagcatcgcagccgggagcagcagccgtatgaaggaaatataaacaaagtgaccatccagcaatttcagtcaccattgcctattcagatcccctcttcacaggccacccggggacctcagcctggacggtgcttaattcaaactaaagggcaaaggagtatggatggatatccagagcagttttgtgtgagaatagaaaagaatcctggccttggatttagtatcagtggtggaattagtggacaaggaaatccattcaaaccttctgacaagggtatctttgttactagggttcagcctgatgggccagcatcaaacctactgcagcctggtgataagatccttcaggcaaatggacacagttttgtacatatggaacatgaaaaagctgtattactactgaagagtttccagaacacagtagacctagttattcaacgtgagcttactgtctaaatattttttataaatagtgaagatacgtctagccagacctaatgttcaaaaataaatttatacatagaaacaaattttgccaattgctggaccaatggcaaacattagtgccaaatgtataatactatatgttagcactgaccatccttaaaaaatgttaactctataaatatgatgttcatgtggttatgtattagttttaattgtcagcctctggctgtgcattggtgcagttttgtttctgtttttgtttttgtttttaatcaaataagtttcttctcaaaatggatttcatataatttcggagcacggaagcacacacaagctctttatgaattctgctctccatcagaaacactgcctcaaagttgtatatgcctttatatagaaaatacaaatataaagaattgtaattcccataaaatatttctagcacaaggtatatgttggcatatatacaaaaagaatatagagaaaaacaatattttcataaactaaacatctcagatagagaaaaaatatatcttaaaataagactttactatatgatctttttcaataaaaattacatgataatgccttatgaaagtaactgtacatatggtataaagtgtttatatttggttccatattcatttgctaaattctcatgacacagagtgaaatatttcataaattagccatttatctctgggacccaaataaaaataggatgaactaatttgttcaatgcctttagctaattacaatacatgcagagtttagaaacagactaaaggtcattgtagttaagtctttttcaccacaaatttaagcagtggatgatgggtggcaggaaaggtattgctttatttctttcaagttcatgttgattataaactgtagcccctgtgatttctttacttgtaaatgtggaatttatttgtgtgttgcttaatctaatttgctgctttttaaattatttaaaacgaattttggaaattgataaaatttatcattacgaaagactgctgttagaaagttatggtaggtgattttaaatccttggtatttaaatatgaaacttcaaatataatttctcagagctgtggtctacctgtatcattaatttcaatggctgtttttctgggcagaaatagataaaatactttttttccaaaaacagtttcaaggtatgtaaaatcctgaatgctttttcactgaagagaaagacaagcatggttaatgtagaattatttacttttccattgaaactattttcctgcataaatgatcaaaatttattttataatcctttaaaatacttatctttcatattagtcattaatttaattacaatattaatttgaatttccaggataatttcccggagttggttgcatgcattatctttcataattttacatagttcttttgttatataatgaatttactttacatgctagtgtttcaagtattgtatgaggattttcacaatagtatcactgaatgatgtcaccagagctctgagaataatatttgtaagttaactgttttatggggacattgaaaatattgtatttttgtagggtctattaaaatgagtgtcacttattag

SEQ ID NO: 275239 - DNA, 317 bp, Homo sapiens
tatttttttctggtaaaaaccttatttgatttgaatgggcaggttaattatattactattcttaaaaaaaactaggtcatttgaattatttgaaaattaggatacatttcagaatatactcttattaatgttcgtagcaaacatttactgacactatgtactaaataatgttctaagtccttgacacaacaatgctataaagtaggtatttattaatactacctaactcaattttatagttgaagaaactgaggttatctaattgacccacagtcacacagtaataaataccaaagcccgacatctgaacaaaagca

SEQ ID NO: 275240 - DNA, 327 bp, Homo sapiens
gcagctacccgtggtcactgggatggctggattctagggaaggcccagcctgtgggtgagactgagactctagggctcacccagcagggaaaggagtgtgggcaggggggatacggtggcgggtggcggcggagcgggggcggtgcccaggatagacagagcatttcagaggcaatgctaatccatgggcccatgggccttgcccaaccatctcctgcacgactcagcagggagcctggcatgggcagggattaaggaatacgggagaggggccatttcttttcacaggaaaagaactgtggtccaagagcaaggtttcctttcaaa

SEQ ID NO: 275241 - DNA, 460 bp, Homo sapiens
caattattgaaattgctgcctagaatcttccgctaccacagtgtattttgattggactgtttattgccttagcaaacacaatgcagtgctgtgtctttggcatcttgccaggaaagatgagccaattttctcgtgttgcttctggatgtcaaaacattctcatctgaccatgccacagaagaagtttgttgagagtgtgactgactgacataatgactgattggctgataacggcagctgacagtgattgattgagtgtaaaattatctgttctcattacttctgaaattgaattcagattggttctattggagggtttccatggagaccataacctgctatagcaagtgtttgtggatgcaatgttttattgtgatcaatacctgtttcctctgctggtccaaagaaattattaatgattatagtcaagtagaaagaggcaaccatatataagaagaaa

SEQ ID NO: 275242 - DNA, 340 bp, Homo sapiens
ttaaaacaaaatgatatatagctttaatagcatttgaggaaggaaaccaagttcctccttttttctagatttggctcaacaaagctgaaaagtaaattttctttaaattttaagggtggctttggtctggatggtgtgtgtatgtgcatgtgtgtcaggcaggtagttgaaaggccaacctcactgtgatgttttatcccaagtccagatgtaccactgttatatctccaggtacatcttttaactctaggaagtaaacacagtttttactgtaaaggtaaaccagaaagttaagtttaaatcaagtttgaatataatttgtacttggagtaataaacct

SEQ ID NO: 275243 - DNA, 407 bp, Homo sapiens
aagtgaaatagtattctgatttaggactgcagtatttagaacactgaaggatttaagtgtcatttctaagatttttaattttaatttttattttgtgtgctttcattaagaaagaggcagccaggctcagtggctcacgtctgtaatcccagcacttagggaggcagaggtgggcagatcacctgaggtcgggagttcgagaccagcctgaccaacatggagaaaccctgtctctcctgaaaaatacaaaattagccgggcatggtggcgggcacctgtaatcccagctactcgggaggctgaggcaggagaatcgcttgaacctgggaggcagaggttgcggtgagccgagatccctacattgcactcaagcctagacaaaaagagtaaaactctgtttcaaaaaa

SEQ ID NO: 275244 - DNA, 6053 bp, Homo sapiens
  misc_feature (547)..(547): n is a, c, g, or t
  misc_feature (851)..(851): n is a, c, g, or t
  misc_feature (1577)..(1577): n is a, c, g, or t
  misc_feature (2175)..(2175): n is a, c, g, or t
ctgttctggccttgaaaatgatccttcttaaaaggattttcctccttcctcaagggaaagaaaacctattgatataaaacttcacttcccattcagtttcccctgctaaatgccactccagtagagactgagtgttgataaatacaggggaaggaaaaagtcgtaagctgagcctggtcacattgccccttgtgatatcgttttatttttaacttcgcaacacttggactatttctgttgaagttttctctcctttccctgccttcccaacagaacgctgtcctctactgcagctgatgcaacccagccacctcccggcaatccgcttacttgcaatcaagggttcaggtgcaagcagatgctgactcagcctgttccattaagagctaagaagcaagaagaaattggggcgccatggggaaagcccgcagatccccgccagggcaccacaggcattgtgagggatgcttcaaccgccactgccacattcctgtggaacccaacacctcctgcctggtaataagctgccacctgctctgtggtgccnccttccacatgtgcaaagaggcagagcaccagctcctctgccctttagagcaggttccgtgcctcaactccgaatatggctgccctctgtccatgtcccgccacaaactggccaagcacctgcaggtgtgccccgccagcgtggtctgctgctccatggagtggaaccgctggccaaatgtggactctgaaaccacccttcatgaaaacatcatgaaagagacccccagtgaggagtgtttggacacagccctggccctgcaggatcagaaggtcctcttcagatccttgaaaatggtggaacntttcccagaaactagagaggctactgaggaggaaccaactatgaatggtgaaaccagtgtggaggaaatgggaggagcagtgggtggagtggatatcggtttggtaccacatggtctgtcagcaactaatggggagatggcagagctaagtcaagaagaacgggaggtgctagccaaaaccaaagaagggatggacctggtcaagtttggccagtgggaaaatattttcagcaaagagcacgcagcctctgctttaacaaattcatcagcgagctgtgagagcaagaacaagaatgactccgagaaagaacagatttccagtggccataacatggtagaaggagagggcgctcccaaaaagaaagaaccacaggaaaatcagaagcagcaggacgttcgtacagccatggaaaccacagggcttgccccttggcaggatggtgttctggaaagactgaaaacagctgtggatgcaaaggactataacatgtatctagtgcacaatgggcggatgctgatacactttggtcagatgcctgcttgtacacccaaggagagagactttgtttatggcaagctggaggctcaggaagttaagactgtttacaccttcaaagttcctgtgagctactgtggaaagcgagctcgacttggagatgccatgttgagttgtaagccaagtgaacacaaggcagtggatacttcagatttggggatcactgtggnggacctgcccaaatcagatctcatcaagaccaccctccagtgtgctttggaaagagaactcaaaggccacgtcatctctgaatccagaagcattgatggactgttcatggattttgccacacaaacatacaactttgagccagaacagttttcctctgggacagtgctggctgacctaaccgctgccaccccagggggactccacgtggagctccacagcgagtgtgtgaccaggagacacaacaaaagcagctctgccttcactttcacttgcaacaaattcttcaggagggatgagttccccctgcacttcaagaatgtccacacagacattcagtcatgtctcaatggctggttccagcatcgatgccccctcgcctacttgggatgtacatttgttcaaaaccatttccgtcccccagggcaaaaggcaaaagtaatctatagccaggagctcaagacctttgccattaagccggaggttgctccagagctgagcgagggaaggaagaacaaccatcttttgggtcatggaggaaaaagccagaattctttaaccagcctgcccctggagattttgaagtacattgctgggttnttggacagcgtcagcctggcccagctctcccaggtgtctgtgctgatgaggaatatctgtgccactttgttacaagagagaggaatggtccttttgcaatggaagaaaaagaggtattcccatggaggcacctcctggagagtccacagagagatctggcagttcagcagcctcttctccaaaatcaagagctgggagtttaatgaagtcacctccatgtctgagcacctgaagtcctgtcctttcaacattgtagagcacaaaactgacccgattcttttgactagcatgtgtcagccccgtgagcaggcccgagagagcttagtctccacctttagaatcagaccacgaggaagatacgtctcctaaaaattcagatgccactcgatgcacccttcttggatttcttctcggagttcctgaagtaggacagagtgtgtggttttgaggactcccttctgtaaactgcctatttgcttatcggggtgtattggaacacgcaatgtccttcgaaacctcaacacgaggcctaagaatttcctaagccatgtcttgtaccatagtgccacattgatgacttgtttccttttttcttttcttttcttttcttttttctttctttctaaaatagattggtctgagaagaaaataagtaatttgaggccatttggaagatgggcccaatttcttaagtgatgagagagcacgaaattccataaccagtacaggcctgtgcttttacatgggctttttagttcacaaagcactttcaaatttatgggacaggaaatgcaggatgggactccccagggaacgcagggtgaagggaacaaagctggaggctctggagctgggtctgttttgacggtcaagtccagggctcattttggttattctactgcctctaggccagggtagtcctaacacagcctgacataggagagcccctggctgagcatggcagccttgaagacaccacaggccaaaacatgaggggcagaaatgggatcacagagtctgttgctagaatcttggcaacatacagcaggaaagccttgataaatcgggagtccaaaggagacaccatatttatggagaacattaggacaaaaagtcaccaacttactttgtaacattttaataatgacttaagggtcaagatttttttcttctgaaaattatgttctgagttaggcagaacatagccatggccctgggccaccctgtgctatctgaaatgacctcaatacactaatgccaacctcagcgtcatgccagaatgcacagggcagcccagggagatcacacctttggcaaagtccagacaaggcccactgcagttcctatggcgccagtcaccagctcctagacagcacttgggtaccccattggggtcttggagaggaagacatgtgaacataacggctccctgaaattgctcctacccatccatatttctggtcatgctttcagtctgacaaaaatggatgatactgctgtttttggtaacaaacagtgaatattcataagaacaaaagtaacagaaaaaaagacacagtagaaactggcatcccctaaagcagggcttcttagccttggaactattgacatttttaaatggataattctttttttttttttctaggtggggaggggatggagttcactcttgttgcccaggctggagcgcaatgacatgatctcggctcaccgcaacctccgcctcctgggttcaagcgattctcctgcctcagcctcccgagtagctgggattactcgcctggctaattttgtatttttagtagagacgggctttctccatgttgttcaggctggtctcaaactcccgacctcaggtgactcgcccgccttggccttccaaagtgctgggtttacaggtgtgagccactgcgccctgcctgaactggataattctttgttgcaagggactgttctgtgtactacaggatacttggcagcatccttggcctatccattaaatgtcagtagcacccccacagtggcaacaatcaaaaatgtcaccagacattgctaaatattggggagcaaaatggctccccgttgaaaatccctaaaggatgtcatactagtgacaataagttaggatatgcttattttttagtacagcaaaatcttatcgcacatagctatccacaatagttatgatttaatgcagctctttatttatgaaataggttttagacatgtggtgattttaagttgggaaccagaaggaaatgattcgtttggtatggcttcatgtccttcagccacccccaagaatgtatcctttcagctctctttggttatacctgaagccaggagcgttgagttattagccttgtgtttatattcctctcactgtaattggtgtcattttcccagcagtcctagcagtcctcaagcaagtgggaaatcggaaaagaaaaggacaggcattgtagggaagcagaggataaagaatttagccaacaaaagaaacaatctagtcaatctgggtgcttttatttcctgggttctctctaaacatggctcagagctggtgtagatgaagtaggtgaaacctctgaaaagagtctagaaggcagtagagcaagtcccagaccagaaacatgctcatcttttcatcgtaatgtgccactcggtactatttggtaatgtcactctatttttcctaatcccatcctttggtttgtatttcatatttgtatataaggcaccattttctaaaaatatgactagggtgtgacctaaggttttattctgtgaagatgagtaactggaaagaagctaacactgcagtgggaaggaaggaagagagttgtccaggtggtagttcgacgtgttttgaatctagtccttcctacatggaggataaaagctcctaaagtccactctgggtttgtgattttaatagaaatagaaagggaaactatagaccaatggagatgaaaatcaggggctatcgacagatggaggagaaataaggtgctacatagagaaaggaagagggcagaaggctttcccttcccaaactgggtgagctggggaagccttggttcaggagagtggcactgcccacaactgctttgtgggttgtgcacttccagccgcactctccccctccagttgctgccttcagagccgtactgaagcacgagcttcaataagacaagcacacttcatagtgagagggcagcggtaccaaagcctttcagagagactatggattagacagaaatgatttgtgagaggaagctggagtgaacagcatgaacagcgagtgttacctgacagaggcaagacagctagaagtggcttcagatttagaaacagctgaggggagcaaagacggactgtgtacacagggagggaggatgtctatgggcagagcccttggtgagtatcatcaccaagaaaggcagtccagagtagagatcagccgaatatggaggctgaggtctgtagaactgggccagagaggaccttactgccttagtagcataagggtctggaaaagaagtttctatctcacaacaaaggaaaaagtgaaaagcaaggtggaacttgaagatacgtcacgaaaatcactataaaagtctgatttatgtgtgatgtcaaatcaaactgaaatgaagaatgagattgagtatatctgtggtgactgacctctgtatactagaaacctcaacatctctagaagaggaaataaaagctgctttgcactctgaaaggctaattgggtgaatcttataagttaggtctagagacagatgtgtgattcacaggcatagaagttgtcgctgaaaccaagtgtgtatcatgaagaaagaccagagcacaagcctgagaccaaa

SEQ ID NO: 275245 - DNA, 276 bp, Homo sapiens
tggagtcagttgtgtagctctcataaaatgagaacatgatccagaggctcttccaagtgccttatttatattaatagtgcttcattcgtttttcaataatatggaggaggaccaaattacggatgagaaaactgacacccaaagagatgatgtaatgcccacatggcaggctagcatttgaatacagtgcagtgttctttaccatgtatattaactgttctggggataagagggtcttttaattaaataaaaacactatacaatgtgtaatcctca

SEQ ID NO: 275246 - DNA, 406 bp, Homo sapiens
cttggcgccaagcttcaggctgggcccaggtgtgtgccatgtgtctctcatttttcttggctgggcaatctatccagagcgtcttcttgtcatggtgatgtcaaagcgcaacaaggcaatctgtgccctgtccaccatcaacccaacagccaaagccagtcatgtgaccacaatcaagatattggggaaggaggcatgactgcccagagtgggagaaggaagagagtgcatatgctttattgtttttatctaattatatatgttaaatatatgattgagaaaatgtgaaaataaagaaattatttggaaattattaaaattcctccttaatactaccacccagagagagtcaccttaacattttggagtatcaggcttgttttgaaatattctttaatattctttt

SEQ ID NO: 275247 - DNA, 564 bp, Homo sapiens
ttgaaattcatcttgcttttgcctgtaggcagggagcaatttattaaaatactctgcatatccaatatttcttaaacaaacaaacaaaatctcttatactcagctcaaaaagatggtgacagatgaaggaagaattagaagtgttaaaaaaagaagaaaaagaaaaaacaactaaccacgtggcctatcttagaacctgactgatgattccattcagataatatttcttgggcacccacaggccacaagccacatgacattagatagagaaaatgatagaaatcaagccatatttctctacttgcaagcaagttatatactagcagatacatacaatacacaaaatgctcttaaatccaaataaatcacattttcatgatgcaaatactgacagcttaaatcgacatagcactccattggttacaaagcacttctacctaaaacatcttatttaatttgaaagtaagttaatctagttaggttaaagagttgtgtcaatcgcaagttgtctccaaaagctacctggagcataaagaaccaagaagagctacgacaatattgaga

SEQ ID NO: 275248 - DNA, 248 bp, Homo sapiens
ggctcccctgccttcatgtcccccacttgctctggcaccacggcctccactttgcctccagacctgttattcctggccgagcgcccagcccctggtgtaaaccccatgaggtttcaaaggaagaagatggtccctcaagtcgcatatgggctctaaacacttcccccgcggcccctgtggttgccctcaagtttcctgagctccgttgagtcagaatgagtgttttcctggtgacggatggctgtgtg

SEQ ID NO: 275249 - DNA, 233 bp, Homo sapiens
atccagggttttgcttttgctgttgagtgtgacaagatggaagggcaggcaggctagggtactgtgaaaaggcttgaagttctggacctagaatgcctgatgaagtactggatgaagcctggttaagaagggatgagccacaaactcactattttccacattggacccctcatcttttttcttctgaaccctatatccatgactgtaaaggacctgggatctttacctactta

SEQ ID NO: 275250 - DNA, 423 bp, Homo sapiens
atgctggcaaggttgtggagaaaaaggaatgctcatatactgttggtgggggcgtaaattagttcaaccattgtggaagacaatgtggtgattcctcaaagacctaaagacagaaatgccattcaaccaagcaatcccattactggatatgtatccaaaggaatataaattattctatcataaagacacatgaacacatatgttcacgtcagcactattcacaatatgaatgacgtgaaatcagcctaactgtccagcaatgacaaactggatccagataatgtgatacatacacatcatggaatactaacactttcctccactacactttctaccaaagtatattttaatgtcagatatttcattttcctctctgggtgataataaatcagggaacaaaaaatacactttgaaaattaaaag

SEQ ID NO: 275251 - DNA, 485 bp, Homo sapiens
attcttattccgtaccatacacaaaaaataactcatatttgattatagagctatatgtaaaaggtgagattagtaactaagatactaaaacatactacctgtacaactgcaagtaatataagtgggttaatcaaccataattccatctgtatatttctctacttagatcattatttctataataataataatcccctgcatagtaatctatcaatatctataatgctattttaaataaaactaaattagatggtgggtcaccgtcactctgatttagtggaaattcaagcaaaaatattattgatactccatctttctccttagatttttggtattattacttctttctatttttcattttttgagacacgttctcactctgtagccccaaatggagtgcagtggtttgagattggctcactgctgtctacagttccagcctcaagctatcctcccacattagcctcccagatagctaggactgc

SEQ ID NO: 275252 - DNA, 428 bp, Homo sapiens
aaaaagaaagggtatccaacatagaagggacagaagtcccaggaggagggcaaaatgataggaagacagttgtgccagaagacctaggtatagatgacagctacagacagacagctccaggtacccatggacaaaaaacaaaattaacaggaaattcaatatttttgtgcatgtgaatttgagaggctgtatgaaatgtaggaaaacttagctagagactcaaggaaaaacaaagcaaataggaagaaaaataaagcaattgttaactttcagtgggaacaggaaagaatatatagtaattttttgtcttaccattaaacagttttccaggctgggaacagtggcttacacctgtaatcccagcactttgggaggccaagccaggaggatcacttcagcccagcagtttgaggccagcctgggcaaca

SEQ ID NO: 275253 - DNA, 554 bp, Homo sapiens
gtcaggagaaatagttgtttgcaatatgatataatagaagttatgagagaagtatgtatgggcacacccaggtgcagaacctaatccagagggtggagtggagaagtaaacaatgttagagaaggttatgtggaaatgtgacccctgtacttaacgcttaactacaaagaggagttttggaaggaagaatattggttcttttcaacagagcagtgtgtgcaaaggccaataggggaaagaggccaaagaaaagactagtgggccgggcgtggtggctcactcctgtaatcccagcactttgggaggccgaggcaggcgggtcacgaggtcaggagatcaagaccatcctagctaacacggtgaaaccccatctctaccaaaaatataaaaaaatttagctgggtgtggtggcgggcgcctgtagtcccagctactcggaggctgaggcaggagaatggcgtgaacccggcaggtggagcttacagtcagccgagattgcgccactgcactccagcctgggtgacagagagagactccgtctcaaaaaaaaaaaa

SEQ ID NO: 275254 - DNA, 488 bp, Homo sapiens
caggcctcggggttggaaagctacacagtaaacgggtggagtaccaaagcttagttgtgtgtctagagaattcagggcgtggtgagtgatcagctcctggaagagcaaagattagtatttaatacatatgcatttattagcgtggctgggtctctcgtcaaaaatgtcataatttcacagatcaggattttaaagcaaatagaattattgatatatatctcttccaacagccaataaacatcccgcagagaggacagcttacgcatgggctcacacaaagaaaattgcagagtctttgcttaagctacagcctgaaatattaaaattctgattttcatgcgctgttagaaatagttttcaaagaattccttcctccagccccatcacaacccctgcccatgtgagaggttaggagtaaatcatatgttttttaaaacatttgctgaaacctcctcccttttccaagtctaccaaatttttatctcaaa

SEQ ID NO: 275255 - DNA, 588 bp, Homo sapiens
actggataccaacaaggttaaatggtggaaaagccataatcacttctaaattcaagggtaggattaatactgtattttcacagtacctgaaagttctgtggcctttcctagacaccagttcatgtgatcaccagaacagaactgaggttgaggggaaagttagctatcagcattgggcccattttacagatgggaaactgaggcagtggaaggtaaagtagtttgcccaaggttactgtttctgcataaatggctgccctgggactagatgggaacagaactaccacagacttgtgggtcagacatactttggttaaaaactcaaccttgacatttatgtaatgttggtaatgttactttacctttttaagcctggggttttttgtttgtttgtttgtttgtttgtttgtttaaacttacaaaatggggaggataaagcctagatcataagtttgcagtgagggttagtttaaggagatgataggtgcaaaggacctggtgctcgggaagcctttgcacctcccaccgtgtacttacattacttacatttgattttgaaatatagtataagactgctttggctaacat

SEQ ID NO: 275256 - DNA, 497 bp, Homo sapiens
ttggctccaagcttcagtgccttcttcctggcttcctcgaagtcttccttctggccagtattggccaggtaggcagtgacatcatagccttgttccttcagccacacgaggatgcaggaggtgttcaggccaccactgtaggccagaaccaaggagcctttgctggacatagcgtctgggattggaggcgtgagttcccggtgtcaggaatctgtcttcacggtgcagtgaaccactcgggcccgagcagcggtggcaggcgacagagcaggtctcagcttggttgtcacttcctcaaggaagccttccctgatttctcctctgcctgatgaacctagatcttccactccatattcctataacacattcacctttttttcatagcactcatcactgtttaattcacctgtttaatgcttgcctttttcattacactgtaaactccatgtgtttactgctatatgcaagaattagcctgataacttacactgggaaaa

SEQ ID NO: 275257 - DNA, 398 bp, Homo sapiens
aatcctgacaaaagagaacatcagtcagattcattggtagaagactctgagatgtgttctaatttgatgaagctctgaaatgtgatcccacttctgaagtctgtttgcccagggtcgtggaatagttgtctggtgtccctggcagccctgccgcacgtggctgcacgcccttacgatgcttagatgcatattgtttaccggtctcccactgcgcatttctatgacttgcagagtaaatgcttctgagaagaactttgtgttcttgcacaagggacatttatgaaataaacatatttctggccctatacatttgtcttccaaggaaccaaaaccaatccgttgaattagacacgagtaagttctgttaattaaaaaaaaaaagtcaatggtgagttatg

SEQ ID NO: 275258 - DNA, 584 bp, Homo sapiens
atgtaaagaagcatttgctaggagttctgagagagaagtttctgcatagcttagagagagctacaagaagagactgccactcttattctggatagtctagagttgaggagtgagttctagagctagcatggccatttcttttactataatgagagtctagcctgaggaaaaattgaatacacaaagaagggcaaaatacataacagtgaagcatagagaaagagaagcttgatggcgacaggaatctcagcattgaaatgtactagaaaacacacaaacttgaaccatgaagtctcattaaaaattttaatttgctcaaagtaagttttctgacacttgcaacgtaaacatctcaacaaaatttaactctacgttgtatcagtgaaaactgacccatactacaattgactgggtgaacttaactgtgggttcacaagaccacgtaatcaacaaggacatcccaaatccttccatgcacaaggcatcatggagaattttagtgttagtataggaacgaattatccataaggaatacactccagttaggggaagaggaataccctataggaaacgaagatgagcaa

SEQ ID NO: 275259 - DNA, 608 bp, Homo sapiens
acatttcaccagcagccatccttccgagggacactctaaccctgaaagcttttacttaatctctgcaatttaggaagatttctggatgtcaatttaactgcgttgggaaggcaagacggtgtgggaccaagaagggcactgtctagccctcccggcaggtctcacactcctgcatgcccaagggctgatgggtggactggaaaagcggctgcagcaaggctggtttggtttctttcctgaagctcacaggaatatagtgccttggttctgtaaacaccataatccctgttcctgaatgttttctttgaaatcaaccacatcttgggagacagatgaccttaagcacacagtatgcagggacccagtttcctttcccagaagacgaaagctctggactggaacctctgaccacagtcagtcttgctctggtccttgatgttctgggatcctgatcgtcaggaaatctcgacggaccgtccgtgggaagtgccaaggggctgacaacccagctggaaaggcccaggcttggcctccacccagctgactgctgggtctgggatttgatatgattccacttaacaggctagtatgtgagcctcttactgttt

SEQ ID NO: 275260 - DNA, 419 bp, Homo sapiens
gagcactaggactttgggtgaaatctgtcctttctactttaaatagtagtgtgtacaattctgtagctaaaatgagtatgttgttaattaagggttttctatgtctctgagaggtaactgaaaaaaatttgtaatgatgcaggaaattataaaaatacatggaacataagtttttctaaactaattagcaatgttggcctatcatagtcattatttgatgactcagagaaaagtgacaataaccagtgcaaagtgcccttagttcagtgagtgagggaagtccttgactcctgtaggcaatcagtctatgcactgaagcatgagatctacttaccattatattgctttggctagctgcaaatgtattaatattcatgccattatcatctggcctcttttgaagctagcaacagcaatct

SEQ ID NO: 275261 - DNA, 354 bp, Homo sapiens
aacagaagaggaaaaggatgataaaaaatgtaatcgaggtaacttatttaatcttacatgctggttgacaaaaattcctcactgttagcagttcaaagtatgtttctcagccaggtacggtggctcacgcctgtaatcccaacactttgaggggctgaggcgggtggatcacttgaggtcaggcatttgagaccagcctggccaagatggtgaaacaccgtctctactaaaaatacaaaaattagcagggcgtactggcgcacacctgtaatcccggctacttgggtggctgaggcacaagaatcgcttgaacccaggaggtggagattgcagtggccaaggtcacgcccagcc

SEQ ID NO: 275262 - DNA, 410 bp, Homo sapiens
tgagacagtctcgctctgtcgccaggctggagtgcagtggcgcgatcgctgcaacctccgcctcccgggttcaagcgattcccctgcctcagcctcctgagtacctgggactacaggcatgtgccaccatgcccggctaattttttgtattttaggagagacggggtttcaccatgttggtcaggatggtctcgatctcctgacctcgtgatctgcccgcctcagcctcccaaagtgctcggattacaggtgtgagccaccgcgcccggtagactggccttttctaaaaacaaggcaatccctcatttggaaggtagacatgtaactgattctatactgttccaagattttttttaataacatgatacaaacactatcagatccagaaacaagcaaagcagagtactctg

SEQ ID NO: 275263 - DNA, 334 bp, Homo sapiens
tctgcactcacccaccttccgcagtgccagatcgctttcctcctcagaatctgaggaatagaaccaagccaccattaccagcccaggttcgcttttataagagagattatacttcttcccgactccacggaaatgatagggcttcttccttatcaactttgcctccctggacctttcccaatgaactgttaatatactttctaggaaagggccgggcacagtggctcacgcctataatcccagcactttgggaggccaaggcaggtggatcacctgaggtcaggagttcgagacccgcctggccaacatggtgaaacccctgtctactaaaata

SEQ ID NO: 275264 - DNA, 352 bp, Homo sapiens
ctttggcttctcgggtggccatccctaccttggagaaaagtcctcaggcagcgaggtgcagatacctgtagttggaggtcagctttgggtggctagggcaaattcagccccatcttgtaattgtgatgatttatacacatttgttcctccatagcaacctgtcagatccctgaaggcaggatatgtaatttgtcttgtgttctaatagcatttagtgcatattatgcttttttgtttgctcaatgagtgagttgattgttggtactttctactttggcaaagtgttacaagtgcagtttatggtgcagttcggactccagcctgggcgacagaacaagactctgtctcagaa

SEQ ID NO: 275265 - DNA, 526 bp, Homo sapiens
ctcgtgccgaatcggcacgagctggcatataaaaccttctcaataaatgttagctcttacatttactcctctattagaccataagctgagtaagaggaaggccccagtcgtgtcatttgtgataactcatgcatagtaggtactcacacccacagacgactccggtctctcaagagacaagaaaactgattttttaccatctcggacggctacaaaagggtataataactcatgaaggcaaacagagacatttacaaatgggtagattaggactggacatggcattggagcatttgcgtagctgttatttctgtagcagataatggaaagtgaaaggggtgcacgtcagcgtctcttccacggtgagaaggaagtcactgttgcaagaagctaatgcgaaatcatttctctctgatttacctgaggaggttaacaaggacccatcaaaaccttccaggcttgatgccccatagtctgctggttaataaacttcactcatgcaaattctgtcccatccttaaatttg

SEQ ID NO: 275266 - DNA, 1541 bp, Homo sapiens
tggtctactggaaaaattgtgttttccctcctggtgctgttggtcatgctatctcctatccctagggtggtcttcacagggtgggaatccttctagaggtgtatgaaattcctggccggtgggaggccacaaagttactactgtatttttcaaaataaggattttattttttattttattttgttttttttgagatggagtctcgttctgtcgcccaggctggagtgcagtggtgtgatctcagctcactgcaacctctgccttctgggttcaagcaattctcctgtctcaccctcccgagtagctgggactacaggtgtgcgccaccacacccggctaatttttgtatttttagtagagacggggtttcaccatgttggccaggctggtctcgaattcctgacctcaggtgatctggctgcctcatcctcctgaagtgctgggattacaggcgtgggccactgcacccagcctcaaaataaggactttctttaaaaagcttaagaaactgacctaatacaatttcttccattgaaaatttatctgtcagaattctgcctctgtgtgcctgaaaacacagcgccaaagctcctggcagcatgaagtcttccctttcatttcagtcaagcaatcagatgtgtaagaggataaacaaacactcgtaatgaataaaaatcctcggccacacggactcagagggagggactgagcaggaatcgtaaagtgggcatttagctgagcatggtttccactaatcattgttatttttctgagccagtatagaatagttaaggacaagggagccctgcttgcttctgtttgggcttagagtccaggcttggctactcattagctgtatgactcatggcaagttatttaaccttcctgatccccaaatttctcatcaatacaatgaggttatgagagtagctacttcctaggaacataaaatgaaaaaaatattaagtgaaaaaaaatgcacgtaagatacttaccaaaatgacggctgtagttaaacgttagctgttatatttatctggcatataaaaccttctcaataaatgttagctcttacatttactcctctattagaccataagctgagtaagaggaaggccccagtcgtgtcatttgtgataactcatgcatagtaggtactcacacccacagacgactccggtctctcaagagacaagaaaactgattttttaccatctcggacggctacaaaagggtataataactcatgaaggcaaacagagacatttacaaatgggtagattaggactggacatggcattggagcatttgcgtagctgttatttctgtagcagataatggaaagtgaaaggggtgcacgtcagcgtctcttccacggtgagaaggaagtcactgttgcaagaagctaatgcgaaatcatttctctctgatttacctgaggaggttaacaaggacccatcaaaaccttccaggcttgatgccccatagtctgctggttaataaacttcactcatgcaaattctgtcccatccttaaatttg

SEQ ID NO: 275267 - DNA, 1043 bp, Homo sapiens
ctgctatccatattgatcgcctggactgtgcagtatttccagtctgtctcagaattctgcctctgtgtgcctgaaaacacagcgccaaagctcctggcagcatgaagtcttccctttcatttcagtcaagcaatcagatgtgtaagaggataaacaaacactcgtaatgaataaaaatcctcggccacacggactcagagggagggactgagcaggaatcgtaaagtgggcatttagctgagcatggtttccactaatcattgttatttttctgagccagtatagaatagttaaggacaagggagccctgcttgcttctgtttgggcttagagtccaggcttggctactcattagctgtatgactcatggcaagttatttaaccttcctgatccccaaatttctcatcaatacaatgaggttatgagagtagctacttcctaggaacataaaatgaaaaaaatattaagtgaaaaaaaatgcacgtaagatacttaccaaaatgacggctgtagttaaacgttagctgttatatttatctggcatataaaaccttctcaataaatgttagctcttacatttactcctctattagaccataagctgagtaagaggaaggccccagtcgtgtcatttgtgataactcatgcatagtaggtactcacacccacagacgactccggtctctcaagagacaagaaaactgattttttaccatctcggacggctacaaaagggtataataactcatgaaggcaaacagagacatttacaaatgggtagattaggactggacatggcattggagcatttgcgtagctgttatttctgtagcagataatggaaagtgaaaggggtgcacgtcagcgtctcttccacggtgagaaggaagtcactgttgcaagaagctaatgcgaaatcatttctctctgatttacctgaggaggttaacaaggacccatcaaaaccttccaggcttgatgccccatagtctgctggttaataaacttcactcatgcaaattctgtcccatccttaaatttg

SEQ ID NO: 275268 - DNA, 658 bp, Homo sapiens
ctacccacttcattctctatgcttcagcctcacagatctccttgcgaatttcctggaaactcacacgtatgcttctatctttggaactttacaccttattattctattagatatcctcatggtttgttccttcattggcatcatgaagatctcttctcaaaaatcccttcgtaaaacatatcctccatgacaacccccccaaaactatagatttatcaaggaaaatccctccccagtatcactcttcccttatttctccttctccattgcccttattatcttctaataagctaagtaatttacttatctcattttccatttccacagcctagcatataattccatgaagtcaggagctttaaatgttttagtctcttgtatccccagagcctaaaacagtgccttgtatgtaacaagtatttaatacataagtaaattagaattcaataaaaaatacatgtaagaatgtttacaaggatagatgtccaataaatggtttttcttactatttgtaaaaacttgcaaattcaagtgcagttatcccaaaattggtggggcaaatagtagtgatcaagttgatagagaacgatataaactagaagtcattctcccatacacattgaatttttaacgccaaaattccatctgggaaggtcat

SEQ ID NO: 275269 - DNA, 373 bp, Homo sapiens
tgatcattgatcattgatcactgatgccttgaactgctggactccagcaatcctcctcccttagcctccggagtagctgggactacatgtgcacgccaccatgcccagtggtttccttttcgtattgtacattttcactagtagggcagatcagctgaggtcaggcattcgagaccagcctgtccaacatggtgaaatcccgtctctactataaatacaaaaattagccgggtgtggtggtgggcacctgtagtctcagctactctggaggccgaggcaagagaatagcttgaatccgggaggtggagtttgcagggagctgagattgtgccactgcacaccagcctgggcgacacagtaagtctctgttaaa

SEQ ID NO: 275270 - DNA, 417 bp, Homo sapiens
tctgaggctttatatgttgctggagaaattccagccagcttcctttttcatttatttatactatgcattagaatgttgtttttcaagcctttaaacggctgtggaaccctgtgctcactgaagttttacgtcaagtcctgctgggtaaatccaataaaagagctggtctggttgcagtgatgggtgatactcaacgcatgtactcccaaacccttggccccccaggactctgtggggccccagcaaattcctagtgttcctcagatgctagttgaaaacccactgctactgggcacagtggtgtacacctgtagtcccagctacttgggaggctgaagtgggaggatcacttgagcctgggagtgtgagtccggcctggacaacatagtgagaccctgtctgtggaacaaaaacaag

SEQ ID NO: 275271 - DNA, 684 bp, Homo sapiens
catttcaaaaggagatcagggactccaggaagcagagcgtaactccccacttctaaactgtgggcttcacataatgacatcctaccaagaaatcagtatagcaaaggaggaaaaagagtaacttcgcattggagaaacctaacaaacactgtctcagccaggtgatcaaggccactgtgagcagtgatcagtcaagtcgaaagtgcatatcatatgacaggatgagaatggcattttacctcgacatcttccctcccaaaactaataatcctactacatcagacaaacctcagctgagaaacagtttccaaaaacacctgactagtaccccctaaaaccatcaaggtcatcaagaacaatgtagtcctgagaaatgatcacagccgggaagaacctaaggacttggtgtcctttggtatcctgatatggaatcctggagcagaaaaggacattaagtaaaaaccaaggaaatagaaataaagtataaacttaataatatatcaatattaattcattaattgtgacaaatgtaacatagtaatgtaagacattaaaatggggaaaattgggtatgatgtggaggagaactctgtgtattctatttgcaactcttctgtaaatgtaaacctatttgaaaattaaaaatttattttttaaaaagaaaattaagaaacctatatactt

SEQ ID NO: 275272 - DNA, 700 bp, Homo sapiens
ggaggtgagctgtctcggaaggagccctccacgcagaccccacagctatattaactgtgcttaacgtaatcatgaacacataatcgcggggctattgaagactccataacaaacaagatcaaggagcctggagcctctaaaacatgaaaaccaattagcactatgaaatctaagagcagacacagccagagctcgagaaaaggcatgggcaggagctggactgctcaatcctgctcactcctcccttccttcctgttacacggttctgttctgaggtgctgctgagaggggcttcctctcctgggccagaactgaggctaaggcccgaagctgaggacagaaagtgatcaactccccacattctaaagaggctgctggagaagcggccacgactggggcctgacatccttctctagggattatcaggcagcactctgctacccatcccacaggaccgtaacttatccttcccaatccgtagaaagcaagactctgaagcatgtgcgtttgtctttggccttgtgggaggtttctattcaagaggaaaactgatgccatgaaggatgggatgaggtgctttctcttcccagaagggaaagatttgggtgcctcgtgaaagggagtctggagtcagctccctggtcaatgatctacttgcagagacaactctctgatctcaccttaataaatgagattcatt

SEQ ID NO: 275273 - DNA, 454 bp, Homo sapiens
ctgggttcatgccgttctcctgcctcagtctcccaagtagcatatacgttttttttttatacacatgggcaaatagaaacattcttttgctatcagtggagagggtctaaaagaaatgacatctcagtagcaacaagcacacttaatgcctagatctagtttccaatgtcattcttcaatagaaggccccttccaagtcatatatatatatacagggttccttgaagaaatggtcaattctaggaccaaggcaggaaatatacgagatgagcctggaacttcttttagtgccaaaaagtaaggaagtgcttaaataaacgcaaacaaaacggaagcccacattgatggggatgtgacaagtggcacctgtgctgactgaaagagcccccagtggccaaccctggaacaatttagcaacaaaataaatggccccaaactccagtcttatcatgag

SEQ ID NO: 275274 - DNA, 487 bp, Homo sapiens
gtgttttcctggatactagatatgctgagttgggacaggagctaaggatagaggtgaggaaacccgcagacaacagcgacatgctcctcatctttgagtcccagcgaacctttccactgtgtgtgtgtgctggaatgcagttaactgatcacctgcaggcttgaactccagggttcaagcgatcctcctacttcagcctcctgagcagctaaggactacagcacattatgttcctgaaaaccaggaactgcttcctgtctgacccactgcagtggtggagaggatcaagggaaataatgatcatggatgtgcttaggagacgtaagattttactaagaattgctgtgagctgggcacccttctacgctctgcagacaccatggctagtaagacaggcaaagacctgccatctggagcttgtttggatatagggtagggggacggggagaagggagataaacaataaacaagtaaatttacactcaaa

SEQ ID NO: 275275 - DNA, 580 bp, Homo sapiens
gtgttttcctggatactagatatgctgagttgggacaggagctaaggatagaggtgaggaaacccgcagacaacagcgacatgctcctcatctttgagtcccagcgaacctttccactgtgtgtgtgtgctggaatgcagttaactgatcacctgcaggcttgaactccagggttcaagcgatcctcctacttcagcctcctgagcagctaaggactacagcacattatgttcctgaaaaccaggaactgcttcctgtctgacccactgcagtggtggagaggatcaagggaaataatgatcatggatgtgcttaggagacgtaaggtgagatacaccatcatggagctgtctctgctctccctgtcccttcagtgtgcatggtccataccactcagtcattccttacccactctacagattttactaagaattgctgtgagctgggcacccttctacgctctgcagacaccatggctagtaagacaggcaaagacctgccatctggagcttgtttggatatagggtagggggacggggagaagggagataaacaataaacaagtaaatttacactcaaa

SEQ ID NO: 275276 - DNA, 207 bp, Homo sapiens
cagtctcatctctggtggtagggctgtgtcttaccctctcccagggaagtagctgtggggaggaggaggtgctgagggagtagtggagggaggggagttgctgagggagtagctggggaaggtgaagtactgagggagtagctgagaaaggggaggtgctgagggagtagctgagggaggagaggtactgagggagtagggagggag

SEQ ID NO: 275277 - DNA, 742 bp, Homo sapiens
ttatcctaagcaaattaatgcaggaacagaaaatcacatactgtatgttctcacttataagtggcagctaaacactgggtactcatggacagaaagatggcagcaacagacactggggactactagagggggaaggatgggaggagccaagcactgaaaaactagctattgggtactatacttactacctgggtgacaagagcaatcataccccagacctcagcatcatgaaatatacccaggtaacaaacctacacatggaccccatgaatctaaaataaaagttgaaattattaaaaaggcaaaaataaaaaaataaaatccaggtaattgtaagtatataaattatatcttaataaagctgttaaaaatgtttaattaatcagttaatagatgggggaaaatgaaacagtaaaaattatccagtcaatcccaaagtaaaaatgaaatgagacaggccgggtgcagtggctcatgcctgtaatccaaacactttgggaggccgaggcaggcggatcacaaggtcaggagttccagactagcctggccaacatggtgaaaccctgtttctactaaaaaatacaaaaattagccgggcggggtggcgggcacctgtaatcccagctactcaggagactgaggcaagagaattgcttgaaactggaaggtggaggtcacagtcagccgagatcacaccactgcactccagcctgggcaaaagagggaaactccgtctcaaaaa

SEQ ID NO: 275278 - DNA, 396 bp, Homo sapiens
cctcccttcattgacacagacacactctctaagcttggatctgtagttctcacacgcagtgaggtttcagcactgtcttctaccatgtcctaggatacctgggctccttgaccctggggagctttaccttggctttcctggccatgggtttgcctgacaccttcaataagtcaagttcttgatgttcagcatgctggtgttctgcagtcacctccctccttgccgaccacagcatcaaggggaaggtcctggaagccatggggttcttcttcatcttagctttcagtgctgagctacttggctgcatctttgcccccatatattacgttactcttatgagatatgaataccttccaaggtctgaagattaaaataggttctggaagcagtaagaat

SEQ ID NO: 275279 - DNA, 210 bp, Homo sapiens
ccaaaaaagaaagtattagagttctctctgcctcaattatttataaaatataattattttcaaggagaaaaaagttcctcattctgtttattcttccccacagtttctgacctataaacaatatccaggatatttagcacaggacctagtatatagtcgactcttcataaatatttgttgagtaaataaatgctggtgattttctcgttg

SEQ ID NO: 275280 - DNA, 387 bp, Homo sapiens
acctcctcgtcttcctttttctcctggtctccaggtcattctggcctttacttaaacatccccactttgctctgtgtgacttgaacattgggaatgtaataatgaccacttttgaaaatgtaaaacagaaaacaatattacaaatatttttgtcagattctatacccaggtaagatagataaagacaaataatttcccttctctgtgtaacttttaaagtgttgtacaagttaaagtatgagtgaaatactgaagaacaaggcagttattaaaaacctctgatgacattgggcatgtgggtatttgctttatttttatgcttctattcaatatgctacattcaaaaaaactgtaatgggtgattaaaaacttgtatctgagtccagt

SEQ ID NO: 275281 - DNA, 362 bp, Homo sapiens
tgtgtaactgacctgcttcatctagaaaattgccggcgtaccagcaatcacacttgcattttaaattctaaacattgggccaggcacagtggctcacgactgtaatctcagcactttgggggagccaagacgggtggatcacctgaggtcaggagttcgagaccagcctagccaacatggcaaaaccccatctctattaaaaatacaaaaattagccatgtgtggtggtgggtgcctgtaatctcagctactcaggaggctgaggcaggagaatcacttgaacctgggaggcagaggttgcagtgagctgagattgcaccattgcactccagcctgggcaataagagtgaaaccccatctca

SEQ ID NO: 275282 - DNA, 398 bp, Homo sapiens
aggactttactataaggaacctagggcctgcacttagagcaaaagttccatgaggggagagactgcacatgccctctttgcttttatccccaagcacttagcatttagtaggtgctaagaaaaaggaaagacccaggactgggcgtggtggcgcatgcctataaccccagcgctgtgggaagctgaggtgggctgatcctatgagcccaggattcaagatcagcctgggcaacatggtgaaatcccatctctacaaaaaatacaaaaaattagctgggtgtggtggcacatgcctgtggtcccagctacttgggaggctgaggtaagaggattacctgagcccagaaggccaaggctacagtgagccgtgatcatgccactgcacaccagcctttttc

SEQ ID NO: 275283 - DNA, 181 bp, Homo sapiens
atcagctgtgcagagagagggacccggaggagcgtggggctcagagagacacagaaagagggtctcacaggaatcacaggcagacccgaggcagaaccccagggaacgtagcagcatctgagcatccgggagacagccctgagggaagagagactgaagccgatagggtctgaggcgggga

SEQ ID NO: 275284 - DNA, 527 bp, Homo sapiens
cacatttgctcagaatgtccctgcaagcagaaaatgcaggacctcagcaagaaggttcagaaagtaccctgttcccctaataaactccagatgcatctgcatctggcttctgcacacacgtctgaatggccaacttggaaaaactcagaggaaaggaaccaggagtggtggctcactcctgtaatcccagcactttgagaggccgagacaagaagatcacttgagcccaggagttgaagaccagcctggggaacatggcgaaactccatctccacaacaaaagtacaaaaaaaaaaattagtctggcatggtggcgcgcacctgtagtcccagctactggtggtggcagattgggtgggggttagggggtgatgtaggaggatcgcttgagcccaggaggtcaaggctgcagtgagccatgattgtgccactgtactccagcctgggcaacagaagaaaaccctatcttggtaacaataataataattttaaaaagaaaaataataaaatgaacttgaaatttttaa

SEQ ID NO: 275285 - DNA, 319 bp, Homo sapiens
tatatatatatatgtatatatatattaatttatagttcctaggactttttaagagttttacagtaatcttcagcatttaccatgcaactttcttgtttgattatgcataggattgattagacaggtattttcaaaaagcctgcaagcatagtactcagactcattgaaagtttatagaatttggcctgtgtggaaaactctgtgctccaagtacaacaactaactgaattctctaatttaaacaactttgaagggaagtgaaaggttataaaatgatacagactcataccgcagaatcaccttaaaatgcagctgttgg

SEQ ID NO: 275286 - DNA, 377 bp, Homo sapiens
ggagtgggagttgactgggcagacattcacctcacctcggtggagtcatcgtatagtttaaagcagcagttgtcaaccagggtcagtttgtcttgaggtgacatttggcagtgtctggagatatttttaattgtcaagacttggaggggagggtaatactactgccatctagtgaatagaggccagggatgctgctagacgttctacattgcacagcatattccctcacaacaaataattatttgcccaaatgtcagtagttccgagattgagaaaccagcttaaagtgtacaggtgtgtgtcgtatgattgagctagggttctgtgctagtaaagttgttttgcctgcaaacatcagaaagctgatctatttaagt

SEQ ID NO: 275287 - DNA, 330 bp, Homo sapiens
aaagactttaaaagactagtacatacataaacacacaaacacacacaaaaagcagaatggtggtattgtctcactctggtgaaggacagtggaaggaaacaaggagaaccttctaattctttatgcatttgttttgttagaatattgtgcaaagtgtttagctgttgtgtgatctctccataaaggcagagtttattatgattgtgaaaatcagataaaagttaaagaatgtacaaaactaaagtaaccggccaggcgtggtggctcacgcctgtaatcccagcactttgggaggctgaggcgggtggatcacgaggtcaggaaatcgag

SEQ ID NO: 275288 - DNA, 111 bp, Homo sapiens
tgtaatgaactatttgttctcttctagatgacagccagttgcttaaaacctataatgagatgtcaggtgaattgcactgattggcattgatggatggacttgttgaaatat

SEQ ID NO: 275289 - DNA, 557 bp, Homo sapiens
gggccacaaaacacatcttaacaaatttaaaagaatagaaattataccatgtttgcacttagactataatagaattaaagcagaaatcaatacagaaagataactgaaaaattcccaacacttggagattaaacaacacacttctacataacacatgagtcaaaggagaaatctcaggagaaatttaaatatattttgaattaaatgaaattaaaatatgatatcagaatttgtgggatactgcttagcagtgcaagcagtatttagagggaaatgtatgacattgaatgtgtatattagagaagaagaaagatctaaaatcagtcatctaagctttcaccttaggaaaataaagagaacagcaaattaaatccaaagtaagcggaaaaataaaaattagagcagaaatcaatgaaattgaaaacaagaaatcagcagagcacaatggctcatgcctataatgccagtactttgggagggcaaggcaggaggactgcttgaagccaggagtttgagaccaaccagagcaacatagtgagactctgtctctacaaatt

SEQ ID NO: 275290 - DNA, 164 bp, Homo sapiens
tagccctccttcccctcctaccctccacatccacacttctctccgcagcccttcccgtccacatcgatcagtagccttcaattaaactgctgcacagcaagtgtcactgcgcccagcccacttccatttattcttgtattcttgtatcagttaagcctccctca

SEQ ID NO: 275291 - DNA, 211 bp, Homo sapiens
gacgagtgacgatagaatgtataagacaaatcacagttgggaggaatgttgcttttatgccaggcatgctttcccaggaaaacccagggaagccagcttggatggcataggagctactgaatgaagggaaaattggctttgatgcttccctgattcccccagcccagttctgggctgtgtgttataattccgcctcagataaaaacatgtc

SEQ ID NO: 275292 - DNA, 1093 bp, Homo sapiens
atcacttgctctgatcacacagagtcaatctaagcctagtcccactcacttcatccagctgtcccacactgcctggctttgcaagacagcagccgaatcttattagaagtctgggcatcgagtcctccttcttggtttagaattgtcttggaataaatcatcctggttggggagagcaccagagaattatagaatcccacaggcttctcaaagataattcactttaaactgttctccgtaaaagccacataaaaatgtccaacaaatcatagaaaaatgagctcatggagttaaccacaaacttgaataagaatgtgtttgtccagagctagaagtatgtagaagatgttttcaaaagtgtggcaagtagtaaaaattgggagaagaaagagactggagcctggtttggttctcattgtttttctgggaaagaacggagaaactagttagatccaattctccttgccccaccctaatttttgatgttctcagaatttgtttctttgaagttcaagctaatagatttatggcctctttaagcagttgaaaaccatcacattacactcaaatgcacatgttttttctcactccagcagaaacatctgaaagttctgtttaggtatttgcaaagaactagtatgcctctcagatagcatatactttaggcagaactgctcttgtctaacttatttcatgtgacatgcagtggagggattgttgaatgaaatgttagtgtgagtattccttaggtgttattgtgtcttgggtttaaaaatggcagatggagtcaagacaagcctgtccctctttctgtctgtgtcaggctttgccgtctgttctcttcctggcttcactggaacagacatttttttttatgtatgtgcacagtgctagtgtcacaggatgacatgacatgctaccaggactgcctcactgtcaggatgggtccagtgactctacaagttcctttttgaaatgggaatctggtctagatttttgcacatctgttagcttcttcacataagtccaagtctttctcacatgctaatttccttgtatcctatttctttgtaggatttaaaaaaaaaaaaag

SEQ ID NO: 275293 - DNA, 540 bp, Homo sapiens
acctacccacactctgtactgatagacattaaatatacaccatccttaccagtttatgagtgattggaatttttgttgttctaagagaatacaagttgttggaaaatcatagaccctaagttactggtgcaagataactgaaagtccctggcctgccattatgataagtacattctacatgcatcctttgttatttctgcatatttatacaactggaagctaacactctctgcagtgcctggggggaagtgctgatttcttagacctggaagaattctatttcatttattctgaatcatagcatactatatgctttcaacgtgggtagtctttcatttccggtcaaattttctccctttttattaagttacacaaagccatgcactttcttcccctcttcattatgctctgtgtacagaggtttttttaatcagcatcctctgaacagactctgctttgtaagaattcctcagaaaattgttcactgtgcagatctgtgtttgaaaatggccacgattaaagacatttctcagcagttca

SEQ ID NO: 275294 - DNA, 751 bp, Homo sapiens
gaagagaagtgtgttgagcactgtgtcaaactagacacagaaagccaaaggtaacttaagacgtaatccttactttcaaaaagttcacaacatagtatgtatgtgtggagaggggagggagggttgatatacaaacccaaaggtaaagtaagagctgttcaatattataggtatgataataaacatcctgtagcatttagtgaatggataaagaagggagtggtcagttcatcctggtggtgtcacatacgaaagttacattttcacacagagtcttgaaagtgtgtttgtattgcaaagtaagaagaggggaaggaagagcatttcagacagagagaacagagtaaactaagatctagtgatgtgaaataatggaggattcaagactctaacagaaacatggctcccacataaacataagaaggattgcagaagaggggggcagaagccagatcatgaaaatacatctatacattgctaagaagtttagcatacacagtacctttggaatattttaatcaggggaaagacgaagttatgttttagaaagaatacttcagtaacaatgtgacagatgaattgaaggaaagatgagtacagcattagagacaaaaacttgttgcattcgtccaagggaggaaagtagggtagtagcaataagcttggaggggaaaaagtggataccagagagattcagggataatccactggacttggtgatagactaaatgttaagaggaaaggggaggag

SEQ ID NO: 275295 - DNA, 521 bp, Homo sapiens
gctgaaacaggtgtcctccacctagttgcggttatagatttccaagcccttccacaaccagatttggaaatatcccagatcttagatgtccgtgggctaacttccagaaggtgcacacagggcatggcataatgggaattacttgagcctgtatacagaagcagcagacatcgcattgagcaaaagggtaaaggctaacagtaacggagtcttatgtttgtacagcagattgaaaagctatgatgaaacggaaggcctgtaatgttgcttataaactgtggtactaataaacaggctagaaattttctttaactcatccatctaggcacacgaagttctaattagcctttgaacagacttggcacatccaaatcaaaactgcagataagaaagattctacgagtcagagccataatagcaatgctaataacatcaccataaaattgtatagtattggtatgctcagccataggaaacaatttccagtgtgttcagaatacaaggtatttctcgttaacaaa

SEQ ID NO: 275296 - DNA, 470 bp, Homo sapiens
ttccagttgtttgttattattttttaaattctgcagcaaataacctcttgtacatatgtcattttgcaaatgtgggcatatttctgaagttagcacttcttgccttgattatcctaatagcctcctaacctgtttctttttccttattttcattcatctgtaattgctgtgctggcttaaacgcttttaaaaagtatttgatgacattttaattttttccctacacagctgaggggcgtagagtaactccttcactcctgggattcagtaccattccctcagctggcatacgaagctctcctagttacttgttaggtacttaagttcccagaaggacatgggaggattaagacactgttaaattcatgggagtgttctcaaatataatttaaactaaaaatagaagcaatttagtaatatttcccctgttttgcagagatattgcttaggctaattctaacatttgtttg

SEQ ID NO: 275297 - DNA, 670 bp, Homo sapiens
  misc_feature (1)..(2): n is a, c, g, or t
  misc_feature (11)..(11): n is a, c, g, or t
nnagaacgccngtgaattgtgagagtgtgcagtcgcgttcctgctgtccggacacttttttcctctactgagactcatctggtagatccgcaggccagtcctcccaggggctgaagttgtgaaatatgggttttctaagaagattaatctatcggcgtagaccaatgatctatgtagaatcttctgaggagtccagtgatgagcaacctgacgaagtggaatcaccaactcaaagtcaggattctacacctgctgaagagagagaggatgagggagcatctgcagctcaagggcaggagcctgaagctgatagccaggaactggttcagccaaagactgggtgtgagcttggagatggtcctgataccaagagggtgtgcctgcgaaatgaagagcagatgaaactgcccgcagaagggccagagcctgaagcggatagccaggaacaggttcacccgaagactgggtgtgagcgcggagatggtcctgatgtccaggagttgggcctgccaaatccagaggaggtgaaaacacctgaggaagatgaagggcaatcacagccttaaaagaagacacgctgaaatggttcaggctgctcctgtgttggaaatttgaccattaaaattctcccaataaagctttacagccttctgcaaagaaaaaaaatgtg

SEQ ID NO: 275298 - DNA, 420 bp, Homo sapiens
tggttcactgggatgtaagttccatgagaacagggtttttgagggccttttgctgactgctgtattctcagctcctgggacagtgcttgcctctctctctgttgaagcatagcccactgcagttcagacgcaatatgtgttaaaataccagctgtgtgccctgttgatggcaggttggggggtggtttagcacgtcgaggacagcacactgtggctttgcttgccggctcactgagcatatctgagagagcttttcgtgcattatcagtcagccttaattgcagtttcaggccttggtcctaccacactgatcctgtgtgttttgtacaagtagatataaacagggttcatagcactatacatagcactataattttaaaaaattgattatgatgtatttggaaatagctataaatgacc

SEQ ID NO: 275299 - DNA, 2214 bp, Homo sapiens
  misc_feature (1117)..(1117): n is a, c, g, or t
  misc_feature (1119)..(1119): n is a, c, g, or t
  misc_feature (1176)..(1177): n is a, c, g, or t
  misc_feature (1180)..(1180): n is a, c, g, or t
  misc_feature (1184)..(1184): n is a, c, g, or t
  misc_feature (1231)..(1231): n is a, c, g, or t
aacatgctgttaatacttgtaagactcctagcaaactgcatttaattttttaaattagttttagtgtacataaaggcatgtcttttccaaatactgtactttttgaagtgttctttgttgttcattaatctttgtgcgtttccctccagtctctaatagtaggttgtagcatgatttgcttccatcgtgtgaattctgttcggttttgattttcaagtatgagagtgagcgtaagctacccttataggttacctaaggtaagttagaattagaacgtctttatgctagggttactactccccaccataaccaaccatctgcaaaagcgttcagaaagaacatgctagcaaggtcaaaagcttcaaatcacgaaataagaacttgaaaacgagcaaaattgctgctgaggcgctctgccatttaactcaaaggcttcactttatttaggtttaaagtatgagtgcatattcagtggacattgagctccgaactgttcaaaatctctattcatctgcattctggagtagagctgcgggtcacattattagctccatctttggatttctgcctggacccagggcactcctaaccgttgtgggatcatataacaatcttacaggatgaattttctgttagtccaagcagaaattttggcacatgaaaactatcttaccataaacaaacaaaaaaagtacaaatggtaatctaaggaaaatagctaaaatcattaaacaactcttacagccgtttcccctgttttctctccattttttaaaagcatattttcctttactttcttccttctgctatgggaatttttcagggttctagaccttttttctcttctgcggctggaaagttaaacacaggtcattttttaaataagactgctagtaaataccttcttaataaacaacaccaaatgctagtcttgtgggtgagtagttgaacagcaagtaaagcactctatcacctgtaattttcctgtggtaggcacaccccatctctaccttcacgtaatttctgattatgcctccataccttacacatataattcatttgtgggtgggggcgacagagtcttttgctcttttgcccaggctggagtgcagtggcnanctctgctcactgcaacctccacctcccggcttcaagcagttctgcctcagcctcccnngtngctnggatcacaggagcgcaccaccaccccctgctaatttttgtatttttngtagagatggggtttcccctgttggctaggctggcctcaaactccgatctcaagtgatccacccgcctcggcctcccaaagtgttgggattacaggcatgagccaccacgtctggctataattcacttcttgtgtgtgacttcctactaatttgtaatcatgaaagttgggcacatacccagtatgctcactatttctctgcagggcctgatacagtggctgctacaacactgatactctgcatttgttgaatgagtaatttaaattttaaattatcatctagaatcatttagagatttatttagactttgataaatttagataacccacacacagtttattcctagagttcttgatacattgttacagtaagtttggtcctggcaacagcaataacacttactgtaataacttaattcttcatacgaggttgcttcacttttattattaagcagaaaatacccaaagtaaaattgagctatttgggactcctttcagaatactgtgtaggctgaagcattgttgtatcagaagtgctctgttatttgaatgcataaggtattcaacaaacaaatgcttattaaattaaatggtattcagcatacagctactgtcaccgtgctaggagttcacatttttcatatgcgtggcagttagcactggtgcatgtttccttcagcctcagaaatggaggtgtctgcgtgttgcccagatctaccttgaaaactctagttgcttcctaacacctaggttgtatagtgggacttgattatgttttataaagccaagtctggtctgtgaggactgaaaggatttcctcatcttaactctaatttggcctgcaatgtctggggaaaacccaaaactaaaatgtaactaaatgtggaactgtttttttctgcagtttgatttccttgtaccattttcagtacagttaaattcatcacctcccctacctcaccatccccctccccctgcaaaaa

SEQ ID NO: 275300 - DNA, 317 bp, Homo sapiens
cctctatctgtcctcatttttcttcattttcctctgctcctggtgctatgggtatcaaacagccctagatcaagccactgtctccagaggctggaggcttctgtctctggccactattatcagacctatggcttccagaactctagttgctattccccctggaaggccagaaggagggggggcctttaaaactgctgggagctgatattctctgccccaggaccccagtgcagattaagcagccatcacatgaagggccactgccgaggtttttctcctcttctctgaggctgatcctagtagtagttcctttccac

SEQ ID NO: 275301 - DNA, 845 bp, Homo sapiens
acccaggagtcgttcacgcctactgaggagcatgtgttggtggtgcgcctgctgctgaagcacctgcacgcctttgccaacagcctgaagccagagcaggcctcaccctccgcccactcccacgccaccagccccctggaggagttcaaacgggccgctgtcccgaggttcatccagcagaaactctacctcttcttggagcattgctttggccactggcccctggacgcatcgttcagagctgtcctggagatgtggctgagctacctgcagccgtggcggtacgcgcctgacaagcaggcttcaggcagcgactcccagccccggtgtgtgtcggagaaatgggcgccctttgtccaggagaacctgctgatgtacaccaagttggttgtgggcttcctgaaccgcgcactccgcacagacctggttagccccaagcatgcgctcctggtgttctgagtggccaaagtctttgcccagcccaacctggctgagatgattcagaaaggtgagcagctattcctggagccagagctggtcatcccccaccgccagcaccgactcttcacggcccccacattcactgggagcttcctgtcaccctggccaccagcggtcactgatgcctccttcaaggtgaagagccacgtctacagcctggagggccaggactgcaagtacaccccaagtgtttgggcccgaggcccgcaccctggtcctgcgcctcgctcagctcatcacagaggccaaacacacagccaagtccatctccgaccagtgtgcggagagcccggctggccactccttcctctcatggctgggctttagctccatggacaccagtg

SEQ ID NO: 275302 - DNA, 850 bp, Homo sapiens
gaaaaaaaaaaaaaaacaaaaaatacgacataggtcgaggctgcgtgataaatcggccgaggagagcactgcacgcctttgccaacagcctgaagccagagcaggcctcaccctccgcccactcccacgccaccagccccctggaggagttcaaacgggccgctgtcccgaggttcatccagcagaaactctacctcttcttggagcattgctttggccactggcccctggacgcatcgttcagagctgtcctggagatgtggctgagctacctgcagccgtggcggtacgcgcctgacaagcaggcttcaggcagcgactcccagccccggtgtgtgtcggagaaatgggcgccctttgtccaggagaacctgctgatgtacaccaagttggttgtgggcttcctgaaccgcgcactccgcacagacctggttagccccaagcatgcgctcctggtgttctgagtggccaaagtctttgcccagcccaacctggctgagatgattcagaaaggtgagcagctattcctggagccagagctggtcatcccccaccgccagcaccgactcttcacggcccccacattcactgggagcttcctgtcaccctggccaccagcggtcactgatgcctccttcaaggtgaagagccacgtctacagcctggagggccaggactgcaagtacaccccaagtgtttgggcccgaggcccgcaccctggtcctgcgcctcgctcagctcatcacagaggccaaacacacagccaagtccatctccgaccagtgtgcggagagcccggctggccactccttcctctcatggctgggctttagctccatggacaccagtg

SEQ ID NO: 275303 - DNA, 563 bp, Homo sapiens
agacaggcaccagtgcccaagggcacagcctgtgccacccgctgcggatttgcagcagtgcagaagcaggcctgggaggccctctgcagatgtgtctgtcttagtgaggcctcccccggggtgggctgtgtgggcgctgggccaagcacttccataccacaagctggtcacagttcagaccaagcagtgcaaggcacgtctgctgggtgccaggcacagtggtgccccatggggtggccccactcccggcctggctcgtgcctcctgtggggaagcagagcaactggctcggtgcgggatgtggtcagacctggaggccgagtgctatgggtgccgcgctccttcccaggccctcacccctccttctccacccaggagtcgttcacgcctactgaggagcatgtgttggtggtgcgcctgctgctgaagcacctgcacgcctttgccaacagcctgaagccagagcaggcctcaccctccgcccactcccacgccaccagccccctggaggagttcaaacggtgggtggcccttgcggcttcccaccactgccgtctccccca

SEQ ID NO: 275304 - DNA, 396 bp, Homo sapiens
ggtctagcaggatctcccactctcatcatagcgacaggggcaaatcctctctctaaaaagtacaataaacactaaagtaagacaacagagcctggaagttcgaggatgcagtaagctatgaacctattactgcactcccgtgtgggtgacagaacaagaccccacctcttagagaacaacaacaactaaaagaacgaacaaacgactttcttaagaccaacatcctttaattaccttgaagacaatgcactgtctggccctggccatctgctccagcttcttctcataccactctcaaggagacttgctctttctacaaagctactctggcatccaatgctttatatgtaatattccctttaactagaaccacctatttgttcatcctcccaaccc

SEQ ID NO: 275305 - DNA, 452 bp, Homo sapiens
tcagatcaggaaaatggaggaggagacaggaaaagaattctggaattctggttctatccctaggatctatttttggtgtgaccttggtccaccaacacttgcttcttacctcccaacataagaatttcaataacctcaaggaaaaaagaataacattagcaacaacataaaaatcacaaaagcaactggcctgcatttaaaatgatcaagaattccacttcaacagaaatttgtaagtacagaaataaatatataactagctcattttaaaataaaattggggctgggtgtggtgactcacacctgtaatcgtagcactttggtaggctgagatgggcgaatcacttgagatcaggagttcgaggccagcctagtcaacatggtaaaacctcgtctctactaaaaatacaaaaattagctgggcatagtggtggacgcctgcaatcccagct

SEQ ID NO: 275306 - DNA, 370 bp, Homo sapiens
ctggcaggggcatgggtgccaggtaccacgcggaaagccgggccgagcatgctgagagcctgggggacccgacgccgccgggatttacctctctctctccctctgtgtatatataaacgagtccctctctacttgtatttaaccgtgggtgcacgtgagtgtgactgtgcggtgtgcgtgtgttccgcttgtgtgtgtgcgtggggccgccctgtgagggcgcggcgactgtgcgcccaggaggcaaccgggggcgttgtgtgtgtcgtgacttcgtacctctcaagcccctccttgtacttcactgaaggatggcactttggtggggttggaaacaaagtcgacattaaaggtcatttctcctgttcgg

SEQ ID NO: 275307 - DNA, 462 bp, Homo sapiens
ttactattttttccctttacataatctattgtttggaagcaagacactaaattcagcccatactcaaggggtgaagctttaagttccatctctggaggggaaactgtctacatgtattatttggaattctttagtaaggaagatttatcttttacccatttatttatttacttaatcatatacttacatatgtatgtcagcatagatccaggtatatttattttattatttgggttaaaatactgtactgtttggttgttatgaatggttaattttagaagtcaacttgattaggctaagtatgcccaggtaactggtagaacattatttctaggtgtggctatgaagttttttctcctggaagagaaaaaggacatagtaggaagagatttgaatcagttgactgagtaaagaagatagccctcaccaatgtggtgggcatcatccaaactgttgcatgat

SEQ ID NO: 275308 - DNA, 1456 bp, Homo sapiens
  misc_feature (92)..(92): n is a, c, g, or t
  misc_feature (856)..(856): n is a, c, g, or t
  misc_feature (863)..(863): n is a, c, g, or t
  misc_feature (869)..(869): n is a, c, g, or t
  misc_feature (883)..(883): n is a, c, g, or t
  misc_feature (935)..(935): n is a, c, g, or t
  misc_feature (952)..(953): n is a, c, g, or t
  misc_feature (958)..(958): n is a, c, g, or t
  misc_feature (1032)..(1032): n is a, c, g, or t
gggagtccaacgatcacgtgtgtctccagcactgtttgagctggctttatgtgctggggcagaagagatccgatagctatgttctgctggancattctgtgaagaaggcagtacatttgggttaccgtacctcgcctccctgggaatacagtcccttgttcaacagagagcttttgctgggaagacggcaaacaagctgatggatgccctaaaggactccgacctcctgcactggaaacacagcctgtcagagctcatcgatatcagcatcgcacagaaaacggccatctggaggctgtatggccgcagcaccatggcactgcaacaggcccagatgttgctgagcatgaacagcctggaggcggtgaatgcgggcgtgcagcagaacaacacagagtcctttgctgtcgcactctgccacctcgcagagctacacgcggagcagggctgttttgctgcagcttctgaagtgttaaagcacttgaaggaacgatttccgcctaatagtcagcacgcccagttatggatgctatgtgatcaaaaaatacagtttgacagagcaatgaatgatggcaaatatcatttggctgattcacttgttacaggaatcacagctctcaatagcatagagggtgtttataggaaagcggttgtattacaagctcagaaccaaatgtcagaggcacattagcttttacaaaaattgttggttcattgtcagaaactgaagaacacagaaatggtgactcagtgtcctactgtccgtggcagaactgtactggcgatcttcctcccctaccatcgcgctgccatgctcctgcagggcgaattgggtacgggccccccctcgaggtcnacggtgnggcgcnctaaaactattggngccccctccagggaattaccggttacattatttgggcccctgaaaccattgntgaaacttggttttggnncaccncatccttggaatcccaaaacaggccttaattctcctccacatggccatcgagcccatcttggctgacggggctntcctggacaaaggtcgtgccatgttcttagtggccaagtgccaggttggcttcagcagcttcctacgatcagccgaaagaaaagcagaagctctggaggctgccatcgagaacttcaatgaagccaagaactattttgcaaaggttgactgcaaagagcgcatcagggacgtcgtttacttccaggccagactctaccataccctggggaagacccaggagaggaaccggtgtgcgatgctcttccggcagctgcatcaggagctgccctctcatggggtacccttgataaaccatctctagagaggacatccctgctgggctgctgtgcagagtataagattttggacttgttcatgtcccctctctccctataaatgatgtatttgtgacaccctatcttgtcaataaacagcattctgatt

SEQ ID NO: 275309 - DNA, 1417 bp, Homo sapiens
  misc_feature (92)..(92): n is a, c, g, or t
  misc_feature (817)..(817): n is a, c, g, or t
  misc_feature (824)..(824): n is a, c, g, or t
  misc_feature (830)..(830): n is a, c, g, or t
  misc_feature (844)..(844): n is a, c, g, or t
  misc_feature (896)..(896): n is a, c, g, or t
  misc_feature (913)..(914): n is a, c, g, or t
  misc_feature (919)..(919): n is a, c, g, or t
  misc_feature (993)..(993): n is a, c, g, or t
gggagtccaacgatcacgtgtgtctccagcactgtttgagctggctttatgtgctggggcagaagagatccgatagctatgttctgctggancattctgtgaagaaggcagtacatttgggttaccgagagcttttgctgggaagacggcaaacaagctgatggatgccctaaaggactccgacctcctgcactggaaacacagcctgtcagagctcatcgatatcagcatcgcacagaaaacggccatctggaggctgtatggccgcagcaccatggcactgcaacaggcccagatgttgctgagcatgaacagcctggaggcggtgaatgcgggcgtgcagcagaacaacacagagtcctttgctgtcgcactctgccacctcgcagagctacacgcggagcagggctgttttgctgcagcttctgaagtgttaaagcacttgaaggaacgatttccgcctaatagtcagcacgcccagttatggatgctatgtgatcaaaaaatacagtttgacagagcaatgaatgatggcaaatatcatttggctgattcacttgttacaggaatcacagctctcaatagcatagagggtgtttataggaaagcggttgtattacaagctcagaaccaaatgtcagaggcacattagcttttacaaaaattgttggttcattgtcagaaactgaagaacacagaaatggtgactcagtgtcctactgtccgtggcagaactgtactggcgatcttcctcccctaccatcgcgctgccatgctcctgcagggcgaattgggtacgggccccccctcgaggtcnacggtgnggcgcnctaaaactattggngccccctccagggaattaccggttacattatttgggcccctgaaaccattgntgaaacttggttttggnncaccncatccttggaatcccaaaacaggccttaattctcctccacatggccatcgagcccatcttggctgacggggctntcctggacaaaggtcgtgccatgttcttagtggccaagtgccaggttggcttcagcagcttcctacgatcagccgaaagaaaagcagaagctctggaggctgccatcgagaacttcaatgaagccaagaactattttgcaaaggttgactgcaaagagcgcatcagggacgtcgtttacttccaggccagactctaccataccctggggaagacccaggagaggaaccggtgtgcgatgctcttccggcagctgcatcaggagctgccctctcatggggtacccttgataaaccatctctagagaggacatccctgctgggctgctgtgcagagtataagattttggacttgttcatgtcccctctctccctataaatgatgtatttgtgacaccctatcttgtcaataaacagcattctgatt

SEQ ID NO: 275310 - DNA, 1488 bp, Homo sapiens
  misc_feature (888)..(888): n is a, c, g, or t
  misc_feature (895)..(895): n is a, c, g, or t
  misc_feature (901)..(901): n is a, c, g, or t
  misc_feature (915)..(915): n is a, c, g, or t
  misc_feature (967)..(967): n is a, c, g, or t
  misc_feature (984)..(985): n is a, c, g, or t
  misc_feature (990)..(990): n is a, c, g, or t
  misc_feature (1064)..(1064): n is a, c, g, or t
ctgtgccaggatggcactcgggtctgaattcacccgtgaaaactaattaacatactatgactgcagggaacatggggtgggggcggggggatctgggcagcgtgtactcccagctgtgccctaaccactacgtgtctcctcgcgctgcacatccaggatgcttttctgcctttcttatcctgagggccaggttgctggcactgggaggcatctgctcccaagaaagccagagcctgtgaggtgtatgactttacgcctccactcaagatagctgacgggcatggccaaagcgcagccaggtctgctgctgaaaggaaatcctgttccctctccccacccagcaccatggcactgcaacaggcccagatgttgctgagcatgaacagcctggaggcggtgaatgcgggcgtgcagcagaacaacacagagtcctttgctgtcgcactctgccacctcgcagagctacacgcggagcagggctgttttgctgcagcttctgaagtgttaaagcacttgaaggaacgatttccgcctaatagtcagcacgcccagttatggatgctatgtgatcaaaaaatacagtttgacagagcaatgaatgatggcaaatatcatttggctgattcacttgttacaggaatcacagctctcaatagcatagagggtgtttataggaaagcggttgtattacaagctcagaaccaaatgtcagaggcacattagcttttacaaaaattgttggttcattgtcagaaactgaagaacacagaaatggtgactcagtgtcctactgtccgtggcagaactgtactggcgatcttcctcccctaccatcgcgctgccatgctcctgcagggcgaattgggtacgggccccccctcgaggtcnacggtgnggcgcnctaaaactattggngccccctccagggaattaccggttacattatttgggcccctgaaaccattgntgaaacttggttttggnncaccncatccttggaatcccaaaacaggccttaattctcctccacatggccatcgagcccatcttggctgacggggctntcctggacaaaggtcgtgccatgttcttagtggccaagtgccaggttggcttcagcagcttcctacgatcagccgaaagaaaagcagaagctctggaggctgccatcgagaacttcaatgaagccaagaactattttgcaaaggttgactgcaaagagcgcatcagggacgtcgtttacttccaggccagactctaccataccctggggaagacccaggagaggaaccggtgtgcgatgctcttccggcagctgcatcaggagctgccctctcatggggtacccttgataaaccatctctagagaggacatccctgctgggctgctgtgcagagtataagattttggacttgttcatgtcccctctctccctataaatgatgtatttgtgacaccctatcttgtcaataaacagcattctgatt

SEQ ID NO: 275311 - DNA, 296 bp, Homo sapiens
ttggcctcagacccaccctccagttcagtttgcctttcacagtcttcttcccacagtgccatccctgcagactctgtgccgcctagtgatacaaaggagcatggtgcaccggctggccattgatgggctccacctgcccaaagaacttaaggatttctgcaagtatgagtgaagacccacagtgcaccagagcacagctgcatcctggagccccagacctgtggctggctggtccgaagttggccacattgctgccagccaagaccagaaataaacagccgatgctgacatcttga

SEQ ID NO: 275312 - DNA, 509 bp, Homo sapiens
gcagccggccagggctctacagccatctcttggaccagctctatgagctgaacgtgctgcctccgaccgcgcgccgtagccgcctgggtgtcctcttttgcccgcgccccgatggcacggccgacatgcacatcatcatcaacggcgaggacatgggcccgagcgcccggggactgccagctgcgcagcccctctacgcggtggtggacgtgtttgcttccacaaagagcgtgcgccttgtccagctcgagtatggcttgccatccctgcagactctgtgccgcctagtgatacaaaggagcatggtgcaccggctggccattgatgggctccacctgcccaaagaacttaaggatttctgcaagtatgagtgaagacccacagtgcaccagagcacagctgcatcctggagccccagacctgtggctggctggtccgaagttggccacattgctgccagccaagaccagaaataaacagccgatgctgacatcttgaaaactggaagg

SEQ ID NO: 275313 - DNA, 560 bp, Homo sapiens
tgtaggtttcggtgagctgagaatatgccactgcactccagcctgggtgagtctttagagtatactatatagatatttaaagcagcgtttcaagaagtttttatgattagagaaatttatgtgttataataaagtaagaaaaaaaacagcaaacaaaattgtacacatgggattgttgttaaagcattaaaagaatgaaggccaacaacagctgtcatttacgtgactggtgggattactgaagctttcccactcttttttccttttaaaaaatatttgaggccggggccgggcgccgtggcttacgcctgtaatcccagcactctgggaggccaaggtgagcggatcacctgaggtcgggagtttgagaccagcctgaccaacatggagaaacccccgtctctactcaaaatacaaaattagctgggcatggtggtgcatgcctgtaatcccagctactgtggagactgaggcaggagaatcgcttgaaccctggaggtggaggttgcagtgagctgagatgatgccattgcactccagcctggacaataagagcgaaa

SEQ ID NO: 275314 - DNA, 861 bp, Homo sapiens
tttttttttactttttaaaaatagggctactggaaatcttaaaattacatatggagctagttattacgtttctattgaacagggctaggctctgacgcaggaagacctccatgcagggactttgtcacaggcctcagcctcagcctgctggactaacccgcgacatcagtattggctggaaaccaggcatgggacatatctattttctctccaacctccatgtcagcacacactggggactgctgcttgctaattcacaaggttaccctgatcaaactggaaccaggggtggcgttttgataagaccggcttcaggtaggaacccagagtttctaagggctggcaccatgaaccagaagcgaatctaaagcatgaggtatacgaataacccaaggatgtcactggcatttagatcagcgtttctcagtctctttttcattatcaacatgcccctgagcattctgagaaattaatagcccaactccacccaccatgagattttaatgctgtggccccttagagaccacaaaccattataacgtctaagattttgtcaccacccaagaatgaattttcatcccaatgggggttatattatttcctgtgttgagaacacaggatttagctctaccctcttccccaagtcctttgaaaactagccagggggctcactattcccagaggtttcactgatgtaaacatctctggggtcatcaggatggcatctgcacagtgagcagctctagttctccaagttttcctctagggcaacttgtgagttcatttcagggaaataaatattcttgaattcggcagaatggattaagtgtggcggaggcaccattctaatagccctgaacg

SEQ ID NO: 275315 - DNA, 325 bp, Homo sapiens
gagccaagagcacttcatgcactccagcctgggtgacagagcgagactctgtctcaaagaaacaaaacaaaataaagtttatatagagaagcaaaacattcagaatagccaacacaatattgaagtcaaaagttggacgactgatgctactcgacctcgagacttaatattagagctacagtaatcaagacagtatggtattggtcaacaaacagagaaatagaccaatgaaacagaacagagagtccagagatagacacacataaatatagtcaactggtctttgacaaagaagcaaaggcaatacaatggggtagacagtatt

SEQ ID NO: 275316 - DNA, 255 bp, Homo sapiens
ctgttttaagaaatctctgtaaaaaatgtcaagtgtgacaagaattcttcaagaaacaagctcctctagtttgtcttctatatttagagcttcaacagttacctatattactggtaactcccaaatataccttcaaacttgttttttgggcccaagttttttgcttcatatatatctgttttgaatatcccataaataattgcatctaaagcatacctccactccattgttctcaaagataaaaccaaacctgtg

SEQ ID NO: 275317 - DNA, 390 bp, Homo sapiens
ttgtactcaatcttcagatgagaagtaacagttctcattcatggacacttttgtataattgggtgtatctgtttacactatcctctgaatggaggtcttgatggaaataagggagagagaataaaaagagaatcatcttgtctcagaagagggatctcaggaaaagcttcagtgcagcttgacagcagcttgagagaactgaatttctgcgaataggtttatagagggaagccaggcactagaagagatacacaaaagggccctgtaaataaaataaaacgaaaaaaccccaaactagaaccagtgtgggttacaactgaggaaacacattaaagcacagttctaaacaagataagcaatagcaccttggggcatactatggaaatgtta

SEQ ID NO: 275318 - DNA, 361 bp, Homo sapiens
atacccttggtggcaatgaacaatgcatgctcctctgagaaaactggacctaaaggagaatggaaggtgataccagaattgggaatgtccaaggcccaaggcattccctggtctggagaccactttgagtccatggttgggaagattctccaagggaacataaatgcttttactatctagtttgtctctttgagaattaaaactcttttttttttttttcattccagtagcttttggggtagagtttggctctttgagaattgcatactaattaattttaggggtgatttgtacatcatctctatattcctgaaacacagtagaaacagccagcagtcaggcaaccatctaccatgaccat

SEQ ID NO: 275319 - DNA, 534 bp, Homo sapiens
ggcagacttggagcctgtgtttcctgtagccaaaggcttttgcaaagatttgtggctatgaaagataaaccttcccaaactttaaaattatgcagtgttttcaaaaagatagccattgcacttttgtgggaattttaatttaatagagaaatgaaaggaaagcagtcatatcttttcatcattgcctaacccctttaaaagtatatattaaaattcatactatttcgatatttatgcctatggccttctaaactttttatttaatccactcccctccccaacccccaggagaaaccacagtgcagacagcaattacgagccttctggtttctttcacaaaatgggctttttaaaaactgcctttaaaacactctccatgtaaggagtcctggtccacgtcatttctgccttctccatagggtacatactcactaggacattagggattgaagacaatagaagtctactgttcctggatgtgttgtttctagtttcagctctaaaaagccaaattgtttctaattccatattaaa

SEQ ID NO: 275320 - DNA, 372 bp, Homo sapiens
gctgtttattatgcaaagacgagtattcgtttccttcacttcaaggaacgtccatgagttgtggaaagggtaaaacaaattatttttatagttctgcaaaacttcaaagccatagaaacataagagaataaaactttctacttttgaaacctgtgtctaaagtcaagcttatgactttgggtgtcaacttaagggaaatgatgtagaagacctgagaaaagacccatgttttcatgatctgtggaactaactcagtaaggtcctggaagacaaacgtgtttgaaaaaataattcttggtcactatttggttctgattggttgcctggctgacaaaataaattttaggtgtaacttgatagtattatatgtgt

SEQ ID NO: 275321 - DNA, 455 bp, Homo sapiens
tggaattactagattttaaacctcattacactgaacaagatcccaaacgtgcccaagccaggggtttgagaaaagagattccaattcccctagaaaactgacacctataagataacgcctacaggatgatgaaaccccaaggccttggtttatccaatctcaaaacatctacataaaggaatgcactatgggagtgatgtcctcgccaacctagtacaaccacacctcagtagaccacactttcaaaacatcactcggaaaattacacagggatgcatcttgtgcactacaaacaaacaatcccaagatggaatgtagtcctcctaaaaaggagatatagtacaaagagctgagtcccttcaaagactgaaaggcgggcttcactcagatgcctacctggttatgtgcgccaaggaaagatctgaagttattaataaaagaaaaagaaggagata

SEQ ID NO: 275322 - DNA, 464 bp, Homo sapiens
tcatccacaattccattgcccgtgttctcaccgtaattaaccagactcacacaaagaaaacctcaggaaattctacaagggcaagaggtacaagcccctggacctgcggcctgagaaaacatgcgcctgcgccactggcccagcaagcacgaggagaacctgaagaccaagcagcagccgcggaaggagcggccgtacccgctgcagaagtacacagtgaacgcctgaacgtcacattgtcaataaaagagagctggccgaagagaacaaaagaaaagtgtgtatttaatatgcaattctgtattcattcaacaaatatttattgaaggcaaacaatgcagaactcataaccctctgatgatggactcatcatgtggttctcatgcaggagcaaaacacacagcatatgccttccatgtgcagcataaatcccattgcagtgagccatgttacagggcagtttc

SEQ ID NO: 275323 - DNA, 533 bp, Homo sapiens
tacaaatagcctttttgactgagaaggaaaagagaaattcaacaacatcaaagaatgggagtgactaaagtgtgtttttcagctggtacataggagccagtagagagaaaaggttgaagatggagggaagagaagaaccagttgttaggacaaggtgccagggatgttgggaagaaaacagatccagggacatatgatggagggtggacttaactaccctaagatttgagggcaacaaatatttgcttggggcatgggagtgattaggatggtggcttaaggagagtgacaaaaattttagaatagctgctaaagggagaatgaaagcaaatgaaagagttgtctgccagatggtgttaagagcccatctgaaagtgaaaaccatgaattgttcatcacatcattcaatctgcatgggtagatgctgcctttcatttgaaagcagcatatttctttccttaaaaaaaaaaaaaattggctgggtgcggtggctcatgcctgtaatcccagcactttgggaggccgaggtgggc

SEQ ID NO: 275324 - DNA, 289 bp, Homo sapiens
gttatctacaccaatattcccctccactggtgtaaataatcaggaagcaactggatttctgacaagagaagtctttttttgttgttgttgcactggtagttttcacattacctgtgctctacagcaaactatacataagtattttcctgtactcttagaaaagctaatttaagattgcattagctacatttaacctgctattgtggatggcatctctttaagaaatgtttctgcctcctcaatgcaccttgaaattgagaaagtaatgatgcaacaaatgtgcctgggg

SEQ ID NO: 275325 - DNA, 457 bp, Homo sapiens
cagtttttaaagtttgaaatatatgcccctgctactgaatcttgtcttgttatgtatagtcgttttattatttatctggttggagcacagtcaattgaaattctgttgccagcggagtagaaaaagtctgtatctgattcattacaaaactcccttcaataaaatggctttcaaaaattcctcacttgttatcgtcatcgttatgaaaaactaaggaacatcttagaagaacatttatcctttctggctttgggggaggttgctgtaatggaaacctgaagaaactcataaagtttgccttaaatcaagttattcccaccaagagaacaacgtacaagactactctggggaaaactgtagttcctcccagactctcagttaaaacaaactgttcttgagcctcaaggcaagagagaactggaaaagccatgggacttcgtagacggccgacaaaaaa

SEQ ID NO: 275326 - DNA, 778 bp, Homo sapiens
  misc_feature (10)..(10): n is a, c, g, or t
cacacacacntctccagcgtatgtacacacacacctctccagcatatgtacacgcgcacacacctctccagcatatgtgcacacacacataggcacacacatctccagcatatgtgcacacacacctctccagcatatgtgcacacacacacataggcacacacatctccagcatatgtgcacacacacacctccagcatacatgcacacacatgcacacacacatctccagcatatgtgcgcacacacatacacgcacacacacatctccagcatgtgtgtacacacacacacacctctccagcatatgtgagcacacacacacctctccagcatgtgtgcacacacatgcacgcctctccagcatatgtgcacacacacacatgcacctctccagcatatgtgcacatacacatagccagcacatgtgcacacagctctcatgtatgtgcacgtgtatctctagcatacatgcacacatgtatctggtgtatatgtgcaacacatgtatctggggcatgtgcacacgcatctcttatgtgcacatacacacacatgtatctaggtatgtgcccacgtttttctagcacacatgcacacacatctctctagcatatgtacacacacatgtatttgtagtgtgtgtgcacatctgtgtctctagtatgtgtgcatacacgtacacatgtaggctttgagttaagcaggggaggaatattttgatcaactttaaaatcagcaaaattagatatgcatgtatgaaaataatgaaagtttt

SEQ ID NO: 275327 - DNA, 496 bp, Homo sapiens
agatgggctgaaacccaaggaattaactgcaaggaagaggtaacggtgctctaggacaagtagtgatatcattgttgtgctaggtgtctacacttgagccagtagtaagatgaggaacctggactaaaatttccacattaagcctgtgtaaggggaataaaataaagtaattccaggtttgtatcacaccctgacttcccacagaaggaaatgtaaattctctctggaaaaaatcatgtccaatagagtcccataggtttcccacagattagaaccaagcaaatgtgaggaataaaataaatgtgttgtaataaaatatcaacaaattaacaaggaaatgaaccaccatgactgacagtcagcagaaaagacaaagccaagtaagattggcttactctttactcaggacctttgttactaaaactatccagacatagatataaaataaccatttataaaagctttaaagaaataaaaaaaagtcacaaaaatgagg

SEQ ID NO: 275328 - DNA, 373 bp, Homo sapiens
tttttctttttttgtattgctccttgcagagcagggctaccctacaggtagtgtgcccagagcagtctcccccaattcttaacaagtaacccaaatatagtaaaaaccagcaaaaaactgtggtagtggtgaacaagtgaaggggtgtagtctaaaatcatacactttaaaaagtggcagctaaaagagaaaaaaaagattacagagcagtaaaatgttatccctaaatgttgttttaaatactcaccaccaaaagaagtaatctgaaaaggctacataatgtattattcaaactatatgaaaatctggaaaaggcaaaactaaaactgtggagagagttcaattaggataagtagtaagttcaggagatcta

SEQ ID NO: 275329 - DNA, 729 bp, Homo sapiens
ccctcacgatttctcttcaaaatatctaacaaaccatattcaacagcccattaaaagaagcattcatccatgatcaatgttagatttatcccactgaatacaagggtggtccatcataaacgaatctattaatttgataaaccatactagcaaagtgaacggcaaaaaccatattatcatcacaacagatgcaaaaaagcatctgacaggccgggcgcgggggctccagcctgttatttatcaaagtgtgtgactgcttctaacctgtcaaatatgcatcttatactacatattaagtcccaccaaacaagtcatttaagtcaacattattttagcattgagttaatcggggaggaaaaatccaataaatatacatgtaactctaaagatgcccaaataattgtaatttgccctcccttttaaaattaatttacttttgttttttgagtcagagtctcactctgtcatccaggctggagcgcagtgatgcaatattggcttactataaccactgcctcccaggttcaaacaattctcctgcctcagcctcccgagtagctgggattacagtcatgagccactgcacctggcttagggtaggtgtttttttgttttttgttttttgttttttgctttccaatggcgaaattctctatctttagaataagggagtccatgaatgctcacagtggaagcattcccagaacagagtggaagtagggagataat

SEQ ID NO: 275330 - DNA, 349 bp, Homo sapiens
gtgaatgtaagtgttctaagcgtgtttaaagtaggctaggctaagctatgatgttcagtaagttggatgtattaaatgcattttgacttaaaatattttcaatttatggtgagtttgttgggatataccccaccgtaagtcaaggacaatctgtatactattctatcctttggtcatctttctatttgaaacaaaaatttgctcttctttttcgttttaaaagggttgtatgggctgggcgcggtggctcacgcctgtaatcccagcactttgggaggccaaggtgggtggatcacctgaggtcaggagttcaagaccagcctggccaacatggtgaaaccccatctct

SEQ ID NO: 275331 - DNA, 344 bp, Homo sapiens
gactgggaaatgccgacttcacaatcaatgtcaatgtatttcatgtcgtctcgatacctcttagtcattttgcttcagaagtgcgtgaacagggtcaatatatttcattagtttgtttcatctgaaggagagtacaacacgagaactttgattatattataagaattgctttaatgtgacaccgattccctgattgtgctataccagacattcaagggctggagggcaacaaaaccatctttcccctaaacattcatccagccaccaccagcaaaatgtgccgcaaatgaaagaagaaaataagatccaactcaatttacatagtggagatgagattatgctgt

SEQ ID NO: 275332 - DNA, 283 bp, Homo sapiens
agggtagggggtcttaattttagtgagcaaggggcacgaatgctcagacctgggccaccatggagttgtcggggtgtgggtaggagactggcgtcacccataaatgcagagtagacccacttcctccaggatatttgactgtgatcttgggccattgtgtctgttccccaggccctgagggttctcctgggataagatgggtatgaacttgctgcgctgatggtgaaggcgggtggctgaggaacaggaagagtgcgtccagtactgcttaagaattcggtga

SEQ ID NO: 275333 - DNA, 133 bp, Homo sapiens
agtccttgacttaaaagctaaagatcagaaactattgtcatcttccattcttactcctcaggttgactcataaacctagaatccccccctgccaaatatatgcacccacaatattgccgagaaagcaaagttc

SEQ ID NO: 275334 - DNA, 526 bp, Homo sapiens
ctacatcaaattgaagatattttcatgctggggcttgagcctggcaggcccaggaaatgtgacccagtggaatgattttcatttattcaagtaatcatatacagtagctgcttttatgaacatggcgttcacttggctcgagtgcgttcttcaccagagctgaggggccaacattcccaagccatgagaactcaaagctcagggctctgatgaagatgaattaaggggctgggtcttgagcatcactctgggcatcgggaaaatcccatcagcctgaagcattcagaaaaaatgcactatctctccttcatgccacaggcctcctggccttccaaaccccacagatgtgggtgctgagggcggaggagagagagcagcaaggggaaggttagggcttctaacacaagcttcctctactagttgtcttttttcactttagttttgtacaggattctggggaaggccagggatatgagacaggctagagaaaagggcagaatggaaagaaaaaaaagtagtaaacttg

SEQ ID NO: 275335 - DNA, 414 bp, Homo sapiens
ggagtcatgattagagaactcctgaaaatgcatggagcaaactcccaaaatacagaatacatgacaatatcttctcctctctccttccaccctcactctcagctgctgactttgctttctatttcatgaagaaatgaaagcaaccagaaaagaatttccagtgttgccattaccacaactcccagcctacttgtatctgtacctatattgtctgccttccttcctgttagtatagaggggtctctgtcccagtccaaggccaaggcctctattactgcactagatcttatctgtgatcacctacttggggacgtctttccagcaaatgctcccactctcccctgcacatcagttggtaccttctaatgaatcattcacattagcatacaagcatgctgtattttcgccctttaa

SEQ ID NO: 275336 - DNA, 471 bp, Homo sapiens
tcagcatacgaaataatctaattctggaatccagctgttttagtttgctagggctgccataacaaaataccacatagttaattgcttaaacagtagaaatttcttttctcacagttctggaggctagaagtccaagattaaggtgtgtgtaggtttagtttctcttgaggcctctcgccttggcttgcagtgtccttttgctgtcctcacatggcctttcttctgtgtgtccttgcatccctggtgtttcctcttattgggacaccaggttggattagggcccacccctattatctcatttaaccttaattacctctttaaagtccttatcgccaaatatagtcacactctaaggacttcattcttcattctaggttagggcttcaacatgaattttgggggtacataatttagcacatcacactagccttgcaaataaaattcaaataatttactgacccattttgagtt

SEQ ID NO: 275337 - DNA, 794 bp, Homo sapiens
gagcttgcagtgagccaagattgtgccactgcacgccagcctgggcaacagagcgagactctgtctcaaaaaaaaaagggaatgaagtcttgaatgcatgggcactttgaaagcattatgctaagtgaagaagctcatctcaacaggccacacattgtatgagtccatttatatgaaatattcaaaataggcaaatctatagacacagaaagtagattaatggtcacctaaggcttgaggtggacgatgattgctaatggaggtttctttttggtgtgataaaaatattcttaaattatgatggcacaacactgaatatattaaaaaccattgacttctacatgaattatggtatgcaaattacatctcataaagctttaaaaagaaaatcctcctttaggtgctttctagttcaagttagggctggctcagcaggtaagggagggccaagaaagtcaagcagaagctggaaaataatttaaagcagcactgcccaaaatgtatcctgtggaccaactcttttcctcagggtacctgactctagtcccagacaagataaggagctgagatagaatgtcagccaacttaaggccggatgcggtggcttatgcgggtaatcccagcactttgggaggccaaggcgggtggatcacttgaggccaggagttcgagaccagcctggccaacacggtgaaaccctgtctctactgaaaatacaaaaattagctgggtgtggtggcgcatgcctgtaatcccagttacttgggaggctgagacaggagaatcacttgaac

SEQ ID NO: 275338 - DNA, 288 bp, Homo sapiens
tcacccccaccctactcccgtagccccatgacctctgcccacagcagccacggtcatctctgtgctgtcccccagcccctctgccacgtccagtgggcagctgtggtcgctcccctcctgtattcaatccccgactgatggcctggggtctgcggggccccgccaagcccaggactctcctcatccacctcggctcggcccgcgcccgggagaagctacatgcagaatttggagcccagggccaggccagattcgctcacagagggcagcatctgtccagccctggtc

SEQ ID NO: 275339 - DNA, 185 bp, Homo sapiens
cctcacccctctatgtgtctcaagcctaatctttcctggtcgtgtgacaagaacctggtttaaactaaactgaggggaaagttctgcaacagtagaggggaaaagggatgtcctggaaaaagtgaggctctggtgacaagaacagatgtgagtgtcctagtgagaggttcttggggacagaacaa

SEQ ID NO: 275340 - DNA, 331 bp, Homo sapiens
tcctgtatagacagggtttcaccatgttgcccaggctggtcttgaactcagcccagactgggctcaagggatcctcctgcctcagcctcccaagtgctgggattgtaggtgtgagccagcagcacccggccataccttctcttctgtaaagtgggtctcttgtcccaaggtgttgttacgcaggatcccacgtcagtgaattaaacgctgtgaaagccatcagctagaggttctgcagagaccctgtgggcaagggcaaactatacctggaacagtgtcagttcggggcaacatgatctgctgagccttacagggtagaaggggcccagtg

SEQ ID NO: 275341 - DNA, 360 bp, Homo sapiens
tggtagaggcaggccttactgttgccaggcttgtcttcaactcctggcctcaagggatccccctgcctcagcctcccaaagcactgagattataggcatgagccactgcacccagcccactatttattatctttatacacaaagtatgaacctcatagagttgtgcagattaaatgagaatacatatggagtactcaaaactgtctagcacaatgtaagtgctcaaattttgtcctcctctcttcccactccatccagatgttctcagtatctagggcttcctagccaaatcagtaatggtctttttgtcctttactataccattacaacagctttggctttgtaaggtctacatgtatc

SEQ ID NO: 275342 - DNA, 433 bp, Homo sapiens
aagtgtgggcagatgctaagtgattatgacagtaaataatttcctttgttcttgtaggctttaacatctctcctacaagatagtaccttcataaattgtcttgtggaaacattatctaaaaatttcatttaggacaaaggagaatagaagcttctgtcattaaacatgaaacagccttgctttctttactcctaaaaatgtaggcagtatttctagaaatatttaatgatagcgaaccacttcctggccatcaatttgattcccttccattttcctagacttctgaagaggtctcactttacactattttgcattacagaacagtctttatacttcctttttttttttttgacacaggatgtcactctgtcgccaatgctggagtgcagtggcgctatctcagctcattgcaacctccgcctcccaggttcaa

SEQ ID NO: 275343 - DNA, 299 bp, Homo sapiens
gtcagtgaggaatatgactgagatcacttgttacaaggaacttttataacccattcacctgcatttcacatgtttatgaggactggcttcacttatgatctgcagttgacagtcataaagtcctttgttataatggcaaattctgataacaagtttgcttcacattggctccaaattccactggaaactgtcataaatggctggtttataaagtgaaccttcctgtcccttgtttactgatttcacatttatgaagagaaaggaatcctttcctaaaaaattattttcttttaaccaca

SEQ ID NO: 275344 - DNA, 418 bp, Homo sapiens
aagtgggaacactaaactggtattcaggtgacctgaattctgccactctgtaattatgaacaaatttaatctctccagtgttgtttatcttcaaattaaagggtctagatttgatgatctctagaggcaaaataatttcataatttcaagatcacaagccaacaggccaggcacggtggttcaagcctgtaatcccaacacttcgggaggctgaggaaggtggatcacccgagctcagaagttcgagaccagtctgggcaacatggcaaaaccctgtctctaccaaaaacacaaaaacttagcctttggggaaaagaaagagagatcagactgttactgtgtcgatgtagaaagaagcagacataagagactccattttgttcagtactaagaaaaattattctgccttgagatgctg

SEQ ID NO: 275345 - DNA, 349 bp, Homo sapiens
aagtgggaacactaaactggtattcaggtgacctgaattctgccactctgtaattatgaacaaatttaatctctccagtgttgtttatcttcaaattaaagggtctagatttgatgatctctagaggcaaaataatttcataatttcaagatcacaagccaacaggccaggcacggtggttcaagcctgtaatcccaacacttcgggaggctgaggaaggtggatcacccgagctcagaagttcgagaccagtctgggcaacatggcaaaaccctgtctctaccaaaaacacaaaaacttagccgggcatggtggtacacaactgtgggtcccagctactcagggggct

SEQ ID NO: 275346 - DNA, 461 bp, Homo sapiens
aaaaaaatcatgctagtgccaagagctactaaattcttaaaaccggcccattggacctgtacagataaaaaatagattcagtgcataatcaaaatatgataattttaaaatcttaagtagaaaaataaatcttgatgttttaaattcttacgaggattcaatagttaatattgatgatctcccggctgggtgcagtggctcacgcctgtaatcccagcagttctggaggctgaggtgggcgaatcacttcaggccaggagttcaagaccagtctgggcaacatggtgaaacctcgtttctactaaaaatacaaaaattagccgggcgtggttgcacacacttgtaatcccagctactcaggaggctaagaatcgcatgagcctaggaggcagaggttgcagagtgccaagggctcaccactgcattccagcctgcccaacagagtgagacactgtttctga

SEQ ID NO: 275347 - DNA, 322 bp, Homo sapiens
ttgaatttaggctccaatgttaggtttgaagtggaaaagtaggattggttttcagcaacttttttttttttttttttttttgagacggagtctcactctgtagcaatgttttctttcaggatgggtggacttcttgtttgggttacttatctttatcctctgaatatccaactattctcattgtcaggactccactcagaggtacccataaacagaaaggacccactggccacttctccaggacagcaaggtagtggacatgcacaaggaccttgcccctgttcagatccatgaaagaagtgctgtgcctcccttgacttga

SEQ ID NO: 275348 - DNA, 1324 bp, Homo sapiens
tctggtgagtgcagcatggcctctgctctctccccctgcctctttttgttttccttttctgagggttcctcagcctcatgaagtttaaagcctaatgcagatcctctccctccgctgcattgttctaggtgtcactgaatttctccaaagagaaaaataaaaactcagaatattcttgtgactgatttctgaatgtgacacgtggcgtaatgacttaaacgtattacagccagcagctcttggtataggacccatgatattttattatattttgtttagcattttgttgtactttattattttattgtctttgttttatttagaacactttatatccacccttttcacagagttttaaatgtacgttacggtactgttaactctgggtacgatgttgtgcagcagatgtctagaacttactcatcttgtggaagtgaaactgtacaatgtgtctgtgatccttcttaaagccttagctgggctgctgagtcctgcactctaactgcaggaagggcagctaaggaaagccaagtgcaacttgccagacagatgggattttcatgtctcatctatcaggcaagacattgtctcagtgtactcagcagactcctagactcgggttctgggctgatgctgtcagacatcataaaaggagagacactcctctcagccatgctcctaatacccctgataagcatgctcctaattcatctactgcccttagcaaagctgccgtttgtgtctccgatttggtgtctttatagacatcgccatcccctgttagtgaatttggggtcttgagacgtcatctgatgaggacctgctgtttcacagaggaaatataactgtctgtgtgctttttattattgtcatgtttgctgctgacatttcacagctttcatttattgaattttgaagacattgattttttcttcatagcagaaattatggatcagataattggccaaataagaaaaattcagacagcattgtttttctaaacatactgaaaataacgcatgtacctggtgaaaagtgaagacgtcatgacagagggtccagccctgctgtccaggccacccccaggatgggagccctgaatcctcatgggatgtgcgctgagatacaaggaggtccctgcacacacctgcctttccccgctgctggactcttgcaaatcatttcctgtgagtgtcagccagcccactgcatgttccgaaagctctgcagagtgcgccaatattccagagtttcaaagtagtgccctttgaaaagatttaaacctgcaaataaaattaaatttgcatttgagaatacaatgtgt

SEQ ID NO: 275349 - DNA, 444 bp, Homo sapiens
caggacggtatctccacaaaggttcagaggcgaaaggaaatgagaacgggagctatgacttggattcacagggaagctgaataaagggaaaggagagagtttaaacttatctgcaggcatcatgttaaatgtaatgttttcttgacaaatagccagcacactgcactatttttaaaaatcccctcattaaaagctaagaccaatttcttacatatggaagagtttctatgctacaggttattctaatgagaaaagaagaaaagtgacttacaatactatacaataccatcacatgaaatattcatgtaaaaattcttttagaacaagaagacacattcttataggtaagaaatgctatgcagatattaaaaattaattcctgagcacaagagtgagccagggtaatgcgagtgcagtttgtccagagtttaaaaaccaggacct

SEQ ID NO: 275350 - DNA, 352 bp, Homo sapiens
ttgcaagtactctgttgaataaaagtgatgaggctggccatccctatcttgtactcaatcttagtggaaaagctttagttgttccccactaactatgattagactgtgggtttttcataaatggtgtttattatgttgaggaactttccttctatacataaactattaagaggttttatcaagaaatgttgctaaactttgttaaatgcttttactgcatcaattgaggtgaccatgtcattttatctttcattttgttaatgtgatgtatcacattgattgatttacatattttaaaccagccttgcatgccagggataaatcccacttaaacacgatgtataatgttttt

SEQ ID NO: 275351 - DNA, 415 bp, Homo sapiens
gcttgatggtgtatggccacactctgacaatatcctggaaggttctctggatttcttgctgtaattctttctagtttattgtctgtgtataattagacagtgctttctaagtagcaaaacttggttgtagatactgatgcagcttagcaaaaaatgttctatgatggcagttagtccaacttttatcttcttcagggccatcaggcctctgtaataattagaatccataaaaactggctatattctagactaatataaaagttttatgttcttcagtgatgtctcaagcacatcataaagcatcagtgatctttccaacaatgttcctttgtgccggtgatttgggtgatcggaaaagtttgccagtggaagaaccacttgctgccctgataaggaaccaatattactatatttc

SEQ ID NO: 275352 - DNA, 458 bp, Homo sapiens
actcctggtaggaaacacatttacaaaaacttctgttatcgcttacatccagctatagaatctctcaaagggaatcatcgagaagaatttttttttagttaattaatctcaaaggtattcatttctacgagatgctttttatgctcattatgattttggctattttgccctttaattgttggtttccatttgtgagctgtgtcatgaggtaaagaggattagttagccaatgcaagaaggcttgttacagtgtttatgtcttggattcactctgcaattgttattccaaggaaaaactaattatgagtgtaacacatacatgttaatatacagcctcctttccagacacatgttcatggataatttcatttacatcagtttttcagcatttccgaggtgaggctgatttttttctaaatcactgtattaaaaagcaaacaagcaactcccctgctcca

SEQ ID NO: 275353 - DNA, 378 bp, Homo sapiens
ctggttaaggtgggtacctgcaggtcatgggcagacagcacccctaatgatgatcagagctcatgcggcaacttctaggccctcagtcacccctctgattcactaggccaactttcagccctctccctgcagtctgtgtccaccaggtgtctcctcaggctaggacggtggccctcctgaaaaaaacaggcttctttcacaacagcctcactcagttactatttgtgacgcactaagctgtgcacacagattaaagtccagaacagcacagagggaggaagacagctgtgctgcagcctacatggtcaggaggttccaggtacaagatgccaagctgtctgaaaacttagaaataaacatctttttgggtcctccaaa

SEQ ID NO: 275354 - DNA, 374 bp, Homo sapiens
gaaaagtcccaaccctctaatcctgctttggtcttttgctgccagcccccatcctgaagctaccagtcaatttgtttgcatacaagaagatatcactttggagattctaagtgtatacgaggaaatgaggtcaaagaccaaatatatatatttcactatatcacacttcaaacttttgtttactgtttcccttctcctactctattataaacctttgagggtggggactgtgagttatttatctttatattcccagtgtcaagagtgtttagctataatgggaatgaatctcaaagtttcttgaataaatgacaagaagaatcatagttgcatgaactaaattcattattctcagtccttgaggtaaatgaata

SEQ ID NO: 275355 - DNA, 392 bp, Homo sapiens
gaatttctcatcactgctatccttgaactgacttctcctttcagtccatagcagtaaatctctgcagcatcagcaggtgcagccattaacgactcaagtgtccctgcagccaatgcttgtctgttctatttattcccattcctgacatgtcactgaatcaggccataccatgaacagatattaaaaaatactgcctttctattaattttaaatgacctttcaatctacatgtaaatttaaattgtataaaagcacatcaaatttcaccatcagagaaagaaggggatcaagaagacaccacagaccaaagcacttgtatctcagaagccagcattaggggagaaaacaaaaataaaaatcttcacaaataaaggagagtaagaaataatttt

SEQ ID NO: 275356 - DNA, 301 bp, Homo sapiens
acgtgcacgcagccagctcacagcacccaaaggcacgggcaagttgcatcacggcagcccctcctgtctgaccaggagcaggtgcgttcctgaggtcctggccacttctgcaggagcgtccgagggagcccagctgatataccacagcccctgacctcccaggttagcctttccatccaacagcaccaggactggacaggccaccttggctgaggatcacgtgtgcctgggtctgggcggtgctgatgcccacaggccctgagtctgtgttgcgcacaggccttggaaagcagtgcacatc

SEQ ID NO: 275357 - DNA, 395 bp, Homo sapiens
tataatatagttttaactgaggaattacaatgaagatactaaaaggaagcttaaggtttctggtattaactaggttctgttaaatgattttacttgttttagaatatatagaaatatactgagttagaatgagtggcgtattttctaaataattcaaataaaatggggagagagaggaggagattggaaggaatgaaattttcctgttcaagctgtaaacactaaaacctttaattttgtaggaagacattatatactctggtcattcaacttgtgtatccttagtctatttagtagtcaaaaacttctaagtaaatatgtgtgatttaatttgtgctgctgagaaacagtgatcaaaaatggcaataaaagtcacataacgaaataagaatact

SEQ ID NO: 275358 - DNA, 507 bp, Homo sapiens
cttcctttctcacagctataaataaatacatgaataaactgcccactctgattcataggctgtcagaactataaggaatcttcagaacacactggtttgatttcttccttttaaatatgagcaaatggaggcctagagaaggttgaggttcctgttcatggggcactgggtggatgggaaccctcgtctgattctgggggacatgggagatagaaatcatcctcccatcacgaggttagcagttcaagaccagcctggccaacatagtgaaaccctgtctctactaaaaacacaaaaaattagccggatgtggtggtgggcacctgtaatcccgcctactctggaggctgaggcaggagaatcgcttgaacctgggaagtggaggttgcagtgagccaagatcgtgccactgcactctagcctgggagacggtgtgagactccgtctcaaacaataacaacaacaacaaaaaaagaaagaaagaaagaaagaaagaaagaaagaaag

SEQ ID NO: 275359 - DNA, 151 bp, Homo sapiens
atgcaaagtaaatgttgaagttgagtttgcagagcctgagccagagagaaagttaatcatcccacgggggacatatagagcaaaggagattgcagccccagaactggagcccctccatttgcgatatggccaagagcaatgggaagaaggt

SEQ ID NO: 275360 - DNA, 547 bp, Homo sapiens
agcaccgtctgagattcgccggaacctgggaggcggaggttgtggtgacccgagatcgcaccactgtactccagcctggcaacagaacgagagtccatctaaaaaaaacaaacaacaataacaacaaaaaacaaagaaacctatagtaaaaggcagaatgaaattagagtcataagagttgattttttaaaagagaagaagaaaggttaacaggaaagcaaggaaagaaaatgtggtgcctaactgaggttaccagggaagcatttattagacttgcagggtgaataagataaccgctatggacacccttctaggcagagcagtggcatgaataaaggtatgaagaaagcatgtgtgaggtacatagagcagttcagttggctataaagaagagtagaggtgaccatataatggagtctgagagaaggagtgtgtttataaatcatctcggtatcttcagtatctaataccatggctggcacatggtaactgcacaatagatgttagcataaaagactgtcagatgtgctgtggctgctaagtagtg

SEQ ID NO: 275361 - DNA, 334 bp, Homo sapiens
gggtgctctgagtccaagatctgattaggatacagaactgtttgattgtaattaatgttgtggcatatttgaaataattataaggatggaaagttcctagtgcttaaagaagagtgagggagataacaaaacattaaacttaagctctctctcaattttaggaaataactgatggacaagtagatattgaatgaattatgtatgatggctcttccagcactcaaatcctttgtttatttctttgttggtgattgaagatataaccatttcctcatataaagcggttttcacaaactttctataactgtattttggggcctcaaaaggaagaaaa

SEQ ID NO: 275362 - DNA, 454 bp, Homo sapiens
tcctgctgcacaggacctgaaggcattgatgccagtggctcccagagacctctggggcatgggaggaagaggtgatggagtgcccctgacaggagcacccaggctgctggcagctaggagagccacatcctggcatctctccaccttccttctctccaccaccactgtgagctgtgagtcaggcccgtaggatactcctggatagctggcagtgtcacgccacttctcgggggaagccactgccccagttactattgaagacggggtggggaacagggaggatggggaggtagagatactgaacctcacccattggtttagtggctggctaaattagtacatgctacccctgcacaggctggttcagaggcatcaaacaggctatctgacctgcggagtggtcaggaggaggggagagagcttggcagtggcggtggtgtgtggggatagcctt

SEQ ID NO: 275363 - DNA, 331 bp, Homo sapiens
agtgctcattagccaatgcgactagtggctaccatattggacagcacagatacagaacattttcatcatcacagaaggttctgctgtacaataatgctcatgagaagcaaatgatgtgaaagtcatgagactagggctctagagccctggctgggttccaatcctcctcctcctctccaatttcgtgtgtgtgtgtgtgtgtttgtgtgtttgtgtgtgtgtgtgtttatcatacccacgcttaccatggaagtcacttaggaacagagaacctcaaggtcaaactactctttgccaaggcttgaaattcatggctgtttttaagaacact

SEQ ID NO: 275364 - DNA, 446 bp, Homo sapiens
gatcttatacctaatttttgtgattttttttttttgagacggaatcttgctatgtttgcccgtggtggtctcaaactcccagcctgaagtgatcttcctaccttggcctcccaaagtgctgggattacagacgtaagccaccacaccagtcctttatccttgattttctaaaagaacagagacaaatttgaatattactaatacctacatctaaagcagattcagtagtatgatacgttagtaaaaaatttaagtggccaggcgcggtggctcacgcctgtaatcccagcacttggggaagccgacgggcagatcacttaaagccaggagtttgagaccagcctggccaacatggcgaaaccctgtatctctattgaaaatacaaaaatcagccgggcgtggtggcagacgcctgtaatcccagctactcgggaggctaaggcagg

SEQ ID NO: 275365 - DNA, 259 bp, Homo sapiens
gtcattccgcatgcagtcctgacaggcagtcttccttggccgtttcactgggcagttaataatcaagttaattcccagaaacagcacaagtaaatcctaacccaaaccaccaaaaagagtttccccgctcattgaaaggatagtcatgtgacagactcatcacattcatattcattccctccctgttaaagtggtcttaatacggttttaattaatagtgcttcttttgaattgtatgtgttcagcttccccataactt

SEQ ID NO: 275366 - DNA, 751 bp, Homo sapiens
actcttgtggggtggggggagaggggagggatagctttaggagatatacctaatgctaaatgatgagttaatgggtgcaacacaccagcatggcacatgtatacatatgtaactaacctgcacattgtgcacatgtaccctaaaacttaaagtataataataataaaataaaaaaatttaaaaaataaataaataaacatatacactcaaataattagcagtttcaccttatttattttttaagttaataatttgtaacttcatgtgggtggaaaaagagacattacaatggagggtagacttaggaaagatttagaatagagccttttccccccgaacaataaagcagtgacataaagacatggaaaataatatatacaaacctggaatgaaaaagagaaaacatgaataacaggcttacatgagtgataaattgcattgtactttgatgaagaaaatctagagatataatttgctgaaatcttcataaaaatgcaaaaatatatcttctttagcacaaattatctccagaatcacctatgtactattctccgagaaacaaagcagaatagaatgtctgtttgacagatttccccatgagacagttaatgttctcggctaagacatttcaattatagccataccacagtaaatgctgaattcctcagttaaacaaggatagactgggttttaccagatgtgtggtgagtagatagacactgatgagaaacacgcaactgtaaaacccccg

SEQ ID NO: 275367 - DNA, 191 bp, Homo sapiens
aggtgaccctctgagaatcggccatcctggatagtgagccaggaatacagagccctgagcacagccctgctcaccacaccaacctttctttcattatgttttttgtttgtttgtttgtttgtttgtttgtttttgagacagagtctcactctgtcgcccaggctggagtgcagtgacgcgatctcagctca

SEQ ID NO: 275368 - DNA, 314 bp, Homo sapiens
agcagagataaaaagtagaagaacaggtgaaaccttcacttttcatcacttatggaaaggtgaaactttctatttcttgagttcaggccaaaacactggaagagggaaagtgcctatgtactaccttacagtgtttaactttgaaaccttgtaacaaaaataaaagacaaattgttcttttgtaaaaaagctgattaaataaaacagaaaaatgtattttaaaaatgaatactgaaatgaaagagttagataataagaggaaaaaatggtttttaagttgccttccctggccaaggtaggagtaggagagaaca

SEQ ID NO: 275369 - DNA, 112 bp, Homo sapiens
acacatgagaatcagggaaagagttaaatctaatttcatatgtatattatgactggaggaatagtggttccaggaaagaaattcaagacattactaaccaaagatggtggtg

SEQ ID NO: 275370 - DNA, 378 bp, Homo sapiens
aatgggccctcagtgactatccgatgcagggccaggcactgaatgcagatgcatatactggagctcagaggatttcagtgagttaccccggccacagccagtgagcagcgatgtcaagatgtcttgaatcctgggcctcagctgcaaagccgtaaccagtcctctgtgttcccatgggccagtgctttacaaaggtccttgcagagaatcatgccaggttaggctggtggtcccagaggaggataagaggcttatggagcagagttgcctaatcaggcccagccaagatcagcagaccctcaaccaatacatagacacatgaaccagataaatggttttgttatttgccactgagaaatggtaggtgtttgttacaca

SEQ ID NO: 275371 - DNA, 422 bp, Homo sapiens
atacaggaagcaaggcgagtcccctccactaaccaacagggattattgcagcagaaagggagctgctggcagaagctctgtggcagcttatgaaggcctctctgctcaccagcctagagcactgtttaaccagggggtgctggggagaccagggccagaaaggaagggacttttgtctccaccaagctggggattcatgagatagcgatcctgggacatagacacatacgcatatcctgcaacagctgcctttggtccaagcaggcagagtcaaatcaggtctaagtggggttagacgttaattcgactttttccaatcgtgtgtgtgtgtcttcctccccagatttcctgtgattataaaaaaaactttagattcagctggccgaaaacagaaaaatagaggaggatctatgtgtccattc

SEQ ID NO: 275372 - DNA, 405 bp, Homo sapiens
gtaaaatcctagttattattcagaatctaaaaaaatttaaacattaaaacccaatataatgtaataattcatataaagttaatattaaaaatcatgaactccactgagtgaaagagagaagtcaatactcattaagttcctatcacaagcaaggtattatgcttaggactatacatgtatttttgtacataacttttataattctataatgtaggcgatatagatgcatatgcttttatatgaaactctccaggaaaaggatgatcagaataaataagtttacagatttcagaaatatgttactttttatacttaacattcaaagcatgatgtggagcactaccacataatcaaacacattaatttctacagtaaaaaatgaaatctgtgcaaactagaacacac

SEQ ID NO: 275373 - DNA, 403 bp, Homo sapiens
gctctgtccctgccccaggtgtccagcaggccctggaatccgcaaaggcagaaggggaagttggggtgctgggtgctgggcagggggtgctgaggcctcacagcccggcggcttggcccccacccaccccacggtggtcccgcgccccacacttcctctcctctcctgtggtttctccttccactcagtgctgcccagagatgggcttctgtctagttctcctgagaaattccacactcgcagctgggaagtcgggggacccccgaagctgtgcggcggccacgctgcggctcctgcttccctcctgctcgggtgcgggctcggctgccttctcgtcccgcggagcccggagtgcctccccctcgggtagatcctactaacagcatcaaagaaataatgaaat

SEQ ID NO: 275374 - DNA, 250 bp, Homo sapiens
tcttttttttctctatttctctctttaaaaacaaacaaacaaaataaataggatttggatttttctaacaatgccgtgaagtacagtctgagtgacaaagtccaattaaaagaggcacttgccagtgacagaaaagtctcacggcagagtctggtccgaatgaggctggagacagtgaccagggccccggggctcctgtggtgtccttcacactaatggtgaaggaaagtgctgtcacttgatttcatat

SEQ ID NO: 275375 - DNA, 698 bp, Homo sapiens
aaagaatgaaaggaattaagagagagtaagagagagagagagagagagagaataccgtttaaaggtctggtgcgtgtatttaaagttccagaaaggcaagagaaagaggatgaatcaaaatcaggatttgaagagaaaatggtttagaactttctaaaactgatggaaaacattagtccataaattgcagaaatgatatgaaccctgagcaggagaaataccaaagaactctacatatataggcattattgttaaattgctgaaaaccaaaaatgagaaaaatcttaaaaggagctagagagcaaaggaaaattaccttcaaataagcaacaactagctagtagctgtcttctcaatagaaatgatggaaacaaaaagtcaatcaaaggccatttttaaagagctgaaagaaaataactgtcaacttagaattttatatccagtaaatggatgaatgatcatagaaatatataatggaatacaaggcagtaatgaaaataaatagcctacagctatatacagttgtgaatctcacaaataaattattgagcaaaagaaaccagatttcaaaaaacacatactgtgtgattccatttatagagagcttacctaaagtatagtgtttaacaacacatgcttgggtggtaaaactataaaggaaaatgaattattaccataaaaatcagattgtggttacc

SEQ ID NO: 275376 - DNA, 305 bp, Homo sapiens
aaagaatgaaaggaattaagagagagtaagagagagagagagagagagagaataccgtttaaaggtctggtgcgtgtatttaaagttccagaaaggcaagagaaagaggatgaatcaaaatcaggatttgaagagaaaatggtttagaactttctaaaactgatggaaaacattagtccataaattgcagaaatgatatgaaccctgaggcaggagaatggcatgaacctgggaggtggagcttgcagcgtccgagatcgcgccactacactccagcctgggggacagagtagactccgtctcaa

SEQ ID NO: 275377 - DNA, 599 bp, Homo sapiens
tgaggcccgcggagaccaggggtgaggaggccgggggggacgggattagagggctgacggggctgggacgagggtcaggcgagcgcccaaggcgcacaggggtgaaatgggaccgaggaaccggaggggtggaatcagagggctggggaggcaaggaggccgagacgaggctcacatgggtgcaccgaaagggtgcgggggtgcagtgcggggggccgaggagcaagaggggccgctgcggacatgaggaacccgaggctgggagttggggggctggggagccaagggggcagaactggggggcaggcgggggtgtggccgagccgagggcctggtagggaccgagggctatgaggcagaatcgggtgctgagggggacgcgccccattttccgagatttggcctctccccaccccccaggagcctctgggccggcacgttgccccatatccccccagtccctgcaccttcaggggcccagtctgcctgatggcccccggctccgcggcctcccaagcgtccgtgaagcgagcgtcagctgcacaagtgctcgggctgcagctgcttcagccacaggtctgtgagccagagcctcaggc

SEQ ID NO: 275378 - DNA, 263 bp, Homo sapiens
atcaaagcaagagtcctgattgggaaccccaatttccattatattagtagatgatcagctttaccacctgctggtctaacttctaatacttgtggttctgttcttaatcaacaatatagaatacttgtacactccaaggatcagcaaactttctgtaaaaggtcagatgataagtattttagtctttgttagccatgtgacccctgccccaaccacccagctctgctgctgtagcgcaaaagcagccattgacagtgtgaaaa

SEQ ID NO: 275379 - DNA, 188 bp, Homo sapiens
tgctagcattacagacaggatccactgctcccggcctgtcttgtattttgacagtttgattataatgtgccttggtgtggatgtttgtgagtttattctacttggagtttgttgaacttcctggaagtatatattcatattcttcatcagatttaggaaatttttggtcattatgtcttcaaatattc

SEQ ID NO: 275380 - DNA, 458 bp, Homo sapiens
agcctgtaccgaaataagagaaagaaggaagggcactcttcttggactgaagtagattgtcgggtgttggaactcttgtgtacctgtcatgttcatacctaggccatagctggcagaataaaaagaagagggttggagaatgagtctgtgtactcagatgtgaattccaagactttaacttgtcctctggtttccttccttcatggagatttatacagattctccttatgtgcctaatctgaagagcagaatttcttttattttcttttttcttttttcctttcttcttttctcttttcttttctttctttcttctttctttccttccttctttctctttctctttctttctttccatctctctctttctttctttctttccttctctctctctttcttttttatttatcatgaagtctcactctgttacccaggctggagtgcagagaaaagcagaa

SEQ ID NO: 275381 - DNA, 116 bp, Homo sapiens
aagcactgtgaaaatccctgtcctgttctgttccgttccgttctaattaccagtgcatgtagcccgcagtcatgtaccccctgcttgctcaatcaatcacgaccctctcacgtgga

SEQ ID NO: 275382 - DNA, 839 bp, Homo sapiens
gaactcggtccaagagcctctctgagacctcttctcccttctctgtcagcacaggaaaagagagtggaggggctgctgccccaggaaggctgggcccacccctcctcacaggcaccctgatgcctgttcagcttggctctctggatgacaggcagaagcccagttgcttctcttctccacggtgatttctgcatactttatccaaaccccctccccaccgctgttcagtttctggctcctcttcctgcccgtgctctgaggccagctgggggcctcccaggtgactcctgctgctgctgtcactggaccctgacgctgtgccgcacccgaattcctccgaatggagccttggccagagcaaggcgtgccgtgtagaggagcggatctgagcctggcaggagatcgctaaaacctttgcccttcacacaaacgcggaagcacggggcgggtgctgaagagccaagcaagtgtcccccatttccttccaaggcagagcagcagcccagggaggcccagtttccatcgcggcagaagggcagaagagtgggggaggtcccaggaccacagcccaggggacactcaggatgcgccaggaaggacatggcagacaggccctttaggtggaaaagcaaccctcagctgcccagagagcggcccctccaggccctccccgccgtctgcaaagctcttcagctgggagaggaggaaagggtttgttcttgacctccttcctttcctttcttctccactgtccaccagagagcaggaagacaggctgatgctcttgttaaagatgaaggcataattcacatgccataaaattcaccattttaaccatt

SEQ ID NO: 275383 - DNA, 476 bp, Homo sapiens
aagagaaagaaagaaagaaaagagaaatgaaatctgccagctgaccaggatggctcactcttaaatatgataagacaaagatcgtcagatatttgaaaaatgaccttagcatgaaaaagagacaaggataaatggtggtggtggtcagggcagagctccataagaaagagaagtaatttaggaaacagaagacaaaagaacattttaaatatttcaggcatttgtcagatagattggagaggtgttacatccctaaacaaggacaggatgctatgaaaaggagtaatcagagaataagtgtgaactactggaaattaaagataggatcacagaaataaaaaagtcattagaaggtgttggaaggtaagagaattagttttatatctaaatgatagtatatctagatcctaaaaatttccttagaggtaaaaaaagaaaaaaagaaaggttacctaaaaatttccttagaggtaaca

SEQ ID NO: 275384 - DNA, 278 bp, Homo sapiens
tcaggtgttccacccgcctcggcctcccaaagtgctgggatcacaggcgtgagccaccacgcccagcctcgactctagactttttaaacttgagtttgctaacaagaactttgtcctcttggcttcaacatatgttcccagcatcacagagataggacagcagacaaacgagagagataataagagaggagagagaaaataagagaggaggaataaaagaaaaggaggagaaaagtcactattatctaattgcatttgagttcctagatccaggtgtc

SEQ ID NO: 275385 - DNA, 2331 bp, Homo sapiens
ggatatccgggggcgggggcgccggcgcggcgcatgcgcgctgcattgttttgactgaaaatgccgtcggtttcgaaagcggcggcagcggcgctgagcgggtcccccccgcagacggagaagccgacccactacaggtacctgaaggagttcaggacggagcagtgccccctgttttcacagcacaagtgcgcgcagcaccggccgttcacctgcttccactggcacttcctcaaccagcggcgccgcaggcccctccgcaggcgcgacggcaccttcaactacagccccgacgtgtactgctccaagtacaacgaagccaccggcgtgtgccccgacggcgacgagtcacttctcggcgtcctctatcctctgtgggcaccccctccggtgcctgcccccgtgggtgcccccactgtgcaccctttcctagcccggtggttctcgcacgttccctgggaaccagccggcagtgcagatccacgggcctcgtccacaccagctggggggaccacatgggccacgggcctcctaggtgattttgatgcatgtggctcgcagtctcgagaatgtgttaagggggtctggtggaccctccttgggttcaggtgtccctacctgcaccggacgacgggggacacagaacgcaagtaccacctgcgttactacaaaacaggaacctgcatccacgagacagacgcacgtggccactgcgtgaagaatgggctgcactgtgccttcgcgcacggccccctggacctgcggccgcccgtgtgtgacgtcagggagctgcaggcccaggaagccttgcagaacggccagctgggcggcggggaaggggtcccggatctgcagcctggggtcttggccagccaggccatgattgagaagatcctgagcgaggacccccggtggcaagcattgcttccagtcgcgctgctcaggcaccgtgtggcccatttttcagatgccaacttcgtgctgggcagctacaagacggagcagtgcccgaagccgccacgcctgtgccgccagggctatgcgtgcccacactaccacaatagccgggacaggcggcgcaacccccggcggttccagtacaggtccacgccctgccccagtgtgaagcacggggatgagtggggggaaccctcacgctgcgatggcggcgacggctgccagtattgccactcccgcacggagcagcagttccatcccgaggggcctgtcgggagtccggtgtccggggcgttttctgtgttcagtcacgcaggcctggttgcagaccccagtctctggtacccagctgagtggagctggcaccacgtgggccacagccgcaccataaatcctgagggagataaaccctcccgcctgggccccgccccagaaaatatcaagcggggaaatgactttgcctgtgatgggagggcagatgctgcgggaatggccccacatgtgtgcgtgttccctatctacaaatctacaaaatgcaacgacatgcgccaaaccgggtactgcccgcgcggccccttctgtgcctttgcacacgttgagaagagcctggggatggtgaatgaatggggctgtcacgacctccacctcacgagtccttcctccacgggcagcggccagccgggaaatgccaagcggagagactcgccggccgagggtggccctaggggcagcgagcaagacagcaagcagggggtgcgcgctcacggtgtttatgtctttgaacagaaccacctggccgtgtttgcagcggtccacccgccggcccccagcgtgagctccagcgtggcgtccagcctggcgtccagcgccggctccggcagctcctcccccactgcgctgcccgcgccccccgcccgtgccctcccgctcggccccgccagcagcactgtggaggccgtcctcgccctggagcccaccccttcctctcctacatcctctgctgtgcagggtgtggcgggggagctgggcatgggatcaggaggacagggctgctggagccacgtggtgggggccctcgctgcagtccctgcctggacacactctggggacttggagtgggaccccagcaccatcaggacccgcgtcaatgtgggcggcggcccggcggccagacccgcaatgactcttgcccgagagccgcagcttctggtcgttggtggttgccccacacggaactgctcaggcccagctgcaagcccccagcaactcctagacgatgccggccaaggaggccgaggagagagagactcttcccagcggccacttaggccacagaccacacatcggcaggacactagaccagtcccatcctga

SEQ ID NO: 275386 - DNA, 1481 bp, Homo sapiens
ggatatccgggggcgggggcgccggcgcggcgcatgcgcgctgcattgttttgactgaaaatgccgtcggtttcgaaagcggcggcagcggcgctgagcgggtcccccccgcagacggagaagccgacccactacaggtacctgaaggagttcaggacggagcagtgccccctgttttcacagcacaagtgcgcgcagcaccggccgttcacctgcttccactggcacttcctcaaccagcggcgccgcaggcccctccgcaggcgcgacggcaccttcaactacagccccgacgtgtactgctccaagtacaacgaagccaccggcgtgtgccccgacggcgacgagtgtccctacctgcaccggacgacgggggacacagaacgcaagtaccacctgcgttactacaaaacaggaacctgcatccacgagacagacgcacgtggccactgcgtgaagaatgggctgcactgtgccttcgcgcacggccccctggacctgcggccgcccgtgtgtgacgtcagggagctgcaggcccaggaagccttgcagaacggccagctgggcggcggggaaggggtcccggatctgcagcctggggtcttggccagccaggccatgattgagaagatcctgagcgaggacccccggtggcaagatgccaacttcgtgctgggcagctacaagacggagcagtgcccgaagccgccacgcctgtgccgccagggctatgcgtgcccacactaccacaatagccgggacaggcggcgcaacccccggcggttccagtacaggtccacgccctgccccagtgtgaagcacggggatgagtggggggaaccctcacgctgcgatggcggcgacggctgccagtattgccactcccgcacggagcagcagttccatcccgaggtacgtccctccaaccccccaggcgtaggggtcgctggaaggtcccagagaagctgtggggttcacagcgtggttatcacacagaaggaacagtgattaactttggccgagggctggcacaggtcgggaagcctgggggtggaggcatgagggctgtacctgcttgcttgtcttgcttgctggccttcgggctgccctcagccagcgagtctctccacttggcctgtaacagaagaaagagtcatgtgggaaaaaagcagagagaaaatgtcaattaaaaacatacatattcaggtctgggtgcagtagctcacgcctgtaatcccagcactttgggaggctgaggcagctggataacgagatcaagagatcaagaccatcctggcaaaaccccgtttctactaaaaatgcaaaaaatcagccaggcgtggtggcgggcgtctgtagtcccagctactcaggaggctgaggcaggagaatggcgtgaacccaggaggcggagcttgcagtgagctgagatcgtgccactgcactctggcctgggcaacagagcaagactctgcctcagg

SEQ ID NO: 275387 - DNA, 1435 bp, Homo sapiens
ggatatccgggggcgggggcgccggcgcggcgcatgcgcgctgcattgttttgactgaaaatgccgtcggtttcgaaagcggcggcagcggcgctgagcgggtcccccccgcagacggagaagccgacccactacagcacaagtgcgcgcagcaccggccgttcacctgcttccactggcacttcctcaaccagcggcgccgcaggcccctccgcaggcgcgacggcaccttcaactacagccccgacgtgtactgctccaagtacaacgaagccaccggcgtgtgccccgacggcgacgagtgtccctacctgcaccggacgacgggggacacagaacgcaagtaccacctgcgttactacaaaacaggaacctgcatccacgagacagacgcacgtggccactgcgtgaagaatgggctgcactgtgccttcgcgcacggccccctggacctgcggccgcccgtgtgtgacgtcagggagctgcaggcccaggaagccttgcagaacggccagctgggcggcggggaaggggtcccggatctgcagcctggggtcttggccagccaggccatgattgagaagatcctgagcgaggacccccggtggcaagatgccaacttcgtgctgggcagctacaagacggagcagtgcccgaagccgccacgcctgtgccgccagggctatgcgtgcccacactaccacaatagccgggacaggcggcgcaacccccggcggttccagtacaggtccacgccctgccccagtgtgaagcacggggatgagtggggggaaccctcacgctgcgatggcggcgacggctgccagtattgccactcccgcacggagcagcagttccatcccgaggtacgtccctccaaccccccaggcgtaggggtcgctggaaggtcccagagaagctgtggggttcacagcgtggttatcacacagaaggaacagtgattaactttggccgagggctggcacaggtcgggaagcctgggggtggaggcatgagggctgtacctgcttgcttgtcttgcttgctggccttcgggctgccctcagccagcgagtctctccacttggcctgtaacagaagaaagagtcatgtgggaaaaaagcagagagaaaatgtcaattaaaaacatacatattcaggtctgggtgcagtagctcacgcctgtaatcccagcactttgggaggctgaggcagctggataacgagatcaagagatcaagaccatcctggcaaaaccccgtttctactaaaaatgcaaaaaatcagccaggcgtggtggcgggcgtctgtagtcccagctactcaggaggctgaggcaggagaatggcgtgaacccaggaggcggagcttgcagtgagctgagatcgtgccactgcactctggcctgggcaacagagcaagactctgcctcagg

SEQ ID NO: 275388 - DNA, 801 bp, Homo sapiens
agcactgcaggagggaccccaagcccagctgggacccccgtgtgccccacccgtgcctctggttgcagccacgctctccagcctgtgggctgcatgctgtctcctcacccaagctgccaggggctcaggcactgtcgtcacctgggctcaatcttgtcttcacagctggcagctgggacgccgggtccttaggctgagtcccagggccaacaacccaagggtcgccctgcccagggtgcacacaggaccttcctccaccgcctgagccccagctgtcccctgggtctggcttgtgggtttggcacctcgcagcctgcttgcctctgaagcccctttctcctccttgctccagcccggccttctggttgtgcctggcctggcttgcctcctgtctgcagtttgcacctgagaggggggtgggggggtgcagaccccacagggtgtctggatgcctgggccatggccttggcctccctgaggccctgtctgtgtccagctcttcctttgagcagagagccaccctcgcctcttttgaatgacctggtgctgcctcgcatgccccggagagcacctgtgcttcctttgggaaggacgccccactccttgttgttatgccacgttcagtctccctctgagcagcttccgagtaaaggacctgaacggctgtagaacaaaccacaaattagtgtctgagattttgtcatcgcccgtcatggaaagaaaataaaaattattttttcaacaggcacttaatgtgtcccataaatacaaatcagttacaataaagcagctagagattcc

SEQ ID NO: 275389 - DNA, 1392 bp, Homo sapiens
tggtgcgcgcctatagtctcagctacttggaggctgaggcgcgaggatcacttgaacctgggaggctgaggttgcagtgagccaagagtgcgccactgcactccagcctgggggatagagcaagactctatctaaaaaaagtaaaatcctcagccaagggggaggcgtgcaggggctgggaaggaccaggcgctgcttcccgtcgtttcttgactcatgttgtcacagacgcgcatcatgctttctgggtgtcggtgaccacacactcaatggtgtcaccaggggcctgtcgggagtccggtgtccggggcgttttctgtgttcagtcacgcaggcctggttgcagaccccagtctctggtacccagctgagtggagctggcaccacgtgggccacagccgcaccataaatcctgagggagataaaccctcccgcctgggccccgccccagaaaatatcaagcggggaaatgactttgcctgtgatgggagggcagatgctgcgggaatggccccacatgtgtgcgtgttccctatctacaaatctacaaaatgcaacgacatgcgccaaaccgggtactgcccgcgcggccccttctgtgcctttgcacacgttgagaagagcctggggatggtgaatgaatggggctgtcacgacctccacctcacgagtccttcctccacgggcagcggccagccgggaaatgccaagcggagagactcgccggccgagggtggccctaggggcagcgagcaagacagcaagcagggggtgcgcgctcacggtgtttatgtctttgaacagaaccacctggccgtgtttgcagcggtccacccgccggcccccagcgtgagctccagcgtggcgtccagcctggcgtccagcgccggctccggcagctcctcccccactgcgctgcccgcgccccccgcccgtgccctcccgctcggccccgccagcagcactgtggaggccgtcctcgccctggagcccaccccttcctctcctacatcctctgctgtgcagggtgtggcgggggagctgggcatgggatcaggaggacagggctgctggagccacgtggtgggggccctcgctgcagtccctgcctggacacactctggggacttggagtgggaccccagcaccatcaggacccgcgtcaatgtgggcggcggcccggcggccagacccgcaatgactcttgcccgagagccgcagcttctggtcgttggtggttgccccacacggaactgctcaggcccagctgcaagcccccagcaactcctagacgatgccggccaaggaggccgaggagagagagactcttcccagcggccacttaggccacagaccacacatcggcaggacactagaccagtcccatcctga

SEQ ID NO: 275390 - DNA, 361 bp, Homo sapiens
tttccagagctctgtttggcggtgtcacctgacagacctgacacttcccgcttgccctgtgcgcctccccaggcctctgtcgtccggcaggtgcagaactcctgtctggatgggtccggggtgtgcctagctgggtctccactgtgcattctgtgagtaactggtgggaggagaaacttttccaagtatccatttctaagattaactgttgctgcttgtatctggcgggtctggagtctgatcttttttttttctttctttcttttttttgagatcgagtctccctctgtcacccaggctggagtgcagtgacacgatctcggctcactgcagcatccacctcccgggttcaagtgattct

SEQ ID NO: 275391 - DNA, 1430 bp, Homo sapiens
ggatatccgggggcgggggcgccggcgcggcgcatgcgcgctgcattgttttgactgaaaatgccgtcggtttcgaaagcggcggcagcggcgctgagcgggtcccccccgcagacggagaagccgacccactacaggtacctgaaggagttcaggacggagcagtgccccctgttttcacagcacaagtgcgcgcagcaccggccgttcacctgcttccactggcacttcctcaaccagcggcgccgcaggcccctccgcaggcgcgacggcaccttcaactacagccccgacgtgtactgctccaagtacaacgaagccaccggcgtgtgccccgacggcgacgagtgtccctacctgcaccggacgacgggggacacagaacgcaagtaccacctgcgttactacaaaacaggaacctgcatccacgagacagacgcacgtggccactgcgtgaagaatgggctgcactgtgccttcgcgcacggccccctggacctgcggccgcccgtgtgtgacgtcagggagctgcaggcccaggaagccttgcagaacggccagctgggcggcggggaaggggtcccggatctgcagcctggggtcttggccagccaggccatgattgagaagatcctgagcgaggacccccggtggcaagatgccaacttcgtgctgggcagctacaagacggagcagtgcccgaagccgccacgcctgtgccgccagggctatgcgtgcccacactaccacaatagccgggacaggcggcgcaacccccggcggttccagtacagctggcagctgggacgccgggtccttaggctgagtcccagggccaacaacccaagggtcgccctgcccagggtgcacacaggaccttcctccaccgcctgagccccagctgtcccctgggtctggcttgtgggtttggcacctcgcagcctgcttgcctctgaagcccctttctcctccttgctccagcccggccttctggttgtgcctggcctggcttgcctcctgtctgcagtttgcacctgagaggggggtgggggggtgcagaccccacagggtgtctggatgcctgggccatggccttggcctccctgaggccctgtctgtgtccagctcttcctttgagcagagagccaccctcgcctcttttgaatgacctggtgctgcctcgcatgccccggagagcacctgtgcttcctttgggaaggacgccccactccttgttgttatgccacgttcagtctccctctgagcagcttccgagtaaaggacctgaacggctgtagaacaaaccacaaattagtgtctgagattttgtcatcgcccgtcatggaaagaaaataaaaattattttttcaacaggcacttaatgtgtcccataaatacaaatcagttacaataaagcagctagagattcc

SEQ ID NO: 275392 - DNA, 529 bp, Homo sapiens
tgaccactgtgtcctcggcttgcagggagctgcaggcccaggaagccttgcagaacggccagctgggcggcggggaaggggtcccggatctgcagcctggggtcttggccagccaggccatgattgagaagatcctgagcgaggacccccggtggcaagatgccaacttcgtgctgggcagctacaagacggagcagtgcccgaagccgccacgcctgtgccgccagggctatgcgtgcccacactaccacaatagccgggacaggcggcgcaacccccggcggttccagtacaggtgagcctgcgggaccgtgctcagaggactccggctggtgggcgtccttcccggcccgtggctcgcgttgcccaccccggggttctaatgggagggctgcccttgtggcaccatcatccccgggaggggagggcatctccaagcacagtggctgtgggaggtgccatggaggcccacgcgtctgtcctggggatgggcctccccacctacgctcagtgtctcccatgcagtccc

SEQ ID NO: 275393 - DNA, 1209 bp, Homo sapiens
tgtcgtccggcaggtgcagaactcctgtctggatgggtccggggtgtgcctagctgggtctccactgtgcattctgtgtccctacctgcaccggacgacgggggacacagaacgcaagtaccacctgcgttactacaaaacaggaacctgcatccacgagacagacgcacgtggccactgcgtgaagaatgggctgcactgtgccttcgcgcacggccccctggacctgcggccgcccgtgtgtgacgtcagggagctgcaggcccaggaagccttgcagaacggccagctgggcggcggggaaggggtcccggatctgcagcctggggtcttggccagccaggccatgattgagaagatcctgagcgaggacccccggtggcaagatgccaacttcgtgctgggcagctacaagacggagcagtgcccgaagccgccacgcctgtgccgccagggctatgcgtgcccacactaccacaatagccgggacaggcggcgcaacccccggcggttccagtacaggtccacgccctgccccagtgtgaagcacggggatgagtggggggaaccctcacgctgcgatggcggcgacggctgccagtattgccactcccgcacggagcagcagttccatcccgaggtacgtccctccaaccccccaggcgtaggggtcgctggaaggtcccagagaagctgtggggttcacagcgtggttatcacacagaaggaacagtgattaactttggccgagggctggcacaggtcgggaagcctgggggtggaggcatgagggctgtacctgcttgcttgtcttgcttgctggccttcgggctgccctcagccagcgagtctctccacttggcctgtaacagaagaaagagtcatgtgggaaaaaagcagagagaaaatgtcaattaaaaacatacatattcaggtctgggtgcagtagctcacgcctgtaatcccagcactttgggaggctgaggcagctggataacgagatcaagagatcaagaccatcctggcaaaaccccgtttctactaaaaatgcaaaaaatcagccaggcgtggtggcgggcgtctgtagtcccagctactcaggaggctgaggcaggagaatggcgtgaacccaggaggcggagcttgcagtgagctgagatcgtgccactgcactctggcctgggcaacagagcaagactctgcctcagg

SEQ ID NO: 275394 - DNA, 411 bp, Homo sapiens
cttctcagcctttggtaactatcattctactctccatctccatgagttcaattgtttcagtcattagtcccacaaatgagtgagaacatgtgaagtctgtcatgtagacaattttgagacacattctaccttgctcctagctcaataacacacttgcataagctttcctctattcctcttatttcttgcctgtttcccactccttttcattcactttacaaaatagcatatctgtattcaaactcttgtctcaggctctgctttctagggataatccatacaaaatcatacaatcagttcccttgacatgagtaaatgcacgcattcagctgatcccaaactacttcttcagtctgtgggcagcccatggtttacttacagcttctctctcctgtctttttgtgcctgcag

SEQ ID NO: 275395 - DNA, 447 bp, Homo sapiens
tcatacagtatttgcctttctgtgactggcttattttgcttaatacgtcaaggttcatccatgtatgtatcagaatttcttttttaaatttataaacacatgttcacctgcattttttcacatttttaatttccttcctaaggctgaataatattctgttgtatggatagaccacattttgaagctttactttttactaaaaagttgttttccatcatgttccatgattcgtcccgagtgccactatccagtgacactgtgcccctttctcctgtggcccaccaccttgtaccccgcctgagacgcctcaggatgctctggatcacagatacttggattagaatcccagctccacccctgccccccgtgggcagatcacttcctgcctcagtcttttcatttatgaattgggttaagaactgcctggctgtgttcaaaactatagag

SEQ ID NO: 275396 - DNA, 6569 bp, Homo sapiens
  misc_feature (149)..(149): n is a, c, g, or t
  misc_feature (2239)..(2239): n is a, c, g, or t
  misc_feature (3121)..(3121): n is a, c, g, or t
  misc_feature (3547)..(3547): n is a, c, g, or t
  misc_feature (3868)..(3868): n is a, c, g, or t
  misc_feature (3923)..(3923): n is a, c, g, or t
  misc_feature (3936)..(3936): n is a, c, g, or t
  misc_feature (3938)..(3938): n is a, c, g, or t
  misc_feature (3947)..(3947): n is a, c, g, or t
  misc_feature (3982)..(3982): n is a, c, g, or t
  misc_feature (3984)..(3984): n is a, c, g, or t
  misc_feature (4008)..(4008): n is a, c, g, or t
  misc_feature (4018)..(4018): n is a, c, g, or t
  misc_feature (4024)..(4024): n is a, c, g, or t
  misc_feature (4041)..(4041): n is a, c, g, or t
  misc_feature (4469)..(4469): n is a, c, g, or t
tattttgacatgcaagaggagcaggcattccaggtatttgaatactgagagattcaaattatcagcaaggttctttccagttccacgtttgttgtgttatcagtgtaaaattatttgaatagctttccactgatgagttattagctganaagtgtttattgtcatggttgaaagaaaataataatgaaagaagaaacgattacctttagtgataaagttggggccggatgggacgaagcagtgcaatttttttctttataattattcccctatttgaaaaatcaacttgtatatgaggcagcaaacaccttgcagagcagcattcccttttagtttcaggacgtggtggtggatggaaccactgtaacctggcctccctccatgagaggagggaatccaggtggccatgttgaaatgtgcctgtgtgcagcaaggcttctgaaatgacaagagagcccagcagcttccaaagcagctgtgactctggatctcacccatcatctctgcttctcactgttagaggagtgaatctgtgctgccttaggaggcatggaacctgggacttttcttccttgtttaatgtttaattttattaaaataatttgtaagtgatagatgttgatctcgtgacaaaagagagattccctctttataaaactattctaactaaagatcttttgtaagcccatgtgttagaaataaaacttgaatatccccttttttgttgttgtttatgaatggccaataatttattcacatgtgacatttgagctggcattttttcctcctgagatgacagtagcgtccgctgtgttgtattctaaagcaaagtcagaatagccctttgcttttgtcccgattagtagttctgttttgccttcttgccttttccatttagaccttatggtatttcctaaaccttagactgttttgaaaggctttgattaaaatatgctgataaaagaattcgataaccaagttaggaacgacaaggctatctggagaagaccaaatgacttggcagcctaacaaattctattcagagcacacaaagagatcctggaacgttttatagggactcgtgtgtggggaatggtatgaactcaggttacctgcaaaatatggtgtcatatggaaacatttaagagcttatggaaaattctttgaaataaagtggaatgagctagcaagcatattatacctaagaagaaaaacaagagcattcattctggttttttaaggtagctgctcaaggaagggagatagatgaaagtaaattgttttctactttgtacacataatatagaagagatcacctaagcctagttttgctaaccagaccctagacttaaaattagaggtcatgatgtctagccaccttcctctgtaggaacctctcgtgataccctgaaagcctctgcttaaatacttccagagaaaagtgaggaaggtaggggtggggatgaaggtttgcaggaactcatgttgagtacctagtatctgcaagatactagagtaggtactttatcgccatctcatctgacttatgtatgagtgcaggttttataaccctcaagtttacaagtgaggaaactaagtttatataagtgtcacgaaacttgcttcagttcagatgtctagcttgaggcaaatctgaaattagaacctaggtccatcttcttgcattacactaaactgcctctcaggatgagggagagctcccttcatggctaaggcaacctcttctgtctaataatgcagattctttaaaaattctttcttttatttaactgaaatctgcctcccattaacatctctcattggtcctgattcggcctcaggaggatcacagagctgatgcaattctctttccttatgcaggtatgtttgcaaccactgctgccaaaatggcctctgccatcttttacctagttggttttttttgaaaatgaacacacacacacacacacacacacacacacacacacacactcacacacacacactcacagaaatatcctcttattgactgcaatccatctttcaacatatggagttctttttgaatactagaggtatagccttaaagaatatgagtatcagaagatactttagtttcatctttccctgcctgattcatcagccaattgttagtatgccatcagtcaagccattaataaaaataatgaacaaggtgaacaggataggttaacttgtagtctatgtataagtttccgangttgcatgcagaatttagcctatatgtgaatttttctggaaaaatggtcagtaactattgtcagattccttttttttttttttttttttttgaagacaaagtcttgctctccagcctgggtgacagggcaagattccatattaaaaaaaaaaaaagtattgagaagtactcagagtagagaacttactcccgaatgaatatactaacctctttgaggagagctccccaaatgaccataaattcatatagctcagccatcactagaccgtgtatttcagccagaagatatggtgaatggtcttgtaagatgcctgactaaattaaagtattaaagtatttcttgaattctcttgatattcctggactttgagaaagaataattatgcccttaaaaatggaaaaagagactgcaatattgttatacaggccttttaaaaaaaaagtatccttaaatttttagttacagagttcacttttttcccctacttttctttgttttagattataagcccaggattgttcaccagaaggttaccctttagtctgcaggaacctttgaaaacagatgtggtattgaagaatatctctgtaagcccagaacttatccattgtataaagaattttattttccccagtagaccgggagctcctcaagggcagggacctttgcaagtctttgactccctagcactgaacccagcatctggcaaatcttatttcatgtgactttattttggctgaatggcctaaaaatgcgcttgtactgagcacctaatacatttaatttaatttttaaatttttattcaataatatagacatggagtccccctatgttgcccacgctggctcaaactcctggcctcaaggatgttcctgcctcngtctcccaaagtgctgggattacaggcatgagccactgcaccaagccctaacacatttaataaattgtaaggaggaagaacagtggaccgcagtgagatatggtctacagggaaaatgaagaacctcttcaaaaatgatgatcttcaggcctgtaatcccagaactttgggagccgaggcgggtggatcacttgagcccaggagttcaagaccagcctaggaaacatagcgaaaccacatctctaccgaaaaatacaaaaattagccatgcttgtagtcctagctattaatacgtgggaggctgaggtgggaagatggtttgagtccgggaggtggaggttacagtgagccactgtaccccaacctgggtgacagagtgagaccccatctcaaaaccaaaaaagatgacctttattatgtttgacntttaaaaaaatgtagccaaagtaaaagtgttgattagcataaccccgatcacatgttgttgttgaaaatgagcactggcttgcataaaatggacattcatggacatgaaatggacattaatgattttacatatgttaagaagagaattttagacttgagaccttagggagatctgttgatagaattccctatgctctacagataaggatacttagtgaagggactttcctaagctcacagacccagaagagtagtactctttccagccaatggtgatgcttacttatgtttttttttttttttttttttttttgagacggngtcttgctctgtcgcccaggctggagtgcagtgacacgatctcggctcactgcangctccgcctcccngnttcacgccnttctcctgcctcagcctcctgagtagctgggactncngacgcccaccaccacgcccggctnattttttgtntttttngtagagacggggtttcnccgtgttagccaggatggtcttgatctcctgacctcgtgatccgttcgcctcggcctcccagagtgctgggattacaggtgtgagccaccgcgcccggcctacttatgtgttttagaaaaatctttaaaatgttaaaagatgacaggtaatttctagaccatatgaagtagcccagttgtcccaggattagtttattatgtgtatatcagccattattttacagagtcatctcacataaatccacacaaccttaaaggattaaaggatggtttctgtgcaactgaaacatatgcacagaatgacaatagtcgtgatactttctttattcttttttttttttttttgagatggagtctcactctgtcgccctggctggagtgcagtggtgtgatctcggctcactgcagcctccatctcccagattcangcgattctcatgcctcagcctcccgagtagctgggattataggtgcacgccacccgcctgggtaatttttgtatttttagtagagatggggtttcagcatgttggccaggctgatcttggaactcctgacctcaagtgatccgcccacctcagcctcccaaagtgctgagattacaggtgtgagccaccacgcctggccagtcatgctactttataatctgaagttaccagttctttgcagtgtttcacattaggggcattctccaaagggaactttagagataacaaatatgttaaaaatatcgaataaagttagagatgtggggagacattcctactcctacagagagcaaccataccttcctatagactgtgcactgaagaaagggcggaggggatgcgcctgttagagttagaatcttggcttgataggcaaggaaattgacccggtgtggtggttcttatattggtaagaagacccttctttggtttctttttttccagatagctaaagtcaatgtcagtgattgcttcaagcatgatagtcttaccagcctacactctaagcttttcttatgcttccagaatgacttactcagcaatcacttctactttgtattaaaacagttttggttattcaggtaggaagaagagaaaaaaaccaggctgtttccagttgtctggggtttacattatgttacctctcagactgttagtgaaatcagggagactagtggtttttacggcatcagagataccaaatgtataacagacagatgtcatcttactctttttaagtcatggacaaaaagacagacacattgccctgtaactttcagatcttctgtaacctttttaaacaacataggagagaagttggtacttgtacccaagggaagagaaagttaatgagtagaaaagacagaatttatttaggaaaacgatggaattaagctctggacaaaacatgcatcagtgatgcataacatttttgttaattgggtcttaacaggtttctgactcatatggtaatcattgtagaagtgggtcttactagaccacgccagtggcaaatcgcgaagctgtaagaactcttacctccctgtgtgtgtgcacctgagtgtgtgggggggcgtacgtttctgtagcttaatttaggttccacatacacttcagtggttaaacctgagctagactcaaatagtttgtttccattaagaaaatgaatcttttatgtggaccaaggtcaggttagttaatttgtttgcttttattggaataacttttcccattccaattcatcacttaattttaagtggttctactaaaatacccattaaagtcctttacatttctcacagactagggctatgacagattcataagacgtttcttttttcctcaaggcacaaaaggtagcttttctggtcatcaacctagtcttccttgttcctaatttcacaacagtggggcaacattttatataataccaatatgaactctaattgcaaagagactaaatgaaatcttcacacgaagcaagattaattaaaatataaaatgtgcttgactgtggtaaaacatttcttttaaaaaaaatagtatgacttttttttttttttttgctaaatctttcttttttgtacacctcaccctcttcttcactgatgcattttccagcaactggaagttcactctggctaggaaagtaactaaatgtgatgttatcattctaattagtgattacaaaagatcaattaatgttataattaaaaacagtgtctagatctgttgtttgtagtgaataaatgtgacaattactttgttcattgacatagatgtgttgaatttcctccctagattttaaggggatgcattttagtgctgatgtgtgcatttaactgtggacagtaggaacaaggcaagcatattaggggaagagtagggcccctaatgtctaagctacagacatattttagcatgcttgacacctttccttggtatatgatgctatatcagcaacttgtactcattggatctggagcctctagcttttaatattttatcactaaatgcttaagtgtttatgttgcaaaaaga

SEQ ID NO: 275397 - DNA, 571 bp, Homo sapiens
agcccacgccagcctacgtcacgcaggaagggagccagtggccaccccaaacacacctctcctcctcacacctggcctacgtccaactctccacggctctacccagaaggctgcacgtacaacacacacagaggcgggcatttccctgacgactcgtgtgtgccgtgggggagcggtagatggcccagccccaagtgttccgatcttcctgcccaaacatattctgtgacggaaagcctatgttgacctcgtccggcactcaaggcgtgggcagcggcctaacgtctgctgcgggaacacagtcgcgttgaatgctattctcaagacagacaaaacagtgggaagacactacgccaagctgctaactccctggccattgccggactctttcacccccatggactttccgctggcattttaaacaacatagtttcttttctctgtctctttctctttctctctctctttctctttctctctctctctctctctctctctctctctctcaatctcataatttctctctctcgtgccacgttcccacccaacgctctctcgcccacttctactg

SEQ ID NO: 275398 - DNA, 402 bp, Homo sapiens
caagagtgctcattcaagttactcagattttctggaagtcttttctgaagagctatgtgatgttgttctatgggacagactactcttatttaacatctgggcacttaggtagacaaccttctactgacctggaataaagtgtttcctaacataatattgaattattcagaaataatccattacttcaaaaaagaaaatattcattgggctagcccaaccttctctaggccctaagaattattacctcccctttctaattctagcaaacatggaacattctccttaggcacttgacacccacgagggtaatcctgagtgctcagtttggaataggttgcaaatctcagattttagggattgagtcacaccttcaatctatagaatgaagttgaccaattaaaa

SEQ ID NO: 275399 - DNA, 166 bp, Homo sapiens
actttatcttatcctacgttgccatacatgcatgggctttcttctagactctattcaattccattgttctacttttctatttctgatcaataacacactattttaggcactctaactttcatatcttatgtttcgatatctgatagggttagtctcctccccccta

SEQ ID NO: 275400 - DNA, 260 bp, Homo sapiens
atttgtatggaatatcttttcctgttcttttactttcaatccatatgtgtctttaccagtgagaagagtttcttgtaggcagcttatagttggatcatgttttttcatccattcagcccgtctgtatcttttaaatgaagtttaatccattgacgttcagtgtgattactgatatgtgagggctgattcttatcattttattaattgatttctagttgttttgtttatcctttgttcctttctcttttattttttatcat

SEQ ID NO: 275401 - DNA, 534 bp, Homo sapiens
taaggcacaggtcatagcatgcaaatggacttttaacctttaattagtggtttaccctggatagtaatggtttctaacctctttagtaaataaacagcttatagaaagccaggaactttgggaatgtaatacaaatggatttattattaacatttgagtgactcatagttgatttattcattacctaaaaatttgagtatgtaatctactctaggttaagttgtacttataattttggaggaatgatagatgaataatttttctgcagttatattgaattgatatactgctacatttagacctggacctgggcagaaatacatctcaggataatgaaaacaataaaccatggttgaaatttggcccattgcctatttatgcaaataaaatgttgtattgacacaagctatgctcattcatttacttgctgtctatggttcctctcgtgctgcaatggcagaattgaccagttgcaacagagaccatatgtcccacaaagtctaaaatagttctatctgaactttcatgaaaaaa

SEQ ID NO: 275402 - DNA, 342 bp, Homo sapiens
tattaggtattctctatcatttaataatatacttgtggactaaaagatataagtgctgtataaaatcagctcaattatgttaaactagcatatctatcttttttgtgtttgtcattggcctgaatagaaaggcctttaaaatttttttagaaagcatttgaatgcattttgtttggtattgtatttattcaataaagtatttaattagtgctaagtgtgaactggaccctgttgctaagccccagcaagcaatcctaggtagggtttaatccccagtaaaattgccatattgcacatgtcttaatgaagtttgaatgttaaataaattgtatattcacttta

SEQ ID NO: 275403 - DNA, 408 bp, Homo sapiens
gtggcgcatgcctgtagtcccagctacttgggaggctgaggcaggagaatcacttgaacccggaggcggagcttgcagtgagctgagattgcgccactgcactccagcctagtgacagagcgaaaatccatctcaaatatatataatttatgacacttgttaaagaaggccattcaaagaggccatgacaatatgtatagggacccctgcaacaggtcttgcagtgggggagagagactggactcaactccaagtccaattaggacatgtgggaatttataatcaaggaacaagaggggcagaagggggggtcagtggatgaaaaatcaaaagaaatatcaaggagaaggggcttctggctaaaatgacttgatactattgttgctgaaggcaggccagggtgaccag

SEQ ID NO: 275404 - DNA, 580 bp, Homo sapiens
taaactttttttcacttttatgtaattaagaaataaatatttatcagatctcagaactataataataaaagagatatgccatattgatttgctgatggaggctaaatgtaactactttattttcgtataaattagagggtgttcaaatcacagttttgatagtcaggttaaacatcacctcttaagattttttaagtgacttctcattttctagtattttatatgaatatttatgtttctcttcaataaaaaagggataaagttaatacagtttcactgactgctttaaaattaaccagaacttcaaaattgtccaaccacttggtctgggaaaggctgctcattgtttttcaatggctaattaccaatgaactcacctaatgctatgctgttgcattcaatgggaattacttgagaagaagttgaattgttgaacttttatacacacatatatattcatatatatatacacacacatatttatttagagtctataaccatatatatttatacatatatatacatgcaaatgaaatatgaacatatgactatataaataaaataatttcaatcattcttg

SEQ ID NO: 275405 - DNA, 197 bp, Homo sapiens
cccaggcctcctggccctgaagttcagcctgtgacagctcccccaccaagtgggaatgggcagtaaaataagccaggcccgggtgtggggccaccgagaggacccaaagggggtcttgaggccacgctcctccatcctgactcaggtggggagggtggtaagaggtctgtgctgttgcatctcaaacacccgtccgt

SEQ ID NO: 275406 - DNA, 471 bp, Homo sapiens
ggatactttctgctgcattcagatgagagctaatagctaatctttaaaaccattaagctgcacttagctgagccttcacttacagattctgggagaccctttgctattacacagtggaatcaaactttgtgaggtcatgagtgtagtcaaataagccttttctgtgagaaatcagtgagacatacatttcctcaatctcagtgctcaggtggagtatatgctttgctgccttttgtttaaaacagaaatttttagaaggtttttaatcctaacatccctctgaatttttaatagagttacttatttaaattgaattgtattaaaatttcagtgttttcatcttcaagacagcaggagacctggagtagggtaggcaagtaaggcacttaactcagacacaaaatttaaaggaagttcagcaatcaatataaataatattttaaggcaatatttttaaaaacaaaaattaac

SEQ ID NO: 275407 - DNA, 367 bp, Homo sapiens
ggtccctgcctccctccctcctgcctcatccgtgccctgggagaaggctgagccctacccatctaccatagcctcagcatctggttccagatgtggatcccaggcctccaggtccatctgggccccagctttaagcctccctgctcctcaaagtgggtaaagctttagctataaccagtcgaacagcgctgcctctgccacctccctccgctccctgggtctgctgctttctctcaccctatatttgtgaagcaattgtaacatctagaaagttcttgggttctctggaggtttttaagaaaataggacctttctatttctccagtccactagcaaaaataatcaggggcccagaaaaggtgaggga

SEQ ID NO: 275408 - DNA, 183 bp, Homo sapiens
tcagaagcattcaagcagacggcttagtctggggctcatctaaactagttccagtgggatacggaattaagaaacttcaaatacagtgtgtagttgaagatgataaagttggaacagatatgctggaggagcagatcactgcttttgaggactatgtgcagtccatggatgtggctgctttca

SEQ ID NO: 275409 - DNA, 333 bp, Homo sapiens
cagtgttggtgaccagtgcttatcttcttggacatatacatttatctaccattctacctacctatctattcttcataaaacatttaacatcaaccttgtatagagtcatggtgtggagcctagaagccggaggggaatattttctcaatctggaaatgtctttagtccttttgtgatcagaagcagtctcatttttttttttttttggctctttccatttcacaaggagcaaatcctcaggactaaatatgtgggagtcacagtggtgttactgaattttgtctcttaggcttccctggctcccagtaagtatgccatttgttaccttcttcc

SEQ ID NO: 275410 - DNA, 1033 bp, Homo sapiens
cccaaacagaagggtgagagcatgtcagtggcataaacgggaagaatttgagcaagagaataaataacgtagtattggattagaactcaaagtctaaaataaacatacatgagcccatactgataaaaatgattacataaatacatgggtgagaaaacacaaatcttccttacaggaaaatttcaaatagtatacgtagattcctattcccaggagatggagcttaatcctctcagatgctagtgtggattgggcttagtgacttcttcaaagaaaaaaatatggcaagggaaaaataataactttacagggagacgtcgagcagtaccatacctgaagtgccaaatgaccaaagttaacattactagtgttaagtcatattggtgtcatatatcctctgatgggtgatgaaaagggtacttcacccctgtggtattccaaaaatagacccacgtatatatggaaaactgattttcaaaagtgcaaaaggcaattcagtttcaacaaacggtgctggaacaattggatttcaattggatatcacactctatataaaaattattacaaaatatattgtagacctaaaagtaaaatagaaagtcactcagctcttagaagaaaatgtaggggtaaatctttgtgatttggggttaggcaaagatttcttaggtatgataccataaacatgggcagtgacctaatttccaaataaagtcccacaggtatggaagttaagacttcagcatgtctttggagataacacaattcaacctgcaacaaatataatggttcccaattaggactgctttcatgtttaatacagagaaactgagaatctctatatgagtttagtgcttttcacatactacctaagaaatgcatcttccacatttacatttagtcttccaatgtgttggtgttgtcattaacaaaatacaaattctcctaaaaatattatgaattgtagatttgggcacttcaggttggggatctctaagtcgactgagctgcagtggatggcgcgttaagcaga

SEQ ID NO: 275411 - DNA, 521 bp, Homo sapiens
aacgaagcaagagtccatcccaaaaaaaaaaaagttctgcaaaaatgaatactaaaataaattgggatgttaagaaatgtgatttctgcaatgcttgtagtttctatgttggaatatgtaaccattgcatgattttctgcaaacatcatatcttggtgttctgctgctcgtggacttttaaactgcaccaaaccatggaggtttaattatttaaaaaaaaaatgttttaggctgggcacagtggctcacgcctgtaatcccagcactttgggaggccaaggcaggtggatcacctgaggtcaggagttcgagaccagcctgaccaacatggagaaaccccatctctactaaacagacaaaaattagccaggtgtggtgacgcatgcctgtaatcccagctactcgggaggctgaggcaggagaatctcttgaacccgggaggcggaggttgcggtgagccaggatcacgccactgcactccagcctgggcaacaagtgtgaaactctgtctcaaaaaaaaa

SEQ ID NO: 275412 - DNA, 380 bp, Homo sapiens
ctccagcttgggcgacaagagcaagactccatctgaaaacaaaaacaaaaacaaaacaaaaacctctactctgtggctacgtacaacttctttatgagccgtaaacacatcagtgttttctccgaagagctccatggcatcacatttcacagtcagtccccttgtcaaatgtcacagagcggagtcacttgacaggtttcagaataatcactgtcgacgcactaacatgctccaacaacttcccgtagcaaacattaaagctttcctgaggaagaggcactaaacactggccattgaaatgaccatctgaccatccacaggccacagatggaacatgcagacatgaggctcctggcagggatagtgcccacagcttttgg

SEQ ID NO: 275413 - DNA, 451 bp, Homo sapiens
actgaaagaagtcatttaagcatgttgcttgtcaaaataaaacttggtaacattgaattagttttcttcctgcagttaatgaactcagaagagataaatgactgtggtggtggcccatgcctgtaaatcccagaggtttgggagggtgaggtgggaaaattgcttaattccaggagctcagaaccagcctgggcaacatagtgaggctccatctctacaaaaaaaggaaaacctgccaagcatggtggcatgtgcctgtaatcccaactacttcagaggttgagatgggaggattgcttgagcccaggtggttgaggctgcagcaacacagtgagaccctgtctcaataaaaaaagaaagaaaagagagacacagtcaatagtttctcctgccaaaagaaaaggtgaaaacaagattgtaagaaagagagaagagaaaagaaatcaccaag

SEQ ID NO: 275414 - DNA, 904 bp, Homo sapiens
ctcctgggcacaagcaatcctcccttctcagcttcctgagtggccaggactacagaggactgtatgctgttcttaaggactctctgcttcctggacaagctcaagctaaggactacatctcccagcaggctgtgctctgacagctcttggatttaaataggattctgggctctgctcagagtcaggctgctgctcagcacccaggacggagaggagcagagaagcagcagaagcagccaagagctggagccagaccaggaacctgagccagagctggggttgaagctggagcagcagcaaaagcaacagcagctacagaagttggaacgatgctggtcaccttgggactgctcacctccttcttctcgttcctgtatatggtagctccatccatcaggaagttctttgctggtggagtgtgtagaacaaatgtgcagcttcctggcaaggtagtggtgatcactggcgccaacacgggcattggcaaggagacggccagagagctcgctagccgaggagcccgagtctatattgcctgcagagatgtactgaagggggagtctgctgccagtgaaatccgagtggatacaaagaactcccaggtgctggtgcggaaattggacctatccgacaccaaatctatccgagcctttgctgagggctttctggcagaggaaaagcagctccatattctgatcaacaatgcgggagtaatgatgtgtccatattccaagacagctgatggctttgaaacccacctgggagtcaaccacctgggccacttcctcctcacctacctgctcctggagcggctaaaggtgtctgcccctgcacgggtggttaatgtgtcctcggtggctcaccacattggcaagattcccttccacgacctccagagcgagaa

SEQ ID NO: 275415 - DNA, 410 bp, Homo sapiens
aacgtatcttagtgtgagctcgtgaaggatggtacgtgatgctcttgtttcccttgccgataggaagttctttgctggtggagtgtgtagaacaaatgtgcagcttcctggcaaggtagtggtgatcactggcgccaacacgggcattggcaaggagacggccagagagctcgctagccgaggtaagtgtttcccctttagtctccaaagggccatgcctcccacccttcttcccactggggcctctgtccatattgctttgtgtttcctcctaggcttgggggctctgactagaaattcaaggaacctgggattcaagtccaactgtgacaccaacttacactgtggcctccaataaactgcttctttcctattccctctctattaaataaaataaggaaaacgatgtc

SEQ ID NO: 275416 - DNA, 248 bp, Homo sapiens
agagaatattgaaatatgcctcccctttccagcagaatatctgtgtgaatatggatttttaaatatactttaaccaagggcagatcacatcagattgactgcagaagtagatatgagaatccagttgtcttctattaagttagataattgaagagatttgtaaaaatgtaaaacagaggtattcctctaagttttgtcttgtttttgaaaagttattttcattaaaatgttatgtatattaacatgta

SEQ ID NO: 275417 - DNA, 515 bp, Homo sapiens
caaagctcaggctggttttctgctgttatattagtccattctcatgctgctaataaagacatacccaagacagagtaatttataaaggaaagaggtttaatggactcaagttccacgtggctagggaggtttcacaatcatggcagaagatgaaggaagagcagagggatgtcttacatgagagtgtgtgtgcagagaaactcccctttataaaaccatcagatttcatgagacttatttactatcaggaaaaagacccgctcccatgattgaattacctctcactaggtttctcccatgacatatgggaattatgggagctataattcaagatgagatttgggtggggacacagccaaactgtatcagctgttttctagggcactcactcacagcataacaatgtagcacctgcctcacactgtcaactgccacctgtggcctaggtgcatttcacaggatggccagggcattgccctgaaccacctgggctacagagcaaggctgctttaaac

SEQ ID NO: 275418 - DNA, 454 bp, Homo sapiens
ctaacacaggtatgcgggctgctgggagcctgagagcactgtctgagctgtctcactgcatgtccaccaattgggtgaccatggggcattggcccagagccaccctgtcacgggtgggaaagctgaggcccagcacagggaatggccttgcctgagtgacattgggaatgggtggcagggcaggagctaactttgtccccaggctgtcagagctgaccccttgccctgactccgatggtgaaactgagccactctgccagcagtgtggctctaggtcagaggtagaggctttgtggggatagccccgggctcctcagcagaagacagcgtgcaatccctgcgtggtggagggaggtgcacacacctgcagacccctgccccattctatcccctgctctggggccagggcccctcccctgagtcctggagcctgatgaggatagagaggggaggc

SEQ ID NO: 275419 - DNA, 328 bp, Homo sapiens
atgaaactgctccatctcagaccatcaagcattagattctcataaggagcatgcaacctagatctcttgcatgcacagttcatagtagagttcatgctcctacgagaatctaatgcccctgctgatctgacaggaggcggggctcaagcggtaatgctcacttgcccactgctcacctcctgctgtgtggtccagttcctaacaggccacagaccagtaccagtccatggcccaggggctggagactcctgaggtaataggacttaataaattaagtcattcaaaactgtgcaattaaaatataaattaatgtgttacttctttaaag

SEQ ID NO: 275420 - DNA, 388 bp, Homo sapiens
gtgaaggactttagcaagagaatcaaaaaacgctgaaggctgggtttttactactactcttcctaggttctcaggaggccacagatcaggagggaacactttacagcagacaggaggccgtgctgctcagcctctggaggacccactgagaaagactgccccaaacagcctgcctgctagaagtcacgctcttcaacaccctctgcttccaaacacgaaccacataacacccacaacttaacgaagccagagtgctgggaaaaaaataataagtggcaaaagacaaatactccacaagtgatcacttcagtcatccattccccaaaaaaagaccctcccatcatgctctgccaaacaacagaaagatcattaaagatcatcactggca

SEQ ID NO: 275421 - DNA, 413 bp, Homo sapiens
  misc_feature (204)..(204): n is a, c, g, or t
  misc_feature (381)..(381): n is a, c, g, or t
acagccaaagacctggtcacaaggctgatggaggtggagcaagaccagcggatcactgcagaagaggccatctcccatgagtggatttctggcaatgctgcttctgataagaacatcaaggatggtgtctgtgcccagattgaaagaggggattgccagggccaagtggaagaaggctgtccgagtgaccaccctcatgaaacnggctccgggcaccagagcagtccagcacggctgcagcccagtcggcctcagccacaagacacttgccacccccgggggctggcagaccgtaagtgcccaccccagccacaagatgggaagttgccaccccagccacttgatggcagtgtcaccccagccaccgatggaagcattcantccagccactgatggggagtgtcaccccagcg

SEQ ID NO: 275422 - DNA, 599 bp, Homo sapiens
cctaaggagtactcattctatgccagtcactgtgccaactgtcttacctcaccatgagctcatggggcaagtattctcatgcccaaatccccaatgaggaaactgaagctttgaggaggtcacagaattctggcatatccagaatttaaatttaggcctgcctgatcccacatacttaaacattaccctatactgttttactctatttaagtcaacaattacagagcagtaggcacactgcttcatttaaaggccataaatattgaaaggttgttgtctgaaggtagagaccaatgaacagataatttgcacagataaatataattttgatcaagtgctgtgaggagacgagttagggcaaagttttacagacctgggacctgaacgatgagtaagacagtgccatctagggggaaaggagtaccagcggacaaaaacaagcatcacaggcaaagaaaatcaattggtatcttgggcgtctcagtctctccatcattaccacaatctaacatttacttcaaaggcctacttcctctatccttctgtggtaaagcagcatgtcggatctaatggtctggattaacgcgggtcgcgagctc

SEQ ID NO: 275423 - DNA, 477 bp, Homo sapiens
atttttggtcatgaggtttttgcctaacccaatgtctagaagagtttttccagtgttaccttctagaattttttattgtttctgatcttagttttcactatttgatccatcttgagttgattttttataaggtgggagacaaaggtgaagtttcattcatctgcatgtggattgccggttattccagccccatttgttgaatggagtgtcatttcccctttgtgtttttgtttgctttgtcaaagttcagttggctatgggtgtttgtctttgtttctggaatctctattctgtacatgcctgttttcatgctgataccatgttgttttggtagcttttaatgtgccttgtaatacattgggtggtgtgatgcctctaggtttgttcttttttgtggtctttctttgactatgcaggtttcaaagccgagaatcaaataaagaactcatccattttgaaaatagctgcaaaaaaaaa

SEQ ID NO: 275424 - DNA, 371 bp, Homo sapiens
aggttaggcatacttggatcgtatcatttgcacaagctcaccttgaagtatatatgtaaacatgccattttacaaatgagggaactgagaggctcagaggttttataacgttcccaaggtcacacagcaagtaagtcacaaggcaaatatatccaaccacaggcctctgtccagagcctcctccaagcacccaggctgagaatggtgactgggggagccagatggaaccctgatccttctgagtggaaaggtgcttttactgcacttcatttccactccccaagatgtcatatgagtgggactgtttcacacccaaactgttaacctggggtcagtagtgtcctctcttctttatcctcaaattgtacccc

SEQ ID NO: 275425 - DNA, 400 bp, Homo sapiens
aggtgggtggatcagttgaggccaggagttcaacaccagcctggccaacatggcaaaaccacatttctactaacaccacaaaatatagccaggcatggtggcacacacctgtaatctcagctactcagggggctaaggcatgagaattgcctgaatccagaggcagagcatgcggtgagccaagatcacaccactgcattctggcctggggtgacacagcgagacactgtcttaaaaaaaaaaaaagtttggaaatgtctcaaatggagtactacagtcttcaacatagcaatgaaacaaaaaacagtaagctctggagtaggagaatctgattactggagttacctcattataacagtcaaatgcccatttttcaacaacaaaaattacaaggcataca

SEQ ID NO: 275426 - DNA, 456 bp, Homo sapiens
tatatgtttctcagccattgatgtttcatttttggccttttacttttcattttttaattaattttatttctatggtttgatatagtttttaaaaaaattattcaactatttcctacatatttgtgaggtaggtaggagaaaatgagtactgtatttttaactttgctagataagataatgcctgattgtttttttttccaaatagtttcacattctcacccaaatatcatgttgtcaaacttttaaattttgttaatttggtgggtataatgctttcttattaattttgacttgcattttttcaattgcaactgaggttgacaactttttgatatatttattatctaattggattttgtaaatctctttcatcatttctctgttcaattggctttttcccatgtattcatttgttgctggtatatagaaatacaaattgattttgtgtacttggta

SEQ ID NO: 275427 - DNA, 433 bp, Homo sapiens
tgtcattggaactctgaagctctctctgccctttaggtttggaccaagtgctgtcaaagccagagaaagtaggattaaagatactgatcagccaggacagataggggttttctgctggaaactgcgatacctaccctcggtacatggggatagctcacgtaagtgacttggtcacttggcaagatttcttcgcttctcggatagctgcaggaattaaaacatagtgtatagaatttaggtgttttacactaaaaatgataatgtcttgttccaattaagaatagtaaacaggtccaagtatagacaataaatgagattgggattctgttctcatttctcaatgtgaacagttactcccatatcagcattattttctatttggccttcttaaatacagagaaaaaataggatatattaatagtaggtcacttga

SEQ ID NO: 275428 - DNA, 422 bp, Homo sapiens
aagttacgatggaatgaaatttcaattatgccgtcacctattttctgatgtggattttattttcattttacagagatttcaccaagttaaataacttgtacaagggaaaggggaaaaaaaacacaaacttatagaccaggatcttaaacaacactagtgaccatgaccacccatctccaggctgctgcatggaagaggaggtataagtgagagattggagcaatgtttttcagcttctgagcattctgtgatgttccattaggaagcaagtagcgagagcatgggcctgggaagccctttctccacccagcctcatcttttgcagctacagccactctttttatctttatttatcgagacagagtctcactctgtcacccaggctggagtgcagtgtcacgatctaggctcactgcaaccac

SEQ ID NO: 275429 - DNA, 330 bp, Homo sapiens
ccagttccatccaagttagtgcaaaagacattgtttcattcctttgtatggctgagtagtattccatggtgtatatataccacattttctttatccactcgttggctgatgggcagttatgttggttccatatctttgcaattgcaaattgtatatgtactttatttttattattttttaaatttcatttctaaatttcagaaaacctacttaaatacactttgaaacaacagtccaacaaaatagaacagacttcaaatgttgaatatacaaaccattatagttcaaatctgaacactggtactttccgtcataaacttcaactaaaac

SEQ ID NO: 275430 - DNA, 197 bp, Homo sapiens
gaagctcagggacacccacctcccagagggggccaggcaccatgcctgcaggcaggttgctgactgcagggtgacaaggtttcactgggacagaggggtttcctaggacacaagatattcagtgctaaagcatggaagtcgcagcaaatgattgagttggtcccccaaacgcctggcccaccaggagggctggataa

SEQ ID NO: 275431 - DNA, 388 bp, Homo sapiens
tagtaaattgttatggcaacaataagaaaaatcaagacaacatgcacagatggaattattttatacttcactattcctctcctaccctctatagtcaaaagtgtatgtcatttaaactaatattcagtatttacatgattatgccaatggaaatacttcatgaaaggccaaatatataaaaaatatttcttatacatatttttcttgagctaataattgtcttgtttattctttgtacactttaccatgcaaatatcactttctttcttatgctatcattactctatagtattgagtattttattccccattgtcccttcactttgtgtcttctactgtcttgtcccaagctaaactgttttgtaggacatttgtacacgtatatttt

SEQ ID NO: 275432 - DNA, 347 bp, Homo sapiens
atccttactctggggcatatgcttgtgattggaatcataaaccctgatggtttaaattgatgtaatttaagtgtgcacaaaatgcagctactgggctgccatttcatataggcttcgatggtataggaaacagcaaaatgactagaatgaaatatacccccaaaaactttaacagtggttatcactgggtgatttttgtttatacttttctgaagtttctacaatgaacatatcttaacttttttaactaatacaaacttattagtcctggcatggtggctcatgcctgtaatctcaatgctttgagaggctgaggcggggcaggaggatcccttgagcccaggagt

SEQ ID NO: 275433 - DNA, 571 bp, Homo sapiens
taagcctagggaacccaaggctgcagtaagctgcaatcatgccactgtactcaaacctgggtgacagagcaagacactgtctcaaaaaattaagaatacctgagaaattctcaaaagtaagaaaataaggttgtaaaaatgaagaagctcaacatactaaaactaggaaacatacagatccataacaagacatgcaaagcaaagttcccaaagtcacagacaagaagagaatctcaaatgctggaaaatacataattatggttgcatgatataaccagtgactctttcaacaaaaaccttgcaggccagaaggaaattgtgtgctatagttgaggtgccaagcgaaaaatagcttctatgtaagaataacataaccagcaaaactgtgctacaaaaatgaagaaaaagcaaagacctctaaagataaccaaacgtggaaaaattatatcaacactacatgtgccatacaaaaaatgctgagaagagtcctcctattaaaactatatgatgctaaaaaacaaaactatcatataaaaataggtagctttctaggaaagatataaagatatgc

SEQ ID NO: 275434 - DNA, 724 bp, Homo sapiens
ttgtatttttagtagagactagtagttcaccatattagccagcctgatctcaaactcctgacttcaagtgatctacctgcctcagcctcccaaagtgctgatattacaggcatgaaccagcacacccagacgagtttttgttacttaggtgaaagctcaaacctttgctgatactcaccctatcatgctccaccttaccccccaacccccactcaagccaaagagaacaagatgaccagaaggggccctaagccttggagagtggaaaaactgtgtaaggtgatactaaaaacaagaggcaatgcaggcttgctcattttcatccgtttactcaaaggccatttaatgagtacctttcaaaactgttctgggcagttcccctgggcaggaggggcccctgctctgggctccaccatttagagaaccctactgaggttgggcacagtggcttatgcctgtaatcccagcactttgggaggtggagacgggaggattgcttgagcctgggggttcaagaccagcctgggcaacatggcaaaaccctttctctacaaaaaatacaaaaattatccaggcacagtggcatgcgcctgtacttctaactattcaggaggctagagtgggaggatgacttgagcctgagaagtcaagcctgcggtgagccgagatcatgccactgcactccagcctgagtgagtgacagggcaagatcctgtctctatta

SEQ ID NO: 275435 - DNA, 295 bp, Homo sapiens
taatgggtatcataaattggatgtaaatcacaggagagcaaatacgaggagctgttaagaggcatctacagcccgtcttatctcaggagtttcaacagctctgcagcttttagctctgctttgcagccaggttaatgtatatggcaagggggtaatatctacagaatgtagacaaaacaacttcgcgttcattaagaggatgacagcttaagcacaagtttaaagaacatcaggatttgcttgtgagtgagataaaatatgaatatatataaatatataaatataaatataagat

SEQ ID NO: 275436 - DNA, 291 bp, Homo sapiens
actccagaggattccgtgcagcttgtggaggttggaaagagcctcaggcagaagggcagctgtgcaaaggccctgaggtgggagtgtgctcaggatgtttgacgaaaaggcagccagtgagagtggcgataagtgacggagcactgggcagtatgtgggggtggagcgtggcaaaggtgggcctggaggaggtgtggggcagggcctctcaactctgtctggttgggagcattccttgaattcctagtccatccagacgggtccttttgtgtccatgtttagatgttgtgc

SEQ ID NO: 275437 - DNA, 467 bp, Homo sapiens
ccaaccaacttttgtgtttttagtagagatggggttttgccgtgttgaccaggctggtcttgaattctgggcctcaagtgatctgcccgctttggcctctcaaagtgttgggatcataggcatgagccactgcacctcgccagaatttttttttttaaattgtgtgtatttaaggcatacaacatgatgttattggatacgtatagataataaaaaggtcactatggtgaagcaaattagcatatccatcatctcacaaagttatttatttttgcttttgtttttatttttgcttttgtggctggaccgactaaaatctactcatttatcatgaatcccagatacagcactatattattatctgtagtcctcatgttgtacataagaaatctagactttttcattctatgtgtctgctactttacatcctctgactttcgtctccccattttctttccaccccctgc

SEQ ID NO: 275438 - DNA, 398 bp, Homo sapiens
ggcaattttcgaaaatattgccagagagattgaaataattcaccactgcccctcctccagcttctcctgggcatgccacatacactgtgggaaggggaaaggctgacctagaacaccttcaagtggatgctacagaacccaccagggcagagcctcagctctcagcctcccggaatgaaccatgaacccaaagcaaagagcagaactcctttgacacctccagcttcacagacaaagatgaatctcctaaggcatttctgaaacatgcagttctgaagtctggccagccacaccaaagagcttttcgcaagaaggcacaggccagaagcagatgctgctatgtttcctgtagagcctgcagaactgtgagctaattaaacttcttttcttatgaatta

SEQ ID NO: 275439 - DNA, 349 bp, Homo sapiens
ataattctatatttctcaaatttgagaacttataagactctcaagaatattgtcaagaatattgttactgaccagacacggtggctcagagctgtaatcgcagcattttggagaccagggcaggcagattgcttgagcctaggagcttgagaccagcctaggtaatatactgagatcatgtctctacaaaagttttaaaaaattagccgagtgtggtggcacgtgcctgtagtatcaactactcggaaggctgagggataagaatcacttgaacccgggaggcagagttgcagtgagccaaggtcatttcactgcactctagcctgggcgacagagtgaggcgccatct

SEQ ID NO: 275440 - DNA, 405 bp, Homo sapiens
gctggtcaccttggccttgccacatggccttcaggattcaggcagtggacatacactctttagtaacccgggtgggggggacctgttacactacaggtgtattaaaattcacaacattgttttaagtttaaatattttatttatgccaagatggatgtaatataactttacttttaatggaagtaaactgatcagtaatgtgttcaaatctgctttgcttgttttgagagaattgccatgccttcacaatttttcttgaccaagtaacaaccttaaataattttaattaacttcagcttactgatcttgtctttatttaaaattttggtattttattcatcatgaatttttttcattagttttaatattttaagaatatttcattaaagtatcacaaatcttgat

SEQ ID NO: 275441 - DNA, 183 bp, Homo sapiens
ggagctgcctaaaccctgtacatgaggaaggtggtggcaagaccaagatggtgggccaggggtcaggcagctcagccctgggacctactgagaagagtggaacaaggggcccctgaaacctccccaaatcgagccagggaccaggggaatccccagatgtcagtgcctgtgagaagccctaga

SEQ ID NO: 275442 - DNA, 342 bp, Homo sapiens
ttagcagccatctcatagtaaatcttccaaataattaggagggtcactgctttgtcaggacaatttataccctttctcaattagcaaattgtgtggcaatccaaagttaactggagtgttgctccccttttctattttgctcccgtgtggatgtggtgcaagaaggcctgccaaggtcagcctcccgttttcctccgtgggttggtatagacatgtttgttggccagacattgcctaaagccctgtagtcaagggtggtgtgcttgcatttgcctggctgaattaaggctcttggtgcttttctatcagtcgaatcccttctcctccatgtcttctagaaat

SEQ ID NO: 275443 - DNA, 241 bp, Homo sapiens
caccctagccatgtggaactatgagtctattaaacctctttttctttataaattacctagtctcaggtatttcttcagagcagtacgaaaatggacaatacaactatgatggtgccttcttctagtatcatttttccaatctaacatttttctacgtaattaccggcaaaacagaagggtttcaactaactctattttgggatatgttctacaaagtgaacacccatggatggctagaatg

SEQ ID NO: 275444 - DNA, 421 bp, Homo sapiens
agcacttctagaaagactgagggataaagacagtcttcctcctaaaaaagcccatgcactagtggctgcagatgtaaacaagctggaatggagctggggggaggaaaaatcaactctacctggctcattaggaaaggttccattgcagaggtgacctttgagcaggatcttgaaggaagactagaaatttgccagatggagaaggaagaaagaagattccatgcagaagaagcaacacaaagaaccagaggcaagaaagaacatatgtgctcagggagaagtacccttcttccatcaataatgatgggcacggtggctcacacctgttattccagcactttgggaggccaaggtaggaggattgcttgaggccaggagttcaagaccaacctggacaacatggaaaaaccctgtctctacc

SEQ ID NO: 275445 - DNA, 1074 bp, Homo sapiens
gcatttgcaaactctttactttcttgttgtatacattctcaagttaagccagaggtataaagttagggccttcttagggctttcctgagcatgcacatagtgctgggcatgtgcatagctctacacattgtcatggtattatagactcacaataatttgtcagagcttttcagaaccataatggacaactcttagcccagcccagcttttccttaacgtttttggttagtctgttttgtattttccactgcctcaggtacctttaagattaaatagttgcctgccattgttttcaacaaagctgccagggaaaatgttttcatattggccaagctccaaatccaatcatatgtagacagccttgcaagtggagttttctagggaaccattagaaaagtaaacttaatgacaattctctgggagtaaggctttggcgaaatgccagcccattctatcctctccagggcctgtcagcttccttggtttttactttgaatgtgttttaaggctgctgcacagctagagtataggagattggattagggtaagttaaaatcacgtagcttgatgttcttactgaatgtcagccattttctttaaatatctactccttgaattgttgcaagcctctggttattttctggaattctgaaaatgatgcttataatttttggcaattttcccattgcttttgtggaagagagaacttttcaggttttctggatttcttcatatataaaatacggggatactgcaaaggacgttcactgcagcaggatttgtaacagcaaaggtgtgagaaacaacccaaatgcccaaaataaggaaatagttttataaaatggttcatgtaggtatacatttgatggagtataatgcagatactgtcagtcatccatgtaaagagaatattttatggtgtaaaaaaaatgtttacaatgtgatacaggtgaaaaaagcagaatacaaaatacagtatgttgaagtttttaaaaatacgttttgtaagggaaatcagcaatgtcagcatttattatttctgggtgatagaatgacagttaaattatgtgagta

SEQ ID NO: 275446 - DNA, 484 bp, Homo sapiens
agccagttataagtgggaaaagagaataataaagttaatcctcttttgtgttggctatcagcactcctaatccttagcaccacagtgtcagtactttttattttagactcaaagatgttttcactgatagggccattttgagtttccacagttgaggacttaagtgtaatagactcttgaaagactattcatacagcgatcattctttcactttgcttcaactgaccaagttggaacatattaaaaatgcaaatgtaatttttacttttatctcttaggatcctgcagagtgtggggcattttccaagccatgctttgagaactgtcaaaatgctgtaaccacctctaggcgaaatgataatagtatcctgcatccacttggcacttgcagtccacaagacaaacagaaaggtaagagtctattcattttatccactgcaaatggagtgagaaaacacaaaagtgtctttttatctaaaaaaaa

SEQ ID NO: 275447 - DNA, 349 bp, Homo sapiens
agtctgtcaacttgggcgtgcaaacaaccatcctaagagcctttcttgctctgatagggagaaaaaaaggcttcgggggctaccagaggagaagaggccatcacctcggaccagcagcaacacactctgaagtaggtctcagaagacaaaaagctgaaatcaactcatgcttcctgctacacagaatccactgagaggaaaaggaaacttcaccgaaacttcagaaagctacagaaatgacatccattttcacaatcccagaaggaaagatgcatctgaagggaataaaaacagagcaatggaagagtatttgttaaaataaatggctttgacagggcaaaaaaaataa

SEQ ID NO: 275448 - DNA, 383 bp, Homo sapiens
cctccaccagcttggcgaactccttgaggacatgggctttgttttctgttccattttaccctccactgtgccttcgcagggattccccaggatcaaccatctgagcagataccttggaatgtccccagatttcagagcctcggaccagcagcaacacactctgaagtaggtctcagaagacaaaaagctgaaatcaactcatgcttcctgctacacagaatccactgagaggaaaaggaaacttcaccgaaacttcagaaagctacagaaatgacatccattttcacaatcccagaaggaaagatgcatctgaagggaataaaaacagagcaatggaagagtatttgttaaaataaatggctttgacagggcaaaaaaaataa

SEQ ID NO: 275449 - DNA, 347 bp, Homo sapiens
cctggaagagtcctcccttccaccccggatatcactgtgaacctgattccccaggatcaaccatctgagcagataccttggaatgtccccagatttcagagcctcggaccagcagcaacacactctgaagtaggtctcagaagacaaaaagctgaaatcaactcatgcttcctgctacacagaatccactgagaggaaaaggaaacttcaccgaaacttcagaaagctacagaaatgacatccattttcacaatcccagaaggaaagatgcatctgaagggaataaaaacagagcaatggaagagtatttgttaaaataaatggctttgacagggcaaaaaaaataa

SEQ ID NO: 275450 - DNA, 351 bp, Homo sapiens
aataacgccacacgtacgccccgtcccacacccacaccatccgcgttggctatcaccaggtacaccattctgagcagaaccttggaatgtccccacatttcagagcctcggaccagcagcaacacactctgaagtaggtctcagaagacaaaaagctgaaatcaactcatgcttcctgctacacagaatccactgagaggaaaaggaaacttcaccgaaacttcagaaagctacagaaatgacatccattttcacaatcccagaaggaaagatgcatctgaagggaataaaaacagagcaatggaagagtatttgttaaaataaatggctttgacagggcaaaaaaaataa

SEQ ID NO: 275451 - DNA, 797 bp, Homo sapiens
cagctggatgtctggatgaactactgaaagctgctgagtgtcctgcaagcaggccatttccaatccagaggaagaccttctagaagaagtgatgggtgggagagtgctgacatactatgtgaagctactatttggagttggacacgagtgcatgtgaccttgtgccacagcgggaatgtgagctggatgacaaatggagattggacttgtgataattggcctctgtgtcattgtgtggaagactgactggtccctttatttcctgtagcttgactaccacacaaattaatccactcaaatgttggcaagtggagcagagtcccaggacggggtctcactctgtcacccaggctggagtgcaatggcatgatctcggctcgctgccgcctccgcctccagggttcaggcgattgtcctgcctcagcctcccgggtagctggagctgcagatataatacgtaagtttggaggtggatgctttcagccattaagttcaaaagtactgccacaagggccaggcatggtggctcacgcctgtaatcccaaccctttgggaggtcaaagcaagcagatcacgagatcaggaaactgagaccatcctagccaacatggtgaaatcccatctgtactaaaagtacaaaaattagctgagtgtggtagtatgtgcctgtagtcccagctacttgggaggctgaggcaggaggattgcttgaacccgggaggcagaggttgcagtgagtcgagattgcgccattgcagcgcagcctggttacagagtgagactccgtctcccagaaa

SEQ ID NO: 275452 - DNA, 415 bp, Homo sapiens
gctgttgaattcccacaggcttgtcttccctttaaaatttatcacatggtttgtactcctttgcagatataatacgtaagtttggaggtggatgctttcagccattaagttcaaaagtactgccacaagggccaggcatggtggctcacgcctgtaatcccaaccctttgggaggtcaaagcaagcagatcacgagatcaggaaactgagaccatcctagccaacatggtgaaatcccatctgtactaaaagtacaaaaattagctgagtgtggtagtatgtgcctgtagtcccagctacttgggaggctgaggcaggaggattgcttgaacccgggaggcagaggttgcagtgagtcgagattgcgccattgcagcgcagcctggttacagagtgagactccgtctcccagaaa

SEQ ID NO: 275453 - DNA, 354 bp, Homo sapiens
gagctcggtacccccccgactagcccgacagtgggagggaggagcctaggttggcctctgcctccaccagcatgtctggttggtgactgggcaccacttgccaggcgaggataggagcagggagggttgggagcagcccagtgtgttccagtgaggacaggctgagcttgtggtgcctgtggagatgcccaggagctaggggcctccatagcagaaaccccagatggaggtaaggatttgggagtcgtcaaccaagaggtggcatttgcagtcctgaatgtggacagaaagagaaaattggaaaggaggctgatagcatggccacatgctgactttgatgatgtgggtgtggca

SEQ ID NO: 275454 - DNA, 267 bp, Homo sapiens
attcactgggtgtagtggtgtgtgcctgtggtcccagctactcaggaggctgaggtaggaggatcgtttgagcccgggaggcagaggttgcagagagctgaggtcatgccactgcactccagcctgggcaacatagtgagaccctgtcccccacaataaatagtagcccagttatgtgcacgtggcacatgtgatctcatttaatcctcacaacggacactttctattgtttccattttacaggtgagaaaattgaagttcagaggt

SEQ ID NO: 275455 - DNA, 453 bp, Homo sapiens
aggtgtgagccacagcgtccagcctcattcttccattctctcttaatttccgtatagtcaggccttctccccctcacccctacacatagcaaaactgttcccatcaaaaccaccaatgacttctactgtgttaactactacttagctctcattttacttgatagatcagcttttggcacaactgatcgtttcctttgataaatttttttactctgctttttgaaccccactcttccttggttttccttctacattactagttattccttcttaatttcttttacaaaatttctccctcttcttctaggactcaattcttcgttctttttgctttctctatctacattgactccctagtgctctcatcagttcctttggttttaaatactacctataatgctgaggattcccagatttatatctccagcccagacttctcacagtctctatata

SEQ ID NO: 275456 - DNA, 539 bp, Homo sapiens
aaaatctaatgatagagctcaaaaaaaaagagctaaaaataggagttggttcttcttagctgtttatccttctaaccttttttttaaatgatgaaggtatgtttttgttgtggaaaatacaagggcttttgttatcactcagacccagagtgaaatgtttgctttgtggttttgaataagttggcctttaataagttatttagtctctcttagcctcagttttctatctgtaaaatggtcatagcaatgtgaacatatgtgttacatcctagacttatttttctaccccagtaggttgtattgaaaggaaaatgttatatgtgtttcagcatgttttggtgaatcttcattccctttcctgccccttgttttccctcctcaaaggggagaaattagcacaaattagtatcaggattgtgcaggaaataaacatttgtgaaggttaagaaagaggaaaaggaagttatttcttcaacagattaaggatttttctacacacagttcttttgtggcattggccacatgtccattagaccaat

SEQ ID NO: 275457 - DNA, 287 bp, Homo sapiens
gttgcagtgagccgagattgtgccactgcattccagcctgggtgacaaagtgagactgtttcagtcaatcaatcaatcaatcatccatgaaggctgggtgtggtggctcacacctgtaaccccagcactttgggaggccaaggtgggcagattgcttgagaacaggagctcttaactagggagtctgaggtgggaggatcccttgagcccaggaggttgaggctgcaatgagccatgagcatgctgctgcactctagcctaggtgacagagcaagaccctatctcaa

SEQ ID NO: 275458 - DNA, 266 bp, Homo sapiens
cagcttcccaaagtgctgggattacaggtgtgagccaccactctcggccacctgtgagttcttctcagggaaacagtttcttaggaaggtggtaaatggcctgacagacttcattttttaaataggtagattatcaagaaaacaatggcattaatcacttccctagaagaagaaaggaagagtttaatctgcaagtgatcttatctttgctaaccattgtcttccctcttcactgatcactgagtttgttcttcgggcattctgtg

SEQ ID NO: 275459 - DNA, 331 bp, Homo sapiens
caaaagaataattattctagtaacaactgaataacaataacttaacaaattcttaaacattttaaatgcactatttttatttataaacttcctccaaaaaagagaaaggcaacttcactaagcttttatgctcttcaagacagactccctactttaagagaaaatagccgttttttattttaaaagttaaaattacatgtcaactcttaaaataatgaaaactaagataaatttccaagatagcttattacagttccttatgacataagcagtacaatagtgcaaaagaaaatttggccaaacttcaattccttttagcaagatcatctaa

SEQ ID NO: 275460 - DNA, 255 bp, Homo sapiens
ttgcttcggtggtctcctcctgggaggatcacttgaaccccaggagcagaggttgcagtgagccgagatcccaccactgcactctagcccgggcagcagagtgagactctatcttaaaaaaaaaagaaacaaagaaagaaaagaaagaagagggatgctgttgcgggggaggtgagaattatggttggctggggtacaggaggggtttgtctttatagccagggaaaagcagtaaaaggcatgaactgggctatt

SEQ ID NO: 275461 - DNA, 325 bp, Homo sapiens
agatagaatcaattcatttcttcactattcacttgttgtgggcgtctcctgtgcacttgttttagaggaacagagctagatgggtcctgaccccacccttaagaattccgtcctactgtggtccatttcttcctctgctgcttcctagcactgtgatcttggacaattggcctaacttccctaagcctcagtttcctcatctgtaaaatgggtatagtgatttctttaatcccctgagaaataaacagaataatgccaggaaagcatggtgacaaatacatgtcactaaatgttattgatggtagcagtgtgaaggctcagctct

SEQ ID NO: 275462 - DNA, 546 bp, Homo sapiens
ctcacttgcaaaggggttggcaagagaagtgagaagggagggaatgagcaagagagaactgggactatatctctgctgccacctgctactctctccgggcgcagcggtgccctctttacttctcagccatttctttagtgaccctgctgttgctgggtagaaaatgccactcaaaaggactcagggctcatggaaaactccctgcaatgagtcgaaaggctcatgttgtttgatctaaagagaactattataaagtgacccaaaaaacctcggatccatatgtgtccaggctgcgaatgagaggagcccattatctggaatctttcagacttttacacaatacggtggagctctgtcatgccagataatttgtgctggccagtctatatgttattttcaaaaaatagaaaagaaagatttttttccacctatacaacaaatcgcatataattaatgactagttatattttatttggagaaatagcagttttacaaatatattttgtaatgatgttttcagtgatcgggatcctcaacacagtagtg

SEQ ID NO: 275463 - DNA, 163 bp, Homo sapiens
aattgtctgtttaaatcttttgtatttttctactgaaattttttcttactgatggaacatttccttccttccttccctccctccctctctccctcccttcctcccttcctttcttccctccctcctcctctccctccctctctccctccttccctcctctcct

SEQ ID NO: 275464 - DNA, 366 bp, Homo sapiens
tgagctgagattgtgccactacactccagcctgggcgacagagcaagatccgtctcaaaagagaaaatgttgtctttgccaggcagtgtggtaggcccaagagatatagcaattagagttgactaagacagtgtccctatcctgttcttgagctccagttctagtgggagttcttgagcttggtaagatgatgtgagtccatcagtggcccaggactctaagcatgtatgttttagtcccagctgtaaatgaggattccattaaccccatcttctccaatgtatggaggatgcaagaagctttaaaatgtccttttctcacagtgacttcccttgaccatgccttagtttcctcagccagaaattg

SEQ ID NO: 275465 - DNA, 343 bp, Homo sapiens
gagccaccgtgcctggcccacagctatttcttgaaaatgagttcaacaatgtggaccttctgtgtgtgcaagggaatatgccttatattcatcctctattctatcacctgacaagaacgaaacagagttcaatggtctaaatttgcattcacgtgcagggttcctagaaatgatgatcctgcataattgttgtggaaatcatttgtcttctattggattcatgaaggcttaaacacatggtcaggggatcagactcactaatagctcttttatgtttcttccacttattgagataaaatctttttttttttttttgaaacaaggtttcactctgtcacccagg

SEQ ID NO: 275466 - DNA, 540 bp, Homo sapiens
cagtagatgctcccattcagaaaggacaggaattaagcatagaggaggcctctccattttgaactgtttcagatcctttggacttccttgaaagctctatgggtttcccatgtaccagatttgggactgctctattaaacaaaagctgaaatcacagtcagacaggcctcacatctttggcaaggtgtcggtgctatgggacaatgcccataagaatctcagaagcctttttgtccagcgtggagactccactaggcatccccttaacacttcagaggttctaaagtttgggtcttttagccaaacttttgattcgaactttactctgagtttatttttttattttgagacatgtgctggctggagagactgaagatgtaaaataattttatttccaagctagcaagtcctgacttgtctatatttcctctgaattacgcttgcaatgagccgagaccacgtcattgcactccagcctaggtgtcagagtgagactatctccaaaaaataaagaataaataaaataaaaccaaaaaaaaa

SEQ ID NO: 275467 - DNA, 541 bp, Homo sapiens
taaataaaagtaaagagacatacatgcgtaattgttcagtgatgtggatgaagggcagggacagcacagatgcctgtgatttcaaatggttagggaggcctcctagaagtagggctgtctcaattgcccctgactggtttgttaagttggagattggggggaaggcattccagtgggaggcggcaaggaagcatagatagtttcagaggctggactctcagtgtggaaggattatggtggccagtggacttgcttaagattgaattttttttttttttttttttgagaccgagtctcactctgtcatccaggctggagtgcagtggcgccatctcggctcgctgcagactctgcctcccaggttcacaccattcttctgcctcagctacttgggaggctgaggcgggagcaggagaatcgcttgaacccaggaggcagaggttgcagtgagccgagaccacgtcattgcactccagcctaggtgtcagagtgagactatctccaaaaaataaagaataaataaaataaaaccaaaaaaaaa

SEQ ID NO: 275468 - DNA, 366 bp, Homo sapiens
gattctatctaattttagatagaaactattggtttatctatgtccaggacattttatttatgaggataaccaattttcattccttatttaaatgtgatatccttgtatttttaatttttggaactaaatcattttcatttcatttggcatttattaacagagtcattaaaatatagtgttatatttcaactatattagaaaaatcagcaatttgaatatcactagtaatattactattttgctgtttccaaaagttaaacctaatagttgtcaattaaaataagaattttaaaaatatagtgcaagatttttcaaagacaaagttaaaaaataaggatacttataaatgaatttgatgttgtattc

SEQ ID NO: 275469 - DNA, 355 bp, Homo sapiens
aagaaccttaaatattattgatatttttggataaagacagaattttttaaatgatcaaataaatgtgctatctattctcttgtccaaggcctatgcttattactaaacctcagcatctagaacaacttctgacacacagtaagaactcagaaaaaatgttttttcaagcaggacacagtggctcaaacctgtaattccagaactttgggaggctgagatgagaggatcacttgagcccaggagttgctaaaaggttggtgtgaaagtgatgggggtttgggtaggtggtagattggtgcctgattgccttgtgctgcaagggtccagacagtctaactactcctcatagactttg

SEQ ID NO: 275470 - DNA, 355 bp, Homo sapiens
gggattatagatgtgagccactgcacccggccaaaaatagatttaaattgcatatatcctttaatttggcaattcttcttctaatactgtattctaaggatatatgagcagcattgctcataatagcaaaagtttgaaaacagcctaatggagagctgtttagataaatcatgggaaaagtcgtgctgccccaggctcttctggagctcagcactgtgtgggaagctgctgggtaagttgctcttgggtgcaaggtgtagtaggctgaataatgcccccaccaaatatgtccatattctaatccccagaagctgtgaatcttattttatttttatttttgattagagacagtgtc

SEQ ID NO: 275471 - DNA, 685 bp, Homo sapiens
ctgtcggcggtgcactgactgactgctactgatcgctatacgtatttatccataccaattccaaaatgcaggttattttgaagagcatattttacaatatttagagatttattcgattttcagttaaatacacataatcaagcactcttcaagaaagatgacatctgcaacacaaaggataccaattcaaaggaaaactaagaaggtcaacagagaggaggacattcaggctctataattagcagataaaaaatatacacatttctgccaaaaaagatccagagttgcctgagactatgaacaattcccctagggctgagagacttctggaagcctgccacatcaaagaacaatatggactaatgaatagtccttcataaagtacaggctattggaaaagtcccagaacagatgaggagggtctgctctagggcagggttaaggggactgaagaggagaaaacagaatggagaaaacagaagaaaagaaaatctaaaaataaacttatctaattcatgtgtgtaaacaactcaagcaactgctgtaggatgtacatttatcttctatttgtagaaatatttcatattaataacagtgccaaaaaccctaacaacgtatctctctaaaaggggcaggagaaatagaataaacaactgaataagccaagaccacacataacaagggt

SEQ ID NO: 275472 - DNA, 342 bp, Homo sapiens
agaaatggtttagagtaaacattttattataaaatctgcttttctcataacttgtcatgtccagctttggatactgtaacacacaggtttgcctggttctttcttaagggtgcgtgtactgcatttcttagtgcacgtggttgcctaggttttctgtattttcacaattatgattaatattgcataatattattctcatgcatctatgctcaagttatgcatatccttccacagcaaaaatttctggaagtggacctgctaggtcaagagcaatgagcactgaataccttgatggttattgttaaaggttcttcacatcggacgcaccagcttagactctcg

SEQ ID NO: 275473 - DNA, 1328 bp, Homo sapiens
cacagagccaaaccatatcagtggctgtaccataatttagttattgctcagtggttgaacatttaggttgcctctagatttttctatttattagaaacattcagggtttctagatttttcagttttataaggaacattccagtgaacactttcgtggaagacttttgcaggaatttcaacacctaattttgttacaaccctaactttctccatttgttttgatgagtagtaaatttttattttgaaaaagtcttaaggcaaaataaatgtaatgcacttatatttcaaaaatataattgccatatactacctataaaataggagtatttcaggaaatcaaacaaaaacaatgatttttctcaagcataaagaactatgcctggtatgacctgctccttttgaattattaaagtataaaaagttgaccagtatttactgaatgagatttattgcctgccttgattgtaaacacctttggctgatgctgggaattggcacaaatgtgaggatggctgtgtttattttgctggttgggcacaatgaactcttattaactcttattttagaataagaactgaatcccaccttcccttctccctccatcatggaaaaaccacagagttcagcaaaatcatgcaggaaagataatttcccttttagtaacctttggtcttgcttcctgtttcttttctgcttcctacttcctgttaacttccagcagcctccactttgcaagctattgtctcctgtctctcccctagaacagttctcatgctttcaaaaaatctcccaccaccacctctggcattgccaccacacctattcttctgccagagttttctaaaattacacattcctttcccaccttctttcccattaaaacactcaggagggattccttcttggggagatgattgaaaacaaagcgaggctttatctaagatgaagagcaaggtatgagtggcaggtgcaagtgactgacaggtaggaccatccagggtattttaaataaggatattgctaactcaaataaatgcatcctttatagttaagaagtgctagagaaatatatgaagggctttctattggtctaggctttctccagtctaggctgactttcccacttatcaagagagccagcattggcagattgtgaccaccctcttatgaaggcataaaactcccagcaggactcctgacatagcaagaaggaccttaactttgggggacttgggctccagatgaaaggatgctttaaggcctaaactacattgcatgtaactaaggctattttctctacagtgaaggggaattcctgaaaaaaaaaa

SEQ ID NO: 275474 - DNA, 451 bp, Homo sapiens
acaagatactcaaagagctggaagaatttgtgaagcagaagaaatctgaaaccacagacactggatctgatctgaggcctatgttagaaccaaagggagggatcctggaggccggttctcctagttaaagtgatgggagcttggcagacggcatggagcactcaagggcaagcagcaatcctgcttggctacttccaaaaacatccactgcctacagcattagccatggggcactgatgcctaagaataacctgtatcaacatccacctgcccaaatagctaatgatgagacacattcaactacctgttttagccctggtaggcctgtttggggcaaaggtgaattgaatgttctggaagagtcccctgactcttggacaaggctgtttttcaacacataaggttggtcaagagtaccttatgaaactctcacatgcccagggctccaacc

SEQ ID NO: 275475 - DNA, 589 bp, Homo sapiens
ccttacatttgtatggtttctctccagtatgaatcctcctatgtctttcaagatgtgatttgcgactgaaaactttgtcgcattcttcacatctgtaaggtttctctccagtatgcagtctatgatggtacacaaggtgtgatgtctgactaaaggtcttgccacactcattacacttataaggtttctctccagtatgacttctatgatgacatgcaagggttgctttttgatcaaaaaccttgccacattcattacatgtgtaatgtttgtctcccctgtgaattctagtatgttttgccaggtgtgaatcatgcttaaaagccttgtcgcaaaccttacatttgtatggtttctctccagtatgaattatcctatgtatttcaagatgtgatttgcaactgaaaactttctcacattcttcacatttgtaaggtttctctccagtatgaattctcctatgtcttcgcaaatgcaaatgaaatcttgattcaagctgacctttaataggcttgtttccagcatgcctttgatcatatcggtctgtactactagtcaacttttttatttctgtcatagctgtttcatg

SEQ ID NO: 275476 - DNA, 444 bp, Homo sapiens
agacacagagagacaatctactgcacacatgcctgaatcagctattggaaaaggcgatctatctaataacatggagagaacaaaagacaatagaggtaggcccaagtgtctttgaagtggagaacacaagtcaacctctattttatatgaaaaaaaaaatgggctgggcacggtggctcactcctgtaatccaaatactttgggaggccgaggctggcggatcacctgaggtcaggagttcaagaccagcctgaccaacatggtgaaacgccgtctctactaaaaatacaaaaattagccaggtatggtggcagcgcctgtagtcccagctactcaggaggccgaggaaggagaattgcttgaacctggaaggcggagtttgcaataagccaagatcacaccactgcactccagcctgggtgacagagggagactcagtctcaa

SEQ ID NO: 275477 - DNA, 345 bp, Homo sapiens
gaaactagtaccatttgatcggacatgcagctataccacagtatgacacacacatatttatcaccaagagaaaagtggctttttaaaaatgtgttagctataagaaaagataaccagctttctgggagctctaaatatatacatatctagggaatgatttaactatttaatcacagatgtctaattttaagaggcaactcacttgccaaattatagtaatagtgcttcaccagtgtggttagctcttggtgggggaggataagggtggaatttacaaggtgaagcaggggtttttttgattgcttgcttttttttctctttaaataagttaaggccaatcccatc

SEQ ID NO: 275478 - DNA, 569 bp, Homo sapiens
ccagtttatcctggtggaccaatatctggcccagcctggggagcagttcctgccaccccttctctcttctggagaacatagctatctagaggcaagtcaagaacttggatattcaggccaggtgaagtgcctcacgcctgtaattccaacactttggaaggaggccgagacctagagatcacttgaggtcaggagttctagaccaccctggccaacatgacgaaaccccgtattctactaaaaaaatacaaaaaattatctgggcatgatggcacacacctgtagtcccagctactcgggagtctgaagcaggagaatcgcttgaacccaggaggtggaggttgcagtgagctgagatcacaccactgcactccagcctgagcaacagagtgagactccatctcaagaaacaaaaacaaaaaaagaacttggataggcaagtaaggtatttgtgcagtgtctagagagctaaactcccctggtttcgtgcccattttgtgatttgcatctaaaattgaaccccagtgtagccactaccagctccaataacatgaattcatacccccatc

SEQ ID NO: 275479 - DNA, 1238 bp, Homo sapiens
cctgccggccccgcggcctgggggccagggagacccagacaacagagggcaggagacgctggagggtcgggcgcaccgcctgcccaggggacacggggcacactccagggggatccaccagccagccacagaacagtaggagggtgtaagtactgcgaccgctccttcagcatctcttcgaacctccagcggcacgtccggaacatccacaacaaggagaagcctttcaagtgccacctgtgcaaccgctgcttcgggcagcagaccaacctggaccggcacctcaagaagcacgagcacgagaacgcaccagtgagccagcaccccggggtcctcacgaaccacctggggaccagcgcgtcctctcccacctcagagtcggacaaccacgcacttttagacgagaaagaagactcttatttctcggaaatcagaaactttattgccaatagtgagatgaaccaagcatcaacgcgaacagagaaacgggcggacatgcagatcgtggacggcagtgcccagtgtccaggcctagccagtgagaagcaggaggacgtggaggaggaggacgacgatgacctggaggaggacgatgaggacagcctggccgggaagtcgcaggatgacaccgtgtcccccgcacccgagccccaggccgcctacgaggatgaggaggatgaggagccagccgcctccctggccgtgggctttgaccacacccgaagcatatgcaatgatgctgtcctttccgaaggaaactcctcttcaaaaccactccaaggggtatcttcatggaacgccatgaggttgagaaggtcactgggcagcccaggtacgggaagtcttggaacatattaacaccccaatataagcacaacctttgaaggggatagtgaagaccagggggggccagatggcctaaaagaggaagggaccaacacagagaaaaggaacacgaagacggggacgggggccaccggagtgaaaaccagtataccaaggtgagtagtgcacaaaccaccagaaaaacactcacaccgacgcaggatcatcaccaaatatcacatgaggacaattggatgcgaaagagacatcaaagaagaagagagaaactcaaccacaccagaaaggtagtaaaaaactgatatgatggagagcgagggagtgaacacgagagacaaagagcgcatcaaagaaatgtgcacagggaaaagacagaagaaagtggcaaacgaagg

SEQ ID NO: 275480 - DNA, 888 bp, Homo sapiens
gaagatagtgtgtggctgcttctggactcaaggaggaggagagagattccgcgagccgacaccatgcgatccaaggcgagggcgaggaagctagccaaaagtgacggtgacgttgtaaataatatgtatgagcccaaccgggacctgctggccagccacagcgcggaggacgaggccgaggacagtgccatgtcgcccatccccgtggggtcaccgccccccttccccaccagcgaggacttcacccccaaggagggctcgccgtacgaggcccctgtctacattcctgaagacattccgatcccagcagacttcgagctccgagagtcctccatcccaggggctggcctgggggtctgggccaagaggaagatggaagccggggagaggctgggcccctgcgtggtggtgccccgggcggcggcaaaggagacagacttcggatgggagcaaatactgacggacgtggaagtgtcgccccaggaaggctgcatcacaaagatctccgaagacctgggcagtgagaagttctgcgtggatgcaaatcaggcgggggctggcagctggctcaagtacatccgtgtggcgtgctcctgcgatgaccagaacctcaccatgtgtcagatcagtgagcaggtaatgaaagtgaaattggagtgaaggaaaattgggcttgaggcgcatagaaggacggtctttccgtccccttctggggctcagatttgcagagtgtgtccttagtcgtccgttgggaagctgacgggcaggggcaccgcggggctgggccagggctgtgcttttgtgagatgcaaactatagtaatgaagggcccagattttttttatctaagaaataaatgtttattagaacttttgaactaaacttaag

SEQ ID NO: 275481 - DNA, 8711 bp, Homo sapiens
  misc_feature (1663)..(1663): n is a, c, g, or t
  misc_feature (1964)..(1964): n is a, c, g, or t
  misc_feature (6061)..(6061): n is a, c, g, or t
  misc_feature (6380)..(6380): n is a, c, g, or t
  misc_feature (6390)..(6390): n is a, c, g, or t
gaagatagtgtgtggctgcttctggactcaaggaggaggagagagattccgcgagccgacaccatgcgatccaaggcgagggcgaggaagctagccaaaagtgacggtgacgttgtaaataatatgtatgagcccaaccgggacctgctggccagccacagcgcggaggacgaggccgaggacagtgccatgtcgcccatccccgtggggtcaccgccccccttccccaccagcgaggacttcacccccaaggagggctcgccgtacgaggcccctgtctacattcctgaagacattccgatcccagcagacttcgagctccgagagtcctccatcccaggggctggcctgggggtctgggccaagaggaagatggaagccggggagaggctgggcccctgcgtggtggtgccccgggcggcggcaaaggagacagacttcggatgggagcaaatactgacggacgtggaagtgtcgccccaggaaggctgcatcacaaagatctccgaagacctgggcagtgagaagttctgcgtggatgcaaatcaggcgggggctggcagctggctcaagtacatccgtgtggcgtgctcctgcgatgaccagaacctcaccatgtgtcagatcagtgagcaggtaatttactataaagtcattaaggacattgagccaggtgaggagctgctggtgcacgtgaaggaaggcgtctaccccctgggcacagtgccgcccggcctggacgaggagcccacgttccgctgtgacgagtgtgacgaactcttccagtccaagctggacctgcggcgccataagaagtacacgtgtggctcagtgggggctgcgctctacgagggcctggctgaggagctcaagcccgagggccttggcggtggcagcggccaagcccacgagtgcaaggactgcgagcggatgttccccaacaagtacagcctggagcagcacatggtcatccacacggaggagcgcgagtacaaatgcgaccagtgtcccaaggccttcaactggaagtccaacttcatccgccaccagatgtcccacgacagcggcaaacgcttcgaatgtgaaaactgcgtgaaggtgttcacggaccccagcaaccttcagcggcacatccgctcgcagcacgtgggcgctcgggcccacgcctgccccgactgcgggaagaccttcgccacgtcctccggcctcaagcagcacaagcatatccacagcacggtgaagcctttcatatgtgaggtctgccacaagtcctacacgcagttctccaacctgtgccggcacaagcggatgcacgccgactgccgcacgcagatcaagtgcaaggactgtggccagatgttcagcactacctcctccctcaacaagcaccggcgcttctgcgagggcaagaaccattacacgccgggcggcatctttgccccgggcctgcccttgacccccagccccatgatggacaaggcaaaaccctcccccagcctcaatcacgccagcctgggcttcaacgagtactttccctacaggccgcacccggggagcctgcccttctccacggcgcctcccacgttccccgcactcacccccggcttcccgggcatcttccctccatccttgtacccccggccgcctctgctacctcccacancgctgctcaagagccccctgaaccacacccaggacgccaagctccccagtcccctggggaacccagccctgcccctggtctccgccgtcagcaacagcagccagggcacgacggcagctgcggggcccgaggagaagttcgagagccgcctggaggactcctgtgtggagaagctgaagaccaggagcagcgacatgtcggacggcagtgactttgaggacgtcaacaccaccacggggaccgacctggacacgaccacggggacgggctcggacctggacagcgacgtggacagcgaccntgacaaggacaagggcaagggcaagtccgccgagggccagcccaagtttgggggcggcttggcgcccccgggggccccgaacagcgtggccgaggtgcctgtcttctattcccagcactcattcttcccgccacccgacgagcagctgctgactgcaacgggcgccgccggggactccatcaaggccatcgcatccattgccgagaagtactttggccccggcttcatggggatgcaggagaagaagctgggctcgctcccctaccactcggcgttccccttccagttcctgcccaacttcccccactccctttaccccttcacggaccgagccctcgcccacaacttgctggtcaaggccgagccaaagtcaccccgggacgccctcaaggtgggcggccccagtgccgagtgcccctttgatctcaccaccaagcccaaagacgtgaagcccatcctgcccatgcccaagggcccctcggcccccgcatccggcgaggagcagccgctggacctgagcatcggcagccgggcccgtgccagccaaaacggcggcgggcgggagccccgcaagaaccacgtctatggggaacgcaagctgggcgccggcgaggggctgccccaggtgtgcccggcgcggatgccccagcagcccccgctccactacgccaagccctcgcccttcttcatggaccccatctacagggtagaaaagcggaaggtcacagaccccgtgggagccctgaaggagaagtacctgcggccgtccccgctgctcttccacccccagatgtcagccatagagaccatgacagagaagctggagagctttgcagccatgaaggcggactcgggcagctccctgcagcccctcccccaccaccccttcaacttccggtccccacccccaacgctctccgaccccatcctcaggaagggcaaggagcgatacacgtgcaggtactgtgggaagatcttccccagatcagccaatctcaccagacacctgaggacgcacactggggagcagccgtacaggtgtaagtactgcgaccgctccttcagcatctcttcgaacctccagcggcacgtccggaacatccacaacaaggagaagcctttcaagtgccacctgtgcaaccgctgcttcgggcagcagaccaacctggaccggcacctcaagaagcacgagcacgagaacgcaccagtgagccagcaccccggggtcctcacgaaccacctggggaccagcgcgtcctctcccacctcagagtcggacaaccacgcacttttagacgagaaagaagactcttatttctcggaaatcagaaactttattgccaatagtgagatgaaccaagcatcaacgcgaacagagaaacgggcggacatgcagatcgtggacggcagtgcccagtgtccaggcctagccagtgagaagcaggaggacgtggaggaggaggacgacgatgacctggaggaggacgatgaggacagcctggccgggaagtcgcaggatgacaccgtgtcccccgcacccgagccccaggccgcctacgaggatgaggaggatgaggagccagccgcctccctggccgtgggctttgaccacacccgaaggtgtgctgaggaccacgaaggcggtctgttagctttggagccgatgccgacttttgggaaggggctggacctccgcagagcagctgaggaagcatttgaagttaaagatgtgcttaattccaccttagattctgaggctttaaaacatacactgtgcaggcaggctaagaaccaggcatatgcaatgatgctgtccctttccgaagacactcctctccacaccccctcccagggttctctggacgcttggttgaaggtcactggagccacgtcggagtctggagcatttcaccccatcaaccacctctgacgggctgggcagccgggggccggtggccagagcgagggcaccagccacgaaggacggaggcgggcggggccccggagaaccctgtccctgcgtgtggccactcctcagcatcctccccacccaccatggttcattccgacttttccaatggaaactcagatcccaaaagtccctaaagcagtcgtagagtctcaccatctccaaggattggtcttgagaacactgttcagtgacggccatgcaggtggccgtccaaagacagccaacggagctgcctcgcagaatcagccagtgggcaggtggacgctctgctgagacagaagctggtggccactgccgggtgcccgcgtggggtcgcggaagggaatggatagactggtgtgctcaaaagagagagatcactcaaatgatttttataatgaaatgacaagaataacccttttggtaaccgtattgactgcagagtctatttaagcatgtggttttaaaaatagacagtattttttaaaaatcaaaaaatgacttgcaaattgttttttaaaagtaattttgcattgctttgaaatttgagctcatttgcaaacccgagtctgcctgggaacccgcactgtgcctgggtgtattctttatactgtagataatggagaaattttctatctctgtccctatttgtataagccaaggtgatgctgggtgccccgaggcagaacaagaggcgcggggccacacccgtgaaccatgcagacggccgaagaagtcttaggcagggcgccctgggctgcaggcctgcccgaggctgggatgggaagtgtgcctgccctcgtgtgacatggaattggtgtcaggaccgccacgtggccttcagaggaatccacaggtccccacccaagatccctcaattatatggggaagtcgagggcctgtggcttggatccgccatgcagagatgtggccgggcacccatcttccttccctcctctgtccctgcctcggccaccccacgcgggaacccagcgccgtcctctgaaggcagggccttggccacgtcctgggtctcccacctcccacctgaccccagcggctccggtgtcctccacgtggctgccctggggagcaatcccagcggatcgctccgggccaccaagccgcacctgtgcctgagactccggatggacgacacagtcgtcacgtcgctcttcctgcgggttcttggcgagacacagcttgagaacagaagggcgtcgggggaacctgccgcaaggagcagagacagcacagccccccgggcccagccgcctccctctcttgggacgcaacttcttccccactcggatgggctttaaattattcccataggggccaatttcaaataataatttttttccctgatggaatttaccttaatctgtatataacttgtaattttttctaattcatttcttttcttattttatttcctccttaacagtatttttggcattagacattcttattgtgaagaaataatgttaatataagtatctggtgaaggaccaaaaccgtgtgataaggttgtgtgtcgtgtgggagtggggcgattttttatgtgccaaatacccccgtcccccccatgaatcctgctgtccctgctgccgtttaccagacaatcatatgtttttgttaaatttgcgtttcagttacatttgcatttaagacaagtgttctatttatttcttgtattgtttggaagaaaaaatgatgatagagtcccaaaaagaagagaaaaaaaatgcccaagttgccctttaaaaaaaaagagcgtaaatacaaacaggagtggtgcaagccgccttggtgtgggtttgtgtcacgcgtggacatctcctcaggctttgtgtcacgcgtggacatctcctcaggctgtccccagcggtgacgggaggtgtcctggctgctccaggacaaaagacaatcgtctctgtgggtgccgggcggtccaggcttgcactgaagacgtgccacggggaggctcctgcaggaggctcaacccgacggatcacagtgaaagggattcctcccacgccagatctgcacaacgaggcaagacaggacccacctgtgcgtgcgctggggccatggggtggccccccccggggcagcgggggagctgcctgcagaagagccagcnggcgtgtcgggaaggatccaggatctgcaaacacaaccgctcaggccttctcacgcgtttccacaacatcccctgggtcagacccaccaggtaccccgtaggaatttccagtttcccttgatctagatgggattcttataaaaattcaacctcagacataaacaccccatttctgtaaacccaaattatatggtttcttctgcgaaagagtaaggtgtgtgcttttttttttgcaatatggccccgtctctctgaagtgggacattcggacggatggagccctcagcgtgtcttttcagcaggagcagaaccgatgagngccgcccttnccgttggtctccggatcccccagtcccatcccgccgttttcggctgtcttcctaaccgtcctgtcttctcttggcgctctttccttccacctttcccaagagtcctggttgcacgttttaagtcatatattttcgtccccctgaaaatgatggcaagcccagtttctcctgagcattcagacccccaggccccagcacttggcgttttcaggaggccctgttcttagagcccctgacaaaggcagcacttatttcctgggctggtgcgccccaaaacacggccccgacacttagtgtggccccaggccccagcgagcctcgccctcccagttttgctctgcccagcagtgttggtgcccagagatgacaagggccagggagcctggcccgggtgtgagaattcagagattctggcctccagctgtcaccacaccgtaacggggccatgtaactgtgcagcatggacagggatgcgacggggcagctggctgtgtccatggccaggtggccagggtcagggctgcaagccaggggtccagggcccttccgttcagcccaaatgctgccccaatgctaactccttggattgtcaacccccatcccccaaatggaaattccgaaggaggcctcctcgcacctgccctccgctgctcctcagaccccagcccccagcgagccgacgtccccacccgttcctgctctcatccccaggttgggcacgtggggttcctcctctgtgggcctggcagacccttcatgagtgggacccaagatatcactgacttcaacccagaggatcgagcccctgcaccctgcctggggccctggggtgtggagcagtggctggggtgggcgtggtgtggcctgagagactgcccagctggagaggccttcctttacaaggccacgcgtgcagctgtcccatccagaccccgactggccaagacctccacgtccccagagtccagccctggaaattccaagggccctggcgtcctctgccttccccgcttccccgtgagcgtctgcaaaacacttgcctgaatacatatcacgtattttagactcgaagcctcgaagcactggattgtggtcccctgccccctctgtcccgtccccctgcccaagtgactgaaacctactgagctatattcactgtgctgtcctagggggagggagagcagagctcgcccctgcactgcagccttgtgggggagggcaaggctctcctcccagccagggacgccaggacatagctgctcctggtcagtggaggtcagccgggtatcaaaagccatgaaactgtgtctctgtagcaatgagtgatactgtgacaaaaccatccttgcattcttcctagaagagttcctctgctccttccattccatttttgtgtttgttttgttcttttctgtcactgatccgtattaccacttttggaaaaaaataaataaataaataaataaaaggcagcttgagtttccaaacgtgtgattcacttgtgaacaaaagtcattctaacaattgccttcagcgtcacgtgcattgccactgcgctttcggcacgagggatgctgagccctggtgtcagagtcgtaatttaaagcgtgtgtgtatatggactttgtcccttaaggtcgatataaagaatcctcgcagaatcacagacctgtgccgcccgccaccttctgccattgttacattacagatttggtttagtttcgttttgttttgttttttctcttagaactgtatagtattgaaaaagaaatcaaatgtaaatgtctggttttcatataatgtttaaaaagaccattgagaaggaggctggcgctcgccccatgtcccccttgattgtaaattgcttctgttctgtttataagtaaactgtgcatgactcctgcttagcggtcattatcgtgtctgttggtgaaatttttattaaaaggaaaattctgtagatgcacttattgaatatgtgattaggatctacgtctgagactaggagtcctgaactgctgacgcgaaagaggcgcagttcccaattaatacggaaatcgctgtgggagaagaatgaaataagacgtgaagtgtaggaaatcatgaaaagaacaattttgcaaattgcattctgatgcttgtgatgaacacaaatgtacttgtgtagagacatttccttaagagaaagcctaggagaagccgatttggaggttaatgctgtagaataggactgtataccaaatgtaatctttccaatgctccaatgaatttatacatgagattgatatgcaataaatctgtgtgcttttctaagcctcggt

SEQ ID NO: 275482 - DNA, 8536 bp, Homo sapiens
  misc_feature (1663)..(1663): n is a, c, g, or t
  misc_feature (1964)..(1964): n is a, c, g, or t
  misc_feature (5886)..(5886): n is a, c, g, or t
  misc_feature (6205)..(6205): n is a, c, g, or t
  misc_feature (6215)..(6215): n is a, c, g, or t
gaagatagtgtgtggctgcttctggactcaaggaggaggagagagattccgcgagccgacaccatgcgatccaaggcgagggcgaggaagctagccaaaagtgacggtgacgttgtaaataatatgtatgagcccaaccgggacctgctggccagccacagcgcggaggacgaggccgaggacagtgccatgtcgcccatccccgtggggtcaccgccccccttccccaccagcgaggacttcacccccaaggagggctcgccgtacgaggcccctgtctacattcctgaagacattccgatcccagcagacttcgagctccgagagtcctccatcccaggggctggcctgggggtctgggccaagaggaagatggaagccggggagaggctgggcccctgcgtggtggtgccccgggcggcggcaaaggagacagacttcggatgggagcaaatactgacggacgtggaagtgtcgccccaggaaggctgcatcacaaagatctccgaagacctgggcagtgagaagttctgcgtggatgcaaatcaggcgggggctggcagctggctcaagtacatccgtgtggcgtgctcctgcgatgaccagaacctcaccatgtgtcagatcagtgagcaggtaatttactataaagtcattaaggacattgagccaggtgaggagctgctggtgcacgtgaaggaaggcgtctaccccctgggcacagtgccgcccggcctggacgaggagcccacgttccgctgtgacgagtgtgacgaactcttccagtccaagctggacctgcggcgccataagaagtacacgtgtggctcagtgggggctgcgctctacgagggcctggctgaggagctcaagcccgagggccttggcggtggcagcggccaagcccacgagtgcaaggactgcgagcggatgttccccaacaagtacagcctggagcagcacatggtcatccacacggaggagcgcgagtacaaatgcgaccagtgtcccaaggccttcaactggaagtccaacttcatccgccaccagatgtcccacgacagcggcaaacgcttcgaatgtgaaaactgcgtgaaggtgttcacggaccccagcaaccttcagcggcacatccgctcgcagcacgtgggcgctcgggcccacgcctgccccgactgcgggaagaccttcgccacgtcctccggcctcaagcagcacaagcatatccacagcacggtgaagcctttcatatgtgaggtctgccacaagtcctacacgcagttctccaacctgtgccggcacaagcggatgcacgccgactgccgcacgcagatcaagtgcaaggactgtggccagatgttcagcactacctcctccctcaacaagcaccggcgcttctgcgagggcaagaaccattacacgccgggcggcatctttgccccgggcctgcccttgacccccagccccatgatggacaaggcaaaaccctcccccagcctcaatcacgccagcctgggcttcaacgagtactttccctacaggccgcacccggggagcctgcccttctccacggcgcctcccacgttccccgcactcacccccggcttcccgggcatcttccctccatccttgtacccccggccgcctctgctacctcccacancgctgctcaagagccccctgaaccacacccaggacgccaagctccccagtcccctggggaacccagccctgcccctggtctccgccgtcagcaacagcagccagggcacgacggcagctgcggggcccgaggagaagttcgagagccgcctggaggactcctgtgtggagaagctgaagaccaggagcagcgacatgtcggacggcagtgactttgaggacgtcaacaccaccacggggaccgacctggacacgaccacggggacgggctcggacctggacagcgacgtggacagcgaccntgacaaggacaagggcaagggcaagtccgccgagggccagcccaagtttgggggcggcttggcgcccccgggggccccgaacagcgtggccgaggtgcctgtcttctattcccagcactcattcttcccgccacccgacgagcagctgctgactgcaacgggcgccgccggggactccatcaaggccatcgcatccattgccgagaagtactttggccccggcttcatggggatgcaggagaagaagctgggctcgctcccctaccactcggcgttccccttccagttcctgcccaacttcccccactccctttaccccttcacggaccgagccctcgcccacaacttgctggtcaaggccgagccaaagtcaccccgggacgccctcaaggtgggcggccccagtgccgagtgcccctttgatctcaccaccaagcccaaagacgtgaagcccatcctgcccatgcccaagggcccctcggcccccgcatccggcgaggagcagccgctggacctgagcatcggcagccgggcccgtgccagccaaaacggcggcgggcgggagccccgcaagaaccacgtctatggggaacgcaagctgggcgccggcgaggggctgccccaggtgtgcccggcgcggatgccccagcagcccccgctccactacgccaagccctcgcccttcttcatggaccccatctacagggtagaaaagcggaaggtcacagaccccgtgggagccctgaaggagaagtacctgcggccgtccccgctgctcttccacccccagatgtcagccatagagaccatgacagagaagctggagagctttgcagccatgaaggcggactcgggcagctccctgcagcccctcccccaccaccccttcaacttccggtccccacccccaacgctctccgaccccatcctcaggaagggcaaggagcgatacacgtgcaggtactgtgggaagatcttccccagatcagccaatctcaccagacacctgaggacgcacactggggagcagccgtacaggtgtaagtactgcgaccgctccttcagcatctcttcgaacctccagcggcacgtccggaacatccacaacaaggagaagcctttcaagtgccacctgtgcaaccgctgcttcgggcagcagaccaacctggaccggcacctcaagaagcacgagcacgagaacgcaccagtgagccagcaccccggggtcctcacgaaccacctggggaccagcgcgtcctctcccacctcagagtcggacaaccacgcacttttagacgagaaagaagactcttatttctcggaaatcagaaactttattgccaatagtgagatgaaccaagcatcaacgcgaacagagaaacgggcggacatgcagatcgtggacggcagtgcccagtgtccaggcctagccagtgagaagcaggaggacgtggaggaggaggacgacgatgacctggaggaggacgatgaggacagcctggccgggaagtcgcaggatgacaccgtgtcccccgcacccgagccccaggccgcctacgaggatgaggaggatgaggagccagccgcctccctggccgtgggctttgaccacacccgaaggcatatgcaatgatgctgtccctttccgaagacactcctctccacaccccctcccagggttctctggacgcttggttgaaggtcactggagccacgtcggagtctggagcatttcaccccatcaaccacctctgacgggctgggcagccgggggccggtggccagagcgagggcaccagccacgaaggacggaggcgggcggggccccggagaaccctgtccctgcgtgtggccactcctcagcatcctccccacccaccatggttcattccgacttttccaatggaaactcagatcccaaaagtccctaaagcagtcgtagagtctcaccatctccaaggattggtcttgagaacactgttcagtgacggccatgcaggtggccgtccaaagacagccaacggagctgcctcgcagaatcagccagtgggcaggtggacgctctgctgagacagaagctggtggccactgccgggtgcccgcgtggggtcgcggaagggaatggatagactggtgtgctcaaaagagagagatcactcaaatgatttttataatgaaatgacaagaataacccttttggtaaccgtattgactgcagagtctatttaagcatgtggttttaaaaatagacagtattttttaaaaatcaaaaaatgacttgcaaattgttttttaaaagtaattttgcattgctttgaaatttgagctcatttgcaaacccgagtctgcctgggaacccgcactgtgcctgggtgtattctttatactgtagataatggagaaattttctatctctgtccctatttgtataagccaaggtgatgctgggtgccccgaggcagaacaagaggcgcggggccacacccgtgaaccatgcagacggccgaagaagtcttaggcagggcgccctgggctgcaggcctgcccgaggctgggatgggaagtgtgcctgccctcgtgtgacatggaattggtgtcaggaccgccacgtggccttcagaggaatccacaggtccccacccaagatccctcaattatatggggaagtcgagggcctgtggcttggatccgccatgcagagatgtggccgggcacccatcttccttccctcctctgtccctgcctcggccaccccacgcgggaacccagcgccgtcctctgaaggcagggccttggccacgtcctgggtctcccacctcccacctgaccccagcggctccggtgtcctccacgtggctgccctggggagcaatcccagcggatcgctccgggccaccaagccgcacctgtgcctgagactccggatggacgacacagtcgtcacgtcgctcttcctgcgggttcttggcgagacacagcttgagaacagaagggcgtcgggggaacctgccgcaaggagcagagacagcacagccccccgggcccagccgcctccctctcttgggacgcaacttcttccccactcggatgggctttaaattattcccataggggccaatttcaaataataatttttttccctgatggaatttaccttaatctgtatataacttgtaattttttctaattcatttcttttcttattttatttcctccttaacagtatttttggcattagacattcttattgtgaagaaataatgttaatataagtatctggtgaaggaccaaaaccgtgtgataaggttgtgtgtcgtgtgggagtggggcgattttttatgtgccaaatacccccgtcccccccatgaatcctgctgtccctgctgccgtttaccagacaatcatatgtttttgttaaatttgcgtttcagttacatttgcatttaagacaagtgttctatttatttcttgtattgtttggaagaaaaaatgatgatagagtcccaaaaagaagagaaaaaaaatgcccaagttgccctttaaaaaaaaagagcgtaaatacaaacaggagtggtgcaagccgccttggtgtgggtttgtgtcacgcgtggacatctcctcaggctttgtgtcacgcgtggacatctcctcaggctgtccccagcggtgacgggaggtgtcctggctgctccaggacaaaagacaatcgtctctgtgggtgccgggcggtccaggcttgcactgaagacgtgccacggggaggctcctgcaggaggctcaacccgacggatcacagtgaaagggattcctcccacgccagatctgcacaacgaggcaagacaggacccacctgtgcgtgcgctggggccatggggtggccccccccggggcagcgggggagctgcctgcagaagagccagcnggcgtgtcgggaaggatccaggatctgcaaacacaaccgctcaggccttctcacgcgtttccacaacatcccctgggtcagacccaccaggtaccccgtaggaatttccagtttcccttgatctagatgggattcttataaaaattcaacctcagacataaacaccccatttctgtaaacccaaattatatggtttcttctgcgaaagagtaaggtgtgtgcttttttttttgcaatatggccccgtctctctgaagtgggacattcggacggatggagccctcagcgtgtcttttcagcaggagcagaaccgatgagngccgcccttnccgttggtctccggatcccccagtcccatcccgccgttttcggctgtcttcctaaccgtcctgtcttctcttggcgctctttccttccacctttcccaagagtcctggttgcacgttttaagtcatatattttcgtccccctgaaaatgatggcaagcccagtttctcctgagcattcagacccccaggccccagcacttggcgttttcaggaggccctgttcttagagcccctgacaaaggcagcacttatttcctgggctggtgcgccccaaaacacggccccgacacttagtgtggccccaggccccagcgagcctcgccctcccagttttgctctgcccagcagtgttggtgcccagagatgacaagggccagggagcctggcccgggtgtgagaattcagagattctggcctccagctgtcaccacaccgtaacggggccatgtaactgtgcagcatggacagggatgcgacggggcagctggctgtgtccatggccaggtggccagggtcagggctgcaagccaggggtccagggcccttccgttcagcccaaatgctgccccaatgctaactccttggattgtcaacccccatcccccaaatggaaattccgaaggaggcctcctcgcacctgccctccgctgctcctcagaccccagcccccagcgagccgacgtccccacccgttcctgctctcatccccaggttgggcacgtggggttcctcctctgtgggcctggcagacccttcatgagtgggacccaagatatcactgacttcaacccagaggatcgagcccctgcaccctgcctggggccctggggtgtggagcagtggctggggtgggcgtggtgtggcctgagagactgcccagctggagaggccttcctttacaaggccacgcgtgcagctgtcccatccagaccccgactggccaagacctccacgtccccagagtccagccctggaaattccaagggccctggcgtcctctgccttccccgcttccccgtgagcgtctgcaaaacacttgcctgaatacatatcacgtattttagactcgaagcctcgaagcactggattgtggtcccctgccccctctgtcccgtccccctgcccaagtgactgaaacctactgagctatattcactgtgctgtcctagggggagggagagcagagctcgcccctgcactgcagccttgtgggggagggcaaggctctcctcccagccagggacgccaggacatagctgctcctggtcagtggaggtcagccgggtatcaaaagccatgaaactgtgtctctgtagcaatgagtgatactgtgacaaaaccatccttgcattcttcctagaagagttcctctgctccttccattccatttttgtgtttgttttgttcttttctgtcactgatccgtattaccacttttggaaaaaaataaataaataaataaataaaaggcagcttgagtttccaaacgtgtgattcacttgtgaacaaaagtcattctaacaattgccttcagcgtcacgtgcattgccactgcgctttcggcacgagggatgctgagccctggtgtcagagtcgtaatttaaagcgtgtgtgtatatggactttgtcccttaaggtcgatataaagaatcctcgcagaatcacagacctgtgccgcccgccaccttctgccattgttacattacagatttggtttagtttcgttttgttttgttttttctcttagaactgtatagtattgaaaaagaaatcaaatgtaaatgtctggttttcatataatgtttaaaaagaccattgagaaggaggctggcgctcgccccatgtcccccttgattgtaaattgcttctgttctgtttataagtaaactgtgcatgactcctgcttagcggtcattatcgtgtctgttggtgaaatttttattaaaaggaaaattctgtagatgcacttattgaatatgtgattaggatctacgtctgagactaggagtcctgaactgctgacgcgaaagaggcgcagttcccaattaatacggaaatcgctgtgggagaagaatgaaataagacgtgaagtgtaggaaatcatgaaaagaacaattttgcaaattgcattctgatgcttgtgatgaacacaaatgtacttgtgtagagacatttccttaagagaaagcctaggagaagccgatttggaggttaatgctgtagaataggactgtataccaaatgtaatctttccaatgctccaatgaatttatacatgagattgatatgcaataaatctgtgtgcttttctaagcctcggt

SEQ ID NO: 275483 - DNA, 382 bp, Homo sapiens
gttgtagagtaaatcctattatatcgagatattggtcaggcaagaatttttcttttaaaataatttattgtaaatgaaccataaaatttttacctttgtgccatcttctaggctataaaatagtcttataaagaatcagattgttaagagtatatgaaatgtggatatggatgtggaagatccataacgaggatgatgaaagcacattaagaagctttctgatgggtacaaaaaatagaatgaagaagatctagtatttgagagcacaacagggtgactatagtcaacaataatttattgtgcattttcacataactaaaagtataattggattgtaacagaaaggataactgcttgaggtgatggataccccatttaccct

SEQ ID NO: 275484 - DNA, 200 bp, Homo sapiens
ggaagtcatagaagcgttttaagcgggagtgacatgactgaattaagagacagggtcttactctgttgccctggctagaagtgtagtggcacagtcagagcgcactgcaacctcaaataagtcctaggttcgagtgaacctcccaccttagcctcccgagtagttggaactaaaggcatgcaccgccaggcctggctaat

SEQ ID NO: 275485 - DNA, 379 bp, Homo sapiens
cctgtgctgggagagggtcactgggctgagattggtaggtggctctgggagctgagggcctaaacctatgaccacaaggaactgaattcatcccaaagccagagaggtggaagacgactcagaagatgcagatgccaatgccacatcctggtaaaggttctcggaaggacccaatgagactgggctcactgggataatccaggatcatctcccatctcaaggttcttcatcgcatacttgcaaagccccttttgccatgtcaggtaacttgttcacaggtttgaagattagaatgtgggcatgtttggggggcataattaggcctagcacaatgcccatgtacccatctccttgcttaaacattaaacactttgccaat

SEQ ID NO: 275486 - DNA, 324 bp, Homo sapiens
cagaatgagttatcatgggttagctttccagtggattaatgtaaaagggaggacttgaactgagcttcaaaggtaagtaaaattttaccaggaggtgagggaaagactacagaaaagggtgcaatagcagaaatctttttttttttttttttttttttttttttttttttaaaaaaaaaaagtttttttttttaccccgggttggggggcgggaatttagaaataattttttgaacctttaacctccggggtaaaagagaacttttggcttcttttttggggggaccctggaaaaaaaggaatttgcttttttcccgggttaat

SEQ ID NO: 275487 - DNA, 404 bp, Homo sapiens
aacgcagtggagactcaaaaaacagaaagcacagtaggaataagggagtagaaaactaggaggctgtggtgggagaagaattctgagctcatggctttagagaaggagctggcccaggggataatcaggtccaagctctggtcatttgtggtcacatgggttaataaagtagaaggtctcacacacagactgggtttgactagtaaatggttcatcaacatgaatatcaactgaaccgaagttgcccaaggcgatgccaagtaacaggagagaggaaaagaggtgtcaaagatgggcagataacaagaatgggaagagggaatataaccagatggcaaaggattcaaaggaacgaagactgttggaagctggtaggtactttccctgaggctgtgatgctgccg

SEQ ID NO: 275488 - DNA, 1593 bp, Homo sapiens
ttatgcctgagttggtgagatggaatgatgtatcatatctcttccccttttattaaccagatcgtttaccagattgtacctggtgatgctgcagccagccctcttccggcccctatttctgcttaccgtgttaccagagagcctgggggtctggatcctatctggccccgtcagggtggattaccaaatgagcagttctcttgccccagtccctttcctgtgctataaataagccccatgtttattttcttatgttattgaaatgagcacttgtgatttgggcctcttttgaggagtccagagagcgtccatccggtgcctggtgagggccctgcatggctggctgctgtctgaagctatttggagtcctctccctgtgttttctatgtggcttaatttcaatagaaagggttatatgcaaccctgtatctgctgattttcaggtttcaactttctgccagcgtcactgcctgcttagaagtaaagttatgtttctcattaaggggataacagccacaattgaggtaattaacgaaaattgtacatggtggcagcacctcctataggatttccaatagtctttctctagtagatcattgggggctcaccttgatctcctctcttctgtctaccctgcaccaaaataccttgtcctgttttctggatatagttccaataatttttttcctaacagcctttttgtcaccagttggtttgatatcttacaacttggccaaatgagggttccattaactccatcttgtctaatgcatggagaattcaaggattttttttttctcttttcatagcaccttccagttgccagttgtaccctggcccttctttggaagtcataatgatgaatatccattaataagagattgatgctctttcaactctcatgtcatctataccatctcagtggagaggatgactttggatgaggttggaatagaaaggaaacatttggaagtccactgcagtgtattatatgctgtgtggaagtctgggggttaggaaatacctggagggagaacttcctaagaaatgatttttggttcttttaggccttaacagcacaataaaagtatcccatgagaccattatgagcaggacacgacattgtttcacaccttgggctgtgactatttacttctcggtacagattactctggttaaatcactcagtaaagaaatcttttcatgctcacaatctgaacctgaaggctattactgaagagaattgcatctgacaacaaaatttaatttacttccagagaaaggaccagaagaaagtaaattttcatttatgtttttaagtctattgtcttaaaaagattcttttcccttaaaaaataaaaaaacctgatgtgatgggttccttcagtcaacaaatacttattgagcagttattgtgtgccagatactgttcttggtgtgaggatatggcactgaacaaaacaatgtacctactttcgtcaagcttacattctagtgaggaagataaccaaaacaagtgactgaatataatttcaaatgtcaataaatgctgtgaagaaaataaagcagagtattatatgtggataatgactt

SEQ ID NO: 275489 - DNA, 311 bp, Homo sapiens
aatcccttttcccaaaattcactggaagagctcgaggaaaactttcccttgcagctgtctcagtctttacagtgcttagttacgaagacagtcttaacagtcccatctttcgccctgtaattcaaggtcatttttcattctttctgtttaataattgcaaataatttgggtaggaatttcgttgagcctcacaaatcgttgctgagttgcacagtgacaatcttgccacccttttaaagccttttactttatgggttcctagaaaaccactcatcgtcattattaacattcattagatgtttctcttaaat

SEQ ID NO: 275490 - DNA, 509 bp, Homo sapiens
aaatagatcatttaaatatttctataactattgagaacttgaattcaaatgtagaaattcttcaaaaagaaatctctagacccaggtattttcactagagacttctgctagaggtttaagaaatcattaacatcaattctatacaatctcttctggaaaagagaagaggaaacacttcccaattctttacctcaaactagtattaccttgatactaaaaccaacaaagtaccaacagtatcaaaacaaagtaaacttcagactgatatcccttgcgaatataaacacaaaattcccaaacaaaattgcaaaaatagatttcaataatatattaattatataccatgaccaaatgaggttttcttccagggatgcaaggctgtttcaatattcaaatacatcatattacatgttaagaggcaaaataagaaaaatcacataatcatataaattggtacagaaaaaaaaatttgaaagaattcaatacccattcatggtaagaactctcag

SEQ ID NO: 275491 - DNA, 492 bp, Homo sapiens
tttcaacccaggtgattgcattgtacaaccaaggctgagaaccatcgcattaggagacagattggtggtaaacttgacagaggattaggctgccactacctgcattgcctgatagatcttagcaaccctgaaagttgtaatgtgaaaggtgtgatgtacatggcaccattcataaagtatgctacccacaaaggcttgacctgaaagcttttagctataaccttctgcttaaagaaatagtgtatttagaggaataagtaaatgacatgagaaaaccatcagataaattcaggatgtggaacaacttaaaagtgtattgctgcagtttcctcagttcatcaaaaacatgaaaatgaaggaatgggtgcccctttctaaattgagggacttaaatcagttgtactcaaatgcaatcaggaaaccttatttcagcttgacgagtacaagccaactgaagaaacacatttccaagacatctgaaaaatttgaatt

SEQ ID NO: 275492 - DNA, 382 bp, Homo sapiens
cataaaagtacatttctcaaatcagtttctccttcaaagtatgaatgtgacattaataatgttcccctttcagcatttgtgacacctgggtgtaccatggttccttttcgttgctgaagtttaatttagcttttcttaggaggcttggaatatagactgagatttgcattttcctgattgtcatatgtatcctccaagaaagacattagttgtggctttaaaaaatacatatagaaaaagctataatataatgtaaacactatgggctcatttctctaaagaataatgtgcaacattttttaaaaacttgatggattttcttgaaaattaacattgattttctttgagttctgggacaatatatattttctggcttttgtgt

SEQ ID NO: 275493 - DNA, 512 bp, Homo sapiens
cagcagttctataagaaatgcttgagggagtcttacacctggaacaaagggacaatatctgctgtcatgaagacacatgaaagtataaaacttactgatagagcaagcacacaaatgaggaagaaaaataactcaaatgtaccattacagaaaaccaccaaaccacaatcataataagaaagaatgaaacaaagaacataaaaacaaccagatatcaattaataaaatgacaggaatacactctcacgtgtcaatagtaactttaagataaatggattaaactttctacttaaggaggctgatccaagatggccgaataggaacagctccagtctacagctcccagtgtgagcaatacagaagatgggtgatttatgcatttccaactgaggtaccaggttcatctcactgggacttgttggaaagtgggtgcagcccaaggagtgtgagccaaagcagggtggggcatagcctcacccacaaagtgcaaggggtcagcgaattccttttcc

SEQ ID NO: 275494 - DNA, 298 bp, Homo sapiens
gtaatagctctgggacaatcccaggaggagtcaggaaataggatatgtgacatcagttttgtcatgtcaacagtatgcccaaaacgaaacctattccactccaaacctgcttctgcttagagactggcattaacatcctcccagtcacccagacttggaactgcagaatcagcttcacctctttcttctcctcacaaaccattgtccattctatcaacaaattatctaatccccaaatttgaagtctaatcccaacacctggtccatggtagtgtttatataaactgaaattaatgca

SEQ ID NO: 275495 - DNA, 407 bp, Homo sapiens
tttttccatagttcacatgtccacactccatgtagtattcacgcagtccatgtgtcatcgatacacaacttctccttagctcagcgaaaacctgggttcttatcccacaaccaggaagaagttaggcacgtgaacacgctgaaaggtgaggaaagcagaatttactaacaaaaagctctcagcaaaagaagaggtcctgccaacaggctctcaccacacagattgaattccaggccaccacacatgagccagagacaaggctccccgtgcataaggcccaaacttcccatggctccaccgcatcttcccagtatgcaggtgggtccccagtccgttgtgggcatgtgcagacaaagccctgggcagcttccctcatctgtctcctgcagctgtcattccccctctaa

SEQ ID NO: 275496 - DNA, 337 bp, Homo sapiens
taaacagcttcagaatattcatactgatttgtgctgcaatgctatcttatcaggccttacagcaagcaaaaaaaaaaaaaaggtatttgcttcttagatatttctggttattaaatccagttgaattatactgactattaatcataacccagaaattataatcaaagtttttgggtgcagtaacctaaaagaatgagatatttttattctgtgttagttagcgtaggttttaaaaacaaatggctattaggcagcttcaaagacaataaagctaaggtaatgaaagtttgaaatgaagcactagtcttgtgtcaacaagctgattacagaacacagg

SEQ ID NO: 275497 - DNA, 969 bp, Homo sapiens
aaaccattagtcaaaaaataccattcattcaaaataattcattaatgtcctcctactctgttccaaacactaggctgagttcagaggcctcacagaatagtgaaatgcgttcttagccaaatcaggcaaatcttctccctcactatgtccctgaagaaatctcttcatctgatatatttactattcatctactttctacagcactatgttagggtcttccggggattcagagaaaagtgtctgtgagccattaagaaactcacagatcaggtaataaacactttttctaatgcattccagtgtctcagagcctgcataatcactttatactacttcattaaattgacaggacatctaaggtgacaaaagagatgtttctacctgttggtaaggttgatgcaactgtcataattagatgttcttggtttttaatagatgcagcaatgagagagtacattgctaaagtcagaacttaatttgaattaaattttcaagtttccaccaagtatttgaaaacttagaaattgtatttcgtaattacacatgcagacatttaaatttttattaagcaccacgatggaactcaatctaaaggaataatggcacctgataattactaacaacctttgtttatataagaccttgtgcaaactgtgtgataacgtatgtttgcattctgtctttaaaataaccctgtaaggtgcgttattttaatttttagattttaaaacttagcttcaagagaaattaagtgattagtctatagctacaaatcctgtaaatggcagagtcaggaattaccactgagcatgactccatggactcttaattgttttcctgcctcttaataaattgaccatccttgagactgactagccttcagatttttcatgatggagctatcataacttctcagtggatacatatattatcatttatggcaaataaagggaacattttagaagcctc

SEQ ID NO: 275498 - DNA, 443 bp, Homo sapiens
acttggggacccgggggagctgagatacagttggcagtgctgggcctggctgagggccctgtgtgctcactgaaggctgaggggcctcagtttacccagcatcctctatgggaaagacaacacgcacctacctggaggacatgagcacatggggcctggaggtgggtttcgcccgcacacccctgtgggcatttgcacatgttccaaggctacgcgctcccctttctagaagcccatattagcctcaagccttctaatgagtccttgctgtcctggattttgatgatggaaggggataccttggctgccctatggctgtcgcttggtgagtgagtgcattaatgtcccttcgtgcaaagctctcaagtgggtgacgtgtgccggaccttctggccgccgtcctggtgccctggccaccttctccacctgttctgtgtccccag

SEQ ID NO: 275499 - DNA, 473 bp, Homo sapiens
agtggcaagagataaatgaggaagaagtaaaagcggaaacacctgataaaaccatcagatctcgtgagatttactatcacgagaatagcacagaaaagaccagcccccatgattcagttacctccccttgggtccctcccacgacacgggggaattctgggagatacaattcaagttgagatttgggtggggacacagccaaaccatatcaactatcttgtccaagctggtcttgaactcctgggctcaagcgatcatcctgcctcagcctcccaaagtgctgggattataggaataagccactgcccccagttcaaaaaaactttttaacgagtatcaggtcatgcatacaagagtgttcatgtgagcactctttttaataccaaaacctgaaaacaacccaaatgcccattaacaggcaagggaatagacaaattaattagaagctcctggaggacagggaccacctctac

SEQ ID NO: 275500 - DNA, 309 bp, Homo sapiens
gtcaatttacagaagagaaattatagtagacaaaggaatatgacatacagttgaaaaaaaatgaatactgacacatgcgaccacactaaaggatgtcacagtcacaacattcagcaaaagactatgaaattcaacaacaggcagtattaatttctaataataagagtcagaatagtggttacttgaggggggcctgtaactgagagaggataatggaatattatattttttatctgactggtggttactcaaatatattcacaggaaatattaatcgcactttacacttaggattcaggttctttatat

SEQ ID NO: 275501 - DNA, 311 bp, Homo sapiens
taagataaaaatttaattggaaatagacatatccttaacctgataaagagtatctgcaaaaagtttagagcaaatatcatacttactggagaagtgttggaagcatttccctgtctcatatttttgtgaagcaaagcccataaatatttcagtatttgtctctaaaagatggattcttaacctaaaatgtagttaacatatttcttcatatcagcaaacatctggttttcaaatttcttgttgtctcataagtaacttcattttttacatcagtttatagactcaaaaacctaataaaattgacatgttgt

SEQ ID NO: 275502 - DNA, 186 bp, Homo sapiens
ttaaaaattgttaccaaaagtacttgaagattacgaggagttgacacctccacacacatgcatatcccctccaccttgggctccttgcttatggccaccaatccctcactaagggaggatcttgccagttctaaatgatggggactacaaaaattacaaaaattacccggcgtggtagcgcgtgcc

SEQ ID NO: 275503 - DNA, 162 bp, Homo sapiens
gcaagcgctgaaatattttaaaaatcctcaggtgggctggacacagtggctcacacctgtaatcacagcactttgggaggccgaggtgggaggattgcttgagtccaagagttcaagaccagcctgtgcaacatagcaaaacctgtctccatttaaaaaagc

SEQ ID NO: 275504 - DNA, 406 bp, Homo sapiens
agagagaggacattgatcctgatctggctgtaataatgtagtaggtagaactgctggtgtggacacccgagcaaggaagggaagctggtgtctcaaggggtcccgctgagagtgaaaggggtcagggcccagactgtggatgtcacctggacccaaccaccatgtctcagaagaagaaatgaccctcccctcctggtgctgcccaaaacaaggagcttagcagtgttgcacacaggatagtccttgcaggagacatgtttgacaagttgctgaggtgcctgatggggccaggctcttctcatgaaatgagtttgaatcctgaggaagcctctttattggaaacctggcagggatccaatttcccctttgccttaaccccgtaagagaacagtagacaggggaggag

SEQ ID NO: 275505 - DNA, 109 bp, Homo sapiens
aggtccagtcgctgacatttgctgaatgaatggatgctggatgcgcgaagacctgggcgaggagcgtatgaacgggcgtgtgtgtgtggacgcggggaagggcaggagg

SEQ ID NO: 275506 - DNA, 435 bp, Homo sapiens
aagattttttttaacctgcaaaagaatcatttcttaaaatgctgcattaaaagtccttgacacagcatcagacaaaaatggtaaatacagacataggcacaatagatgactaaatatatctcacctcacctcaatagactttttggtatttagtttttcagtgatctgttaaatgctctgcacatttttttttttttttttttttttgatgacagagtgagactctgtctaaaataaacaaattaaattaaataaatttcagaagctgacagacaaaataggcagtatggagaagaatgtactgacctgacagagctgaaaagcacactacaaaaatttcataatgcaatcacaagtattagcagcataatagaccaagtggaggaaagaatctcagagcttgaagaccatctttctgaaataaaacaggcagag

SEQ ID NO: 275507 - DNA, 529 bp, Homo sapiens
atccagagaaatcagagagccaggttatacaggatattgctctaaaaacaagagaaatctttaccaacctagcaccattttcagaagtttcggctgatggagaaaagagagtccttaatttggaggcgctaaagcaataacgatttccaccagcaacagaaaacttcctttatcatctagcagcagccgaacaaatgctgaaaatctgactgtgtgacagaacgtatcactgatgactgatagaaagccctctttcactctgattacccactcactacatgaagtcctgaaaataacagagaaactgttatatctttttaatgatttatttgcaagtattgagatttgacctgaaaaacaatgaaacacatgaacacacttccgattttctcctcgctgattagcttcctgcctgctgtcagtgctggacgaagtgctataactactttatgtaacattacagaacagctagaggtcctgggtaagaggaaaaaagcacatcacgacaaatgtgaaagccttcattatt

SEQ ID NO: 275508 - DNA, 1010 bp, Homo sapiens
ctccaagggagacgcctagaagatggaggcccagattcttgagacgtttctctttctgatctagcaggagggacaaagagctcctccactccctcattccccaagaaggcccccagcctacccagtttccgtgaccattccgccctgggaaagcggcttcccagacctccttatctatttttcttgaatcatgagagatgaaattgcaacaacagttttctttgtcacaagattggtgaaaaaacatgataaactaagtaaacagcaaatagaagactttgcagaaaagctgatgacgatcttgtttgaaacatacagaagtcactggcactctgattgcccttctaaagggcaagccttcaggtgcatcaggataaacaacaatcagaataaagatcccattctagaaagggcatgtgtggaaagtaatgtagatttttctcacctgggacttccgaaggagatgaccatatgggtagatccctttgaagtatgctgtaggtatggtgagaaaaaccatccatttacagttgcttcttttaaaggcagatgggaggaatgggaactatatcaacaaatcagttatgcagttagtagagcctcatcagacgtttcctctggcacttcctgcgatgaagaaagttgtagcaaggaacctcgtgtcattcctaaagtcagcaatccgaagagtatttatcaggttgaaaacttgaaacagccctttcaatcttggttacaaatcccccgcaaaaagaatgtggtggacggccgtgttggcctcctgggaaacacttaccatggctcgcagaagcatcctaagtgttacaggcctgctatgcaccggctggacagaattttataacccacatctgggaatgaatttgcagcacctggtagaagaaggcaccttggaaggcactgccttgggcttccatggcaggaagatgagaagaaatcttcagggtgatttctggagcctgaaaagaataaaaaacaaaaccaaacctatc

SEQ ID NO: 275509 - DNA, 274 bp, Homo sapiens
atcgcccttgtaaatgcttcctcaggagtggcctctatcgaactcaatattctcctcctctggggtaggaggatgcagccattaggtggtgtttttcttctcgaaatcacgtttatatccaagatggatagctgtttgtgcctcttacacacctgtgtgcagcaacagctttatgaccaaaatttggtctcttctgttgttcctgagcagaactatgtctgtatttttttaaatttatcaattgtcaaaataaaatatgtgggaaatataattc

SEQ ID NO: 275510 - DNA, 1151 bp, Homo sapiens
cctctactactgtgcataaaacttgaagagttggaggccatgttcaccagcccagaagatatacgtacacttgggatttttgagttgtgtggtggacggaggggttagtcttaaacactactgatgaacctatgtgattgctgcctgtttcccgccaaataacagggcagtcacggcttatcctttctggctccccttttaccaccttctcctggaatttacctgacctcctcttctcacagcttggcaggctctagagagactgacctctgcagatggtttaaagggagaagctcaagggtccacagttcacagggctgccaatcaggcctgtgcagaaaactcaacagtctaaaagaatatatgaagacagaacctcaacctagaagaaatggacaaattcccagacacatcaaggaattcctagacaaactatcaaaactgaatcatgattagatagaaaatctgaacagatcaatataagtaaagagattaaagcagtaataaactctcccatcaaagaaaagctcaggacctgatggcttcactgctgaattctaccaaacgtttaaagaactaacaccaatgattctcaaactctttttaaaaattgaagatgagagaacacttccaaattcatatcacgaggccagcattaccctgataccaacgccagacaaagacactataagaaaaggcaattatggaccaatatccctgataaacatggatgtaaaaatcctcatcaaaatactagcaaatgaaattcaaccacaaatttaaaaaagcattcaccatgatcgagtgggatttatccctgggatgcaggaagtttcaacatacacaaatccataaacatgatacaccacatcaacaagatgaaggacaaaatctttataatctcaatagatgcaggaaaagcatttaacagaattcagcaccctttcatgatttaaaaaaactcaacaaaatatagaaggactgtaccccaacacaataaagaccagatatgacaaacccacagctaacattctcaacagtgaaaagttaaaagcttttcttctgagatcaggaacaagacaataatgctcactctctcgacttctgttcatcgtaacgttggaagttctagacagagcaattagacaaaa

SEQ ID NO: 275511 - DNA, 425 bp, Homo sapiens
gattctttcatttcctggcttctcagttccttgagggccattacatatgatattttttaaatttggcttacagtcagaggcttatccaattaatttactatgttaaaccagtatttaacaaataaaagaagaaagaatacagcaggaatggattttaaaaaccatcagggtgtattgtgtgaaatgggtattatggcattcctgggaatgtgaagctctcttgtccattcatatagcaagcacctataatcccacactttttgaattcctgaagcactttcttctttgcatcttccataggacatttataaattctgtagtccttctagtagaatagaaaatccttgggaaaaaggaatcttttatgtgtgattcttcattatatccccagaatccggaacagttcctggtaataattagacaaa

SEQ ID NO: 275512 - DNA, 513 bp, Homo sapiens
aaattcctcatatttaagctgttgggagtcccttgcaattccatatacacttgagaatctacttttatttctttgaacagggctgttggaattttgataggcattgtgttgaatctgtagatcactttgggtagtattgacatcttaacaatattaagtcttcctatccatgaatatgggatgtctttccatttatttaggtgttctttaatttcttttagcaatcttttctattttcagcatacgagtctttcacctccttggttagacttatttctgagtatttaattcttttagatcttgttgtaaatggcattgtttacttaatttcctgtttgaattgttcaatactgatgcacagaaacaaatgaattttgcgtgttggtcttgatgtgttgatcttgtaactttgctgaatttgtttatgagctattgtaccttcttgtgggttcttttggattttctatatgtaggattatgtcatcttcaaatagagatcgttttaccacttcc

SEQ ID NO: 275513 - DNA, 386 bp, Homo sapiens
tggagcggttttccgatgtacgtggctgttactgcagcaggtgtggtgctgcggcagcatttgtggaggccagcacaggcctataccccgcagacacaccacgcagggtcatggtcccctcccacagccccaggcaagtcccatctccctcctggagctccttggtgtggggagccagaggaccagacctgaggttgtcggaagggcaggggtttcctccctattctgccctgtgtatccttgggcaagtgacttatctctctgaacctcacatcccctgctctgcccaatgctcatggctgcagggagtattcgaggcagaaatgaatggagagggtaaggcctggagataacctcaggccgagtgcaacttgaacgtggttccc

SEQ ID NO: 275514 - DNA, 367 bp, Homo sapiens
gaggaggtgggggacactggtgctgattggagaaaggtggcaaaatccctaggggaaaaaagtacagatttgaaggaggcatcagatgaatccgtgcatagaagcttgagccccaaactcagttctcaggctgcgttatcctttacgacacccagagtccctctgtcttttaagatccacacacaactctccaggccaatagctcttggcgcctgcgattcccaagtgggattctacacgtgtcttgctgcccagctcggggggatctgtttttggggggtctcggggcgggtgcagggtcctggctgtggctttggctagtgcaggccggctcggcactattacagtgacgaggtgggacgcacaa

SEQ ID NO: 275515 - DNA, 191 bp, Homo sapiens
aagttattcatgttgctcagaaatgtttctctgtagccatgttagaaagttagtgggctcaaaatagatcaagacctaaatttaagacctaaaactatgaaaacctgtggaagaaaacattgggcaaaagcttcacgacactggttttagcaatggcttcttggctatgacaccaaaggcacaggctacga

SEQ ID NO: 275516 - DNA, 260 bp, Homo sapiens
  misc_feature (31)..(31): n is a, c, g, or t
  misc_feature (52)..(52): n is a, c, g, or t
ggggttggaattcgggaacccccgaacggcntgcccacggccttcccgccgntcccgcgctcccgagcttccaccacatcgggcccgctcggagcagggagtgctccgaggcgtacggcccagggcccacgatcctgggacgccctccggtcctccgccctgtcgcggaggcagcgttttggatccctcgccgcacaggggctcctgcgaggccccctcttgccccacccacccagagccgtcagggctggccgaaggcg

SEQ ID NO: 275517 - DNA, 371 bp, Homo sapiens
tgaagtgggtttgccttaatataacactgttgtatttgtaaggggcatttttaaagttgtactttaaaaaataataattcttagattcgtttgaaggttttttgtttgtttgtttgtttgtttttgagatggaggctcgccctgtcacccaggttgcagtgagctgagatagcgccactgcactccagcctgggggacagtgagactccatctcaaaaaaaaaaacacaaaaaaagaatagaataactcttgtttaggtgttacaaaatccaggccagaccaatctaaactttaatctcatacccagttcctagatgagtcccttctccagctcaggttccgcctaagcctcagggttccttacttggtgg

SEQ ID NO: 275518 - DNA, 233 bp, Homo sapiens
atcgcttgagcccaggagatcaaggctgcagtgagctgtgatggcgccacttcactccagtctgggtgtcagagcgagaccctgtgtcaacaaataaattttaaaaatcttatatttaccacacaaaaccaataccaattactagaccagcttctaaggtagaaacactctggtctgaacccctggcagggaacttgcacccagtaagccccagttcaacaccaaatccttgt

SEQ ID NO: 275519 - DNA, 478 bp, Homo sapiens
ctcttgttgcccaggctggagtgcagtggcgcaatctcggctcactgcaacctccgcctcccaggttcaaacgattctcctgcctcagactcctgagtagctgggattacaggcatacaccaccacgtccagctatttttttgtatttttagtagagcctggatttcatcattttggccaggctggtctcgaacacctgacctcaggtgatccaactgcctcggcctcccagagtgcagagattacaggtgtgaaccactgtgcccagcccatatctcctttaaaatcccaatacatcagtatcatcaggtgttagactgttaaaatagagctcttgttgagtgtaacccttttggtttttgtgaagatcttccctaccctatccattggaaagactattttaatattgtttcttctcagaatattatatgaatacaatcttgtattaaaaatggtgttcaggcctcgaggtgatggc

SEQ ID NO: 275520 - DNA, 530 bp, Homo sapiens
cctggcttggggctcaggccctggtccaggctgggatcctcgagcgcttcctgctgacagttaatcatagttaattgtgacccccagctttcccaggggccaccgcccagctctcgtctgatgtcattcacgttcagcagtgtgcatcttgccacgatcacgtggtctctcattttcctcctggatccagccttcccagcgggctccaagtggctgggcctgtgagatgctgcgactcttcgagagcttcctatttctgtgaagacgctcaggccacggcctcatgttcctcatccagctttctgaggacaatgcgggaaagatctcaagttcgtatcaaggctgaatccgactctatccacgtgacttctattggaatccgagagttggacccaatggagggtccagccgccacccggaacgacctggtcattttccagatgaggggacctacgtttagatgagatgaagacaatgaggctgagagatgttcagttactaggtcaaattacaaatatgtgcacttcaaa

SEQ ID NO: 275521 - DNA, 532 bp, Homo sapiens
agccatggaattttcccccaatgatatattcacatgcatttagtctttatgtaacactataattaatagaagtttttgagcacttgtgatatgtcaggcactgtgctaagcattttactctcattcacgattttcaagataaacaatggaagatcagagcagtcaagtagtttgttcatggttacacatccaagtgagtgcagagctattgctcaagttagtaatcactttaagtgcttgggttttttttttagttactgaaatggaagaaagtttttcctatgtgttttggttaagtgggttggtgttcatattttccatgctgcaccaagatttcccagcacttcctgggttgcacaggtcttttttttttttttgagatgaacctaggtgataggctgaatcttggtgataggctgttgagttataatttgtcttcgggtgggagattggagggatggtggggcttttctttttaaggatttactttgttgcttattaacattaattttatttaagtggcgtattacca

SEQ ID NO: 275522 - DNA, 100 bp, Homo sapiens
agtctagtgaagatgttgtcattatgtacaatacataactagtttaattaactatgtgatgttaactattattaataaattttaacattttccaaaataa

SEQ ID NO: 275523 - DNA, 434 bp, Homo sapiens
aacaaaggacattatcaagaaagtgaaaagactacctacaagatgggagaaaatatttgaaaatcatatatctgataaatattcaatatccagaatatataaagaattacaattcaacaacaaagggacaatccaataaaatttttgtaattggcttaagtttacatttcttcaaataatatttataaatgcgcaataagcatatgaaaagatgctcaacatcattaatcatttgggaaatggaaatcataatcaatgagatattacttcatgcctactaatatggttataataaaaaatatttaattaattaagaaactaacaaatttccaggatgtgccgaaattagaacactcataaatttcagatggaagtgtaaatagtgcagttgctgtgaaaaatagcttgatggtgtctcaaaaagctaaatacct

SEQ ID NO: 275524 - DNA, 230 bp, Homo sapiens
tcattcccaatattttgagcactttaaggtcttttaaacacttaacagcatttaagcacttttaaggcctgtttaagggctttgggtaattaagaggaataaaattgatccatttcccttatggttttaagcgggtaagtgtatgattgtgtaccaaaggttgtttttttgtttgtttgtttgtttcccttgaactttgctaaaatttattaaaacagagtttggatcta

SEQ ID NO: 275525 - DNA, 683 bp, Homo sapiens
tgcccgttaagcagctttgcggtggcggaggctgggctgccgtctctccgacatcccgggacggaggaagagatgaaggctctgcagcccccgccgcccgatttacgcttgagaaagcgaaggcgagagaggtcgtccagcccctgggggcccagccctagagagcggggcgcgggctgcggggcccggcggcctggacggcggagcgttgaaagctcccccagggataggaagtgcagccgaaatcaacgattgagggtctgagcacctccctcatgcagacagagccccggctcccatgttcaccatgctgagaaagacctgcgggggacagcaggaggacagccggggaatgggcccgcacttgcccaggatactgtgttttaccccagccgcccacctggagagcctccgaggggtcgcgggcgctcctccggggcctgccggcatctgaagcagaggagcagaggcctagacctcccttcgcccccaacacctggcgacggacatttgccggctctcagcagcgatgcgggaattttacattgcgcgtctggatatacacccaccacctgagtgtgccattcacatgttactggactttgtcacatctagttaatcctccctgctttgatcccttttattttttatgcatttccaagtaaattatagacctcaggcgg

SEQ ID NO: 275526 - DNA, 466 bp, Homo sapiens
tggggggcgggggtgggtgaggaagtcctgggccaggcaccccctgttttgaggacgctccgtgtctcccctcgcccagtgccacattctgctctctgccccttctttccacaacttgatccatcccccgtaaggcttggccacttctccctcaggatactgtgttttaccccagccgcccacctggagagcctccgaggggtcgcgggcgctcctccggggcctgccggcatctgaagcagaggagcagaggcctagacctcccttcgcccccaacacctggcgacggacatttgccggctctcagcagcgatgcgggaattttacattgcgcgtctggatatacacccaccacctgagtgtgccattcacatgttactggactttgtcacatctagttaatcctccctgctttgatcccttttattttttatgcatttccaagtaaattatagacctcaggcgg

SEQ ID NO: 275527 - DNA, 1871 bp, Homo sapiens
tgcccgttaagcagctttgcggtggcggaggctgggctgccgtctctccgacatcccgggacggaggaagagatgaaggctctgcagcccccgccgcccgatttacgcttgagaaagcgaaggcgagagaggtcgtccagcccctgggggcccagccctagagagcggggcgcgggctgcggggcccggcggcctggacggcggagcgttgaaagctcccccagggataggaagtgcagccgaaatcaacgattgagggtctgagcacctccctcatgcagacagagccccggctcccatgttcaccatgctgagaaagacctgcgggggacagcaggaggacagccggggaatgggcccgcacttgcccagaggcagagctcgtgcatgcccgacctcgctcctcacggctccctgggcagcagcgccctggcagttggaactggaaggcttatcagagtccacgcagccccaccgccctccccactctcgggggtgggcatcgggggacagggccagggcagggaggaagacagggcccggctcaccccacagctcagcccatgagggtgcgcagagcagggctggcaggagtgggccactccacacccagccctgttgaagagaaagaacagaaatagggaacagaaagttgtcgattgctgtgtaacaaattgcccgcagtttagtgccttcaaacaaacgtagctgcacagtgtctgtgggtcagacatccaggcccggggaaggagcctctgcctcaaggtccctcccgaggcctcagtcagggcccggccggactgtgagtagattgcacgctccgtgcggggaggctcggcttctctgctggccccgcgcctgtgggcaggattcagttcctcatgggctattagagtgagggcctcgatcttttctgctgtttggctggaggcctcgctcagttctctgctgcacggacctttccttggcacagctcccgcatagctgagcaagccgcgaaggcgggctcctgcagccgaagggaattctcccctgtttctgctgtgttctgtttgtgtaggttcagccccggggaggaggttccacaggacagacagaccaggagttgggggcgttgagggccatctcacaggctgcccaccacagcccccacgcagccacctgtgtctgtgttcttgccactgtccctaccctccaggagtgggtctggtctcatcagggagggcagcgctctcttcactctgtccttactctggtgtttcactgtgattttaaaaactgaaactgcacttgttaccccttgacagagctgcaccctgagagggcctctgcgacgcccctccttctcttaagcctttccaagctgtctgacgatttttaaatcccatttcctgagtgacacagagcatcttttcttaagcttatgagtgacttatttgtgttttcctcaaagctagaggggacccccaatctgtttgtttccagagtccctgatggtgtcgtcttgggagtggaggaacctgagggaaaagcccagggacgagtcaggggagagctctgccctggtgctcttgcacgtatccacatgggccacagctgcacccggctctcagcagagggcatcgccatgctcctgggcacagccgggccctctcgcctccctgcggctcctgatgcctcccaggctccgctgaggtcaccttgggcacttagcgtggctgcagctctttgcagccccgtgtcctgtcatccatgtggccgtcatgtggtcacttttgggcattgccctgcgcaaggtccatggggactgggcacctttggccattctttctttggttgtctgtgcaagtaataaactaaatctgaaaagg

SEQ ID NO: 275528 - DNA, 758 bp, Homo sapiens
tgcccgttaagcagctttgcggtggcggaggctgggctgccgtctctccgacatcccgggacggaggaagagatgaaggctctgcagcccccgccgcccgatttacgcttgagaaagcgaaggcgagagaggtcgtccagcccctgggggcccagccctagagagcggggcgcgggctgcggggcccggcggcctggacggcggagcgttgaaagctcccccagggataggaagtgcagccgaaatcaacgattgagggtctgagcacctccctcatgcagacagagccccggctcccatgttcaccatgctgagaaagacctgcgggggacagcaggaggacagccggggaatgggcccgcacttgcccagagtccctgatggtgtcgtcttgggagtggaggaacctgagggaaaagcccagggacgagtcaggggagagctctgccctggtgctcttgcacgtatccacatgggccacagctgcacccggctctcagcagagggcatcgccatgctcctgggcacagccgggccctctcgcctccctgcggctcctgatgcctcccaggctccgctgaggtcaccttgggcacttagcgtggctgcagctctttgcagccccgtgtcctgtcatccatgtggccgtcatgtggtcacttttgggcattgccctgcgcaaggtccatggggactgggcacctttggccattctttctttggttgtctgtgcaagtaataaactaaatctgaaaagg

SEQ ID NO: 275529 - DNA, 489 bp, Homo sapiens
ataacctttgttacttttcagtagctttactgaataataactggcatacaataaactgcacacatttaaagtgtacaatttgatacatcttgacatatgtttacaccgagaaaccatcatcataatcaaggtaatgaacataccattaccccgcaaaagtgtcctcatgctcctctgtaatctcctcctcctgtccccaccaacccccatgtccttaggtcagccactgatctgctttctgtttctagagattagtttgcaatttctagaattttctataaaggaatcatacagtatgtattctcttttgtgtcattctttcactcaacataattttgttgagaatcatctatgtcctaacagcatttatcaataattcatcgcttgttattgctgaatttgcactccagttccttgttacaggacatcttggtggtttccagtttttggctattacaaataaacctgctatgaacattagtgtacaag

SEQ ID NO: 275530 - DNA, 433 bp, Homo sapiens
acctaatttgtatgaaattttaccaattgaagttatttagtaaacattgtcctcctgagagtatagggtaggatgggggtggtaaagatattatccatttactttagtatgagctaatgtgaacattctattcctctaccacttggctagattaagtgagaatggtagctttgtagggagataagtaagagtggcagcatgttggctaggccagaagaagcagtgatttagtaactctggggaactgtttaattgagagttgaaacaggatatttggggcagccagtgagcaatatgcagactcagacagactgaatattttggggcggggggtaagagtatctggacacgagaaaagcaggtgatgagatagaaaaggtgttccagaaagcaagtaaagaaaagaacagtaaaaggaagattgagatataaa

SEQ ID NO: 275531 - DNA, 257 bp, Homo sapiens
agacaccatctgtgaggaacaggctctcagcagataccaaatctgccggccccttgatagtgtatactttccagcctccagaactgtgagaaatcaatttctattaattacctagtctgtggtgttttgtgatggcagcctgaataggctaagacaatgatatattagaattatctgaaaaagattttaaagctgctatgataaaatttctccaaagagcatttaatgaatatgaagcaaatgaaaaagacaccttc

SEQ ID NO: 275532 - DNA, 1166 bp, Homo sapiens
aatttttaattgtgataaaatacatgtagcaaaacttactatcttaaacatttttaagggtactgctcagtagtgtaaagtatattcatattgttgtacaaccagtctccaaaactttttcctagccattaaacaagtacttaatacttcccctacccttggcagtcaccattctactttctgtttctatgaatttgactactctagatagctcatgcaagtggaatcatatagtgtttgcccttttgtaactggtttgtttcacttagcacaatgttctcaaggtccatactattttgtgacttttgaatactttactttgtttattatccatttttaaaagagcactaaagtaaaaagacatgaccttattcagagctgattaattacatggtaaaaagttgaaggctggcgtgtcttattcatttcaaccaatattaaatgccagtttgggcagcaaaacaactttctgccaaagtgccatttgaagcctggtttatgacatgtttctccttttgtcatctttgggtgccacccaaaatgcaggctcaaggccgcagcctcttgactctgttcaacagtttccccccttggcttattgtccaacattggcctactcttccaaatccacctctttatcccaggaacaagctgcttctatgccaagggcatggcttcctctttgcagattgtctcatatctctgacctggaaaaaagggggtttttcattctgctagctttttagtgctgctttgagatcattattctagagccctctgcagtaatgttttttctcatggattgaaattcattgtttccagtaggatttttgactagacgtggaaacagaaggacaaattgaaatgactctgaagcttatgggaggactgagtatcattaactggcacagagggagaaaggcaggctctaggtggaaggtatgtgacttgcttttgaaaacagtggtgtgagattctggcctgtgaaaacagctggagttacgagatagaaatggtcgccaatccggatgggcgaccatttcaacatgagggacccactgacagatggtccgtataataaagtatacaagaacctaaaggagtttctcaaaatggagagaattctgcaaacggtcacatcggttctcagcaagggcaacctggaa

SEQ ID NO: 275533 - DNA, 269 bp, Homo sapiens
ttttttttaaaggtgatatggttgttttattcatttgtacttaaaccaggcaaactagtactgatgtcattgtgatgtagcaaatacaagaccgctgtctataaatattagcataaccaaccaattaggggctatagtaaaacacagagccaaaggggctgatgaaatcagtgaagtatgttacagcttaatccttcaccttaataattgggtttttaacagtaagtaaggccaggcacggtggctcatggtgtaatcctagcactttg

SEQ ID NO: 275534 - DNA, 422 bp, Homo sapiens
cagtggcttaaaaaggaaggacttttgcggggaggggttgagattgtactttctaatttcgcttgcttcagacttgactttggaatgaagttcgaaggcatcacaattgacctggacattccaaaaacaaaactgaagaggcagcatttctcttccgtagtccagtcagctcatttggtagatgcgctttttcctcctttgcgcttattcatccataaggatatataatttgcatatatatttcatatgcgtgcatatgtgtgtgtatgtgtgaactggcaggtgttgatttcataaggacaaaattgttctgcaaaccttgcaccaattatggggtgtttcaacggaaaaacttcaccaaatgatctgtgtgttctttcaaagagaagttatgtctaattaaaatgtgtaacggacaaatt

SEQ ID NO: 275535 - DNA, 369 bp, Homo sapiens
cagatgagaatttcacaaaatgccacgttatcacaaatttctgaagaggctgacaggttattaatcaggataaaccacattgaataaagtattcctgttaagtggttctgcagcctctgaatcggctgggaagttgttggacatgagaattcttaggctcctgcccagatctaacaaatcacaacctcaggaggtggggcccagcaccttgtatgttcgtaagttctccggctgactggatgctgacacttgctctcaggaatctacactggtcccccattgatgccagggggtgcaatgggcatcctacttctaatgtcttgatcatgtttcttcatttagaataaacttcttttcttgctaatcaaa

SEQ ID NO: 275536 - DNA, 393 bp, Homo sapiens
tcatgtctaaaatggggatagtgcccactccacatggttgtgaagattgacggtgccaggcagacaataagcatgtcatatacacctgttatatacatgttagctattgcttttgtggttcaaccaccccgtggcccgcatcaagacggtgcctcccattgggggtccgtatctgcagctgggcacccctggctcagcctccgttctgctctggaggttcctggtacactactctgagaaaggtactcctggtccctcaatctgtattggataaagcccaaactccatttacggcctggcattcaaggtctttccctgtcaggcctgtccttgcctttctgcatccatctcctgctgtagcttcatctacctatgctcaaaccagatatgata

SEQ ID NO: 275537 - DNA, 425 bp, Homo sapiens
ccatgtccccagtgtgtgtgtgggtggtaggtgtgtgagtatacagacgttggtgttggcgtactcagagtgggaatgcatctctgagtgtacacatagatacttagtacagggcacatgactccctgcatccctgctgagggctttgggtatggataggatcttgcaggaggttccccctgctctacattgaccccttccctatacttctgtttgtaggggctgggaggccagggcccggattggaccccatagggccaaatggtctgtgagcctaacccgttagatttgctcactggataccccagagataagaaaggatgtatttggccacagtctaaatgctgagatgagaaaaccctgcacagtgaatgttttgataggattcattacttgctccataaatgtcaattttggatcattga

SEQ ID NO: 275538 - DNA, 415 bp, Homo sapiens
aggagtctcagttcataattctacagactgagcaacattgccatctgttggtgtaaatcaatggctgatttcctttattaggggcaaaacctatagattggtatgtggtcttatttataagaggagggggccaggcgcggtggctcatgcctataatcctagcactttgggaggccgagacgggtggattgcttgaggccaggagttcaaaaactagagtggccaacatggtgaaaccccgtctctactaaaaatacaaaaaattagccggacgtggtggcaggcacctgtaatcccagctactcaggaagctgaagcaggagaatcacttgaacccgggaggtgggaggttgcagtgagctgagagcacgtcactgcactccagcctgggcaacaagagcaaaactccgtctca

SEQ ID NO: 275539 - DNA, 393 bp, Homo sapiens
aaactttatgtaaaagtatatttttcagccaggcgtggtggctcacgcctgtaatccctgcactggcctcctataaattttattttacagtatataggtttacataaagggaatcatatatgctgttccaaaatctgttttttttttttaaactttatgtaaaagtatatttttcagccaggcgtggtggctcacgcctgtaatcccagcactttgggaggctgaggagggagcatcacttgcgcccaggagttcaagaccagcctgggcaacatggtgaaaccccgtccccacagaaaatgtaagaattaaccgggcatagtggcgcaggcctgtattctcagctacttgggaggctgaggtgggaggagcacttgaacctgggaggcctct

SEQ ID NO: 275540 - DNA, 379 bp, Homo sapiens
cctgtagtctcagctgcttgggaggctgagacacatgaatcgcttgaacctgggaggtggaggttgcagtgagccgagatcttgctactgcactccagcctgggttacagagtgagactccgtctcaacacaaaaacaaaaacaaaaaagaagaagacatcatctttgaagcaagaccttaccagacactgaatctcttggcgccttgatcttagacttcccagactccagaactgtaagaaataaatttccaggctggatgcggtggctcatacctataatcccagcactttagaagtcagaggttgtacacatagcttaagcccaggagtttgagatcagcctgggcagcctgtatctcagagaaaccccgtctctt

SEQ ID NO: 275541 - DNA, 590 bp, Homo sapiens
  misc_feature (565)..(565): n is a, c, g, or t
atggctgcttcttgaggatccactgacgagacacaggcacatccaaagacacacagaggagatccgcccatctggggcagaagccactgcaaccacagattgctaataacacttaaaaggtaacttccacaaagctagaatttcagtgtggattggcctaagggtcagaaactcctgaggattctagtcttagggggacctttaaacttctgtgggcttgagccccaggaaccccagaaggttctcccagtgaagatgtgtgaaactcccggatggctctgctggagcaagggaagagtaatcattgtgaaatacacctagagccttctccagaacaaagaccttcctaggaccttatcctagctgggggaaagtcatttctcccactggagcaagccccttgagtctcctaggctcacatgagggagccttcaaacgtgctgggattatagctgtgagccaccacacctgggcggaaattttagaatcactttgtcacttttacagaaaaaaagcctgcaagattttgattgggattgtgttaaatctatagatcaattttggngagagttactatcttaacaatatta

SEQ ID NO: 275542 - DNA, 623 bp, Homo sapiens
atggctgcttcttgaggatccactgacgagacacaggcacatccaaagacacacagaggagatccgcccatctggggcagaagccactgcaaccacagattgctaataacacttaaaaggtaacttccacaaagctagaatttcagtgtggattggcctaagggtcagaaactcctgaggattctagtcttagggggacctttaaacttctgtgggcttgagccccaggaaccccagaaggttctcccagtgaagatgtgtgaaactcccggatggctctgctggagcaagggaagagtaatcattgtgaaatacacctagagccttctccagaacaaagaccttcctaggaccttatcctagctgggggaaagtcatttctcccactggagcaagccccttgagtctcctaggctcacatgagggagaaataaaaattcatagtcaacaagaatcaagactttagggaaatacatctggaatgctatatccagggaggggaataggaagcagggagggggaaaaactattccactagagacacccttaagagagtcacagcctaaagatacagacctactaaatactaaagactaagaaacttctaatattgaaatgcaaag

SEQ ID NO: 275543 - DNA, 306 bp, Homo sapiens
gatggtgcccaaccccattgagggtgggtctgcctctcccagtccactgactcaaatgttaatcttctttggcaacatcctcacagacacagccaggaacaatactttgtatccttcaatccaatcaagttgaccccatcacacaaggcaaaccactgtccccaaaatgtagagacacaggcacatccaaagacacacagaggagatccgcccatctggggcagaagccactgcaaccacagattgctaataacacttaaaaggtaacttccacaaagctagaatttcagtgtggattggcctaag

SEQ ID NO: 275544 - DNA, 337 bp, Homo sapiens
ttgagaatcactgctttgttgaaaggtatggagagattgagatggaaaaatatagggtagaattaaaacaaaatactttatcataggacagacagtttattatagaaatgggcaagggtgaggaataatgtcaaataagaatgagagagttgggactctagatttccaaaaaaatcaagaactgtattaaaggtggtaaagctgcagaagaacatcagtttgtacttgtctcaaggggaagcagtagtttcacctttaagaaggagatgaagtgaagggctatactggcatatataataaagtatttttctacaggtaactgtattgttacttggcg

SEQ ID NO: 275545 - DNA, 455 bp, Homo sapiens
agtgactgctaaaatggaagagttaaataggatccagggtctcctctcataataccagaaatgtccaggatataatttaaaaatcatacataatatgaacaaccagaaaaatcacaacttgaatgagaaaagccaatcaacaatctaacactgagatgaaagattttagaattatctgacaaagatctaaagtagccatcataaaaatgtttcaccaagcaagtagaaattccttgcaaagatgggaaagaaaagaaaatctcaccaaagaaatggaaagtatgttcttaaagaatcaaatgaaaatgataaaactgaaaaatacaataactaaaataaaaactcactggaaaggctcaagagcagagcaactatgacaaaggaaataagaagtgaacttgaagatagaacaataaaaattacccaatccaaaaaacagagagacaatcaacttt

SEQ ID NO: 275546 - DNA, 373 bp, Homo sapiens
atattcatatttgattctataccaaaactcaataagcagtagtttctatgaaggttagttgcaatgtgaaacctaaaaccttatcaataaactcttcatacttttacattagagttcatcatttggctgggcgcggtggctcactcctgtaaccccaggactttgggaggccaaggcgggcggattacctgaggtcagtagtctgagaccagcctggctaacatggcaaagccccatctctactaaaaacacaaaaactagctgggcatggtggtgggcccctgtagtcccagctacttgggaggctgaagccatagaatcacttgaacctgggaggtggagtttgcagtgagcccagattgcgccactgcac

SEQ ID NO: 275547 - DNA, 376 bp, Homo sapiens
tcaaatgtcaagtcgtttaggtttgttatccttcttcactccaagtgttccattgcttagttccaaaccattatcctctatgaaaagtgttaccagaaatatttggatttgctaagaggtctctgcatgacggttcatgtaaaagccctggctttggaataaggcagaccagagtttcatcagttcagccatgtgttagttgtgtgatctgaagtaagtttcttcacctctctgagcctcgttttccccacatatgagttagaaacatgtatttatttatgaaataggctctccttctgtcacccaggctgaagccatagaatcacttgaacctgggaggtggagtttgcagtgagcccagattgcgccactgcac

SEQ ID NO: 275548 - DNA, 443 bp, Homo sapiens
ctcaattaccacaaccatatcgctaaaaatccctgaagaattctttaactaggctatccttacattacttcaaacctagactacctcaactcttcaggttccccaaaaatcaacatccttccttacttcatttctgatatgaactaagtgaccttttgactccttcaatttttcccatatgtctgtgtcaaactgccaggttttgtcagttcttcaacaccattgtataactgtccctagatatccatgggtgattggttcaagcatctcgcttgaataccaaaatctgcagatactgaagtccttgatataacacaacatagtatttgcacataacctaagcatatcctcctctattcttctaatcaggggtccctaagcctccaggttatggacaggctccggtccttggcctgttaggaaccaggctgcacagcaggaag

SEQ ID NO: 275549 - DNA, 526 bp, Homo sapiens
atcagatttgaaagatagcacgcaaaattgaaaacaaatatgttaggatgagattataggtgttgtttaaacacttaaaaaatattactgcagcataatttttagttagaaatttaattattgaattcaattccctcaattcttcagtgaaataaattgggttccagagagactgagtactgccaaaagttacagtaaaaacaattgaagagtaagagctacaatccaggatgcttgacttctagcccagttctcttcttgagacactggaagtgtctcaagagcaacaaattaaaaacttttggaggtaacaatacttttttccccttctggagagattaatataaataagacattgtagggaaaatagatataattaaagttactgatataaagatttatactgatataaagttactgatataaagttttctattttaaacagccaatacataagtataaaattagtatttaaagcaaaagagctaaaagccctggtatttttctcaatactttgctcatttgg

SEQ ID NO: 275550 - DNA, 208 bp, Homo sapiens
gaggactcccaggacactgtctgagcccagtgggaggaggacacacagccctgatctgccagtcagtggggctgagggtcaagctgtgcgccttgtgtgctggcggcgtcccgcctgggatggatggagatggtctgtactttcatgggtgaattgtagggcccctgaattgtatgtatctcaataaagctgctaaagaataaatgta

SEQ ID NO: 275551 - DNA, 431 bp, Homo sapiens
tgttttgttttgttttttaataaaggggcaacttcatctgtgaaggcagataaaccgggcccagcatggtcaggccgggagcaggccatgggatctcccccaggtccaggcaaggcttgttttacgtctggagagatctggcggtaccagcaccccttccccaaggccacagggatctcaggattgagcccccaaagctgggctctgggtcctcccgccacgtcctctgccgaggcgcggtccccacagggctcctctgtggaatcggaggtctcgccctctcagcgaatggatgcctcagccccaggctccttgggacgaaggcgggcagctgctgtgaagaatcccgctgggtggcagggtgctaacacccgctgtgcacactgagcaccagctgtgtaccaggcaccgtcccaggcctcacagtaggg

SEQ ID NO: 275552 - DNA, 406 bp, Homo sapiens
atacacacatttgttctttctggaaaaagccaattccaaccccagtttataaattaatgcccaggtctcttatgttcttggagcagcgcctcaacggtgacatccagtggcagggctgggttattactgctgggtatatcaagggaagttggagtgatttaattgattcagcagatactgattggatgtctctgtgctcggtgctttagagataagggaaagaggctcagtttttccttctgagagtttataatgtagtagagatgtctctttgtcttattcccttcaaaccttttagcaaaaaggcaaatgcaagtaaatgacaattagactagcccttaacattttgtattagtctcttctcactctgctaataaagacatacctgagactgggtaatttataa

SEQ ID NO: 275553 - DNA, 363 bp, Homo sapiens
agtcactctccaacctggatgaaaagaggaagatatttgccatatcccaaggaggaagaaggcctctaaagccagaagggaagtcctattctctgatatgaggccattcatatgtatatttattaatagtaatgcaatgccctctacaacagggaaaagcactatattaatcaaattttaattcatcttatttttgttagagatttgcattttattatcgctgatgctttattactgtttgttgtttaactggaacccaaaatgtctaaagctcctctaaccccagcttctgtcaaataataataaggaaaaccaccacttgcaggttatacagtaattactactaaataaaactctgtgatc

SEQ ID NO: 275554 - DNA, 141 bp, Homo sapiens
ataaactacacttctggtcctcaagatttagcccaatttgactgggctgtctttttatgttcagtagaattagactatatcacagaaccaccaaacattttttactagtttatggagagaattaccattttctagaggtag

SEQ ID NO: 275555 - DNA, 642 bp, Homo sapiens
atagctgaaattaaaagtactgagcttaccaagtgttgataaggatgtagaggaactggaactttcatacactgctggtgggaatataaaatggtataaccattttggaatacaacttggcagtttatttgtttgtttaggttgtttttactcaccactatgctaacgaggaacttggcagtttctttaaaagataaacatatatctctggtccgtgcctccaagatgacaaagaaaagaaggaacaacggtcatgccaaaaagggccgcggccacgtgcatcctattcgctgcactaactgtacccgatgcgtgcccaaggacaaggccattaagaaattcgtcattcgaaacgtagtggaggccgcagcagtcagggacatttctgaagtgagcgtcttcaatgcctatgtgcttcccaagctgtatgtgaagctatattactgtgtgagttgtgcaattcacagcaaagtagtcaggaatcgatctcgtgaagcccacaaagaccgaacacccccaccctgatttagacctgtgggtgctgccccacgtcccccaccaaagcccatgtaaggagctgagttcttaaagactgaagacagactattctctggagaaaaataaaatggaaattgtacttaa

SEQ ID NO: 275556 - DNA, 413 bp, Homo sapiens
tatcattcacctaacataaaaatcacccttttaaagtggttttcatatatattcacaaaattgtgcgtccatcactactatctaattctaaacattttcatcacctccacaaagaaacctcatacgcatggtcagtctccacacttctttcccctagcccccagcaaccacaaacctaccttctgtctctctggatttgcctgttctgcacttttgcatagaatggaatcctgtgccatgtggtccctttatgcacgatatccaacccagagaaaggccttgcttcctaagccctcctgagactcaccagccacgagcccgcatctatagcaagttcttttgaaggccctctttactgctggacattcttcctttgtgcaacaagtcaataaacccattttggttcagctaca

SEQ ID NO: 275557 - DNA, 463 bp, Homo sapiens
cattgagtcaagtgtatgaattaatcagattttcttagtcattctctactgggaaaaacttaattttataaacttagtttattgtgatttaaatgtacttttaattccatggactttgagaagactcatttaacgcatggaagtataaaacgcgtttttatgtctggtaatgcagattaagtttgcttactgccttaagtaactaaaataaaacaaaattaaaatactcctcaccttgtttaaggctgtatgctccttggaaaaatagtttttctagatatcagcataggcaatagctttggtttgaaaaccagattggcataaaaatcaaaacccatcaaatgaattcattgccttttagagacagagcttggcaaggagctcatctgcactgtgtgccaccccgcatctcactactctgcagccctgttttgcaacaccaaacattggttacaaatggaaa

SEQ ID NO: 275558 - DNA, 161 bp, Homo sapiens
gttttccttaaaactctctaaatggtctttgagtaaaatctgggaattcatttgggcacaggaaaaaagagtagtttatatggtggttaagaggaatccacacagcaagtctttaaatatatttttgtaagataatggaaaccacaaaaaacaaaaaggta

SEQ ID NO: 275559 - DNA, 445 bp, Homo sapiens
tgggccttttgatgcagctatggaaaagtctttccagaaaaatgcacgtgcacataaaattagaatgtttccaagatacgcatggaccctgtgaaacccactgaagattccatggccccagtctttctcaggctaacctctcaagctcttgaaggttataagagggattgatagtccatgattcaggtcttgagataaaaggcacgaacgtccctcccaaggggaaaccatgttgtgagagacccatgtatggctgaactaaacctgtgtgcatgtgagtgaagcagagcctcaagctccagatggatcttgagatggctgcagcctggcttgactgaaacctcatggatgacctcgagccagaacaaccgggctaaactgcttccagattcctgaccctcagaaacagtgaaataataaacgcttgttgttttaaactgctaaa

SEQ ID NO: 275560 - DNA, 672 bp, Homo sapiens
ttttgtatctttagatacaaaatttagagacgggatttcaccatattggccaggctggtctcgaactaccgacctcgggttctgcccgccttggcctcccaacttgctgggattacaggcatgagctactgcacctggctggttgtcttaatacacctcaaacttggtatatctgagatagagctcctgagactccccactctaaaatcatttctccttcagtcttccttatcccattctctctttcagccagattgctggtagtcattcttacgccctccccaaccattagcagctcttgatcatgtttatatcacatgttgcctcttttctccatgtctttgccacagccatagtctagaccatgctatcctctcccaccaagatgactacagtgacctccaggtccatctttttcttacccttgggtcttcaaagtattctccatttaatagccagaatgttcttgtgaaatgtatgtaaatcagatgtttctttcgttacttagaacctttcagcaacttccccttttatctaaagtaaaatgcccaatcccttagtttgaacgtgcctttcctctgtcacactttattatctcaggcccttttccctgcttatctatccttttctgaccatactgactctcctttcagatccttgtatacactgagc

SEQ ID NO: 275561 - DNA, 380 bp, Homo sapiens
cggacctcaactccccagaaaaggcatgttgcctcttttctccatgtctttgccacagccatagtctagaccatgctatcctctcccaccaagatgactacagtgacctccaggtccatctttttcttacccttgggtcttcaaagtattctccatttaatagccagaatgttcttgtgaaatgtatgtaaatcagatgtttctttcgttacttagaacctttcagcaacttccccttttatctaaagtaaaatgcccaatcccttagtttgaacgtgcctttcctctgtcacactttattatctcaggcccttttccctgcttatctatccttttctgaccatactgactctcctttcagatccttgtatacactgagc

SEQ ID NO: 275562 - DNA, 385 bp, Homo sapiens
tcttcactcctctactcctcaactgatcgactatttcttaacactctatgacaaaaaaatcccgatccagccaagcagttccatggacttgtgcctacaccgtgctcattcttgccctttgctcacgccatacatcccatctaaattgtctcctcccctcttaagcaaccaccaacccacattttcttaaaaggtgactctggacatcttatttttgcttcattactctgcttcctggctcttacttaatccacatgttgaggcgtatctgcattccgcctggggtgcctgtgtttctatatccaaccagaatctgcttaacacagcgagttctgggggtgccttactggtgtctagtagagaaaataaaaccatgaacagcagt

SEQ ID NO: 275563 - DNA, 373 bp, Homo sapiens
tcaatttattactcaagatcaagctggtcgggtgcagtggctcaggcctgtaatcccaatattttgggggggccaacgcgggagaatcagttccagagcagcctggacaacacagggaggccccatctctacaaaaacaaattaaaaatataaaaattagctgagcatgctggcatgtgcctgtagtcctagctacagtctgaggcaagagggtatcttgagcccaggagactgaggctgcagtgagctatgattgcaccactatagtccagcctgggcaacagagcaaaactctgtccctaaaacatgaaaaataatacgttttttcaaaaagatcaagcttgctgatcccaatagttgtgctgtcagtgtg

SEQ ID NO: 275564 - DNA, 718 bp, Homo sapiens
tacaggctttgcttatgaaaatcagccagggtgattacgtcttcctggcatttgaagtcaggaagactgtttgatgttaaagggtttacaggaaaggactcttgtggggttcctttagtctaaggcagctagctgttgatgtagtcaggagaccacaaagaatgatttatcccgcccccggtcctctaacagtttcagtctcctgtgactcatgcttctgtgtcttagaccttggggaaagttactccatttcctaggctgagacagggccagcctgtgcttctgtctcctctgcaagctcggcagataatcctatggccctggggagctttgtcagaggcttctccttcatctgggaacttgcccagatctgcccagcctggctgcagagcacctgggaatcaattcccaaatcttaatgccagaaaaggccttaggggtcttaaagatttgttgagtccagaggttcccaaatctggctgcacgttggaatcacctggacaatgggaaaaaagggctcctcctcatcccctttgagtctaattcagtatgtatggattgagacccagaaatcagtgttcttttatactgtcttaaggtcacttaccatggtatgtggcatttggtgactgctgatctagtctcatctcttaattttatttgattttaaaattgtatatgtgtgtttttactttttaagatggagaattattaagac

SEQ ID NO: 275565 - DNA, 553 bp, Homo sapiens
ataccactttcagggagcacaggcaaaacagttattttttaaagaggcatttcccccgtgtactactcttgttttccttttcctggtgtgcaacctgagatcttactgctcatttctcatatacttctctggatctcagctaccacaacgagcaacgagatgacaaagccatcttcttgtgattcaggcaataaagagcaagaagagtctctaataaattgtatcttttccttgattatgtgtccagcttttcataaactatcaatcatgtgtccattgtgctcacttttaattccacctggcatttcacttttcgattaaaatacccacaggttgtggaactaaggcaataaacccatccatctcaaacaaaaggtactttacaattaagacagttccttacaacctacaaaatgtcttcatcaaatcagcttacatcgagcccgtgagttcttcatatgctgcttttatgttccccctaacccttccttgccttggcaatctattagtctaagaattagcaacttcaaagaatttagcaactctgggcaag

SEQ ID NO: 275566 - DNA, 393 bp, Homo sapiens
cagctggtcccaaaccatggagaattttacccacacaaagcccccatttgccaatgcaaatctggtaattggacacttaattaccctatttgcacacataaatgaggggtgttcctgcaagaaatcagagtccactcttacaactttggccgcaagcaatgaaaccacatgcttttgtcaacagttaagttgattagaattgtgtttatttctgctcgtgttaggccacatgtattttcattggagcctgatgtctattgagttaaaagcttagtttaaaaaacctatgttatgcagaaaacctagatagtaattgccaactatgtgccaagaatcctttcatcatgtagagaatacaaggtctgaataaaaagaaatattctttgcaacctc

SEQ ID NO: 275567 - DNA, 383 bp, Homo sapiens
ttctctgggatctacttctctgggatgcccagcaggttcccaaaggaaccttaggtggctgttaggagaagcttggggcagaggctgcagaacaccgcatttcaagatgaagcactgtccatgcatatgggacaaacccgtgcagagaagaccacagtggtagtagaggggagcgcgagaggacgtgagcacaagagatgtttgatatgggccttttttttttctttttttgagacagtcttactctgttgcccaggctggagttcagtggtgcaatcttggctcactgcaacctccacctcccaggttcaagcaattctcatgcctcagcctcctgggtagctgggattacagttgtgtgtcaccacaactagctaattttt

SEQ ID NO: 275568 - DNA, 437 bp, Homo sapiens
attagccaggcacatgcctgtaatcccagctactcagcaggctgaggcaggagaattgcttgaacccgggaggcggaggttgcggtgagctgagattgtgccaccgcactccagcctgggcaacaagagcgaaactccgtctcaaaaaaaaaaaaaaagaagtgaagttctgacatctgctgcaacatgggtgaaccttgaagacattatgccaagtaacacactccagggacaaatgagcaatattgtgtggttcctcatatgaaatatctggaacaggcaaattcataatgacagaaagcagattggaggttaccggggctgcagggcttcgctgcctgatggctgcagagttcctagttgaggtgacgaagaagttctagaaatgcagagtagagatgacggcacaacagggtgaatgtatttaatgccactga

SEQ ID NO: 275569 - DNA, 274 bp, Homo sapiens
cagatgactccaaatctcaatggcactcctacctcttcctgtcaacttcttatgtgggctcctaactgtgactggttcccagctgtattgcttctctgtcattattagtgcttgatgattatcataattaattagcacacatcacctttttcctcaaacattttacttgaggccaggcaaattctagtggtctttctcagatgacttccaaatctcaatggcacctcctacctcttcctgtcaacttcttatgtgggctcctaactgtgactgg

SEQ ID NO: 275570 - DNA, 438 bp, Homo sapiens
atacactgaaatcctttaacatacaccaaagcaatgggagatctgcagaatgcttttgtccatgtttaaccataatgatcaatgcattttgaatagaatattgttatatctactatttagcttaattgtgatcattaacaaagtgcccagactctctgaacattctacatggcatactatttgtgagaagatcagcatgtaaatagttacctctttgtaagctcttctacaaggtggctaaaagcaagaactagaaccagagtccctgcattcaatgaatttcccattattgcccatatcattctttcttttctttctttctttatttctttctttctttctttctttctttctttctttctttctttctttctttctttcttctctctctctctctctctctctttctttctttcttgctttccttcttctttcttt

SEQ ID NO: 275571 - DNA, 384 bp, Homo sapiens
gcactgcctctgtctctgctgtaaacaaccagcatgaatcatcgcggaagtcagtagtcatctctcccccgtttgcaaagactggggaactgcagcatcacagggtgacccgctggaagccacagagggaagataacctggagggaaaactagagctgaaaagctgcagctgggattgaaggctggaggctggagcagtgagcccttctgttctgagtagggctgggctctcccagcaaagggcctgtgtcaccagcagcgaccgctcaggggagccttggtcgctgaatggctctttgggtggtgtggtctccctctggccagacctacagagtggccctccagcacccagccttgctgagtccctgcaggcctgctctgagg

SEQ ID NO: 275572 - DNA, 373 bp, Homo sapiens
tagccatcatggataggaaggtaagagagatcacagagttgtagtttattggagcagagagtgaagggtgataattgctatgggagtggaagaacataacacaggtacctattatacttaaaaaaagcttttaggccagttgcagtggcacttgcctgtaatctcagcactttgagagaccaaggcataaggatcacttgagtccaggagtttgagaccagcaaggtagtgaaatctcgtatatgtgtgtgtgtgtgtgtgtgtgtgtgtgtatacatatatatgtatgtatatgtatgaatataggtgtggtgcacctgtggtcccagtgagcccagtggctgtgcctgggcgacagtaagaggccttgtca

SEQ ID NO: 275573 - DNA, 359 bp, Homo sapiens
tagacttcgtctcagaaaaaaaagattcgagtttttaaaaaaagaacattcttaagtctttagtatactgaatggtatgagcagcaatagagggttgtggccttctgaaagtaaggaaaattataatgacagtataaggtagtatgaggggcatagtcttttatttctgaccagtgtcatcaaggagggctttattttttttaagacggagtctcgctctgtcaaccaggctggagtgcagtggcacgatcttggcccactgcagcctccacctcccggactcaagagattctcccacctcagtctcccaagtagctgggattacaggcgtgcaccaccacgcctggttaattttttgt

SEQ ID NO: 275574 - DNA, 300 bp, Homo sapiens
gctacttaactttcctgtgcttcattatttccatctgtaaagtgaggaaatgaaaagaatcaggattaaatgagttaatacatccaaattattcatcagtgactgaccctaaataagcactagctaatagctatagttacttttaaattactgtttttatttttaaaactgggctgaagctaatatttttgaagaatgcaatttgaccaagaagtctgttccgctaaaaacctccccacttttgtagactgggtaaacagaaaccaattattgcttctctagaggaatatcaaacttatt

SEQ ID NO: 275575 - DNA, 334 bp, Homo sapiens
tacaagagttcaaatcagcagagactgctgttgtgaatgcttaaagtaggtgtggcagcaccgaacgcacagaaactgaccactctggtcaaacaatagctccctgacattgtagacctgcggatgaacccaccagatttgtttctcttatcactcatccatctccagctttttgtgtattcacgttccaggatgggagagaagcggaggtaattttctgcttctttaaaataccagtgcacagaataaatgcttgccaccacactaatgccccctgctgatatgcttactgttggtggcctaaaatttggaacatactgtgcttttaagaact

SEQ ID NO: 275576 - DNA, 406 bp, Homo sapiens
tcatagtttactgatttctgttagtcaagagtaggtttatacataaactggtcaatttccttaccatgaaaagataggcccagtttagtttatattgtaaatcaaaacatcctttaacaatccagaaggctgcaaagttaagattacccctattaactaacagaaagttatactatttactgattatgttgtaagacaaactactgcactgttctgattctatgtggtagcatagtgtttattgttagagtatgtctcaatatataaaacaaaaaattaactttagtaggtataaggccttgctttgacattttattgacagtgaagtttgaatacctataaatcttctttaaaattcccaaagtcatgatgacttttaaatactcttctgttaagaacttttttt

SEQ ID NO: 275577 - DNA, 445 bp, Homo sapiens
atcaaaagaaaataaaagaatgagatagaagtccagatggcctcaacattcaagcattcagttttcaaacaactaacatactcatatgtgtgtgtgtttgtgtaatactatttccaaacttggatgttcatatctcaggtgaaaaatgagtgctcaaagtcacctcccagccaattgttccattttagcagcctcactatatttgtgtgcactgtactatttatccaattactcattttttacacttttacctattattttataaataagagtaaacaagaaatattaaatgtctgacactggcaataaaatgcatagctttcatacacaatctagttgagtcaaagaaggaacttatcaagcatgccaatagtagaaaatcattagtctgaatcgaattcctgctggacataagtcagttgaatgtgtgttcagttgtaaagaa

SEQ ID NO: 275578 - DNA, 337 bp, Homo sapiens
acacacagcacacttgtactcggcaatctgagctccccagatccacataaactcgctcatggatgacctctaaccacacaatcacaaagattctcgctatggtgggtggaggaggtaaagaccttttctgtttgtatttttttaaaggtggtattctttggctgtaggggatagagtgtaagcttggagcccaacgcaatcctgactaccccttattgtataaccttggcaagtgacttaacctttctgagccgattttctgatcgagaaaacagagataagatatacttctatggagtgttgtgaagaataaataatataacttgtattggctgcc

SEQ ID NO: 275579 - DNA, 1249 bp, Homo sapiens
cattgttgggatgcatctgaggataacatcagatccaatgaggcaaaagtaacaccagagaagcctatgatgacaagcaggtggtcacagagatcatggcaagatgttttattccaactctgataacaactacttcctgggaaagttttcattttattggtcatgagattcgaattactgaggccatggattgttatggtgctgttgtttggccatcggtataatttcatacagaatttgttacattccaattatttttccagccggttttattcattattatgttctatttggaagaagaaaacaggttccatattccttctttgtgacctcaaatagtactatgttttagaaatcatgtgactaggaaattatttctcccaattaattctgtaattctatttcttttcttttctttttttttgagacagagtcttgctctgtcacccgggctggagtgctgtggcttgatctcagctcactgcaacctctgcctcctgggtttaaatgattcccctgctgcagcctcctgagtagctgggactacaggcatgcaacaccacaccaagctaatttttgtaattttggtgggaatggggtttcaaccacgttggccaggctggttttgaactccttgcctcaagtaatccatccacctccacctcccaaggtgctgggattacaggcataagctaccacgctgggcctcaattaattctatttctgactttattgaaatttgtaggattaatacagggtgttgtttacttcttcagtttttaaaataagagtttagagcagtaaacatttttatttccccttttatcagctccatttgagttaaacaattacattgaaatctatatgagtctcacatgtagaatgtcctcaaagaccctcaatcctttaccaactgtcccatgaagagtaatggacccaccaccccacctgccccaatcccacacaccacttggaaatgactagtattatcagaagttgcttcctttaaaaatgatcaaacctaagcaattgaactccacatttttagttatttctcttttcctctcaataatccccaaggaatttttctagcagaaatgttgaacctctcagaggatgcacttttgttcatattttttggagtgatgtacaagtacacacatgagtactctcatgtactcatatgagcacgcatacatagcataacattagcagcatatttgtccaataaagtttaattttactttct

SEQ ID NO: 275580 - DNA, 403 bp, Homo sapiens
aaaggatttgtttacttaatccttattttttcactctttcagattctgggaaatataccagataggttttaccaagataccaaatgactatgaattagacctgattttttcaatgaggtgtacctttcacctgatatactgaaagtttggagaatatctaaacatttttcattttcataaatagttttggataagatttatttttgttatcaggtggttaaattatgtttttgtcaaaatttgcaactgcagatttagctcattcaagttcaaaatctttgtcactgggcacagtgtctcacgcctgtaatcctagcactttgggaggctgaggcgggaggatcggttgagtccagagttcaagaccagcctgggcaacatggcaagaccccacctctacaaa

SEQ ID NO: 275581 - DNA, 1066 bp, Homo sapiens
cacatgggaattatgggagctacaattcaagatgagatttgggtggggaaacagccaaaccgtatcagcccctatgccaaataacatattattagtagaagttactcagagaaatgccgtatactaatacgtgttacaaggtgagtgtaggttgagtatcctttattcaaaatccttgagaccagaagtgttttggatttgggttttttttccccagattttggaatgtttgcattataccaattatgcattcgaaatccaaaaatcagaaatgccctactaagcatctcctttgggcatcatgttggcacttaaaaagtttcagcttttggagaattttggatattcagatttgtgatgcctaacctgtagtatgtagaacaagcagtggttttggtatacagagagaagagatactcagctagaccaaactgctctgcaaaattttcagaaatgtcttaaaagttatttaaagttaccaattagggaagggaggagaggacatcatcctaggcaaaggagagagcatgagctcagtggtacccagcaagaaaaacacagaatgtatttacagggtgtgaggttgacagttctgaaggacatttggtaatttgaagagatgttaaatgttacagataaaatacacatagcttagttaatattccttctgaaactttttatacatacgcaaaccatatacagccatctatatatataggtgtgtgtactcttttttttggatacaaatggaatcagtagggtgtttatttttcagtatatcatgggcagctttccatgtttctacaataataacacttcaggtactgcactgtttggaatataatcatagatgatttcatcaaatgaatgaaaacatttaaacaaaactttacaaaagacccagaaatactaaaagggaaatgaatagggatactaacattcagatagataatctggtttataaaatatctttactttccttcccagcaagccaccctaccttgtttccaagttatctcagtagagccagaagggccaacttttacctaactccttggggaaattt

SEQ ID NO: 275582 - DNA, 321 bp, Homo sapiens
gttagtgctgcttcatcagatatcatgttagcaagcagccagtgcaaaaaaaaaactcaacctacgtgaagcaccaacatattggccatcctggatgtgtgttgtgaaatcaggtgcatgtgacgtagacatacctgtgaaaaattgcattttagatgtatttgttaatgaaactacaaataatgttaaaatttttaatgcaactcaaaaatagtccaacagatggactgtgcaacgaaggaatagaaataaataaaaatcatgaaatgtctcattgttcttccctgctatgaataaaaacaagaattttgaaacactaca

SEQ ID NO: 275583 - DNA, 775 bp, Homo sapiens
cgtggtggcaggcgcctgtagtcctggctattcgggaggctgaggcaagagaatggcgtgaactcaggaggcggagctggcagtgagccgagattgcgccactgcactctagcctgggcaacagagctagactctgtctcgaaaataaaataaaataaaaaattttaaaaaatttaaaaaataataaaattaaaaacaacgaggcatcagcagttatactgcacataaaaactaaatgagtactggatgagaactgtttgcactagaatcgcttacggaacttcccagttcaatactacacattaatagaaaactacttttccaaaaaatctactcttaaaaactcgccccatcacacatttaagcatattttaaaaacaaaatgatcgaaatagattctggttatcacaaggacaaagactagtaaagtcttatcttctctggtacctaccaatcctagcccacagtacataccgtggaaataacagtggtactagtatgggctgtgaggttaggcatccttaggtttgaattgtgtacctcaattgtgtactacttactagtaaattactctgtacctgtttcttcagctgttctaaaggggatgataaaaatacctgtctctcaaagtggctatgagaataaacatgtgaaaatgctggctcactactggcatacagtacacactctaaatatttattaattacagtggaaagacaaatgactactaaagcaataaaagcaaacataaaaagataggccaggcgagatggct

SEQ ID NO: 275584 - DNA, 705 bp, Homo sapiens
tgaaatagtgttattaagtgttgaaagtaccataaaaatataagggaaaataagctttcctagaatttttcagtgttctagtttttaaacagtgatgttttttattaacctatttcatccattcaaagacaggcctttctccacaccacattttcctctaaaatcatgataacacttttaaattgatggtgtcttccagtgtgtatcagccagatggcagtgtgttacagttccaggaaaactcgttcacatcttccgtaagatcaagaaggctctggcatcagataagatcaaatgttgtctttctgttttaaatatgtgccgcaaagagatttgcttacaatctattgagaaagctaaaacagagcagacattgtcctgttgcggggtagatgaatagcctaagaatagtttagacaaattctgaaaacgaatttaccttagaagatgttcatgttagatctggtaaaagtaacatgttatttttctgtcaagccctttttgtacttgccgtttattacatattttagatttattttttattttcgaaacatccaaaaaggaatgctaattagtgaaatggaagaatttccatttcaacaccttaggaaaaaaaaaactgacttgacatacctaagcgttgttacctagataaatgtaggtttgatttcttggaagcatcacttaagactttccattttcttc

SEQ ID NO: 275585 - DNA, 759 bp, Homo sapiens
tgaaatagtgttattaagtgttgaaagtaccataaaaatataagggaaaataagctttcctagaatttttcagtgttctagtttttaaacagtgatgttttttattaacctatttcatccattcaaagacaggcctttctccacaccacattttcctctaaaatcatgataacacttttaaattgatggtgtcttccagtgtgtatcagccagatggcagtgtgttacagttccaggaaaactcgttcacatcttccgtaagatcaagaaggctctggcatcagataagatcaaatgttgtctttctgttttaaatatgtgccgcaaagagatttgcttacaatctattgagaaagctaaaacagagcagacattgtcctgttgcggggtagatgaatagcctaagaatagtttagacaaattctgaaaacgaatttaccttagaagatgttcatgttagatctggtaaaagtaacatgttatttttctgtcaagccctttttgtacttgccgtttattacatattttagatttattttttattttcgaaacatccaaaaaggaatgctaattagtgaaatggaagaatttccatttcaacaccttaggaaaaaaaaaactgacttgacatacctaagaaaaggccaagttgatttactttgtcagtctcttcatttgtgatacgtaaagtccgttgttacctagataaatgtaggtttgatttcttggaagcatcacttaagactttccattttcttc

SEQ ID NO: 275586 - DNA, 345 bp, Homo sapiens
tgatgcacacacatcccactgtgttgccatggctgctggcatccaagtgagcatgaatcctgctgccaccatcttgataaagtgctttggccagcaccacccattaaagtgtaatgaccagcagattgggaacacctcagtccctccagcacagcaggttcctaacctcaaggggccagagagcaaagccagggtcctggtaccagccccccaggagttacaggacacagtccatgagtgatgagctgagccttgttcccctgaaatcttccagaaatgaaaccagttgactgaacccaccctatactacaatcaaacccccaaggacatcaaagaggataagag

SEQ ID NO: 275587 - DNA, 346 bp, Homo sapiens
tttatttttcaagcagaagttacattctctatcaatatgacattacattatagtgctgctagttcttcagggatatgattgattcctatagtagggtggatataggagccttaggcagtgatgctgtatctcaagtgactaagataagatacaggcagctcactgcacagagagccactagccagtttacctagcatgacttacagagcagttttcaccaacactgtacttagactggcatttttagtcctacttttaaatttgaaaagccaaccagtggtcaatcaggaacacattcaatcccatatatttgtaatatttatcttactttatggcaggaattcta

SEQ ID NO: 275588 - DNA, 336 bp, Homo sapiens
gagcattcttgtacatggctcttgtagcacagtgaacacatttctgttgggtgtagagatgtacgtatatgtgtgtgtgtgtgtgtgtgtgtgtgtgtgtgtgtgcatgtatgcttcttaaagagcagctacaatatattgctgtttgcatatacaagcaaaatttctggaaatattaataacaatcatctctgggagtaagatgatgagaatgagaatgctgactttcattttacctttctgaattctaaaaagatttaagcattcagcatgtgttaatgttatttaaaaaaaaactagtttaaaaaataaaatgtttcatccctgagaggtcta

SEQ ID NO: 275589 - DNA, 315 bp, Homo sapiens
gactgcaggcatgtgccactgcaactggtgggtagcgctggagtcttgagcaaatttaacttttagtttctatgcatgttaaatggaaattattaggttggtgcaaatgtaattgcggtttttgcagttgaaagttaggaggccaggcgtggttgctcatgcttgtaatcccagcactttgggcggccgaggtggatagatcacttgaggtcaggagtttgagaccagcccagctaacatggtgaaacccatctctactaaaaatacaaaaattagctgggcgtgatggtcagtgcctgtaatcccagctactcg

SEQ ID NO: 275590 - DNA, 418 bp, Homo sapiens
cagcttatcctcccaaattcagagactggagctagagttcatagccacaactgatacttaaagagagtcttgtagtttacaaagtatttttcatgaccagggaaaacataactgcactcatgcaagaaggaaggagtatcagagggcgaagaagagaacggaggctgtttatataaggatgaattgggatggtatggagccacattcccggggctcttcttggccaagaagtagcttacgcaaggcccatctggctgggtgagttcatttctcagtttgctctccccacgttagtggagatatatggtcggctgctgcctctgctatgcctccctctcctctggcacgcagcaggaggaggatctccacacccagcctctcctcctgagggcccggctcacgtgcacagctgtgtgac

SEQ ID NO: 275591 - DNA, 917 bp, Homo sapiens
cctctgttctaatctgaatcctggtacagtcagactctatcttggacccactggggcgaacccacgagtcttttggtttgcttttaattcctgcaccagctgcggcctttatctgcagccagaaagcagggtttaccgctggccccacagcgccatacggtctggggaaaagaaggaaacccaatagtacacaaacaaaggcccaaagagaaaccttccaagtgctctatgcctcacggtttagcagaaaatatcaagcaactctcaacctagctggtctgtagcttccacaaatgaaatactgtattcattgcagcctttctggttgagatatttcaaatatttggtggagcttttaatgagacggagagacactctcgagtgtggaagaaaaacgtgagggggtgtgaggataaggcgactttaggacagaaaaaacaaagagacaaggaagccacgtaaacgttttcgggtaggcgtgaggcgatgtcagttttgaaccccgttatgttaggtagagagcgcagccctcttctagcacaaacaccgtttcccacattgaagaaatcacagagatcagcaactctagagtgcgatgaagaagcttcactctgggagaacccccttcgtgaccacggtctctttcctgccaggtaagtgggaatgagcgcatgccctgcagggacagcacagcgtcctcgccctggtcggacgctcagggtcaccaccctacccactgcccccttcgccattcttccaaaccactctctgccaaagattccaccgacagtcaccccacacgacaacccaggccgcctttcagcagtggctcccgcccgcaaccacgcgccctctcacccccgcggttctgcccgccgcctctgtccagtctgtgcacttcacctccctggctcccg

SEQ ID NO: 275592 - DNA, 437 bp, Homo sapiens
ggttaggcacagtatgatagggaaaagtgatgcaggccataaaagtgatgcagtatgatagggaaaagtgatgctggctggccctgtgactaagttaggattgcacactgtagcctgaagtttagaggatttggatattaaaagaaattgtgggccgggcgcggtggctcacacctgtaatcccagcactttgggaggccgaggcaggcagatcacgacgtcaggagattgagaccatccaggctaacacggtatttttttctctactgaaaaaaaaaaaaaaaaatttagccaggcatggtggcatgcacctgtagtcccagctacttagcaggctgaggcaggagaatcacttgaacccgggaggcggaggttgcagtgagctgagatcgcaccactgcactccagcctgggtgacagagcaagactccatctca

SEQ ID NO: 275593 - DNA, 607 bp, Homo sapiens
tcaaaaaaaaaaaggaaaagaaaagaaaactaaccaggaaggaaactgcaatccatgtaccttagaccctggaaactccacttttttatttaatcagagctgaaggatgtcagacgtcacagccatggcccagggaatacaggattatgatgggaggaatggtgaccaattgcttctcattgagaaaggaataggcctaaagtatgagtagcaagaaggaaattagatttgaactaagcggaaacttcttaacctgtctaggaaagatgtttcatctcttagaaggggtttgatgtctttttacacatggggaaactgaggctggttatgcatggcctatccagagtcactcagcagagatttggggctcccacccagccacttgaaattctgcaaactttcaagaacagactaaatttttatttacaggagatgatttcatgcttagaagcaaatgatgaaataacttctctggagatctcattcaatactatgattctatgaaatggacaggaaaagaaccaaactagagttggtgacagcacaagaaaaattatggtatccatgctggtctttttttaagaggttagttaccttgaaaagctca

SEQ ID NO: 275594 - DNA, 380 bp, Homo sapiens
tggtctcgatctcctgacctagtgatccgcccgcctcggcctcccagagtgctgagattacaggcatgagtcaccgtgctgggccagcctcttaacattttaacgtctctgaatttagcatgcatcttataattatagtggacagctttctttctttctttctttctttcttttttatgggacgttttaaaggatgtcttattacttttgccagaaaaacagtacatcttttattcagtgacatcctagattcaatgaaatatggtaagttttgaaatctaggtaagaagaacaattttgtagttgaaaataaattcttaaaattgtcctaaaaaatggcagaaaacctgactgagtcagtaagtatagaagatattgga

SEQ ID NO: 275595 - DNA, 1470 bp, Homo sapiens
ccaggatggtctcgatctcctgacctcgtgatccacccgccctggcctcccaaagtgctggggttacaggtgtgagccaccacgcccggcaacacactctttttccctttttaaggaagagaaaggcagagagcaccaagcagataggaggcagggagctggaagtcctccctttgataaaggaggcagttagttgagagtcctctaaagaggctatagattgatgcagctgggaaacggatgggaagaggtgaaggttgcagagccaggaagggcacagttttttttgcctttagaaacctcccttttccttaaccctaatgattctttcatgtttttccctttcttcacaacatcattccctgattccttgaaaatatgaaaaatcctaaaaagaccatgcattgtaattgctttcattttttcaataaaacttctttagtgtttcattatggagaaattaggggaaaaaaagcagataaatgggagaaattaaaaagaagaaaccctctcctctgtatagtcccatcaccaagagataactgttggcaatatccagtaaatattcttcgaatgtttgtcatatatatagttgtttttaagcatttgttttcattccagaaatatacattttaatctaagtgtcatttcttcatacatccagaacaggtatatttacattttctgtcagttgttacagaagatggcccagagcccaaggacaaaggatcattgccacaaccacccattactgaagtggaatcacaggtgttctcagaaaaacttgctactgacacctctacatttgaagctacctctgagggtaccttagaactgcagcagagaaatcccaaagcggagagactgaggtggtcccctgcccaggaggaaagtttcaggcagatggttgtcatccataaggaaattcccacagggaagaaagaccatgaatgtagtgaatgtggtaaaaccttcatttataactcacatcttgttgtccaccagagagttcattctggagagaaaccctataagtgtagtgactgtgggaaaactttcaaacagagctcaaacctcggtcagcatcagagaattcatacaggagagaaacccttcgaatgtaatgaatgtgggaaggccttcagatggggtgctcatcttgttcagcatcagaggattcactcaggagagaagccctatgagtgtaatgagtgtgggaaggcctttagtcaaagctcatatctaagtcagcatcggagaattcacagtggagagaaaccttttatatgtaaagaatgtgggaaagcttatggatggtgctcagagctcattagacatcggagagttcatgccagaaaagagccttcccattgaattgaaggggagaacgtctccagacagaattctacatcggtctaatctactttaggactggatcccataaaagttataagttccttaaaaaaaatc

SEQ ID NO: 275596 - DNA, 2090 bp, Homo sapiens
gcgacgacgacaaggatggggcccatctcttcggagcctaaggatccagcccaggtccagccctgcgcagccgcccaccaagctgccagaagacgagccggacgcccaaggctacgagaggacgattgcagaattgtacaggctagtggttggggaatattttttcgtggaagggaccgtcttccttagctgtggccctctcatcaggtctgggaagaggtaattggaaaatagaactcatggagaagtgttaccacaggccatggacaaggccagaatttccctgacatctgtccgccagcaccgcccttcaggtacaattccacaagagaccccccaaacttgatgaagtcacccgcttacaagggctcactctccacctgcgcaaggactgcaattcccaggggcctccagggcacccggccgctccagtccagtcgtgcaggcggcgcgctctttctcgctccgctcaagtccaggaaccggttcccgggctcccagcctctcggcagcgcccacgcgcctgggccaaagtccgcgaacggaagccggcggcgaggaggattctgggagttggaggccgaggctgcgacctgcgcaggcgcaaacctgcccctggggtgagggctgtaagtggcgcgattcgcggcagcgccccgatggaacctcctggtcctgtgagggggcccttgcaagattccagctggtatgagccttctgcagagctagtgcagactaggatggctgtatcactaacagcagctgaaactctggcccttcagggtacacagggacaagagaagatgatgatgatgggaccaaaggaagaggaacagtcttgtgagtatgagaccaggctacctgggaaccactctaccagtcaagagatcttccgccaacgcttcaggcatctccgctaccaggagactcctggtccccgggaggccttgagccaactacgagtactctgctgtgagtggctgaggccagagaaacacacgaaggagcagatcctggagttcctggtgctggaacaattcttgaccatcctgcctgaggagctccaatcctgggtgcggggacatcaccctaagagtggagaggaggctgtgactgtgctggaggatttagagaaaggacttgaaccagagccgcaggtcccaggccctgcacatggacctgcacaggaagagccatgggagaagaaggaatctctgggagcagcccaggaagcactgagcatccagctccagcctaaggagacccagcctttcccaaagagtgaacaggtatatttacattttctgtcagttgttacagaagatggcccagagcccaaggacaaaggatcattgccacaaccacccattactgaagtggaatcacaggtgttctcagaaaaacttgctactgacacctctacatttgaagctacctctgagggtaccttagaactgcagcagagaaatcccaaagcggagagactgaggtggtcccctgcccaggaggaaagtttcaggcagatggttgtcatccataaggaaattcccacagggaagaaagaccatgaatgtagtgaatgtggtaaaaccttcatttataactcacatcttgttgtccaccagagagttcattctggagagaaaccctataagtgtagtgactgtgggaaaactttcaaacagagctcaaacctcggtcagcatcagagaattcatacaggagagaaacccttcgaatgtaatgaatgtgggaaggccttcagatggggtgctcatcttgttcagcatcagaggattcactcaggagagaagccctatgagtgtaatgagtgtgggaaggcctttagtcaaagctcatatctaagtcagcatcggagaattcacagtggagagaaaccttttatatgtaaagaatgtgggaaagcttatggatggtgctcagagctcattagacatcggagagttcatgccagaaaagagccttcccattgaattgaaggggagaacgtctccagacagaattctacatcggtctaatctactttaggactggatcccataaaagttataagttccttaaaaaaaatc

SEQ ID NO: 275597 - DNA, 2150 bp, Homo sapiens
gcgacgacgacaaggatggggcccatctcttcggagcctaaggatccagcccaggtccagccctgcgcagccgcccaccaagctgccagaagacgagccggacgcccaaggctacgagaggacgattgcagaattgtacaggctagtggttggggaatattttttcgtggaagggaccgtcttccttagctgtggccctctcatcaggtctgggaagaggtaattggaaaatagaactcatggagaagtgttaccacaggccatggacaaggccagaatttccctgacatctgtccgccagcaccgcccttcaggtacaattccacaagagaccccccaaacttgatgaagtcacccgcttacaagggctcactctccacctgcgcaaggactgcaattcccaggggcctccagggcacccggccgctccagtccagtcgtgcaggcggcgcgctctttctcgctccgctcaagtccaggaaccggttcccgggctcccagcctctcggcagcgcccacgcgcctgggccaaagtccgcgaacggaagccggcggcgaggaggattctgggagttggaggccgaggctgcgacctgcgcaggcgcaaacctgcccctggggtgagggctgtaagtggcgcgattcgcggcagcgccccgatggaacctcctggtcctgtgagctgcaagatagaaagcaacatatgcccccaggtggcctccctcaccctggcaatggaaacgaacagccgagcttcaccggacaagactagaaatcgttcctccacccacccagagacaaagcatatttgacttcttcctctactggggcccttgcaagattccagctggtatgagccttctgcagagctagtgcagactaggatggctgtatcactaacagcagctgaaactctggcccttcagggtacacagggacaagagaagatgatgatgatgggaccaaaggaagaggaacagtcttgtgagtatgagaccaggctacctgggaaccactctaccagtcaagagatcttccgccaacgcttcaggcatctccgctaccaggagactcctggtccccgggaggccttgagccaactacgagtactctgctgtgagtggctgaggccagagaaacacacgaaggagcagatcctggagttcctggtgctggaacaattcttgaccatcctgcctgaggagctccaatcctgggtcccaggccctgcacatggacctgcacaggaagagccatgggagaagaaggaatctctgggagcagcccaggaagcactgagcatccagctccagcctaaggagacccagcctttcccaaagagtgaacaggtatatttacattttctgtcagttgttacagaagatggcccagagcccaaggacaaaggatcattgccacaaccacccattactgaagtggaatcacaggtgttctcagaaaaacttgctactgacacctctacatttgaagctacctctgagggtaccttagaactgcagcagagaaatcccaaagcggagagactgaggtggtcccctgcccaggaggaaagtttcaggcagatggttgtcatccataaggaaattcccacagggaagaaagaccatgaatgtagtgaatgtggtaaaaccttcatttataactcacatcttgttgtccaccagagagttcattctggagagaaaccctataagtgtagtgactgtgggaaaactttcaaacagagctcaaacctcggtcagcatcagagaattcatacaggagagaaacccttcgaatgtaatgaatgtgggaaggccttcagatggggtgctcatcttgttcagcatcagaggattcactcaggagagaagccctatgagtgtaatgagtgtgggaaggcctttagtcaaagctcatatctaagtcagcatcggagaattcacagtggagagaaaccttttatatgtaaagaatgtgggaaagcttatggatggtgctcagagctcattagacatcggagagttcatgccagaaaagagccttcccattgaattgaaggggagaacgtctccagacagaattctacatcggtctaatctactttaggactggatcccataaaagttataagttccttaaaaaaaatc

SEQ ID NO: 275598 - DNA, 1990 bp, Homo sapiens
gcgacgacgacaaggatggggcccatctcttcggagcctaaggatccagcccaggtccagccctgcgcagccgcccaccaagctgccagaagacgagccggacgcccaaggctacgagaggacgattgcagaattgtacaggctagtggttggggaatattttttcgtggaagggaccgtcttccttagctgtggccctctcatcaggtctgggaagaggtaattggaaaatagaactcatggagaagtgttaccacaggccatggacaaggccagaatttccctgacatctgtccgccagcaccgcccttcaggtacaattccacaagagaccccccaaacttgatgaagtcacccgcttacaagggctcactctccacctgcgcaaggactgcaattcccaggggcctccagggcacccggccgctccagtccagtcgtgcaggcggcgcgctctttctcgctccgctcaagtccaggaaccggttcccgggctcccagcctctcggcagcgcccacgcgcctgggccaaagtccgcgaacggaagccggcggcgaggaggattctgggagttggaggccgaggctgcgacctgcgcaggcgcaaacctgcccctggggtgagggctgtaagtggcgcgattcgcggcagcgccccgatggaacctcctggtcctgtgagggtacacagggacaagagaagatgatgatgatgggaccaaaggaagaggaacagtcttgtgagtatgagaccaggctacctgggaaccactctaccagtcaagagatcttccgccaacgcttcaggcatctccgctaccaggagactcctggtccccgggaggccttgagccaactacgagtactctgctgtgagtggctgaggccagagaaacacacgaaggagcagatcctggagttcctggtgctggaacaattcttgaccatcctgcctgaggagctccaatcctgggtgcggggacatcaccctaagagtggagaggaggctgtgactgtgctggaggatttagagaaaggacttgaaccagagccgcaggtcccaggccctgcacatggacctgcacaggaagagccatgggagaagaaggaatctctgggagcagcccaggaagcactgagcatccagctccagcctaaggagacccagcctttcccaaagagtgaacaggtatatttacattttctgtcagttgttacagaagatggcccagagcccaaggacaaaggatcattgccacaaccacccattactgaagtggaatcacaggtgttctcagaaaaacttgctactgacacctctacatttgaagctacctctgagggtaccttagaactgcagcagagaaatcccaaagcggagagactgaggtggtcccctgcccaggaggaaagtttcaggcagatggttgtcatccataaggaaattcccacagggaagaaagaccatgaatgtagtgaatgtggtaaaaccttcatttataactcacatcttgttgtccaccagagagttcattctggagagaaaccctataagtgtagtgactgtgggaaaactttcaaacagagctcaaacctcggtcagcatcagagaattcatacaggagagaaacccttcgaatgtaatgaatgtgggaaggccttcagatggggtgctcatcttgttcagcatcagaggattcactcaggagagaagccctatgagtgtaatgagtgtgggaaggcctttagtcaaagctcatatctaagtcagcatcggagaattcacagtggagagaaaccttttatatgtaaagaatgtgggaaagcttatggatggtgctcagagctcattagacatcggagagttcatgccagaaaagagccttcccattgaattgaaggggagaacgtctccagacagaattctacatcggtctaatctactttaggactggatcccataaaagttataagttccttaaaaaaaatc

SEQ ID NO: 275599 - DNA, 1228 bp, Homo sapiens
tgtagggggaggtgccaagttcaaacctctcttgggccaggtagagcagttagtatgtgtttctgtgtctgtcttttctgccctcgagccctgaatgagaaagagactctagctcctcttcttcccttgtgctgactctgaggaggctctctaaagtctccttggaagctttggtccaaggagggtcacatctgcaagtgtccaggcaggggacagaaaccacactagtaatttgaagaaaatttaaactgagtggtgcctgatcacctccaggtcccaggccctgcacatggacctgcacaggaagagccatgggagaagaaggaatctctgggagcagcccaggaagcactgagcatccagctccagcctaaggagacccagcctttcccaaagagtgtgtcatttcttcatacatccagaacaggtatatttacattttctgtcagttgttacagaagatggcccagagcccaaggacaaaggatcattgccacaaccacccattactgaagtggaatcacaggtgttctcagaaaaacttgctactgacacctctacatttgaagctacctctgagggtaccttagaactgcagcagagaaatcccaaagcggagagactgaggtggtcccctgcccaggaggaaagtttcaggcagatggttgtcatccataaggaaattcccacagggaagaaagaccatgaatgtagtgaatgtggtaaaaccttcatttataactcacatcttgttgtccaccagagagttcattctggagagaaaccctataagtgtagtgactgtgggaaaactttcaaacagagctcaaacctcggtcagcatcagagaattcatacaggagagaaacccttcgaatgtaatgaatgtgggaaggccttcagatggggtgctcatcttgttcagcatcagaggattcactcaggagagaagccctatgagtgtaatgagtgtgggaaggcctttagtcaaagctcatatctaagtcagcatcggagaattcacagtggagagaaaccttttatatgtaaagaatgtgggaaagcttatggatggtgctcagagctcattagacatcggagagttcatgccagaaaagagccttcccattgaattgaaggggagaacgtctccagacagaattctacatcggtctaatctactttaggactggatcccataaaagttataagttccttaaaaaaaatc

SEQ ID NO: 275600 - DNA, 1206 bp, Homo sapiens
tgtagggggaggtgccaagttcaaacctctcttgggccaggtagagcagttagtatgtgtttctgtgtctgtcttttctgccctcgagccctgaatgagaaagagactctagctcctcttcttcccttgtgctgactctgaggaggctctctaaagtctccttggaagctttggtccaaggagggtcacatctgcaagtgtccaggcaggggacagaaaccacactagtaatttgaagaaaatttaaactgagtggtgcctgatcacctccaggtcccaggccctgcacatggacctgcacaggaagagccatgggagaagaaggaatctctgggagcagcccaggaagcactgagcatccagctccagcctaaggagacccagcctttcccaaagagtgaacaggtatatttacattttctgtcagttgttacagaagatggcccagagcccaaggacaaaggatcattgccacaaccacccattactgaagtggaatcacaggtgttctcagaaaaacttgctactgacacctctacatttgaagctacctctgagggtaccttagaactgcagcagagaaatcccaaagcggagagactgaggtggtcccctgcccaggaggaaagtttcaggcagatggttgtcatccataaggaaattcccacagggaagaaagaccatgaatgtagtgaatgtggtaaaaccttcatttataactcacatcttgttgtccaccagagagttcattctggagagaaaccctataagtgtagtgactgtgggaaaactttcaaacagagctcaaacctcggtcagcatcagagaattcatacaggagagaaacccttcgaatgtaatgaatgtgggaaggccttcagatggggtgctcatcttgttcagcatcagaggattcactcaggagagaagccctatgagtgtaatgagtgtgggaaggcctttagtcaaagctcatatctaagtcagcatcggagaattcacagtggagagaaaccttttatatgtaaagaatgtgggaaagcttatggatggtgctcagagctcattagacatcggagagttcatgccagaaaagagccttcccattgaattgaaggggagaacgtctccagacagaattctacatcggtctaatctactttaggactggatcccataaaagttataagttccttaaaaaaaatc

SEQ ID NO: 275601 - DNA, 2112 bp, Homo sapiens
ggggctttcaccatgctggccaggctggtctcgaactcctgagcccagctgatccacccgcctcggtttcccaaagtgctgggattacaggcgtgagccactgcgcctggccagaactcagtccttacagaacatcagagaatccatacaaggaattgtacaggctagtggttggggaatattttttcgtggaagggaccgtcttccttagctgtggccctctcatcaggtctgggaagaggtaattggaaaatagaactcatggagaagtgttaccacaggccatggacaaggccagaatttccctgacatctgtccgccagcaccgcccttcaggtacaattccacaagagaccccccaaacttgatgaagtcacccgcttacaagggctcactctccacctgcgcaaggactgcaattcccaggggcctccagggcacccggccgctccagtccagtcgtgcaggcggcgcgctctttctcgctccgctcaagtccaggaaccggttcccgggctcccagcctctcggcagcgcccacgcgcctgggccaaagtccgcgaacggaagccggcggcgaggaggattctgggagttggaggccgaggctgcgacctgcgcaggcgcaaacctgcccctggggtgagggctgtaagtggcgcgattcgcggcagcgccccgatggaacctcctggtcctgtgagggggcccttgcaagattccagctggtatgagccttctgcagagctagtgcagactaggatggctgtatcactaacagcagctgaaactctggcccttcagggtacacagggacaagagaagatgatgatgatgggaccaaaggaagaggaacagtcttgtgagtatgagaccaggctacctgggaaccactctaccagtcaagagatcttccgccaacgcttcaggcatctccgctaccaggagactcctggtccccgggaggccttgagccaactacgagtactctgctgtgagtggctgaggccagagaaacacacgaaggagcagatcctggagttcctggtgctggaacaattcttgaccatcctgcctgaggagctccaatcctgggtgcggggacatcaccctaagagtggagaggaggctgtgactgtgctggaggatttagagaaaggacttgaaccagagccgcaggtcccaggccctgcacatggacctgcacaggaagagccatgggagaagaaggaatctctgggagcagcccaggaagcactgagcatccagctccagcctaaggagacccagcctttcccaaagagtgaacaggtatatttacattttctgtcagttgttacagaagatggcccagagcccaaggacaaaggatcattgccacaaccacccattactgaagtggaatcacaggtgttctcagaaaaacttgctactgacacctctacatttgaagctacctctgagggtaccttagaactgcagcagagaaatcccaaagcggagagactgaggtggtcccctgcccaggaggaaagtttcaggcagatggttgtcatccataaggaaattcccacagggaagaaagaccatgaatgtagtgaatgtggtaaaaccttcatttataactcacatcttgttgtccaccagagagttcattctggagagaaaccctataagtgtagtgactgtgggaaaactttcaaacagagctcaaacctcggtcagcatcagagaattcatacaggagagaaacccttcgaatgtaatgaatgtgggaaggccttcagatggggtgctcatcttgttcagcatcagaggattcactcaggagagaagccctatgagtgtaatgagtgtgggaaggcctttagtcaaagctcatatctaagtcagcatcggagaattcacagtggagagaaaccttttatatgtaaagaatgtgggaaagcttatggatggtgctcagagctcattagacatcggagagttcatgccagaaaagagccttcccattgaattgaaggggagaacgtctccagacagaattctacatcggtctaatctactttaggactggatcccataaaagttataagttccttaaaaaaaatc

SEQ ID NO: 275602 - DNA, 1917 bp, Homo sapiens
gcgacgacgacaaggatggggcccatctcttcggagcctaaggatccagcccaggtccagccctgcgcagccgcccaccaagctgccagaagacgagccggacgcccaaggctacgagaggacgattgcagaattgtacaggctagtggttggggaatattttttcgtggaagggaccgtcttccttagctgtggccctctcatcaggtctgggaagaggtaattggaaaatagaactcatggagaagtgttaccacaggccatggacaaggccagaatttccctgacatctgtccgccagcaccgcccttcaggtacaattccacaagagaccccccaaacttgatgaagtcacccgcttacaagggctcactctccacctgcgcaaggactgcaattcccaggggcctccagggcacccggccgctccagtccagtcgtgcaggcggcgcgctctttctcgctccgctcaagtccaggaaccggttcccgggctcccagcctctcggcagcgcccacgcgcctgggccaaagtccgcgaacggaagccggcggcgaggaggattctgggagttggaggccgaggctgcgacctgcgcaggcgcaaacctgcccctggggtgagggctgtaagtggcgcgattcgcggcagcgccccgatggaacctcctggtcctgtgagctgcaagatagaaagcaacatatgcccccaggtggcctccctcaccctggcaatggaaacgaacagccgagcttcaccggacaagactagaaatcgttcctccacccacccagagacaaagcatatttgacttcttcctctactggggcccttgcaagattccagctggtatgagccttctgcagagctagtgcagactaggatggctgtatcactaacagcagctgaaactctggcccttcagggtacacagggacaagagaagatgatgatgatgggaccaaaggaagaggaacagtcttgtcccaggccctgcacatggacctgcacaggaagagccatgggagaagaaggaatctctgggagcagcccaggaagcactgagcatccagctccagcctaaggagacccagcctttcccaaagagtgaacaggtatatttacattttctgtcagttgttacagaagatggcccagagcccaaggacaaaggatcattgccacaaccacccattactgaagtggaatcacaggtgttctcagaaaaacttgctactgacacctctacatttgaagctacctctgagggtaccttagaactgcagcagagaaatcccaaagcggagagactgaggtggtcccctgcccaggaggaaagtttcaggcagatggttgtcatccataaggaaattcccacagggaagaaagaccatgaatgtagtgaatgtggtaaaaccttcatttataactcacatcttgttgtccaccagagagttcattctggagagaaaccctataagtgtagtgactgtgggaaaactttcaaacagagctcaaacctcggtcagcatcagagaattcatacaggagagaaacccttcgaatgtaatgaatgtgggaaggccttcagatggggtgctcatcttgttcagcatcagaggattcactcaggagagaagccctatgagtgtaatgagtgtgggaaggcctttagtcaaagctcatatctaagtcagcatcggagaattcacagtggagagaaaccttttatatgtaaagaatgtgggaaagcttatggatggtgctcagagctcattagacatcggagagttcatgccagaaaagagccttcccattgaattgaaggggagaacgtctccagacagaattctacatcggtctaatctactttaggactggatcccataaaagttataagttccttaaaaaaaatc

SEQ ID NO: 275603 - DNA, 1343 bp, Homo sapiens
gcgacgacgacaaggatggggcccatctcttcggagcctaaggatccagcccaggtccagccctgcgcagccgcccaccaagctgccagaagacgagccggacgcccaaggctacgagaggacgattgcagaattgtacaggctagtggttggggaatattttttcgtggaagggaccgtcttccttagctgtggccctctcatcaggtctgggaagaggtaattggaaaatagaactcatggagaagtgttaccacaggccatggacaaggccagaatttccctgacatctgtccgccagcaccgcccttcaggtacaattccacaagagaccccccaaacttgatgaagtcacccgcttacaagggctcactctccacctgcgcaaggactgcaattcccaggggcctccagggcacccggccgctccagtccagtcgtgcaggcggcgcgctctttctcgctccgctcaagtccaggaaccggttcccgggctcccagcctctcggcagcgcccacgcgcctgggccaaagtccgcgaacggaagccggcggcgaggaggattctgggagttggaggccgaggctgcgacctgcgcaggcgcaaacctgcccctggggtgagggctgtaagtggcgcgattcgcggcagcgccccgatggaacctcctggtcctgtgagggggcccttgcaagattccagctggtatgagccttctgcagagctagtgcagactaggatggctgtatcactaacagcagctgaaactctggcccttcagggtacacagggacaagagaagatgatgatgatgggaccaaaggaagaggaacagtcttgtgagtatgagaccaggctacctgggaaccactctaccagtcaagagatcttccgccaacgcttcaggcatctccgctaccaggagactcctggtccccgggaggccttgagccaactacgagtactctgctgtgagtggctgaggccagagaaacacacgaaggagcagatcctggagttcctggtgctggaacaattcttgaccatcctgcctgaggagctccaatcctgggtgcggggacatcaccctaagagtggagaggaggctgtgactgtgctggaggatttagagaaaggacttgaaccagagccgcaggtcccaggccctgcacatggacctgcacaggaagagccatgggagaagaaggaatctctgggagcagcccaggaagcactgagcatccagctccagcctaaggagacccagcctttcccaaagagtgtcgttcccgaagatggccagagccaggacaagggtcctgcacaacaccattatgaaggg

SEQ ID NO: 275604 - DNA, 576 bp, Homo sapiens
aaaaaaaagaaaaaacgaaaaggaaaaaagaaaaacgatgacaaggaagacattaccacatctctgttaggcattaaaaagactttatgttgagggagtatactcttctactcagtgagtttgtgtgtgatttgcatttgaatgcaaactaattatatttgctctaaagaaagtacgtatgttgtacttactgtatatactttgtttttctcataaggttgatgaatttttctcattctgttattttgtggggtagctagaagacgaagggttataggagaagcctgcaaattcaaggttaagtcaattggctcagaatgagtttttttcacctttgcctcattagcactactctttaattaagtctattataaatcacaaataacaaagccctttaactttatatatatagaaggagatgtgaatatatatcatatatatgcatatatacacagacacagatatatatacgtaggtacacactgtgtgtgtatgtgtaaaactatgtctatactgatttaattcacagttgttttatactcagagtaatatgtggaggctattttcttgtttata

SEQ ID NO: 275605 - DNA, 409 bp, Homo sapiens
aagttttctaactagatttctggattttctttctttttttctctttttcaatcttctttcttcttttgttgttatggattttgtccatttgttgttgttagttgtttcaggaatttatttgcaatcactttttgctaatttcaataaaggccttagatcaactgttctgacccaagatcaacactacacatcttccagcttttaagatgagacaaaagaaaaagaacagaagtctggggtcccacacatactatgtttccagatgactgtatttttttcaacaaatagtgggacaaactatgctggtccttgtggctagggccagtcctgggaacactaatgagagaaatgaggggaccttagctggaatgaggtcagggcctcctggcactaccacactgcaatctca

SEQ ID NO: 275606 - DNA, 3602 bp, Homo sapiens
taaaacaaagtgaaatgtaatcatacgatgtactttttttaatgccgttgaaacagagttaatttcctttagcacacaagtcttagagacaaaagaaaaaaaggtctgcaacatgaaagtcacaggcatcacaatcctcttttggcccctctccatgatattattatcagacaaaatccagtcttctaaaagagaagtccaatgtaattttactgaaaaaaattataccttgattccagcagatatcaagaaagatgttactatacttgatctcagttataaccaaattactcttaatggtacagacacaagagttctacagacatactttttactcacagagctctatttgattgagaacaaggttactatcttacataataacggttttggtaacctctccagtctagaaattttaaatatctgtagaaactccatctatgtaattcaacagggtgcatttttaggcttaaataaactaaaacagttatatctctgccaaaacaaaatagaacaactgaatgctgatgtatttgtgcctctaagaagcctaaaacttctgaatctgcaaggcaatttgattagctatttggatgtaccaccactatttcatctggaattaataactttatatggaaacctatggaactgctcttgcagtctatttaatttgcagaactggttgaacacatcaaatgtgacattagaaaatgagaacatcaccatgtgtagctaccccaacagcctgcagagctacaatatcaaaacagtacctcataaggctgaatgccactcaaaatttccttcatcagtaactgaagatctttatattcattttcagcccatcagcaattcaatatttaatagctcttcgaacaacttaacaagaaattcagaacatgaacctcttggaaaaagttgggcttttcttgttggtgttgttgtcactgtactgacgacttcacttctcatttttattgctatcaaatgcccaatatggtacaatattctgcttagttataatcatcatcgcctggaagagcatgaagcagaaacctatgaagatggttttactggaaatccaagctctctttcacagataccagaaacaaactctgaagaaactacagtaatatttgaacaattacattcatttgtggtagatgatgatggatttattgaagacaaatatatagatatccatgaattatgtgaagaaaattaatttctttcaaagtttgctttttaaagcaaagttatcagctcactcagtttagatatggagattttgctatgtgacataacaaaatacagctggcaggcattcatattaatgacaacatacatgaatatcataaaattatgttctttgcattatattgagcaagcaggttcaaatacagtaactgacactcctcggtagttgacagttacatagtctacaatactagcactactattcttagcagtgcttgggtgaccatacgaactagtaaaaaggtctaaattattcatgaattaaaatgaatggattctcatattaacacaggtatttgacataatatgtattaagttatactaatgtttcaatcagtaaagaaataaaagtttaggatttattaatatatggaagtcaaagtgaggaacagagatagcttaaataatacactaagattgattttatgctcccagaataaaatcatagagttggaaaatatttttttgaaatgcttcctgaaatagcacaataaatttcccttaaaatttcatagcaatttaaagcacaagcacaatgttcaggcataatccctaataagtcactattgattctggttataaagaaaggctgtcaccataatgcaggatcactacagtttaatgtcatactggcttccaaagtgggcatcacaattatctataaatcttgttttaaaaatacatatttctacctctctctgggagatttttattcaaattggtctgtgctgacactaaggaatcttcatgtggtccatggacagctatttctatctattcagtagatagagcaatgtttcccaaattgtttttctagaatactaatttccagagagacattcacaagtatttacagaagaagaaggaggtacatggtcaaattactacaggaaaaactagtagtttaaacaaggtgaaacaagattctttttcttttttttttttttttttttgagacaaagtctcgcactgtctcccaggctggactgcagcagcgcagtctcagatcactgcaacctccgcctcctgggttcaagcaattcttctgactcagcctcccgagtagctgggagtacaggtgcacaccaccatgcctggctaatttctgtatttttagtagagacagggtttcaccatgttggccaggctggtctcgaacgcctgacctcatgatctacccgcctcggcctcccaaagtgctgggattacaggcatggagcaccgtgcctggccaagattctttacaataggatttatgtaaaactttactaagctaaactgctctctgattattcaagagcaaagtattaaaaatttctcaaacttacttgacaacaaaacccattctttcagttacatctactaagagctcgtagttcaataacattccaaagaacgtagtttggaaaacactggcctatcggctgtaataggaagggtctaaagaaaattatttgctgagtcctcataatcaattggctataatcacaatttaataatttatcaatgcaaacagtacattaaaaactgtagcacaatctataatttttaccttcatatgcagagaaattaagaatttacatcttttacaaatatgtatatctctgaaataatgaaatatattgatgggtgaaataatatttctggtattttcttcattataacacgtggaatggaacagtggctagaggtatggatggagcaaggtcaaatatgagctgatggagctgggagctaaataagggtataatatgctacttctgtgtatgttgtgtatggtatagtatgctatttctgtgtatgttcaaattgtttatgtatataataaagttttaaaaatttgtatgtacttgacaattccttagaaaaaagaggctaaaataaaatagatctacgtcataatctatagaatagtcattttaaaagttacataattagtaaattcaatacaaatgtctactgagagaaaataaaaactaggatgatatacctgtaaaatagaagaacttactaatttataatacatatttgcttgtgtttacagacacatgttttcaacaaaggatataagtatattatggctaatgtttctttatatatcaattatactttgttttaaaccttaattataagaatgagatgattataggaacataaaatatctttttctaaacaatgtatcattctgctaaattatttcctaattataagatgcaaatattaatatttgagaaatgtagcaaaatgaaatataattgcaaatgagcaaagactacacttaagcttttatattcaagggcctctgttgaatatggggtattcaataaatatctgactacacaaag

SEQ ID NO: 275607 - DNA, 3157 bp, Homo sapiens
taaaacaaagtgaaatgtaatcatacgatgtactttttttaatgccgttgaaacagagttaatttcctttagcacacaagtcttagagacaaaagaaaaaaaggtctgcaacatgaaagtcacaggcatcacaatcctcttttggcccctctccatgatattattatcagacaaaatccagtcttctaaaagagaagtccaatgtaattttactgaaaaaaattataccttgattccagcagatatcaagaaagatgttactatacttgatctcagttataaccaaattactcttaatggtacagacacaagagttctacagacatactttttactcacagagctctatttgattgagaacaaggttactatcttacataataacggttttggtaacctctccagtctagaaattttaaatatctgtagaaactccatctatgtaattcaacagggtgcatttttaggcttaaataaactaaaacagttatatctctgccaaaacaaaatagaacaactgaatgctgatgtatttgtgcctctaagaagcctaaaacttctgaatctgcaaggcaatttgattagctatttggatgtaccaccactatttcatctggaattaataactttatatggaaacctatggaactgctcttgcagtctatttaatttgcagaactggttgaacacatcaaatgtgacattagaaaatgagaacatcaccatgtgtagctaccccaacagcctgcagagctacaatatcaaaacagtacctcataaggctgaatgccactcaaaatttccttcatcagtaactgaagatctttatattcattttcagcccatcagcaattcaatatttaatagctcttcgaacaacttaacaagaaattcagaacatgaacctcttggaaaaagttgggcttttcttgttggtgttgttgtcactgtactgacgacttcacttctcatttttattgctatcaaatgcccaatatggtacaatattctgcttagttataatcatcatcgcctggaagagcatgaagcagaaacctatgaagatggttttactggaaatccaagctctctttcacagataccagaaacaaactctgaagaaactacagtaatatttgaacaattacattcatttgtggtagatgatgatggatttattgaagacaaatatatagatatccatgaattatgtgaagaaaattaatttctttcaaagtttgctttttaaagcaaagttatcagctcactcagtttagatatggagattttgctatgtgacataacaaaatacagctggcaggcattcatattaatgacaacatacatgaatatcataaaattatgttctttgcattatattgagcaagcaggttcaaatacagtaactgacactcctcggtagttgacagttacatagtctacaatactagcactactattcttagcagtgcttgggtgaccatacgaactagtaaaaaggtctaaattattcatgaattaaaatgaatggattctcatattaacacaggtatttgacataatatgtattaagttatactaatgtttcaatcagtaaagaaataaaagtttaggatttattaatatatggaagtcaaagtgaggaacagagatagcttaaataatacactaagattgattttatgctcccagaataaaatcatagagttggaaaatatttttttgaaatgcttcctgaaatagcacaataaatttcccttaaaatttcatagcaatttaaagcacaagcacaatgttcaggcataatccctaataagtcactattgattctggttataaagaaaggctgtcaccataatgcaggatcactacagtttaatgtcatactggcttccaaagtgggcatcacaattatctataaatcttgttttaaaaatacatatttctacctctctctgggagatttttattcaaattggtctgtgctgacactaaggaatcttcatgtggtccatggacagctatttctatctattcagtagatagagcaatgtttcccaaattgtttttctagaatactaatttccagagagacattcacaagtatttacagaagaagaaggaggtacatggtcaaattactacaggaaaaactagtagtttaaacaaggtgaaacaagattctttttcttttttttttttttttttttgagacaaagtctcgcactgtctcccaggctggactgcagcagcgcagtctcagatcactgcaacctccgcctcctgggttcaagcaattcttctgactcagcctcccgagtagctgggagtacaggtgcacaccaccatgcctggctaatttctgtatttttagtagagacagggtttcaccatgttggccaggctggtctcgaacgcctgacctcatgatctacccgcctcggcctcccaaagtgctgggattacaggcatggagcaccgtgcctggccaagattctttacaataggatttatgtaaaactttactaagctaaactgctctctgattattcaagagcaaagtattaaaaatttctcaaacttacttgacaacaaaacccattctttcagttacatctactaagagctcgtagttcaataacattccaaagaacgtagtttggaaaacactggcctatcggctgtaataggaagggtctaaagaaaattatttgctgagtcctcataatcaattggctataatcacaatttaataatttatcaatgcaaacagtacattaaaaactgtagcacaatctataatttttaccttcatatgcagagaaattaagaatttacatcttttacaaatatgtatatctctgaaataatgaaatatattgatgggtgaaataatatttctggtattttcttcattataacacgtggaatggaacagtggctagaggtatggatggagcaaggtcaaatatgagctgatggagctgggagctaaataagggtataatatgctacttctgtgtatgttgtgtatggtatagtatgctatttctgtgtatgttcaaattgtttatgtatataataaagttttaaaaatttgtatgtacttgacaattccttagaaaaaagaggctaaaataaaatagatctacgtcat

SEQ ID NO: 275608 - DNA, 3494 bp, Homo sapiens
taaaacaaagtgaaatgtaatcatacgatgtactttttttaatgccgttgaaacagagttaatttcctttagcacacaagtcttagagacaaaagaaaaaaaggtctgcaacatgaaagtcacaggcatcacaatcctcttttggcccctctccatgatattattatcagacaaaatccagtcttctaaaagagaagtccaatgtaattttactgaaaaaaattataccttgattccagcagatatcaagaaagatgttactatacttgatctcagttataaccaaattactcttaatggtacagacacaagagttctacagacatactttttactcacagagctctatttgattgagaacaaggttactatcttacataataacggttttggtaacctctccagtctagaaattttaaatatctgtagaaactccatctatgtaattcaacagggtgcatttttaggcttaaataaactaaaacagttatatctctgccaaaacaaaatagaacaactgaatgctgatgtatttgtgcctctaagaagcctaaaacttctgaatctgcaaggcaatttgattagctatttggatgtaccaccactatttcatctggaattaataactttatatggaaacctatggaactgctcttgcagtctatttaatttgcagaactggttgaacacatcaaatgtgacattagaaaatgagaacatcaccatgtgtagctaccccaacagcctgcagagctacaatatcaaaacagtacctcataaggctgaatgccactcaaaatttccttcatcagtaactgaagatctttatattcattttcagcccatcagcaattcaatatttaatagctcttcgaacaacttaacaagaaattcagaacatgaacctcttggaaaaagttgggcttttcttgttggtgttgttgtcactgtactgacgacttcacttctcatttttattgctatcaaatgcccaatatggtacaatattctgcttagttataatcatcatcgcctggaagagcatgaagcagaaacctatgaagatggttttactggaaatccaagctctctttcacagataccagaaacaaactctgaagaaactacagtaatatttgaacaattacattcatttgtggtagatgatgatggatttattgaagacaaatatatagatatccatgaattatgtgaagaaaattaatttctttcaaagtttgctttttaaagcaaagttatcagctcactcagtttagatatggagattttgctatgtgacataacaaaatacagctggcaggcattcatattaatgacaacatacatgaatatcataaaattatgttctttgcattatattgagcaagcaggttcaaatacagtaactgacactcctcggtagttgacagttacatagtctacaatactagcactactattcttagcagtgcttgggtgaccatacgaactagtaaaaaggtctaaattattcatgaattaaaatgaatggattctcatattaacacaggtatttgacataatatgtattaagttatactaatgtttcaatcagtaaagaaataaaagtttaggatttattaatatatggaagtcaaagtgaggaacagagatagcttaaataatacactaagattgattttatgctcccagaataaaatcatagagttggaaaatatttttttgaaatgcttcctgaaatagcacaataaatttcccttaaaatttcatagcaatttaaagcacaagcacaatgttcaggcataatccctaataagtcactattgattctggttataaagaaaggctgtcaccataatgcaggatcactacagtttaatgtcatactggcttccaaagtgggcatcacaattatctataaatcttgttttaaaaatacatatttctacctctctctgggagatttttattcaaattggtctgtgctgacactaaggaatcttcatgtggtccatggacagctatttctatctattcagtagatagagcaatgtttcccaaattgtttttctagaatactaatttccagagagacattcacaagtatttacagaagaagaaggaggtacatggtcaaattactacaggaaaaactagtagtttaaacaaggtgaaacaagattctttttcttttttttttttttttttttgagacaaagtctcgcactgtctcccaggctggactgcagcagcgcagtctcagatcactgcaacctccgcctcctgggttcaagcaattcttctgactcagcctcccgagtagctgggagtacaggtgcacaccaccatgcctggctaatttctgtatttttagtagagacagggtttcaccatgttggccaggctggtctcgaacgcctgacctcatgatctacccgcctcggcctcccaaagtgctgggattacaggcatggagcaccgtgcctggccaagattctttacaataggatttatgtaaaactttactaagctaaactgctctctgattattcaagagcaaagtattaaaaatttctcaaacttacttgacaacaaaacccattctttcagttacatctactaagagctcgtagttcaataacattccaaagaacgtagtttggaaaacactggcctatcggctgtaataggaagggtctaaagaaaattatttgctgagtcctcataatcaattggctataatcacaatttaataatttatcaatgcaaacagtacattaaaaactgtagcacaatctataatttttaccttcatatgcagagaaattaagaatttacatcttttacaaatatgtatatctctgaaataatgaaatatattgatgggtgaaataatatttctggtattttcttcattataacacgtggaatggaacagtggctagaggtatggatggagcaaggtcaaatatgagctgatggagctgggagctaaataagggtataatatgctacttctgtgtatgttgtgtatggtatagtatgctatttctgtgtatgttcaaattgtttatgtatataataaagttttaaaaatttgaaaaaaaaaaaaaaaacaaaaaaaaaaaaaacaaaccaaacagaaaaaaaaaacaaaaaaacaacaacaacaaaacagagggggggcggcggcgcgccgccgcactaaaaactccccgcgaggaggggcgcccccaccatcgtgtcgcattgccccacccccgccaggttgttgcggtgcaaaaagaggggcgcgccccctgaaggagaggggcggcatattaataacgaaccgaggagagcggaggcgagcgacgttcaaaaacaaacggagtgtcgatggcggggaaaaaaacgccgtcgatcgcaggacgagtcatgtcgggggcaagaagaccaacccaacactcccgcgggggggcgacgacaatctggggggacgaaacccccagcac

SEQ ID NO: 275609 - DNA, 502 bp, Homo sapiens
aaaaatttatcaacattgtgagaaaacattgcatttgccactcaaaagtaactggacaaaagaaccactaaattggtaagataattagaagtgaatgtcttgatttccttcactgagaagaataaaaaattaatattaactgacaacatattaaggagaggttattggtttattaaccattcacaagattataaagtgcttgcactatgctgagtaccctgcacagtggtacagggaaatacaagaggagagcaagaaagttccttctcaagtagcccagaattgtgtgggatcaaataatttgtactgctcagaacaagattattgcatgtcctttgactccttgaaatatcaaaagttttccatacctcaatgtatgtatgggtaagacatcaccatcattgaattttgctacatgataataaatacaccatttgagcttgttcatattgtcatggcaagagcctgacagattattgggataatcaacttattggagtcg

SEQ ID NO: 275610 - DNA, 414 bp, Homo sapiens
catgttaatatcatgctgcaaaaaaatataacttaaaaagtactcaaatttttggtaggtctagcatgaacctattataccataaagaactaccctgagctgggtgcggtggctcacagctgtaatcccagcactttggaaggctgaggtgggaggatgacttgagcccaggagtttgagactggcctggacaacacagtgagaccttgtctttataaaaaatcaaaaggaaaaaacaaaacaaaacaaaacaaaaaacaaaaaaaactatcctgaaccagactcttagtatttactttaatcttcatgggacagagagacagaaaaaatagttgtcacatgatgactaggggaggtacatatcaagtttcttagagatagcagatttagcttttctacccaagagctgctcag

SEQ ID NO: 275611 - DNA, 323 bp, Homo sapiens
cgccgttgcagtccaacctgagcgtccgagcgagactctatctcagaaaataaagacagaatgaaagagcccggcgcggtggcttacgcctgtaatcccagcgctttgggaggccgaggcgggcggatcgcctgaggtcaggagctcgagaccagcctggccgacatggcgaaaccccctaaaaatacaaaaattagccgggcgtggtggcctgcgcctgtaatcccagctacccaggaggctgaggcaggagaatcgctggaacccgggaggtagaggctgcagtgagccgagatcgcgccactgcactccagcctgggcga

SEQ ID NO: 275612 - DNA, 215 bp, Homo sapiens
ctgtggctgtgtttattcttgtgtcatttagatgtctacgtttatatcgtgaggagagtctctttgaccagataagagtataagatatagctcatcctaattgacaaaattagtcacccacaaaattagtttagaggagacatagtcaacatctaccacgtaatggaatggggaaattttgtcctggagagtgaaaaaagaaaaaacaaacaaac

SEQ ID NO: 275613 - DNA, 421 bp, Homo sapiens
caaaaaggaaaatgaaaaaactttaatggtgaaaaaaagaaaaggcttctggtttgctctgattgggggttgttggctgactagaaatggggcaacttatgtgattggtttgaggatctatttggttttctctggttggttctggttggagtgaggcaaaatactggcagtcactgaccattctgggctgatggctgcagaggctgtgggtcagagttctactttcatacatggtctggccattgtctatttgtacattcactctctgacacatattctattattatatctttgcctcctgatttttaagttttaaatcttcagaaaatgtgtctatttaatgagttattattaaagtttttaaattattttttctgtcatgtacaaacattataagagaaaaattctccatattgtatgc

SEQ ID NO: 275614 - DNA, 447 bp, Homo sapiens
tttttctagttctgtgaagaatgatggtggtattttgatgggaactgcattaaatttgttgattgtttttggcagtatggtcattttcacaatattgattctactcatccgtgagctacatgtaaaattctttatatatctagaaacaaattatttatctgctaaatgtgttgtacatattatctcccaatcttgccctttgactttacctacaataaatttttgatatataagaattttcattttgatttagtcaaatgtaagctcataattctatcccttgatttttcatttttagttttagatgtgataatatttaactgttcacacacacacacacacacacacacacacacccctcaactcccaccacctgaataaacccttacttcctcttctcctaaatatggttacatcatcatattggttaaatcaatatttaatgtt

SEQ ID NO: 275615 - DNA, 248 bp, Homo sapiens
ccaaagtgctgggattacaggtgtgagccaccgggcccggcctttgttgtattttaaagcaagagtttactttttcctcctttcagttgggaatcaacttcctcacggtcccccttttcgtgtccggccagtctgtccttcattccccacggacccaggagacagggctgcttctttccagcgtctcccgactaccagatcaagaggcctgagcagggcagcttcaggacacacagccggcgctcccc

SEQ ID NO: 275616 - DNA, 742 bp, Homo sapiens
atttggctcatagaaggatttattaacccagttattcaacttgttattgataataattgatcaaagctctggtctctgtggctccaaccgcactggccgcctcaccgcttctgagactcactcagcatggagccatgcattcctgtccaatcttccagaatgttcttcccccacatgattgcagggctccctcctgactaccctgctctcctgctctgagccctttcccaggctgccccatttaaagtatgaccttttgttattctttatcctcttagccagccttcattttcttcatagcatgtaacattatattcaatacctgtttacagatattgttacttgttgccctagaatgtaagcagagactgtgaaggcagggacatcatatgttttgttcctcactatgtccccagtgcctggatcagagcctggcacttaagagatgctcaggaaatggctgttaaatgaatgaaggaatggatgagtgaatgaatgaacccaaagctcagatagctggttttacttttgatcccatttattggtgtatttgggttaattttataccttttaaaatttttgtatcggtatataaaatttggattttattgttggaaagaagctcttttgagggcatttaatcctatcctctccccagtatagcaatccagcttgctgtttgcagtcttcctattctgtggaagtgttctgagcagcaagtcttcgataccttgcaaatgaa

SEQ ID NO: 275617 - DNA, 1873 bp, Homo sapiens
acctttccattcagtcgcccaacatggctggagcgcggcggaggtgagccggccgcccgcccgcagacgccccagcctactgcgcccgagtcccgcggccccagtggcgcctcagctctgcggtgccgaggcccaacggctcgatcgctgcccgccgccagcatgttgggcgccccggacgagagctccgtgcgggtggctgtcagaataagaccacagcttgccaaagagaagattgaaggatgccatatttgtacatctgtcacaccaggagagcctcaggtcttcctagggaaagataaggcttttacttttgactatgtatttgacattgactcccagcaagagcagatctacattcaatgtatagaaaaactaattgaaggttgctttgaaggatacaatgctacagtttttgcttatggacaaactggagctggtaaaacatacacaatgggaacaggatttgatgttaacattgttgaggaagaactgggtattatttctcgagctgttaaacacctttttaagagtattgaagaaaaaaaacacatagcaattaaaaatgggcttcctgctccagattttaaagtgaatgcccaattcttagagctctataatgaagaggtccttgacttatttgataccactcgtgatattgatgcaaaaagtaaaaaatcaaatataagaattcatgaagattcaactggaggaatttatactgtgggcgttacaacacgtactgtgaatacagaatcagagatgatgcagtgtttgaagttgggtgctttatcccggacaactgccagtacccagatgaatgttcagagctctcgttcacatgccatttttaccattcatgtgtgtcaaaccagagtgtgtccccaaatagatgctgacaatgcaactgataataaaattatttctgaatcagcacagatgaatgaatttgaaaccctgactgcaaagttccattttgttgatctcgcaggatctgaaagactgaagcgtactggagctacaggcgagagggcaaaagaaggcatttctatcaactgtggacttttggcacttggcaatgtaataagtgccttgggagacaagagcaagagggccacacatgtcccctatagagattccaagctaacaagactactacaggattccctcgggggtaatagccaaacaatcatgatagcatgtgtcagcccttcagacagagactttatggaaacgttaaacaccctgaaatacgccaatcgagctagaaatatcaagaataaggtgatggtcaatcaggacagagctagtcagcaaatcaatgcacttcgtagtgaaatcacacgacttcagatggagctcatggagtacaaaacaggtaaaagaataattgacgaagagggtgtggaaagcatcaatgacatgtttcatgagaatgctatgctacagactgaaaataataacctgcgtgtaagaattaaagccatgcaagagacggttgatgcattgaggtccagaattacacagcttgttagtgatcaggccaaccatgttcttgccagagcaggtgaaggaaatgaggagattagtaatatgattcatagttatataaaagaaatcgaagatctcagggcaaaattattagaaagtgaagcagtgaatgagaaccttcgaaaaaacttgacaagagccacagcaagagcgccatatttcagcggatcatcaactttttctcctaccatactatcctcagacaaagaaaccattgaaattatagacctagcaaaaaaagatttagagaagttgaaaagaaaagaaaagaggaagaaaaaaagtgtggctggtaaagaggataatacagacactgaccaag

SEQ ID NO: 275618 - DNA, 6365 bp, Homo sapiens
  misc_feature (4095)..(4095): n is a, c, g, or t
  misc_feature (4097)..(4097): n is a, c, g, or t
  misc_feature (4100)..(4101): n is a, c, g, or t
acctttccattcagtcgcccaacatggctggagcgcggcggaggtgagccggccgcccgcccgcagacgccccagcctactgcgcccgagtcccgcggccccagtggcgcctcagctctgcggtgccgaggcccaacggctcgatcgctgcccgccgccagcatgttgggcgccccggacgagagctccgtgcgggtggctgtcagaataagaccacagcttgccaaagagaagattgaaggatgccatatttgtacatctgtcacaccaggagagcctcaggtcttcctagggaaagataaggcttttacttttgactatgtatttgacattgactcccagcaagagcagatctacattcaatgtatagaaaaactaattgaaggttgctttgaaggatacaatgctacagtttttgcttatggacaaactggagctggtaaaacatacacaatgggaacaggatttgatgttaacattgttgaggaagaactgggtattatttctcgagctgttaaacacctttttaagagtattgaagaaaaaaaacacatagcaattaaaaatgggcttcctgctccagattttaaagtgaatgcccaattcttagagctctataatgaagaggtccttgacttatttgataccactcgtgatattgatgcaaaaagtaaaaaatcaaatataagaattcatgaagattcaactggaggaatttatactgtgggcgttacaacacgtactgtgaatacagaatcagagtccttgtttcttcccctttttcagatgatgcagtgtttgaagttgggtgctttatcccggacaactgccagtacccagatgaatgttcagagctctcgttcacatgccatttttaccattcatgtgtgtcaaaccagagtgtgtccccaaatagatgctgacaatgcaactgataataaaattatttctgaatcagcacagatgaatgaatttgaaaccctgactgcaaagttccattttgttgatctcgcaggatctgaaagactgaagcgtactggagctacaggcgagagggcaaaagaaggcatttctatcaactgtggacttttggcacttggcaatgtaataagtgccttgggagacaagagcaagagggccacacatgtcccctatagagattccaagctaacaagactactacaggattccctcgggggtaatagccaaacaatcatgatagcatgtgtcagcccttcagacagagactttatggaaacgttaaacaccctgaaatacgccaatcgagctagaaatatcaagaataaggtgatggtcaatcaggacagagctagtcagcaaatcaatgcacttcgtagtgaaatcacacgacttcagatggagctcatggagtacaaaacaggtaaaagaataattgacgaagagggtgtggaaagcatcaatgacatgtttcatgagaatgctatgctacagactgaaaataataacctgcgtgtaagaattaaagccatgcaagagacggttgatgcattgaggtccagaattacacagcttgttagtgatcaggccaaccatgttcttgccagagcaggtgaaggaaatgaggagattagtaatatgattcatagttatataaaagaaatcgaagatctcagggcaaaattattagaaagtgaagcagtgaatgagaaccttcgaaaaaacttgacaagagccacagcaagagcgccatatttcagcggatcatcaactttttctcctaccatactatcctcagacaaagaaaccattgaaattatagacctagcaaaaaaagatttagagaagttgaaaagaaaagaaaagaggaagaaaaaaagtgtggctggtaaagaggataatacagacactgaccaagagaagaaagaagaaaagggtgtttcggaaagagaaaacaatgaattagaagtggaagaaagtcaagaagtgagtgatcatgaggatgaagaagaggaggaggaggaggaggaagatgacattgatgggggtgaaagttctgatgaatcagattctgaatcagatgaaaaagccaattatcaagcagacttggcaaacattacttgtgaaattgcaattaagcaaaagctgattgatgaactagaaaacagccagaaaagactgcagactctgaaaaagcagtatgaagagaagctaatgatgctgcaacataaaattcgggatactcagcttgaaagagaccaggtgcttcaaaacttaggctcggtagaatcttactcagaagaaaaagcaaaaaaagttaggtctgaatatgaaaagaaactccaagccatgaacaaagaactgcagagacttcaagcagctcaaaaagaacatgcaaggttgcttaaaaatcagtctcagtatgaaaagcaattgaagaaattgcagcaggatgtgatggaaatgaaaaaaacaaaggttcgcctaatgaaacaaatgaaagaagaacaagagaaagccagactgactgagtctagaagaaacagagagattgctcagttgaaaaaggatcaacgtaaaagagatcatcaacttagacttctggaagcccaaaaaagaaaccaagaagtggttctacgtcgcaaaactgaagaggttacggctcttcgtcggcaagtaagacccatgtcagataaagtggctgggaaagttactcggaagctgagttcatctgatgcacctgctcaggacacaggttccagtgcagctgctgtcgaaacagatgcatcaaggacaggagcccagcagaaaatgagaattcctgtggcgagagtccaggccttaccaacgccggcaacaaatggaaacaggaaaaaatatcagaggaaaggattgactggccgagtgtttatttccaagacagctcgcatgaagtggcagctccttgagcgcagggtcacagacatcatcatgcagaagatgaccatttccaacatggaggcagatatgaatagactcctcaagcaacgggaggaactcacaaaaagacgagagaaactttcaaaaagaagggagaagatagtcaaggagaatggagagggagataaaaatgtggctaatatcaatgaagagatggagtcactgactgctaatatcgattacatcaatgacagtatttctgattgtcaggccaacataatgcagatggaagaagcaaaggaagaaggtgagacattggatgttactgcagtcattaatgcctgcacccttacagaagcccgatacctgctagatcacttcctgtcaatgggcatcaataagggtcttcaggctgcccagaaagaggctcaaattaaagtactggaaggtcgactcaaacaaacagaaataaccagtgctacccaaaaccagctcttattccatatgttgaaagagaaggcagaattaaatcctgagctagatgctttactaggccatgctttacaagatctagatagcgtaccattagaaaatgtagaggatagtactgatgaggatgctcctttaaacagcccaggatcagaaggaagcacgctgtcttcagatctcatgaagctttgtggtgaagtgaaacctaagaacaaggcccgaaggagaaccaccactcagatggaattgctgtatgcagatagcagtgaactagcttcagacactagtacaggagatgcctccttgcctggccctctcacacctgttgcagaagggcaagagattggaatgaatacagagacaagtggtacttctgctagggaaaaagagctctctcccccacctggcttaccttctaagataggcagcatttccaggcagtcatctctatcagaaaaaaaaattccagagccttctcctgtaacaaggagaaaggcatatgagaaagcagaaaaatcaaaggccaaggaacaaaagcactcagattctggaacttcagaggctagtctttcacctccttcttccccaccaagccggccccgtaatgaactgaatgtttttaatcgtcttactgtttctcagggaaacacatcagttcagcaggataagtctgatgaaagtgactcctctctctcggaggtacacagntnctnnaggggcataatcaacccatttcctgcttcaaaaggaatcagagcttttccacttcagtgtattcacatagctgaagggcatacaaaagctgtgctctgtgtggattctactgatgatctcctcttcactggatcaaaagatcgtacttgtaaagtatggaatctggtgactgggcaggaaataatgtcactggggggtcatcccaacaatgtcgtgtctgtaaaatactgtaattataccagtttggtcttcactgtatcaacatcttatattaaggtgtgggatatcagagattcagcaaagtgcattcgaacactaacgtcttcaggtcaagttactcttggagatgcttgttctgcaagtaccagtcgaacagtagctattccttctggagagaaccagatcaatcaaattgccctaaacccaactggcaccttcctctatgctgcttctggaaatgctgtcaggatgtgggatcttaaaaggtttcagtctacaggaaagttaacaggacacctaggccctgttatgtgccttactgtggatcagatttccagtggacaagatctaatcatcactggctccaaggatcattacatcaaaatgtttgatgttacagaaggagctcttgggactgtgagtcccacccacaattttgaaccccctcattatgatggcatagaagcactaaccattcaaggggataacctatttagtgggtctagagataatggaatcaagaaatgggacttaactcaaaaagaccttcttcagcaagttccaaatgcacataaggattgggtctgtgccctgggagtggtgccagaccacccagttttgctcagtggctgcagagggggcattttgaaagtctggaacatggatacttttatgccagtgggagagatgaagggtcatgatagtcctatcaatgccatatgtgttaattccacccacatttttactgcagctgatgatcgaactgtgagaatttggaaggctcgcaatttgcaagatggtcagatctctgacacaggagatctgggggaagatattgccagtaattaaacatgaatgaagataggttgtaaactgaatgctgtgataatactctgtattctttatggaaaatgttgtcctgtacttactaggcaaaacgtatgaatcggattaactggaaaatatatctgaattcaactgctgactataaatggtattctaataaaattgtgtactatcctgtgtgcttagttttaagatcaaccaatagatatatatcctacaattgatatattgctttattcacacttttattgtggctgaatttttgtgcctatctataaaacacactttcaaattatttgaattaccaagacgtctgcttttgtgacagtcagaaaacacacctggaatacgatgcagcccaccattaactcattcatgtagtttattcaagtgatttatgtatttaaactaaatattgaaaatgttagtcaaattgtggtttgcttgtcaggtatttatatcagtctgtagtggattcccaaatttcaaagctcttttaatgtaatggacaaaaataagatatgagaatattattgatgaattttcataaggtggaattgatcttaatctactaacagagaagggtagacagtttgtgttaaatgttggcatttacttgtattgaccaaagttttgcagctctactatattctgtgctcaggactaaaatgctgttaatttttttttttttttccagtgctgtgcatatattctgtgatgggaaacattgttgatgtcctaacagaaatatattttgatctattttcctatggagttgtttctattatgaccatttaattttgtttttatttaatagtagtatttccttcccttttatctaattttttatatgctgctaaatatattttaaatatactatgtttgcgaaccttggtagctatgatgagagctattatcatctgtggtgggaaaagctatgtaaataggtagattgtatagagagactatcttgtgttgtgcctgtatgaatttttaaaagttgttgactggattttgcaaaaggatgtataatatttctgtctgctcagaatattaatttgtaaattctgcaagtttaatttttatgtagatggtataacatttgaaaatattgtcttatgtgattttttcccctgaaaatatttgcttgtaaatgaaaacttagctagggcttaaataaacatgttgctatgaaatta

SEQ ID NO: 275619 - DNA, 5739 bp, Homo sapiens
  misc_feature (3469)..(3469): n is a, c, g, or t
  misc_feature (3471)..(3471): n is a, c, g, or t
  misc_feature (3474)..(3475): n is a, c, g, or t
ctatgtaaggtgaaaattaactggaacgatgtttgtttgctatacttacatagtcaaactttacaagccatgaaattaattgcactctttgtatttgttgttaaatgcctaagaagttttctaaaaattttgtaaaggtactgtgaatacagaatcagagatgatgcagtgtttgaagttgggtgctttatcccggacaactgccagtacccagatgaatgttcagagctctcgttcacatgccatttttaccattcatgtgtgtcaaaccagagtgtgtccccaaatagatgctgacaatgcaactgataataaaattatttctgaatcagcacagatgaatgaatttgaaaccctgactgcaaagttccattttgttgatctcgcaggatctgaaagactgaagcgtactggagctacaggcgagagggcaaaagaaggcatttctatcaactgtggacttttggcacttggcaatgtaataagtgccttgggagacaagagcaagagggccacacatgtcccctatagagattccaagctaacaagactactacaggattccctcgggggtaatagccaaacaatcatgatagcatgtgtcagcccttcagacagagactttatggaaacgttaaacaccctgaaatacgccaatcgagctagaaatatcaagaataaggtgatggtcaatcaggacagagctagtcagcaaatcaatgcacttcgtagtgaaatcacacgacttcagatggagctcatggagtacaaaacaggtaaaagaataattgacgaagagggtgtggaaagcatcaatgacatgtttcatgagaatgctatgctacagactgaaaataataacctgcgtgtaagaattaaagccatgcaagagacggttgatgcattgaggtccagaattacacagcttgttagtgatcaggccaaccatgttcttgccagagcaggtgaaggaaatgaggagattagtaatatgattcatagttatataaaagaaatcgaagatctcagggcaaaattattagaaagtgaagcagtgaatgagaaccttcgaaaaaacttgacaagagccacagcaagagcgccatatttcagcggatcatcaactttttctcctaccatactatcctcagacaaagaaaccattgaaattatagacctagcaaaaaaagatttagagaagttgaaaagaaaagaaaagaggaagaaaaaaagtgtggctggtaaagaggataatacagacactgaccaagagaagaaagaagaaaagggtgtttcggaaagagaaaacaatgaattagaagtggaagaaagtcaagaagtgagtgatcatgaggatgaagaagaggaggaggaggaggaggaagatgacattgatgggggtgaaagttctgatgaatcagattctgaatcagatgaaaaagccaattatcaagcagacttggcaaacattacttgtgaaattgcaattaagcaaaagctgattgatgaactagaaaacagccagaaaagactgcagactctgaaaaagcagtatgaagagaagctaatgatgctgcaacataaaattcgggatactcagcttgaaagagaccaggtgcttcaaaacttaggctcggtagaatcttactcagaagaaaaagcaaaaaaagttaggtctgaatatgaaaagaaactccaagccatgaacaaagaactgcagagacttcaagcagctcaaaaagaacatgcaaggttgcttaaaaatcagtctcagtatgaaaagcaattgaagaaattgcagcaggatgtgatggaaatgaaaaaaacaaaggttcgcctaatgaaacaaatgaaagaagaacaagagaaagccagactgactgagtctagaagaaacagagagattgctcagttgaaaaaggatcaacgtaaaagagatcatcaacttagacttctggaagcccaaaaaagaaaccaagaagtggttctacgtcgcaaaactgaagaggttacggctcttcgtcggcaagtaagacccatgtcagataaagtggctgggaaagttactcggaagctgagttcatctgatgcacctgctcaggacacaggttccagtgcagctgctgtcgaaacagatgcatcaaggacaggagcccagcagaaaatgagaattcctgtggcgagagtccaggccttaccaacgccggcaacaaatggaaacaggaaaaaatatcagaggaaaggattgactggccgagtgtttatttccaagacagctcgcatgaagtggcagctccttgagcgcagggtcacagacatcatcatgcagaagatgaccatttccaacatggaggcagatatgaatagactcctcaagcaacgggaggaactcacaaaaagacgagagaaactttcaaaaagaagggagaagatagtcaaggagaatggagagggagataaaaatgtggctaatatcaatgaagagatggagtcactgactgctaatatcgattacatcaatgacagtatttctgattgtcaggccaacataatgcagatggaagaagcaaaggaagaaggtgagacattggatgttactgcagtcattaatgcctgcacccttacagaagcccgatacctgctagatcacttcctgtcaatgggcatcaataagggtcttcaggctgcccagaaagaggctcaaattaaagtactggaaggtcgactcaaacaaacagaaataaccagtgctacccaaaaccagctcttattccatatgttgaaagagaaggcagaattaaatcctgagctagatgctttactaggccatgctttacaagatctagatagcgtaccattagaaaatgtagaggatagtactgatgaggatgctcctttaaacagcccaggatcagaaggaagcacgctgtcttcagatctcatgaagctttgtggtgaagtgaaacctaagaacaaggcccgaaggagaaccaccactcagatggaattgctgtatgcagatagcagtgaactagcttcagacactagtacaggagatgcctccttgcctggccctctcacacctgttgcagaagggcaagagattggaatgaatacagagacaagtggtacttctgctagggaaaaagagctctctcccccacctggcttaccttctaagataggcagcatttccaggcagtcatctctatcagaaaaaaaaattccagagccttctcctgtaacaaggagaaaggcatatgagaaagcagaaaaatcaaaggccaaggaacaaaagcactcagattctggaacttcagaggctagtctttcacctccttcttccccaccaagccggccccgtaatgaactgaatgtttttaatcgtcttactgtttctcagggaaacacatcagttcagcaggataagtctgatgaaagtgactcctctctctcggaggtacacagntnctnnaggggcataatcaacccatttcctgcttcaaaaggaatcagagcttttccacttcagtgtattcacatagctgaagggcatacaaaagctgtgctctgtgtggattctactgatgatctcctcttcactggatcaaaagatcgtacttgtaaagtatggaatctggtgactgggcaggaaataatgtcactggggggtcatcccaacaatgtcgtgtctgtaaaatactgtaattataccagtttggtcttcactgtatcaacatcttatattaaggtgtgggatatcagagattcagcaaagtgcattcgaacactaacgtcttcaggtcaagttactcttggagatgcttgttctgcaagtaccagtcgaacagtagctattccttctggagagaaccagatcaatcaaattgccctaaacccaactggcaccttcctctatgctgcttctggaaatgctgtcaggatgtgggatcttaaaaggtttcagtctacaggaaagttaacaggacacctaggccctgttatgtgccttactgtggatcagatttccagtggacaagatctaatcatcactggctccaaggatcattacatcaaaatgtttgatgttacagaaggagctcttgggactgtgagtcccacccacaattttgaaccccctcattatgatggcatagaagcactaaccattcaaggggataacctatttagtgggtctagagataatggaatcaagaaatgggacttaactcaaaaagaccttcttcagcaagttccaaatgcacataaggattgggtctgtgccctgggagtggtgccagaccacccagttttgctcagtggctgcagagggggcattttgaaagtctggaacatggatacttttatgccagtgggagagatgaagggtcatgatagtcctatcaatgccatatgtgttaattccacccacatttttactgcagctgatgatcgaactgtgagaatttggaaggctcgcaatttgcaagatggtcagatctctgacacaggagatctgggggaagatattgccagtaattaaacatgaatgaagataggttgtaaactgaatgctgtgataatactctgtattctttatggaaaatgttgtcctgtacttactaggcaaaacgtatgaatcggattaactggaaaatatatctgaattcaactgctgactataaatggtattctaataaaattgtgtactatcctgtgtgcttagttttaagatcaaccaatagatatatatcctacaattgatatattgctttattcacacttttattgtggctgaatttttgtgcctatctataaaacacactttcaaattatttgaattaccaagacgtctgcttttgtgacagtcagaaaacacacctggaatacgatgcagcccaccattaactcattcatgtagtttattcaagtgatttatgtatttaaactaaatattgaaaatgttagtcaaattgtggtttgcttgtcaggtatttatatcagtctgtagtggattcccaaatttcaaagctcttttaatgtaatggacaaaaataagatatgagaatattattgatgaattttcataaggtggaattgatcttaatctactaacagagaagggtagacagtttgtgttaaatgttggcatttacttgtattgaccaaagttttgcagctctactatattctgtgctcaggactaaaatgctgttaatttttttttttttttccagtgctgtgcatatattctgtgatgggaaacattgttgatgtcctaacagaaatatattttgatctattttcctatggagttgtttctattatgaccatttaattttgtttttatttaatagtagtatttccttcccttttatctaattttttatatgctgctaaatatattttaaatatactatgtttgcgaaccttggtagctatgatgagagctattatcatctgtggtgggaaaagctatgtaaataggtagattgtatagagagactatcttgtgttgtgcctgtatgaatttttaaaagttgttgactggattttgcaaaaggatgtataatatttctgtctgctcagaatattaatttgtaaattctgcaagtttaatttttatgtagatggtataacatttgaaaatattgtcttatgtgattttttcccctgaaaatatttgcttgtaaatgaaaacttagctagggcttaaataaacatgttgctatgaaatta

SEQ ID NO: 275620 - DNA, 6166 bp, Homo sapiens
acctttccattcagtcgcccaacatggctggagcgcggcggaggtgagccggccgcccgcccgcagacgccccagcctactgcgcccgagtcccgcggccccagtggcgcctcagctctgcggtgccgaggcccaacggctcgatcgctgcccgccgccagcatgttgggcgccccggacgagagctccgtgcgggtggctgtcagaataagaccacagcttgccaaagagaagattgaaggatgccatatttgtacatctgtcacaccaggagagcctcaggtcttcctagggaaagataaggcttttacttttgactatgtatttgacattgactcccagcaagagcagatctacattcaatgtatagaaaaactaattgaaggttgctttgaaggatacaatgctacagtttttgcttatggacaaactggagctggtaaaacatacacaatgggaacaggatttgatgttaacattgttgaggaagaactgggtattatttctcgagctgttaaacacctttttaagagtattgaagaaaaaaaacacatagcaattaaaaatgggcttcctgctccagattttaaagtgaatgcccaattcttagagctctataatgaagaggtccttgacttatttgataccactcgtgatattgatgcaaaaagtaaaaaatcaaatataagaattcatgaagattcaactggaggaatttatactgtgggcgttacaacacgtactgtgaatacagaatcagagatgatgcagtgtttgaagttgggtgctttatcccggacaactgccagtacccagatgaatgttcagagctctcgttcacatgccatttttaccattcatgtgtgtcaaaccagagtgtgtccccaaatagatgctgacaatgcaactgataataaaattatttctgaatcagcacagatgaatgaatttgaaaccctgactgcaaagttccattttgttgatctcgcaggatctgaaagactgaagcgtactggagctacaggcgagagggcaaaagaaggcatttctatcaactgtggacttttggcacttggcaatgtaataagtgccttgggagacaagagcaagagggccacacatgtcccctatagagattccaagctaacaagactactacaggattccctcgggggtaatagccaaacaatcatgatagcatgtgtcagcccttcagacagagactttatggaaacgttaaacaccctgaaatacgccaatcgagctagaaatatcaagaataaggtgatggtcaatcaggacagagctagtcagcaaatcaatgcacttcgtagtgaaatcacacgacttcagatggagctcatggagtacaaaacaggtaaaagaataattgacgaagagggtgtggaaagcatcaatgacatgtttcatgagaatgctatgctacagactgaaaataataacctgcgtgtaagaattaaagccatgcaagagacggttgatgcattgaggtccagaattacacagcttgttagtgatcaggccaaccatgttcttgccagagcaggtgaaggaaatgaggagattagtaatatgattcatagttatataaaagaaatcgaagatctcagggcaaaattattagaaagtgaagcagtgaatgagaaccttcgaaaaaacttgacaagagccacagcaagagcgccatatttcagcggatcatcaactttttctcctaccatactatcctcagacaaagaaaccattgaaattatagacctagcaaaaaaagatttagagaagttgaaaagaaaagaaaagaggaagaaaaaaagtgtggctggtaaagaggataatacagacactgaccaagagaagaaagaagaaaagggtgtttcggaaagagaaaacaatgaattagaagtggaagaaagtcaagaagtgagtgatcatgaggatgaagaagaggaggaggaggaggaggaagatgacattgatgggggtgaaagttctgatgaatcagattctgaatcagatgaaaaagccaattatcaagcagacttggcaaacattacttgtgaaattgcaattaagcaaaagctgattgatgaactagaaaacagccagaaaagactgcagactctgaaaaagcagtatgaagagaagctaatgatgctgcaacataaaattcgggatactcagcttgaaagagaccaggtgcttcaaaacttaggctcggtagaatcttactcagaagaaaaagcaaaaaaagttaggtctgaatatgaaaagaaactccaagccatgaacaaagaactgcagagacttcaagcagctcaaaaagaacatgcaaggttgcttaaaaatcagtctcagtatgaaaagcaattgaagaaattgcagcaggatgtgatggaaatgaaaaaaacaaaggttcgcctaatgaaacaaatgaaagaagaacaagagaaagccagactgactgagtctagaagaaacagagagattgctcagttgaaaaaggatcaacgtaaaagagatcatcaacttagacttctggaagcccaaaaaagaaaccaagaagtggttctacgtcgcaaaactgaagaggttacggctcttcgtcggcaagtaagacccatgtcagataaagtggctgggaaagttactcggaagctgagttcatctgatgcacctgctcaggacacaggttccagtgcagctgctgtcgaaacagatgcatcaaggacaggagcccagcagaaaatgagaattcctgtggcgagagtccaggccttaccaacgccggcaacaaatggaaacaggaaaaaatatcagaggaaaggattgactggccgagtgtttatttccaagacagctcgcatgaagtggcagctccttgagcgcagggtcacagacatcatcatgcagaagatgaccatttccaacatggaggcagatatgaatagactcctcaagcaacgggaggaactcacaaaaagacgagagaaactttcaaaaagaagggagaagatagtcaaggagaatggagagggagataaaaatgtggctaatatcaatgaagagatggagtcactgactgctaatatcgattacatcaatgacagtatttctgattgtcaggccaacataatgcagatggaagaagcaaaggaagaaggtgagacattggatgttactgcagtcattaatgcctgcacccttacagaagcccgatacctgctagatcacttcctgtcaatgggcatcaataagggtcttcaggctgcccagaaagaggctcaaattaaagtactggaaggtcgactcaaacaaacagaaataaccagtgctacccaaaaccagctcttattccatatgttgaaagagaaggcagaattaaatcctgagctagatgctttactaggccatgctttacaagatctagatagcgtaccattagaaaatgtagaggatagtactgatgaggatgctcctttaaacagcccaggatcagaaggaagcacgctgtcttcagatctcatgaagctttgtggtgaagtgaaacctaagaacaaggcccgaaggagaaccaccactcagatggaattgctgtatgcagatagcagtgaactagcttcagacactagtacaggagatgcctccttgcctggccctctcacacctgttgcagaagggcaagagattggaatgaatacagagacaagtggtacttctgctagggaaaaagagctctctcccccacctggcttaccttctaagataggcagcatttccaggcagtcatctctatcagaaaaaaaaattccagagccttctcctgtaacaaggagaaaggcatatgagaaagcagaaaaatcaaaggccaaggaacaaaagcaaggggcataatcaacccatttcctgcttcaaaaggaatcagagcttttccacttcagtgtattcacatagctgaagggcatacaaaagctgtgctctgtgtggattctactgatgatctcctcttcactggatcaaaagatcgtacttgtaaagtatggaatctggtgactgggcaggaaataatgtcactggggggtcatcccaacaatgtcgtgtctgtaaaatactgtaattataccagtttggtcttcactgtatcaacatcttatattaaggtgtgggatatcagagattcagcaaagtgcattcgaacactaacgtcttcaggtcaagttactcttggagatgcttgttctgcaagtaccagtcgaacagtagctattccttctggagagaaccagatcaatcaaattgccctaaacccaactggcaccttcctctatgctgcttctggaaatgctgtcaggatgtgggatcttaaaaggtttcagtctacaggaaagttaacaggacacctaggccctgttatgtgccttactgtggatcagatttccagtggacaagatctaatcatcactggctccaaggatcattacatcaaaatgtttgatgttacagaaggagctcttgggactgtgagtcccacccacaattttgaaccccctcattatgatggcatagaagcactaaccattcaaggggataacctatttagtgggtctagagataatggaatcaagaaatgggacttaactcaaaaagaccttcttcagcaagttccaaatgcacataaggattgggtctgtgccctgggagtggtgccagaccacccagttttgctcagtggctgcagagggggcattttgaaagtctggaacatggatacttttatgccagtgggagagatgaagggtcatgatagtcctatcaatgccatatgtgttaattccacccacatttttactgcagctgatgatcgaactgtgagaatttggaaggctcgcaatttgcaagatggtcagatctctgacacaggagatctgggggaagatattgccagtaattaaacatgaatgaagataggttgtaaactgaatgctgtgataatactctgtattctttatggaaaatgttgtcctgtacttactaggcaaaacgtatgaatcggattaactggaaaatatatctgaattcaactgctgactataaatggtattctaataaaattgtgtactatcctgtgtgcttagttttaagatcaaccaatagatatatatcctacaattgatatattgctttattcacacttttattgtggctgaatttttgtgcctatctataaaacacactttcaaattatttgaattaccaagacgtctgcttttgtgacagtcagaaaacacacctggaatacgatgcagcccaccattaactcattcatgtagtttattcaagtgatttatgtatttaaactaaatattgaaaatgttagtcaaattgtggtttgcttgtcaggtatttatatcagtctgtagtggattcccaaatttcaaagctcttttaatgtaatggacaaaaataagatatgagaatattattgatgaattttcataaggtggaattgatcttaatctactaacagagaagggtagacagtttgtgttaaatgttggcatttacttgtattgaccaaagttttgcagctctactatattctgtgctcaggactaaaatgctgttaatttttttttttttttccagtgctgtgcatatattctgtgatgggaaacattgttgatgtcctaacagaaatatattttgatctattttcctatggagttgtttctattatgaccatttaattttgtttttatttaatagtagtatttccttcccttttatctaattttttatatgctgctaaatatattttaaatatactatgtttgcgaaccttggtagctatgatgagagctattatcatctgtggtgggaaaagctatgtaaataggtagattgtatagagagactatcttgtgttgtgcctgtatgaatttttaaaagttgttgactggattttgcaaaaggatgtataatatttctgtctgctcagaatattaatttgtaaattctgcaagtttaatttttatgtagatggtataacatttgaaaatattgtcttatgtgattttttcccctgaaaatatttgcttgtaaatgaaaacttagctagggcttaaataaacatgttgctatgaaatta

SEQ ID NO: 275621 - DNA, 6289 bp, Homo sapiens
acctttccattcagtcgcccaacatggctggagcgcggcggaggtgagccggccgcccgcccgcagacgccccagcctactgcgcccgagtcccgcggccccagtggcgcctcagctctgcggtgccgaggcccaacggctcgatcgctgcccgccgccagcatgttgggcgccccggacgagagctccgtgcgggtggctgtcagaataagaccacagcttgccaaagagaagattgaaggatgccatatttgtacatctgtcacaccaggagagcctcaggtcttcctagggaaagataaggcttttacttttgactatgtatttgacattgactcccagcaagagcagatctacattcaatgtatagaaaaactaattgaaggttgctttgaaggatacaatgctacagtttttgcttatggacaaactggagctggtaaaacatacacaatgggaacaggatttgatgttaacattgttgaggaagaactgggtattatttctcgagctgttaaacacctttttaagagtattgaagaaaaaaaacacatagcaattaaaaatgggcttcctgctccagattttaaagtgaatgcccaattcttagagctctataatgaagaggtccttgacttatttgataccactcgtgatattgatgcaaaaagtaaaaaatcaaatataagaattcatgaagattcaactggaggaatttatactgtgggcgttacaacacgtactgtgaatacagaatcagagatgatgcagtgtttgaagttgggtgctttatcccggacaactgccagtacccagatgaatgttcagagctctcgttcacatgccatttttaccattcatgtgtgtcaaaccagagtgtgtccccaaatagatgctgacaatgcaactgataataaaattatttctgaatcagcacagatgaatgaatttgaaaccctgactgcaaagttccattttgttgatctcgcaggatctgaaagactgaagcgtactggagctacaggcgagagggcaaaagaaggcatttctatcaactgtggacttttggcacttggcaatgtaataagtgccttgggagacaagagcaagagggccacacatgtcccctatagagattccaagctaacaagactactacaggattccctcgggggtaatagccaaacaatcatgatagcatgtgtcagcccttcagacagagactttatggaaacgttaaacaccctgaaatacgccaatcgagctagaaatatcaagaataaggtgatggtcaatcaggacagagctagtcagcaaatcaatgcacttcgtagtgaaatcacacgacttcagatggagctcatggagtacaaaacaggtaaaagaataattgacgaagagggtgtggaaagcatcaatgacatgtttcatgagaatgctatgctacagactgaaaataataacctgcgtgtaagaattaaagccatgcaagagacggttgatgcattgaggtccagaattacacagcttgttagtgatcaggccaaccatgttcttgccagagcaggtgaaggaaatgaggagattagtaatatgattcatagttatataaaagaaatcgaagatctcagggcaaaattattagaaagtgaagcagtgaatgagaaccttcgaaaaaacttgacaagagccacagcaagagcgccatatttcagcggatcatcaactttttctcctaccatactatcctcagacaaagaaaccattgaaattatagacctagcaaaaaaagatttagagaagttgaaaagaaaagaaaagaggaagaaaaaaagtgtggctggtaaagaggataatacagacactgaccaagagaagaaagaagaaaagggtgtttcggaaagagaaaacaatgaattagaagtggaagaaagtcaagaagtgagtgatcatgaggatgaagaagaggaggaggaggaggaggaagatgacattgatgggggtgaaagttctgatgaatcagattctgaatcagatgaaaaagccaattatcaagcagacttggcaaacattacttgtgaaattgcaattaagcaaaagctgattgatgaactagaaaacagccagaaaagactgcagactctgaaaaagcagtatgaagagaagctaatgatgctgcaacataaaattcgggatactcagcttgaaagagaccaggtgcttcaaaacttaggctcggtagaatcttactcagaagaaaaagcaaaaaaagttaggtctgaatatgaaaagaaactccaagccatgaacaaagaactgcagagacttcaagcagctcaaaaagaacatgcaaggttgcttaaaaatcagtctcagtatgaaaagcaattgaagaaattgcagcaggatgtgatggaaatgaaaaaaacaaaggttcgcctaatgaaacaaatgaaagaagaacaagagaaagccagactgactgagtctagaagaaacagagagattgctcagttgaaaaaggatcaacgtaaaagagatcatcaacttagacttctggaagcccaaaaaagaaaccaagaagtggttctacgtcgcaaaactgaagaggttacggctcttcgtcggcaagtaagacccatgtcagataaagtggctgggaaagttactcggaagctgagttcatctgatgcacctgctcaggacacaggttccagtgcagctgctgtcgaaacagatgcatcaaggacaggagcccagcagaaaatgagaattcctgtggcgagagtccaggccttaccaacgccggcaacaaatggaaacaggaaaaaatatcagaggaaaggattgactggccgagtgtttatttccaagacagctcgcatgaagtggcagctccttgagcgcagggtcacagacatcatcatgcagaagatgaccatttccaacatggaggcagatatgaatagactcctcaagcaacgggaggaactcacaaaaagacgagagaaactttcaaaaagaagggagaagatagtcaaggagaatggagagggagataaaaatgtggctaatatcaatgaagagatggagtcactgactgctaatatcgattacatcaatgacagtatttctgattgtcaggccaacataatgcagatggaagaagcaaaggaagaaggtgagacattggatgttactgcagtcattaatgcctgcacccttacagaagcccgatacctgctagatcacttcctgtcaatgggcatcaataagggtcttcaggctgcccagaaagaggctcaaattaaagtactggaaggtcgactcaaacaaacagaaataaccagtgctacccaaaaccagctcttattccatatgttgaaagagaaggcagaattaaatcctgagctagatgctttactaggccatgctttacaagatctagatagcgtaccattagaaaatgtagaggatagtactgatgaggatgctcctttaaacagcccaggatcagaaggaagcacgctgtcttcagatctcatgaagctttgtggtgaagtgaaacctaagaacaaggcccgaaggagaaccaccactcagatggaattgctgtatgcagatagcagtgaactagcttcagacactagtacaggagatgcctccttgcctggccctctcacacctgttgcagaagggcaagagattggaatgaatacagagacaagtggtacttctgctagggaaaaagagctctctcccccacctggcttaccttctaagataggcagcatttccaggcagtcatctctatcagaaaaaaaaattccagagccttctcctgtaacaaggagaaaggcatatgagaaagcagaaaaatcaaaggccaaggaacaaaagcactcagattctggaacttcagaggctagtctttcacctccttcttccccaccaagccggccccgtaatgaactgaatgtttttaatcgtcttactgtttctcagggaaacacatcagttcagcaggataaaggggcataatcaacccatttcctgcttcaaaaggaatcagagcttttccacttcagtgtattcacatagctgaagggcatacaaaagctgtgctctgtgtggattctactgatgatctcctcttcactggatcaaaagatcgtacttgtaaagtatggaatctggtgactgggcaggaaataatgtcactggggggtcatcccaacaatgtcgtgtctgtaaaatactgtaattataccagtttggtcttcactgtatcaacatcttatattaaggtgtgggatatcagagattcagcaaagtgcattcgaacactaacgtcttcaggtcaagttactcttggagatgcttgttctgcaagtaccagtcgaacagtagctattccttctggagagaaccagatcaatcaaattgccctaaacccaactggcaccttcctctatgctgcttctggaaatgctgtcaggatgtgggatcttaaaaggtttcagtctacaggaaagttaacaggacacctaggccctgttatgtgccttactgtggatcagatttccagtggacaagatctaatcatcactggctccaaggatcattacatcaaaatgtttgatgttacagaaggagctcttgggactgtgagtcccacccacaattttgaaccccctcattatgatggcatagaagcactaaccattcaaggggataacctatttagtgggtctagagataatggaatcaagaaatgggacttaactcaaaaagaccttcttcagcaagttccaaatgcacataaggattgggtctgtgccctgggagtggtgccagaccacccagttttgctcagtggctgcagagggggcattttgaaagtctggaacatggatacttttatgccagtgggagagatgaagggtcatgatagtcctatcaatgccatatgtgttaattccacccacatttttactgcagctgatgatcgaactgtgagaatttggaaggctcgcaatttgcaagatggtcagatctctgacacaggagatctgggggaagatattgccagtaattaaacatgaatgaagataggttgtaaactgaatgctgtgataatactctgtattctttatggaaaatgttgtcctgtacttactaggcaaaacgtatgaatcggattaactggaaaatatatctgaattcaactgctgactataaatggtattctaataaaattgtgtactatcctgtgtgcttagttttaagatcaaccaatagatatatatcctacaattgatatattgctttattcacacttttattgtggctgaatttttgtgcctatctataaaacacactttcaaattatttgaattaccaagacgtctgcttttgtgacagtcagaaaacacacctggaatacgatgcagcccaccattaactcattcatgtagtttattcaagtgatttatgtatttaaactaaatattgaaaatgttagtcaaattgtggtttgcttgtcaggtatttatatcagtctgtagtggattcccaaatttcaaagctcttttaatgtaatggacaaaaataagatatgagaatattattgatgaattttcataaggtggaattgatcttaatctactaacagagaagggtagacagtttgtgttaaatgttggcatttacttgtattgaccaaagttttgcagctctactatattctgtgctcaggactaaaatgctgttaatttttttttttttttccagtgctgtgcatatattctgtgatgggaaacattgttgatgtcctaacagaaatatattttgatctattttcctatggagttgtttctattatgaccatttaattttgtttttatttaatagtagtatttccttcccttttatctaattttttatatgctgctaaatatattttaaatatactatgtttgcgaaccttggtagctatgatgagagctattatcatctgtggtgggaaaagctatgtaaataggtagattgtatagagagactatcttgtgttgtgcctgtatgaattcttcccgttcgtccttcccctcactcctagcatccttcgctcgttcgtcctcttttgttcagtatgtgtaacttgaagctgatttgtttttatggatatgggactgcagccacagatacagaatctgtattgtttttccttgaacacagcatggtgttaacattaaccttgaatgggcctaacttaacttgataatgtaaa

SEQ ID NO: 275622 - DNA, 350 bp, Homo sapiens
cagaaagaggctcaaattaaagtactggaaggtcgactcaaacaaacagaaataaccagtgctacccaaaaccagctcttattccatatgttgaaagagaaggcagaattaaatcctgagctagatgctttactaggccatgctttacaaggtaatttgctctcaattttagttgaatgaatttgcatggtagctttgctttttgaacatggtatagtatatccctttcccctatggcttgactgaatagatgctatatttactcatgcttttaataattattctttctttaatttgcatgtgtacattttggcgaggtaattattgtcattccaagaaatggttaccaa

SEQ ID NO: 275623 - DNA, 6341 bp, Homo sapiens
  misc_feature (4071)..(4071): n is a, c, g, or t
  misc_feature (4073)..(4073): n is a, c, g, or t
  misc_feature (4076)..(4077): n is a, c, g, or t
acctttccattcagtcgcccaacatggctggagcgcggcggaggtgagccggccgcccgcccgcagacgccccagcctactgcgcccgagtcccgcggccccagtggcgcctcagctctgcggtgccgaggcccaacggctcgatcgctgcccgccgccagcatgttgggcgccccggacgagagctccgtgcgggtggctgtcagaataagaccacagcttgccaaagagaagattgaaggatgccatatttgtacatctgtcacaccaggagagcctcaggtcttcctagggaaagataaggcttttacttttgactatgtatttgacattgactcccagcaagagcagatctacattcaatgtatagaaaaactaattgaaggttgctttgaaggatacaatgctacagtttttgcttatggacaaactggagctggtaaaacatacacaatgggaacaggatttgatgttaacattgttgaggaagaactgggtattatttctcgagctgttaaacacctttttaagagtattgaagaaaaaaaacacatagcaattaaaaatgggcttcctgctccagattttaaagtgaatgcccaattcttagagctctataatgaagaggtccttgacttatttgataccactcgtgatattgatgcaaaaagtaaaaaatcaaatataagaattcatgaagattcaactggaggaatttatactgtgggcgttacaacacgtactgtgaatacagaatcagagatgatgcagtgtttgaagttgggtgctttatcccggacaactgccagtacccagatgaatgttcagagctctcgttcacatgccatttttaccattcatgtgtgtcaaaccagagtgtgtccccaaatagatgctgacaatgcaactgataataaaattatttctgaatcagcacagatgaatgaatttgaaaccctgactgcaaagttccattttgttgatctcgcaggatctgaaagactgaagcgtactggagctacaggcgagagggcaaaagaaggcatttctatcaactgtggacttttggcacttggcaatgtaataagtgccttgggagacaagagcaagagggccacacatgtcccctatagagattccaagctaacaagactactacaggattccctcgggggtaatagccaaacaatcatgatagcatgtgtcagcccttcagacagagactttatggaaacgttaaacaccctgaaatacgccaatcgagctagaaatatcaagaataaggtgatggtcaatcaggacagagctagtcagcaaatcaatgcacttcgtagtgaaatcacacgacttcagatggagctcatggagtacaaaacaggtaaaagaataattgacgaagagggtgtggaaagcatcaatgacatgtttcatgagaatgctatgctacagactgaaaataataacctgcgtgtaagaattaaagccatgcaagagacggttgatgcattgaggtccagaattacacagcttgttagtgatcaggccaaccatgttcttgccagagcaggtgaaggaaatgaggagattagtaatatgattcatagttatataaaagaaatcgaagatctcagggcaaaattattagaaagtgaagcagtgaatgagaaccttcgaaaaaacttgacaagagccacagcaagagcgccatatttcagcggatcatcaactttttctcctaccatactatcctcagacaaagaaaccattgaaattatagacctagcaaaaaaagatttagagaagttgaaaagaaaagaaaagaggaagaaaaaaagtgtggctggtaaagaggataatacagacactgaccaagagaagaaagaagaaaagggtgtttcggaaagagaaaacaatgaattagaagtggaagaaagtcaagaagtgagtgatcatgaggatgaagaagaggaggaggaggaggaggaagatgacattgatgggggtgaaagttctgatgaatcagattctgaatcagatgaaaaagccaattatcaagcagacttggcaaacattacttgtgaaattgcaattaagcaaaagctgattgatgaactagaaaacagccagaaaagactgcagactctgaaaaagcagtatgaagagaagctaatgatgctgcaacataaaattcgggatactcagcttgaaagagaccaggtgcttcaaaacttaggctcggtagaatcttactcagaagaaaaagcaaaaaaagttaggtctgaatatgaaaagaaactccaagccatgaacaaagaactgcagagacttcaagcagctcaaaaagaacatgcaaggttgcttaaaaatcagtctcagtatgaaaagcaattgaagaaattgcagcaggatgtgatggaaatgaaaaaaacaaaggttcgcctaatgaaacaaatgaaagaagaacaagagaaagccagactgactgagtctagaagaaacagagagattgctcagttgaaaaaggatcaacgtaaaagagatcatcaacttagacttctggaagcccaaaaaagaaaccaagaagtggttctacgtcgcaaaactgaagaggttacggctcttcgtcggcaagtaagacccatgtcagataaagtggctgggaaagttactcggaagctgagttcatctgatgcacctgctcaggacacaggttccagtgcagctgctgtcgaaacagatgcatcaaggacaggagcccagcagaaaatgagaattcctgtggcgagagtccaggccttaccaacgccggcaacaaatggaaacaggaaaaaatatcagaggaaaggattgactggccgagtgtttatttccaagacagctcgcatgaagtggcagctccttgagcgcagggtcacagacatcatcatgcagaagatgaccatttccaacatggaggcagatatgaatagactcctcaagcaacgggaggaactcacaaaaagacgagagaaactttcaaaaagaagggagaagatagtcaaggagaatggagagggagataaaaatgtggctaatatcaatgaagagatggagtcactgactgctaatatcgattacatcaatgacagtatttctgattgtcaggccaacataatgcagatggaagaagcaaaggaagaaggtgagacattggatgttactgcagtcattaatgcctgcacccttacagaagcccgatacctgctagatcacttcctgtcaatgggcatcaataagggtcttcaggctgcccagaaagaggctcaaattaaagtactggaaggtcgactcaaacaaacagaaataaccagtgctacccaaaaccagctcttattccatatgttgaaagagaaggcagaattaaatcctgagctagatgctttactaggccatgctttacaagatctagatagcgtaccattagaaaatgtagaggatagtactgatgaggatgctcctttaaacagcccaggatcagaaggaagcacgctgtcttcagatctcatgaagctttgtggtgaagtgaaacctaagaacaaggcccgaaggagaaccaccactcagatggaattgctgtatgcagatagcagtgaactagcttcagacactagtacaggagatgcctccttgcctggccctctcacacctgttgcagaagggcaagagattggaatgaatacagagacaagtggtacttctgctagggaaaaagagctctctcccccacctggcttaccttctaagataggcagcatttccaggcagtcatctctatcagaaaaaaaaattccagagccttctcctgtaacaaggagaaaggcatatgagaaagcagaaaaatcaaaggccaaggaacaaaagcactcagattctggaacttcagaggctagtctttcacctccttcttccccaccaagccggccccgtaatgaactgaatgtttttaatcgtcttactgtttctcagggaaacacatcagttcagcaggataagtctgatgaaagtgactcctctctctcggaggtacacagntnctnnaggggcataatcaacccatttcctgcttcaaaaggaatcagagcttttccacttcagtgtattcacatagctgaagggcatacaaaagctgtgctctgtgtggattctactgatgatctcctcttcactggatcaaaagatcgtacttgtaaagtatggaatctggtgactgggcaggaaataatgtcactggggggtcatcccaacaatgtcgtgtctgtaaaatactgtaattataccagtttggtcttcactgtatcaacatcttatattaaggtgtgggatatcagagattcagcaaagtgcattcgaacactaacgtcttcaggtcaagttactcttggagatgcttgttctgcaagtaccagtcgaacagtagctattccttctggagagaaccagatcaatcaaattgccctaaacccaactggcaccttcctctatgctgcttctggaaatgctgtcaggatgtgggatcttaaaaggtttcagtctacaggaaagttaacaggacacctaggccctgttatgtgccttactgtggatcagatttccagtggacaagatctaatcatcactggctccaaggatcattacatcaaaatgtttgatgttacagaaggagctcttgggactgtgagtcccacccacaattttgaaccccctcattatgatggcatagaagcactaaccattcaaggggataacctatttagtgggtctagagataatggaatcaagaaatgggacttaactcaaaaagaccttcttcagcaagttccaaatgcacataaggattgggtctgtgccctgggagtggtgccagaccacccagttttgctcagtggctgcagagggggcattttgaaagtctggaacatggatacttttatgccagtgggagagatgaagggtcatgatagtcctatcaatgccatatgtgttaattccacccacatttttactgcagctgatgatcgaactgtgagaatttggaaggctcgcaatttgcaagatggtcagatctctgacacaggagatctgggggaagatattgccagtaattaaacatgaatgaagataggttgtaaactgaatgctgtgataatactctgtattctttatggaaaatgttgtcctgtacttactaggcaaaacgtatgaatcggattaactggaaaatatatctgaattcaactgctgactataaatggtattctaataaaattgtgtactatcctgtgtgcttagttttaagatcaaccaatagatatatatcctacaattgatatattgctttattcacacttttattgtggctgaatttttgtgcctatctataaaacacactttcaaattatttgaattaccaagacgtctgcttttgtgacagtcagaaaacacacctggaatacgatgcagcccaccattaactcattcatgtagtttattcaagtgatttatgtatttaaactaaatattgaaaatgttagtcaaattgtggtttgcttgtcaggtatttatatcagtctgtagtggattcccaaatttcaaagctcttttaatgtaatggacaaaaataagatatgagaatattattgatgaattttcataaggtggaattgatcttaatctactaacagagaagggtagacagtttgtgttaaatgttggcatttacttgtattgaccaaagttttgcagctctactatattctgtgctcaggactaaaatgctgttaatttttttttttttttccagtgctgtgcatatattctgtgatgggaaacattgttgatgtcctaacagaaatatattttgatctattttcctatggagttgtttctattatgaccatttaattttgtttttatttaatagtagtatttccttcccttttatctaattttttatatgctgctaaatatattttaaatatactatgtttgcgaaccttggtagctatgatgagagctattatcatctgtggtgggaaaagctatgtaaataggtagattgtatagagagactatcttgtgttgtgcctgtatgaatttttaaaagttgttgactggattttgcaaaaggatgtataatatttctgtctgctcagaatattaatttgtaaattctgcaagtttaatttttatgtagatggtataacatttgaaaatattgtcttatgtgattttttcccctgaaaatatttgcttgtaaatgaaaacttagctagggcttaaataaacatgttgctatgaaatta

SEQ ID NO: 275624 - DNA, 6295 bp, Homo sapiens
acctttccattcagtcgcccaacatggctggagcgcggcggaggtgagccggccgcccgcccgcagacgccccagcctactgcgcccgagtcccgcggccccagtggcgcctcagctctgcggtgccgaggcccaacggctcgatcgctgcccgccgccagcatgttgggcgccccggacgagagctccgtgcgggtggctgtcagaataagaccacagcttgccaaagagaagattgaaggatgccatatttgtacatctgtcacaccaggagagcctcaggtcttcctagggaaagataaggcttttacttttgactatgtatttgacattgactcccagcaagagcagatctacattcaatgtatagaaaaactaattgaaggttgctttgaaggatacaatgctacagtttttgcttatggacaaactggagctggtaaaacatacacaatgggaacaggatttgatgttaacattgttgaggaagaactgggtattatttctcgagctgttaaacacctttttaagagtattgaagaaaaaaaacacatagcaattaaaaatgggcttcctgctccagattttaaagtgaatgcccaattcttagagctctataatgaagaggtccttgacttatttgataccactcgtgatattgatgcaaaaagtaaaaaatcaaatataagaattcatgaagattcaactggaggaatttatactgtgggcgttacaacacgtactgtgaatacagaatcagagatgatgcagtgtttgaagttgggtgctttatcccggacaactgccagtacccagatgaatgttcagagctctcgttcacatgccatttttaccattcatgtgtgtcaaaccagagtgtgtccccaaatagatgctgacaatgcaactgataataaaattatttctgaatcagcacagatgaatgaatttgaaaccctgactgcaaagttccattttgttgatctcgcaggatctgaaagactgaagcgtactggagctacaggcgagagggcaaaagaaggcatttctatcaactgtggacttttggcacttggcaatgtaataagtgccttgggagacaagagcaagagggccacacatgtcccctatagagattccaagctaacaagactactacaggattccctcgggggtaatagccaaacaatcatgatagcatgtgtcagcccttcagacagagactttatggaaacgttaaacaccctgaaatacgccaatcgagctagaaatatcaagaataaggtgatggtcaatcaggacagagctagtcagcaaatcaatgcacttcgtagtgaaatcacacgacttcagatggagctcatggagtacaaaacaggtaaaagaataattgacgaagagggtgtggaaagcatcaatgacatgtttcatgagaatgctatgctacagactgaaaataataacctgcgtgtaagaattaaagccatgcaagagacggttgatgcattgaggtccagaattacacagcttgttagtgatcaggccaaccatgttcttgccagagcaggtgaaggaaatgaggagattagtaatatgattcatagttatataaaagaaatcgaagatctcagggcaaaattattagaaagtgaagcagtgaatgagaaccttcgaaaaaacttgacaagagccacagcaagagcgccatatttcagcggatcatcaactttttctcctaccatactatcctcagacaaagaaaccattgaaattatagacctagcaaaaaaagatttagagaagttgaaaagaaaagaaaagaggaagaaaaaaagtgtggctggtaaagaggataatacagacactgaccaagagaagaaagaagaaaagggtgtttcggaaagagaaaacaatgaattagaagtggaagaaagtcaagaagtgagtgatcatgaggatgaagaagaggaggaggaggaggaggaagatgacattgatgggggtgaaagttctgatgaatcagattctgaatcagatgaaaaagccaattatcaagcagacttggcaaacattacttgtgaaattgcaattaagcaaaagctgattgatgaactagaaaacagccagaaaagactgcagactctgaaaaagcagtatgaagagaagctaatgatgctgcaacataaaattcgggatactcagcttgaaagagaccaggtgcttcaaaacttaggctcggtagaatcttactcagaagaaaaagcaaaaaaagttaggtctgaatatgaaaagaaactccaagccatgaacaaagaactgcagagacttcaagcagctcaaaaagaacatgcaaggttgcttaaaaatcagtctcagtatgaaaagcaattgaagaaattgcagcaggatgtgatggaaatgaaaaaaacaaaggttcgcctaatgaaacaaatgaaagaagaacaagagaaagccagactgactgagtctagaagaaacagagagattgctcagttgaaaaaggatcaacgtaaaagagatcatcaacttagacttctggaagcccaaaaaagaaaccaagaagtggttctacgtcgcaaaactgaagaggttacggctcttcgtcggcaagtaagacccatgtcagataaagtggctgggaaagttactcggaagctgagttcatctgatgcacctgctcaggacacaggttccagtgcagctgctgtcgaaacagatgcatcaaggacaggagcccagcagaaaatgagaattcctgtggcgagagtccaggccttaccaacgccggcaacaaatggaaacaggaaaaaatatcagaggaaaggattgactggccgagtgtttatttccaagacagctcgcatgaagtggcagctccttgagcgcagggtcacagacatcatcatgcagaagatgaccatttccaacatggaggcagatatgaatagactcctcaagcaacgggaggaactcacaaaaagacgagagaaactttcaaaaagaagggagaagatagtcaaggagaatggagagggagataaaaatgtggctaatatcaatgaagagatggagtcactgactgctaatatcgattacatcaatgacagtatttctgattgtcaggccaacataatgcagatggaagaagcaaaggaagaaggtgagacattggatgttactgcagtcattaatgcctgcacccttacagaagcccgatacctgctagatcacttcctgtcaatgggcatcaataagggtcttcaggctgcccagaaagaggctcaaattaaagtactggaaggtcgactcaaacaaacagaaataaccagtgctacccaaaaccagctcttattccatatgttgaaagagaaggcagaattaaatcctgagctagatgctttactaggccatgctttacaagatctagatagcgtaccattagaaaatgtagaggatagtactgatgaggatgctcctttaaacagcccaggatcagaaggaagcacgctgtcttcagatctcatgaagctttgtggtgaagtgaaacctaagaacaaggcccgaaggagaaccaccactcagatggaattgctgtatgcagatagcagtgaactagcttcagacactagtacaggagatgcctccttgcctggccctctcacacctgttgcagaagggcaagagattggaatgaatacagagacaagtggtacttctgctagggaaaaagagctctctcccccacctggcttaccttctaagataggcagcatttccaggcagtcatctctatcagaaaaaaaaattccagagccttctcctgtaacaaggagaaaggcatatgagaaagcagaaaaatcaaaggccaaggaacaaaagcactcagattctggaacttcagaggctagtctttcacctccttcttccccaccaagccggccccgtaatgaactgaatgtttttaatcgtcttactgtttctcagggaaacacatcagttcagcaggataaaggggcataatcaacccatttcctgcttcaaaaggaatcagagcttttccacttcagtgtattcacatagctgaagggcatacaaaagctgtgctctgtgtggattctactgatgatctcctcttcactggatcaaaagatcgtacttgtaaagtatggaatctggtgactgggcaggaaataatgtcactggggggtcatcccaacaatgtcgtgtctgtaaaatactgtaattataccagtttggtcttcactgtatcaacatcttatattaaggtgtgggatatcagagattcagcaaagtgcattcgaacactaacgtcttcaggtcaagttactcttggagatgcttgttctgcaagtaccagtcgaacagtagctattccttctggagagaaccagatcaatcaaattgccctaaacccaactggcaccttcctctatgctgcttctggaaatgctgtcaggatgtgggatcttaaaaggtttcagtctacaggaaagttaacaggacacctaggccctgttatgtgccttactgtggatcagatttccagtggacaagatctaatcatcactggctccaaggatcattacatcaaaatgtttgatgttacagaaggagctcttgggactgtgagtcccacccacaattttgaaccccctcattatgatggcatagaagcactaaccattcaaggggataacctatttagtgggtctagagataatggaatcaagaaatgggacttaactcaaaaagaccttcttcagcaagttccaaatgcacataaggattgggtctgtgccctgggagtggtgccagaccacccagttttgctcagtggctgcagagggggcattttgaaagtctggaacatggatacttttatgccagtgggagagatgaagggtcatgatagtcctatcaatgccatatgtgttaattccacccacatttttactgcagctgatgatcgaactgtgagaatttggaaggctcgcaatttgcaagatggtcagatctctgacacaggagatctgggggaagatattgccagtaattaaacatgaatgaagataggttgtaaactgaatgctgtgataatactctgtattctttatggaaaatgttgtcctgtacttactaggcaaaacgtatgaatcggattaactggaaaatatatctgaattcaactgctgactataaatggtattctaataaaattgtgtactatcctgtgtgcttagttttaagatcaaccaatagatatatatcctacaattgatatattgctttattcacacttttattgtggctgaatttttgtgcctatctataaaacacactttcaaattatttgaattaccaagacgtctgcttttgtgacagtcagaaaacacacctggaatacgatgcagcccaccattaactcattcatgtagtttattcaagtgatttatgtatttaaactaaatattgaaaatgttagtcaaattgtggtttgcttgtcaggtatttatatcagtctgtagtggattcccaaatttcaaagctcttttaatgtaatggacaaaaataagatatgagaatattattgatgaattttcataaggtggaattgatcttaatctactaacagagaagggtagacagtttgtgttaaatgttggcatttacttgtattgaccaaagttttgcagctctactatattctgtgctcaggactaaaatgctgttaatttttttttttttttccagtgctgtgcatatattctgtgatgggaaacattgttgatgtcctaacagaaatatattttgatctattttcctatggagttgtttctattatgaccatttaattttgtttttatttaatagtagtatttccttcccttttatctaattttttatatgctgctaaatatattttaaatatactatgtttgcgaaccttggtagctatgatgagagctattatcatctgtggtgggaaaagctatgtaaataggtagattgtatagagagactatcttgtgttgtgcctgtatgaatttttaaaagttgttgactggattttgcaaaaggatgtataatatttctgtctgctcagaatattaatttgtaaattctgcaagtttaatttttatgtagatggtataacatttgaaaatattgtcttatgtgattttttcccctgaaaatatttgcttgtaaatgaaaacttagctagggcttaaataaacatgttgctatgaaatta

SEQ ID NO: 275625 - DNA, 4573 bp, Homo sapiens
  misc_feature (2303)..(2303): n is a, c, g, or t
  misc_feature (2305)..(2305): n is a, c, g, or t
  misc_feature (2308)..(2309): n is a, c, g, or t
gggaaaagaaagacaggggaagaaaaaaggctacagaactgaaggaaagcatcgagaagaaacaaagtgtggctggtaaagaggataatacagacactgaccaagagaagaaagaagaaaagggtgtttcggaaagagaaaacaatgaattagaagtggaagaaagtcaagaagtgagtgatcatgaggatgaagaagaggaggaggaggaggaggaagatgacattgatgggggtgaaagttctgatgaatcagattctgaatcagatgaaaaagccaattatcaagcagacttggcaaacattacttgtgaaattgcaattaagcaaaagctgattgatgaactagaaaacagccagaaaagactgcagactctgaaaaagcagtatgaagagaagctaatgatgctgcaacataaaattcgggatactcagcttgaaagagaccaggtgcttcaaaacttaggctcggtagaatcttactcagaagaaaaagcaaaaaaagttaggtctgaatatgaaaagaaactccaagccatgaacaaagaactgcagagacttcaagcagctcaaaaagaacatgcaaggttgcttaaaaatcagtctcagtatgaaaagcaattgaagaaattgcagcaggatgtgatggaaatgaaaaaaacaaaggttcgcctaatgaaacaaatgaaagaagaacaagagaaagccagactgactgagtctagaagaaacagagagattgctcagttgaaaaaggatcaacgtaaaagagatcatcaacttagacttctggaagcccaaaaaagaaaccaagaagtggttctacgtcgcaaaactgaagaggttacggctcttcgtcggcaagtaagacccatgtcagataaagtggctgggaaagttactcggaagctgagttcatctgatgcacctgctcaggacacaggttccagtgcagctgctgtcgaaacagatgcatcaaggacaggagcccagcagaaaatgagaattcctgtggcgagagtccaggccttaccaacgccggcaacaaatggaaacaggaaaaaatatcagaggaaaggattgactggccgagtgtttatttccaagacagctcgcatgaagtggcagctccttgagcgcagggtcacagacatcatcatgcagaagatgaccatttccaacatggaggcagatatgaatagactcctcaagcaacgggaggaactcacaaaaagacgagagaaactttcaaaaagaagggagaagatagtcaaggagaatggagagggagataaaaatgtggctaatatcaatgaagagatggagtcactgactgctaatatcgattacatcaatgacagtatttctgattgtcaggccaacataatgcagatggaagaagcaaaggaagaaggtgagacattggatgttactgcagtcattaatgcctgcacccttacagaagcccgatacctgctagatcacttcctgtcaatgggcatcaataagggtcttcaggctgcccagaaagaggctcaaattaaagtactggaaggtcgactcaaacaaacagaaataaccagtgctacccaaaaccagctcttattccatatgttgaaagagaaggcagaattaaatcctgagctagatgctttactaggccatgctttacaagatctagatagcgtaccattagaaaatgtagaggatagtactgatgaggatgctcctttaaacagcccaggatcagaaggaagcacgctgtcttcagatctcatgaagctttgtggtgaagtgaaacctaagaacaaggcccgaaggagaaccaccactcagatggaattgctgtatgcagatagcagtgaactagcttcagacactagtacaggagatgcctccttgcctggccctctcacacctgttgcagaagggcaagagattggaatgaatacagagacaagtggtacttctgctagggaaaaagagctctctcccccacctggcttaccttctaagataggcagcatttccaggcagtcatctctatcagaaaaaaaaattccagagccttctcctgtaacaaggagaaaggcatatgagaaagcagaaaaatcaaaggccaaggaacaaaagcactcagattctggaacttcagaggctagtctttcacctccttcttccccaccaagccggccccgtaatgaactgaatgtttttaatcgtcttactgtttctcagggaaacacatcagttcagcaggataagtctgatgaaagtgactcctctctctcggaggtacacagntnctnnaggggcataatcaacccatttcctgcttcaaaaggaatcagagcttttccacttcagtgtattcacatagctgaagggcatacaaaagctgtgctctgtgtggattctactgatgatctcctcttcactggatcaaaagatcgtacttgtaaagtatggaatctggtgactgggcaggaaataatgtcactggggggtcatcccaacaatgtcgtgtctgtaaaatactgtaattataccagtttggtcttcactgtatcaacatcttatattaaggtgtgggatatcagagattcagcaaagtgcattcgaacactaacgtcttcaggtcaagttactcttggagatgcttgttctgcaagtaccagtcgaacagtagctattccttctggagagaaccagatcaatcaaattgccctaaacccaactggcaccttcctctatgctgcttctggaaatgctgtcaggatgtgggatcttaaaaggtttcagtctacaggaaagttaacaggacacctaggccctgttatgtgccttactgtggatcagatttccagtggacaagatctaatcatcactggctccaaggatcattacatcaaaatgtttgatgttacagaaggagctcttgggactgtgagtcccacccacaattttgaaccccctcattatgatggcatagaagcactaaccattcaaggggataacctatttagtgggtctagagataatggaatcaagaaatgggacttaactcaaaaagaccttcttcagcaagttccaaatgcacataaggattgggtctgtgccctgggagtggtgccagaccacccagttttgctcagtggctgcagagggggcattttgaaagtctggaacatggatacttttatgccagtgggagagatgaagggtcatgatagtcctatcaatgccatatgtgttaattccacccacatttttactgcagctgatgatcgaactgtgagaatttggaaggctcgcaatttgcaagatggtcagatctctgacacaggagatctgggggaagatattgccagtaattaaacatgaatgaagataggttgtaaactgaatgctgtgataatactctgtattctttatggaaaatgttgtcctgtacttactaggcaaaacgtatgaatcggattaactggaaaatatatctgaattcaactgctgactataaatggtattctaataaaattgtgtactatcctgtgtgcttagttttaagatcaaccaatagatatatatcctacaattgatatattgctttattcacacttttattgtggctgaatttttgtgcctatctataaaacacactttcaaattatttgaattaccaagacgtctgcttttgtgacagtcagaaaacacacctggaatacgatgcagcccaccattaactcattcatgtagtttattcaagtgatttatgtatttaaactaaatattgaaaatgttagtcaaattgtggtttgcttgtcaggtatttatatcagtctgtagtggattcccaaatttcaaagctcttttaatgtaatggacaaaaataagatatgagaatattattgatgaattttcataaggtggaattgatcttaatctactaacagagaagggtagacagtttgtgttaaatgttggcatttacttgtattgaccaaagttttgcagctctactatattctgtgctcaggactaaaatgctgttaatttttttttttttttccagtgctgtgcatatattctgtgatgggaaacattgttgatgtcctaacagaaatatattttgatctattttcctatggagttgtttctattatgaccatttaattttgtttttatttaatagtagtatttccttcccttttatctaattttttatatgctgctaaatatattttaaatatactatgtttgcgaaccttggtagctatgatgagagctattatcatctgtggtgggaaaagctatgtaaataggtagattgtatagagagactatcttgtgttgtgcctgtatgaatttttaaaagttgttgactggattttgcaaaaggatgtataatatttctgtctgctcagaatattaatttgtaaattctgcaagtttaatttttatgtagatggtataacatttgaaaatattgtcttatgtgattttttcccctgaaaatatttgcttgtaaatgaaaacttagctagggcttaaataaacatgttgctatgaaatta

SEQ ID NO: 275626 - DNA, 1863 bp, Homo sapiens
acctttccattcagtcgcccaacatggctggagcgcggcggaggtgagccggccgcccgcccgcagacgccccagcctactgcgcccgagtcccgcggccccagtggcgcctcagctctgcggtgccgaggcccaacggctcgatcgctgcccgccgccagcatgttgggcgccccggacgagagctccgtgcgggtggctgtcagaataagaccacagcttgccaaagagaagattgaaggatgccatatttgtacatctgtcacaccaggagagcctcaggtcttcctagggaaagataaggcttttacttttgactatgtatttgacattgactcccagcaagagcagatctacattcaatgtatagaaaaactaattgaaggttgctttgaaggatacaatgctacagtttttgcttatggacaaactggagctggtaaaacatacacaatgggaacaggatttgatgttaacattgttgaggaagaactgggtattatttctcgagctgttaaacacctttttaagagtattgaagaaaaaaaacacatagcaattaaaaatgggcttcctgctccagattttaaagtgaatgcccaattcttagagctctataatgaagaggtccttgacttatttgataccactcgtgatattgatgcaaaaagtaaaaaatcaaatataagaattcatgaagattcaactggaggaatttatactgtgggcgttacaacacgtactgtgaatacagaatcagagatgatgcagtgtttgaagttgggtgctttatcccggacaactgccagtacccagatgaatgttcagagctctcgttcacatgccatttttaccattcatgtgtgtcaaaccagagtgtgtccccaaatagatgctgacaatgcaactgataataaaattatttctgaatcagcacagatgaatgaatttgaaaccctgactgcaaagttccattttgttgatctcgcaggatctgaaagactgaagcgtactggagctacaggcgagagggcaaaagaaggcatttctatcaactgtggacttttggcacttggcaatgtaataagtgccttgggagacaagagcaagagggccacacatgtcccctatagagattccaagctaacaagactactacaggattccctcgggggtaatagccaaacaatcatgatagcatgtgtcagcccttcagacagagactttatggaaacgttaaacaccctgaaatacgccaatcgagctagaaatatcaagaataaggtgatggtcaatcaggacagagctagtcagcaaatcaatgcacttcgtagtgaaatcacacgacttcagatggagctcatggagtacaaaacaggtaaaagaataattgacgaagagggtgtggaaagcatcaatgacatgtttcatgagaatgctatgctacagactgaaaataataacctgcgtgtaagaattaaagccatgcaagagacggttgatgcattgaggtccagaattacacagcttgttagtgatcaggccaaccatgttcttgccagagcaggtgaaggaaatgaggagattagtaatatgattcatagttatataaaagaaatcgaagatctcaggtatagttcatgttctgtaacatataatgcacatgtttgttttggattttgcaatgttataatatttctgtttgttgggcttagtgttcaacagttgtccatggtgatatttcagccctttggttaggttaactttaggagattctttacttacctttcccttgatgtcatattccaagctgttttcctcctttctcttcccatattattctcctactcttactgctatgtc

SEQ ID NO: 275627 - DNA, 454 bp, Homo sapiens
gccgcctcctcaaccttgaaagacccctcacaggccccttccgagaccctcagagtccctaaaagggctgctgacacgcccgctgttcttagcggacagtgattggctacctgaaagatagcgccagcctcctgcctcttctcccgaccctggccttccgcagtccttgtttcccattagccggccgtcccgcctgtccgctgctgacctggtctgattggtagggtgcctccaacctgccgcattcctgccccgctcacctctagctctatttcgattggatttaggacacgccatctactgtgccttcatctctattggctatctcaacttaaagctctgcctcctcaggcctgttcgaccttccttcgaaaccaccccagcctgcgaattcccattggttgcagggtcctctgtgtgttcttgcccctcctgcttaatttaacccagtccc

SEQ ID NO: 275628 - DNA, 922 bp, Homo sapiens
  misc_feature (709)..(709): n is a, c, g, or t
gagatcaggcattgctgagagagtggagaaagaaaaggcacaagcagttgagcaacaggctaagaaacgactggagcagcagaagccgacagtgattgcaacttccactacttccccaacaagcagtacaaccagcaccatctctccagcacagaaggttatggtggcccccataagtggctcagttacaactggaaccaaaatggtactaactactaaagttggatctccagctacagtaacattccaacaaaacaagaactttcatcaaacctttgctacatgggttaagcaaggccagtcaaattcaggcgttgttcaagtacagcagaaagtcctgggtatcattccatcaagtacaggtaccagtcagcaaacctttacttcattccagcccaggacagcaacagtcacaattaggcccaatacctcaggctctggaggaaccacaagcaattcacaagtaatcacagggcctcagattcgccctggtatgaccgtgattagaacaccactccaacagtcaacactaggaaaggcaattattcgaacacctgtgatggtacagccaggtgctcctcagcaagtgatgactcaaatcatcagggggcagcctgtctccactgcagtctccgcccctaacacggtttcctcaacacctgggcagaaaagcttaacttcagcaacgtccacttcaaatatacagtcnttagcctcacaaccccctcgcccccaacaaggacaagtgaagctcaccatggctcaacttactcagttaacacaaggccacggtggcaatcaaggtttgacagtagtaattcaaggacaaggtcaaactactggacagttgcagttgataccttaaggggtgactgtacctccaggcccaagcccaccactaatgcaagctggaatgccaaat

SEQ ID NO: 275629 - DNA, 140 bp, Homo sapiens
acatttcatgcattggtgccctttcctagaagtcactacgttgctggttattttaaatctgaagcttattaaatgtcttataccccattagccaccagccccaccatatcagctccaaactatcccacgatctcaagggt

SEQ ID NO: 275630 - DNA, 536 bp, Homo sapiens
gtgatagctgttcctgaggatccccgttcgacggtgtcatgcggacaaagagactagaaacgcccaagcaaatctggccctggtattattgaaacctgggtagcagaagaagaactggaattgtgggagatcaggtcatttgctgagagagtggagaaagaaaaggcacaagcagttgagcaacaggctaagaaacgactggagcagcagaagccgacagtgattgcaacttccactacttccccaacaagcagtacaaccagcaccatctctccagcacagaaggttatggtggcccccataagtggctcagttacaactggaaccaaaatggtactaactactaaagttggatctccagctacagtaacattccaacaaaacaagaactttcatcaaacctttgctacatgggttaagcaaggccagtcaaattcagacagctgcggcatctgctacaaccattgccagcacaggtcagacgttccaaattacaggcaatccagtcactatggcaggaaaagtaattaccaaac

SEQ ID NO: 275631 - DNA, 391 bp, Homo sapiens
gatggtgaggtatatgctaagagttaagtcttttgacttattattttgaccagcctttcatccttcatattgagtttcattctatagaggaatgagctctcttggcctttaccattgtgctgtgaaagtagttcaaagtggttataatggttgttccataaagaagataaaataatgaatatatatagtattatgcagagcacgtatcactctgccatattctttccattattaactcaattcatttttcatgataaccctgggaagtaggcattattattctccaaaaaatgttcaatatttgccacagtcctgaaactagtaaatggcagagttgaaatctaaacccacctggcccaccctgggaagtttgtggaagtagattctgaat

SEQ ID NO: 275632 - DNA, 296 bp, Homo sapiens
tatatggaaagagctggagctctggtttaagataaagctaaaaaaagaagtagtcatctgaactatggcaaggtgtctgaatttaagagcaacaggaagctggtggagcattttacacaaagctgtaacatgatctgatttattctttaaaatgacactctggcttctttgtggggaaggtatttaagggtagcaatctgaataagtgctaaatttcgattagcttaatgttatttcaaagactgccatgtttcctcttcatctctcttgatataccagatgataggataattagc

SEQ ID NO: 275633 - DNA, 461 bp, Homo sapiens
aaattagatgtgtggtttagtctaccatcttaacccagaaaaccatttagatctacttttgctccttttttaaaaatgaatgaagtagaagtttcaggatactgagataaagaccaaagcgttcttctgtctcctttattttctctccatgacaatgtgaaaccatatttagatcaaacaagtgttcatttaagccctgtgcttttgagaaaaatagttttgaaagtttgagcaatctgagcaaacttggcccttggagctgacccaaaggagttttctacaaaccatgaccaaactttgtggacacagaggctggttgcttaaagaacagacctctcctaggtcagaaatgataggttccactgagagcaaattcaaacaacactgtttcatttgaaggaatttcaatatctaggtttttctctaataaatacattaaacaacaagcttaatttttcttg

SEQ ID NO: 275634 - DNA, 257 bp, Homo sapiens
ggattaagggcacagaggagggtctggctttagacacgagtgtttattatagtcacaggaggaaggcagaatatgtgcgtgaaattgggtaaacatggcactgggagtctgtgggggttcttatctgattacttcaatttctcagtgaagtaggaaacagaggctgcagtagcagttttcaacattagctgtatcataggctggggaaatttttttttttttgtgacagagtctcgctctgttgcccaggctggagt

SEQ ID NO: 275635 - DNA, 338 bp, Homo sapiens
tcaactcttggaatcagctcccgtaatttatgttttcctaggtaattggcttctaaatcttgaataataaacactgaataaacatagtttttcttcagttgttcatttcttcttagggacagattcactaattcacaagtaatttgaattatcataactgatcagttatgaaaaactgttactaattcaaggatattgcattatcagaaatgttttggcaaattttataagcagaggaaaacctcacataacagagataaaaccaaaaactcattttaaagggtcatataacaatatgtttatagatgtttattgaactgctgtgtataacgccctgt

SEQ ID NO: 275636 - DNA, 433 bp, Homo sapiens
tatttcattcaggtttctgttcagaaaaaatccttccctggtgatcctattgtggtagacataaaactgtgccacccagatcccattccagggaagaatatgctgctgagctgttggaagtacaatcagtggaaaaccttggtctgtcagcaacttcaaggtttgcctcctttgcagaaatggtccattcaaagtcatgcccttcctatagcagtctacattcaaccactgagtgaggcagaaataaaaaagtgctgataattttcaacctacaagggcattaatgagcaatacctgctccagagctccacagtgggttctcagaagatgtgtcttgcctgcagcacagcttgactccttccactattcattttttcttcttttccttttacttcagaggcattaaaaatgaataaaaatcttgaactccaga

SEQ ID NO: 275637 - DNA, 499 bp, Homo sapiens
tgctctgtgtgagttagaagatggaactcctcatctgtgaagagggaaagccaatgctccagggctaatggtttactgagaggatgatggacttggtctcttcctttctgctgagttagaggacagggcttattcagaaatgtctagttaatctctgctttttccgacttcaaggacctaatcataacactttgctactggcaactcaagcattatatattctgttatttttaaatattctattattttcttgcttgttttagacagtaacattgtttccttttactgctcagtctgggcatggctcatgattgcccattatagcttcagctgacatggatcctgtgttttagcaactagttctccaagtgtggccgctgacccgcagtatcagatcctctgggaaatgcaatgttagaaatgcaaatttctaggtcctaccccagaccgaatgaatccaacttctagaataaggccaagtaaatcagcgttttaattt

SEQ ID NO: 275638 - DNA, 624 bp, Homo sapiens
acacacaaggatcctcaataagataaggagatctctcatcagaaactttggagggacccactcccaagatggcagccgcaatggctgccagctgttgcggccacagtgaagacaggcagcaaaacaccagctggtcccagattcactgctaagtgctgaggggagtttttctctatcctctgtgacatttccaattttagataatgcctcacatctctgcccccactccagaacccgctgatgcccccatgatcccaaagaagacagcctaccctagaattcacccccaggatgttgcaacaccacattttgtttttacataatttaagagactaatgcattaaaaaaatagatataggttatgtttttagacacacaacgtgtaagatgcaatatcatgacatcaacaactgaaaggggtgagaaatggagctgttgaagaagccgagttttctatgctattgaagttaagctattataaattcaaattacagtgttataacttcaggatgttaaatgtaatgcccatggcaaccacacagaaaatagctaaagaatatacaccaaaaaaaatgagggccgggtgtagtggctcaagcctgtaataccagcactttggagacc

SEQ ID NO: 275639 - DNA, 415 bp, Homo sapiens
atgtttgattcatttaatcatttagatgcccctgcaaaccagttaaaagtgcatcctggccaggtgcagcggcccctgctgtaatcccagcactttgggaggacaaggcgggtgcgtggcttgagcccaggagttcaagaccagcctggacaacatggcgaaaccccatcttgatatacatgtatatacatctcccacaaaaaattaactgggcatggttgcaggtgcctgtactcaggaggctgaggcagggaggatcaattgagctcaggaggcagaggttgcagtgagttgaaatcataccgctgcactccagccttggtgacagagcaagactgtgtctcaggaaaagaaaaaaaatgcatcccattgttttttggggtgttttgattcttccttttctaatgtgcctcac

SEQ ID NO: 275640 - DNA, 480 bp, Homo sapiens
ttcaccccaatcatcttgatgcagagaggcttcagaaacacaagtgactctgtgttcagaccaagtacttggcctcgagaagatgaatgatcagaccaactcaccatatgattataagggtcaggtagtttaaaaagaaattacaatctgaattgaaccatggatgaacagtgttgctattgagcttcgaatcccagctaataagcataaccttgtaaagagaggttactgtttgggaaactgcatgttcttgcaggagggcaaagcttttgcaatataaatagttgtaagggtactagctttcatctttaataccttaaccctctgtgtttagagtttttgtatccagggctgaattgagaattttagaaaccttgaacactgaagagattgtaataacaaccccatgtgtaatttataaaatcttcaaaagaaaatttactttttcaaaatgttataaaactctgaatactgaaatga

SEQ ID NO: 275641 - DNA, 383 bp, Homo sapiens
ccttggtacctaacgtagtacctagtactctaaagtgggcattgaatatttattgaatgaatagatgtcagctccttttatgtttcaggcagcatgataagagttttacatgtatgtatgtatgtatttatgtatttatttgtatttacatatatgtatatatttatttatttattgcaaaaggggatctcactttctgtcccaggctggagtggagtggtgtgatcatagctcactgcagcctcaaacacctgagctcaggtgatcctcctgccttagccttccatgtatcgcagctactcgggaggctgaggtgggaagattacttgagcccaggaatttggggctacagcgaaccatgattgtgccactacactccagcc

SEQ ID NO: 275642 - DNA, 563 bp, Homo sapiens
ggtgtgcgccaccacgcccagctaatttttgtatttttagtagagacaggctttcaccacgttggtcaggatggtctcgatcttttgaccttgtgatctgcctatttctaaatttaagtttaaatgtctttccaatattgttgaaccaaccttacccatatttacttgaatatgtgggaacaaaatacttttttcaacattaaattttaatgaatttttattttcaatctagttgacattaacaaggctcttcttgccaagagaaagagactagaaatgtataccaaggcttctctcaaaactagtaaccagaaaattgaacatgtttggaaaacacaacaagatcaaaggtaaggtggttgctttttttttagagccacatttcttagtatttactggtataaattacttatgaaaaatactattctaggatcggcacggtggctcatgccagtaatcccagcactttgggaggccaaggcaggcagatcacttgaggtcaggagttagagaccagcctggccaacatggtgaaactccatctctactaaaaatacaaaaat

SEQ ID NO: 275643 - DNA, 1115 bp, Homo sapiens
agcttgcctcagaagcgtcgcggagaaggggccacctcaggtgaagcgcgcttgtggaggagttgtggaggacgcctgtcgacgaccagtaactggtcctcggccattgcggtgtgtttcaggaagcatctaaatatggtgtcctccggaaaaaagtattccaggaaatctgggaagccgtctgtggaagatcagtttacgagagcctatgactttgagactgaagataagaaagatctgagtggatcagaggaagatgttattgaagggaagactgcagtcattgagaaacgtaggaagaaaaggtcttctgcaggagtagttgaagatatggggggtgaagtgcagaatatgctggaaggagttggagttgacattaacaaggctcttcttgccaagagaaagagactagaaatgtataccaaggcttctctcaaaactagtaaccagaaaattgaacatgtttggaaaacacaacaagatcaaaggcagaagcttaaccaagaatattctcagcagtttctgactttgtttcagcagtgggatttagatatgcagaaagctgaggaacaagaagaaaaaatacttaatatgtttcggacagcaacaaagaattcttcaacaatctagaattgttcagagccagagattgaaaacaattaaacagttatatgagcagttcataaagagtatggaagagttggagaagaatcatgataatctacttactggtgcacaaaatgaatttaaaaaagaaatggctatgttgcaaaaaaaaattatgatggaaactcagcagcaagagatagcaagtgttcggaagtctcttcaatccatgttattctgatgactctttgaagaaagaacttgaacctaagtaatatgatacaattataacgttagctaagaagcatattgtaagtctttagaatagtttaattgtaacatctttaatcataaacctgtttcattgtaagacctccctttctgttaagtcaaatctaaatagttatgagttagttagcaactattcctaaagaatatgtattaagctttcagctctttagtaatgatagtgaatttttctctctaacactgtcaattaaataaagacg

SEQ ID NO: 275644 - DNA, 1243 bp, Homo sapiens
agcttgcctcagaagcgtcgcggagaaggggccacctcaggtgaagcgcgcttgtggaggagttgtggaggacgcctgtcgacgaccagtaactggtcctcggccattgcggtgtgtttcaggaagcatctaaatatggtgtcctccggaaaaaagtattccaggaaatctgggaagccgtctgtggaagatcagtttacgagagcctatgactttgagactgaagataagaaagatctgagtggatcagaggaagatgttattgaagggaagactgcagtcattgagaaacgtaggaagaaaaggtcttctgcaggagtagttgaagatatggggggtgaagtgcagaatatgctggaaggagttggagttgacattaacaaggctcttcttgccaagagaaagagactagaaatgtataccaaggcttctctcaaaactagtaaccagaaaattgaacatgtttggaaaacacaacaagatcaaaggcagaagcttaaccaagaatattctcagcagtttctgactttgtttcagcagtgggatttagatatgcagaaagctgaggaacaagaagaaaaaatacttaatatgtttcggacagcaacaaagaattcttcaacaatctagaattgttcagagccagagattgaaaacaattaaacagttatatgagcagttcataaagagtatggaagagttggagaagaatcatgataatctacttactggtgcacaaaatgaatttaaaaaagaaatggctatgttgcaaaaaaaaattatgatggaaactgtaagtgatcatattgaaattgaaaaaataaggattaatataagcaatgaaatattttatttgctgaaataggtataacacttaaataaaaattaaacaaatgtttaatatctccttccatgaaacagcagcagcaagagatagcaagtgttcggaagtctcttcaatccatgttattctgatgactctttgaagaaagaacttgaacctaagtaatatgatacaattataacgttagctaagaagcatattgtaagtctttagaatagtttaattgtaacatctttaatcataaacctgtttcattgtaagacctccctttctgttaagtcaaatctaaatagttatgagttagttagcaactattcctaaagaatatgtattaagctttcagctctttagtaatgatagtgaatttttctctctaacactgtcaattaaataaagacg

SEQ ID NO: 275645 - DNA, 470 bp, Homo sapiens
  misc_feature (57)..(58): n is a, c, g, or t
ctgaccctgtattccccccctgtgacaccccgccacgacgcctccggtagacactgnnggagttaatcatgataatctacttactggtgcacaaaatgaatttaaaaaagaaatggctatgttgcaaaaaaaaattatgatggaaactcagcagcaagagatagcaagtgttcggaagtctcttcaatccatgttattctgatgactctttgaagaaagaacttgaacctaagtaatatgatacaattataacgttagctaagaagcatattgtaagtctttagaatagtttaattgtaacatctttaatcataaacctgtttcattgtaagacctccctttctgttaagtcaaatctaaatagttatgagttagttagcaactattcctaaagaatatgtattaagctttcagctctttagtaatgatagtgaatttttctctctaacactgtcaattaaataaagacg

SEQ ID NO: 275646 - DNA, 218 bp, Homo sapiens
caagcatggtatgttgtggatcttctaaagtgtttaaaatgtaatttctttccaggggtgaagtgcagaatatgctggaaggagttggaggtaggttttaggagatacttgtatttaaagaaaattgttttaagccatataatttgtataataacaaatgttaataatggactataagactgttatttaatgccttgttctcacatagaagattctgc

SEQ ID NO: 275647 - DNA, 242 bp, Homo sapiens
gaagcatctaaatatggtgtcctccggaaaaaagtattccaggaaatctgggaagccgtctgtggaagatcagtttacgagagcctatgactttgagactgaagataagaaagatctgagtggatcagaggaagatgttattgaaggtgcagtacatctcatgttgggcagtgatgtccttcagttcatttgttttgaacccattgagactatcgtacaacttagtttgtaaagcattttca

SEQ ID NO: 275648 - DNA, 1051 bp, Homo sapiens
agcttgcctcagaagcgtcgcggagaaggggccacctcaggtgaagcgcgcttgtggaggagttgtggaggacgcctgtcgacgaccagtaactggtcctcggccattgcggtgtgtttcaggaagcatctaaatatggtgtcctccggaaaaaagtattccaggaaatctgggaagccgtctgtggaagatcagtttacgagagcctatgactttgagactgaagataagaaagatctgagtggatcagaggaagatgttattgaagggaagactgcagtcattgagaaacgtaggaagaaaaggtcttctgcaggagtagttgaagatatggggggtgaagtgcagaatatgctggaaggagttggagttgacattaacaaggctcttcttgccaagagaaagagactagaaatgtataccaaggcttctctcaaaactagtaaccagaaaattgaacatgtttggaaaacacaacaagatcaaaggcagaagcttaaccaagaatattctcagcagtttctgactttgtttcagcagtgggatttagatatgcagaaagctgaggaacaagaagaaaaaatacttaatatgtttcggacagcaacaaagaattcttcaacaatctagaattgttcagagccagagattgaaaacaattaaacagttatatgagcagttcataaaggtttgttgtatgtggtaacacaatacatcgttataaaacataatatatttatggaagtagaagataattctttctaagtttatgggaaaaaacattttagactttaactacttttccattttgaattcattgtttctgatttaagtgataaatatatttttacttgaggattcaaatggttttgttgggattattcaagacaggaaatggtaaattgggaattttacttagaaatatacttatcatgcataaaatccatactttaataacacttcagtcatagttctctgtttaagtgaaaatagactctataataatcatttttaggttgtattttacttgtttttttatccccagtgtttg

SEQ ID NO: 275649 - DNA, 221 bp, Homo sapiens
accgaacctccaagacacacagcttacccatgtaacaaacctgcacatatacccccagaacctaaaataaaggaagaaaaaaaaaagcattgtcttaaaacaacccaatctcaaactgaacatgtctaaacctatcactcccttcccctgccaagtctacttcctgccctttttccttatctagtgaatgccatcaccatctgtttatttgcctaagacag

SEQ ID NO: 275650 - DNA, 836 bp, Homo sapiens
  misc_feature (716)..(716): n is a, c, g, or t
  misc_feature (820)..(820): n is a, c, g, or t
agcgggtcaggtagagaagtagatactggctgtaatcctcaagtaaatgggatattcacaatgtatggaaacagaggtcattgaatctttgggaattattatttataaagcactggactatggtttgaaggagaatgaagaaagggaattaagccctcccctagagcagcttatcgatcacatggccaacacggtggaagctgacggtagcaatgatgagggctatgaggctgcagaagaaggcctgggagatgaagatgaaaagagaaaaatctcagctattcggtcatatagagatgtcatgaagttgtgtgctgctcatctccctactgaatcagatgcaccaaatcattatcaggcagtatgtcgtgcactgtttgcagaaacaatggagctccatacatttctgaccaaaattaagagtgcgaaagagaatcttaagaagattcaagaaatggaaaagagcgatgaatctagcacagacttggaagagctgaaaaacgctgactgggcacgattctgggtacaggtgatgagggatttgaggaatggggtaaaacttaagaaggtccaagagcggcagtacaaccctttgcccattgaatatcagctcaccccttatgagatgttaatggatgacattcgctgcaaaagatacaccttgcgaaaagtgatggtgaatggtgatattccccctcggttaaaaaaagaagtgntccatgaaaatcatcctccgactttcaatcaggattccagaccctccttttaaatccagtcttcagccagaaaaccttgaaaccaacttcccaccacgggccanggaggcctcccattga

SEQ ID NO: 275651 - DNA, 702 bp, Homo sapiens
agcgggtcaggtagagaagtagatactggctgtaatcctcaagtaaatgggatattcacaatgtatggaaacagaggtcattgaatctttgggaattattatttataaagcactggactatggtttgaaggagaatgaagaaagggaattaagccctcccctagagcagcttatcgatcacatggccaacacggtggaagctgacggtagcaatgatgagggctatgaggctgcagaagaaggcctgggagatgaagatgaaaagagaaaaatctcagctattcggtcatatagagatgtcatgaagttgtgtgctgctcatctccctactgaatcagatgcaccaaatcattatcaggcagtatgtcgtgcactgtttgcagaaacaatggagctccatacatttctgaccaaaattaagagtgcgaaagagaatcttaagaagattcaagaaatggaaaagagcgatgaatctagcacagacttggaagagctgaaaaacgctgactgggcacgattctgggtacaggtgatgagggatttgaggaatggggtaaaacttaagaaggtccaagagcggcagtacaaccctttgcccattgaatatcagctcaccccttatgagatgttaatggatgacattcgctgcaaaaaaaaaacacctttgccaaaaaagggaagggggaaaaggggggatttttt

SEQ ID NO: 275652 - DNA, 887 bp, Homo sapiens
  misc_feature (767)..(767): n is a, c, g, or t
  misc_feature (871)..(871): n is a, c, g, or t
actgcatccaacgccgccagcagtatgtcgtgcactgttgcagaaacaatggagctccatacatttctgaccaaaattaagagtgcgaaagaggtaaatgggatattcacaatgtatggaaacagaggtcattgaatctttgggaattattatttataaagcactggactatggtttgaaggagaatgaagaaagggaattaagccctcccctagagcagcttatcgatcacatggccaacacggtggaagctgacggtagcaatgatgagggctatgaggctgcagaagaaggcctgggagatgaagatgaaaagagaaaaatctcagctattcggtcatatagagatgtcatgaagttgtgtgctgctcatctccctactgaatcagatgcaccaaatcattatcaggcagtatgtcgtgcactgtttgcagaaacaatggagctccatacatttctgaccaaaattaagagtgcgaaagagaatcttaagaagattcaagaaatggaaaagagcgatgaatctagcacagacttggaagagctgaaaaacgctgactgggcacgattctgggtacaggtgatgagggatttgaggaatggggtaaaacttaagaaggtccaagagcggcagtacaaccctttgcccattgaatatcagctcaccccttatgagatgttaatggatgacattcgctgcaaaagatacaccttgcgaaaagtgatggtgaatggtgatattccccctcggttaaaaaaagaagtgntccatgaaaatcatcctccgactttcaatcaggattccagaccctccttttaaatccagtcttcagccagaaaaccttgaaaccaacttcccaccacgggccanggaggcctcccattga

SEQ ID NO: 275653 - DNA, 849 bp, Homo sapiens
  misc_feature (729)..(729): n is a, c, g, or t
  misc_feature (833)..(833): n is a, c, g, or t
gtctgttacccaccctggcgccgcgtcgacgacgcgggaagcgcccccagtgcgggtaaatgggatattcacaatgtatggaaacagaggtcattgaatctttgggaattattatttataaagcactggactatggtttgaaggagaatgaagaaagggaattaagccctcccctagagcagcttatcgatcacatggccaacacggtggaagctgacggtagcaatgatgagggctatgaggctgcagaagaaggcctgggagatgaagatgaaaagagaaaaatctcagctattcggtcatatagagatgtcatgaagttgtgtgctgctcatctccctactgaatcagatgcaccaaatcattatcaggcagtatgtcgtgcactgtttgcagaaacaatggagctccatacatttctgaccaaaattaagagtgcgaaagagaatcttaagaagattcaagaaatggaaaagagcgatgaatctagcacagacttggaagagctgaaaaacgctgactgggcacgattctgggtacaggtgatgagggatttgaggaatggggtaaaacttaagaaggtccaagagcggcagtacaaccctttgcccattgaatatcagctcaccccttatgagatgttaatggatgacattcgctgcaaaagatacaccttgcgaaaagtgatggtgaatggtgatattccccctcggttaaaaaaagaagtgntccatgaaaatcatcctccgactttcaatcaggattccagaccctccttttaaatccagtcttcagccagaaaaccttgaaaccaacttcccaccacgggccanggaggcctcccattga

SEQ ID NO: 275654 - DNA, 738 bp, Homo sapiens
agcgggtcaggtagagaagtagatactggctgtaatcctcaagtaaatgggatattcacaatgtatggaaacagaggtcattgaatctttgggaattattatttataaagcactggactatggtttgaaggagaatgaagaaagggaattaagccctcccctagagcagcttatcgatcacatggccaacacggtggaagctgacggtagcaatgatgagggctatgaggctgcagaagaaggcctgggagatgaagatgaaaagagaaaaatctcagctattcggtcatatagagatgtcatgaagttgtgtgctgctcatctccctactgaatcagatgcaccaaatcattatcaggcagtatgtcgtgcactgtttgcagaaacaatggagctccatacatttctgaccaaaattaagagtgcgaaagagaatcttaagaagattcaagaaatggaaaagagcgatgaatctagcacagacttggaagagctgaaaaacgctgactgggcacgattctgggtacaggtgatgagggatttgaggaatggggtaaaacttaagaaggtccaagagcggcagtacaaccctttgcccattgaatatcagctcaccccttatgagatgttaatggatgacattcgctgcaaaagatacaccttgcgaaaagtgatggtgaatggtgatattccccggtataaaagagtgctcatgcatcatcctcgatttcatcgctg

SEQ ID NO: 275655 - DNA, 199 bp, Homo sapiens
tctcccacaggtgctgagaccacagcgctgttccacaaagccccaggaagccacattaccctgtccaccggcctctctagccccatcttgcccaggaagtgggaccttggcgtatcgctgtgaccacacctcccagccggtcagcctggccgctcaggctctacctgcaaaggcaaggccccacccaaccagcacccct

SEQ ID NO: 275656 - DNA, 947 bp, Homo sapiens
ttcctttttacctacaatgttttggagcagaaatcactatatatcaaaacagtaacatggggttggagtttacactgattccttagctactctttgaaggctgtggagtaacccaaggcagacgtaagagacatgttccaactgagaactccaaataagggtgagtcagttttgcttttcagaagtacgtgtttcttctgagatgctgaacttcttaggtgaagtattacctatttctaggtttaatctcctttgacttttttttatagaaaatgttgacagaaactctattaagagactttgaaaatgcagcatcattctacagaaaaatagagacctagggtagttaaacaatctgctccaaactttataaaattttagcaggaagaagctagatcacttccagacacagtgggtcacactttgtgctagcacttctgaagaccaaagcaggaggaccgcatgaggccaggagtgcaagaccagcttgtgcaacacagtgagacgccatctctggaaaaagttaaaaaaaaaaaataatagccaactgtggtggctaaaaaataacctagattttttttaacatttgaggagtttgggctctacattagacttccttacttgagtttacaacataactttacagaattaaaatactgaaagttgaatcttcagccatcaatatttatatacagagttatatggagtgttctacagagtgttctgaagtggaatcttgaaaaaaaaaagttctaaactaattatttcatgtgatgattacctgttttgttatctacaataagttttagttaaaaatgagatttttggttgggcgcagtagcacatgcctataatcccagcactttggaaggctgaggtgggcagatagcttgagcccaggagttctataccagcctgggcaacatggaaaaacccatctctacaaa

SEQ ID NO: 275657 - DNA, 393 bp, Homo sapiens
ggaacctaccccataagcctgagagcactcggctttccattctacatccatttagagtagaccatccccaaatgaaatctgaattctgttcaatttaaggctaggcacagtggctcgtgcctgtaatcccagcactttgggaggccaaggctggtgaatcacttgagcccaggagatcgagaccagtctgggcaacatggtgaaaccccacctctataaaaaatacaaaaactagctgggcgtggtggcgtgtgcctgtagtctcagctactcaggaggctgaagtgggaggatcacttgaactgggagacagaggctgcagtgagccgagatcaaactactgggctccagcctgggtgacaagagcaagaccctgtctttaaatttaaaaaa

SEQ ID NO: 275658 - DNA, 345 bp, Homo sapiens
  misc_feature (11)..(11): n is a, c, g, or t
  misc_feature (228)..(228): n is a, c, g, or t
  misc_feature (310)..(310): n is a, c, g, or t
  misc_feature (313)..(313): n is a, c, g, or t
tgggccttctngatacccgagaggcactgggcaatgcggtgctgtggctcgctaggtcttcgcccccatcccgccccctcccaaagccccagctccaggagccccccgcaaccccaggcgcttgtctcacctggctcggtacacaggtaggagtaaaagccctctgacttgagcatgatgagcagcgagccccagcccaggaggactgccgagaagaggaggttctcncagcacggccgtgcaggccattccaccagcggcgccgatgggcagtggccagggtgggcgccatggtgcggcgcggcgcggnctnccggctccggctccggctctgcaccacctgcg

SEQ ID NO: 275659 - DNA, 232 bp, Homo sapiens
attgccttgaggggagtgttgatagaaataagggcattaaagtctattttgttgtggtctcagatataaatgagggacatgtacttggaaattggaagaaaggtaatctttgttacaaagtagcaaacaaaatggctgctgccttgtcttctagtgttttgtggaaggcagaagttgtgaataacaaacatagaaatttagctgaggagatttcagagcaaaggattgaagg

SEQ ID NO: 275660 - DNA, 890 bp, Homo sapiens
  misc_feature (149)..(149): n is a, c, g, or t
  misc_feature (151)..(151): n is a, c, g, or t
  misc_feature (167)..(167): n is a, c, g, or t
  misc_feature (171)..(171): n is a, c, g, or t
  misc_feature (176)..(176): n is a, c, g, or t
  misc_feature (185)..(185): n is a, c, g, or t
  misc_feature (187)..(187): n is a, c, g, or t
  misc_feature (197)..(198): n is a, c, g, or t
ttccccacctcccccccggggcaaagggttcagaaagggaggccccgagattcaaaaaccttttttaagaaactcccccccgggacctttttttccattgggaaccctggagaatgccgcaccaagaccaacttgccaattcatatgtntnaaaagaagaaacccangggntgatntagtcaagntnatcctctccnnccagcggaaaagaacaggaggcagaaggtgaggccacagtcatttgagccctgcaggcccctccggacgtcaccacggtggccgtggaggagacaataccctcattcacggggaggagcccaaaccactgacccacagactctgcaccccgacgccagagatacctggagcgacggctgctgaaagaggctgtccacctggcggaaccaccggagcccggaggcttggcgtccccctgggctggcttccgtctcctccagtggagggagaggtggggccctgctggggtagagctggggacgccacgtgccattcccatgggccagtgagggcctggggcctctgttctgctgtggcctgagctccccagagtcctgaggaggagcgccagttgcccctcgctcacagaccacacacccacgcctcctgggccacgcagagggcccttcagaccccagctgtctgcgcgtctgactcttgtggcctcagcaggacaggccccggcactgcctcacagccaaggctggactgggttggctgcagtgtggtgtttagtggataccacatcggaagtgattttctaaattggatttgaattcggctcctgttttctatttgtcatgaaacagtgtatttggggagatgctgtgggaggatgtaaatatcttgtttctcctcaaactgtcacctcc

SEQ ID NO: 275661 - DNA, 265 bp, Homo sapiens
agaccactggcgagctggagggctggcagacacccctggaccaacttggtcaaagtgggaccctttttcctcaagaacagcagctgtaggtgatgagtgccatcatgcactggctgagtcatgattcttcaggggatatggaagactgaattagctttagggatctttgtaaaatatagaaaagtatagtacaaagtcaaatatgaatattaaaaatgtactgtaaagatcaagcatgatataaatttattttttcactttagta

SEQ ID NO: 275662 - DNA, 362 bp, Homo sapiens
ttctgggtttggggctttgggaatgtgctagtcacaagccctgtggagagtttttatttgcaagtttgggaaactgcctcaagtattatctgcacttctataaactgtgtcctagaagcctgtactatgttattatgtaatgtaatatactacatatgttagtgtataatatactgcgttatgttatagcagagtaagtgatgtttgtccttcttggtgcactgaatcagactcatagtgtgggtttgtcccctgggtggcaatgctaagttgtgtcacttcatgaggctggagtctgccataactctccattgcaaatcccttttcccttttatagctaataaagataatgtgtagggtga

SEQ ID NO: 275663 - DNA, 489 bp, Homo sapiens
aggggtgagagacggagagaggaaaaagaggggggcggccagaagagggaaggagaggcgtggggacagggcccccgcccccgccggggtcgggtttgatggtgaaatagtaaacccacgcacggagggtcgccaggaaagtggacattaccgctttaattaacttcgagatgctccggcggcgggacctggcgtagccgtgacgcgcccccataaatctgcccggcccggggctgctccgagaactcgtacagtagcggcgtcagatccatcccgcgcctcccagtccggagtccatttgcataattggattttttttttttgcctccttctttctccctgaaacttgtttgaaaacccaagtgaaaaccgcgacgatctgcacactcaaaagcaagtgccaagtttcctgaccaccacggctttaagaatatccttcaaccgggagggagatccattgctttaagacttgcctggtaaggaccatcg

SEQ ID NO: 275664 - DNA, 2231 bp, Homo sapiens
aggggtgagagacggagagaggaaaaagaggggggcggccagaagagggaaggagaggcgtggggacagggcccccgcccccgccggggtcgggtttgatggtgaaatagtaaacccacgcacggagggtcgccaggaaagtggacattaccgctttaattaacttcgagatgctccggcggcgggacctggcgtagccgtgacgcgcccccataaatctgcccggcccggggctgctccgagaactcgtacagtagcggcgtcagatccatcccgcgcctcccagtccggagtccatttgcataattggattttttttttttgcctccttctttctccctgaaacttgtttgaaaacccaagtgaaaaccgcgacgatctgcacactcaaaagcaagtgccaagttgtgcaggacagcattgcatggcacggctgcttgttttgtgctttcacaacgtcctccatggagctcatggcccttcatctccaggccaaccacctgggcaaagcgaaacgcaaagataacaccatcggggtcacagtcaactgcaaagaccaagcccgggaggcgagtaagatggccctgctgccctcgttacaatcaaacaaagacctgggcctctccaatatgatcagctctctagactctgcttctgagaagatggcccaaggtcagctcaaggagactctgggagagcagaagagcggtgcatggaccggccacgtggaccctgcattttgtaacttcccatcagacttctacaagcagtttggtgtttacccaggcatggttggctcaggggcctccagttcctgccccaacaaggagcctgatggaaaggcccactctgaagaggatgtccccatcctgatccccgaaaccacgagtaagaacactactgatgacctctctgacattgcctcctcagaggacatggactcctccaagggggagaacaacgatgaagaggatgttgaaaccgaaccggaaatgatgaccaagccactgtctgccctcagcaaagacagcagcagcgatggcggggacagcctgcagcccacaggcacctcccagcccgtccagggactggtctcacctttatcccaagcaccggagaagcagtggcacagccagggtcttctccaagcccaggaccccttggcgggcctgccaaagccggagcgggggccccagagcctggacaagccgatgaacatgctgtcggtcctcagggcctacagttctgatggcttagcagcctttaacggacttgcaagtagcacagcaaattctggatgtatcaagaggccagacttgtgtggtaagtgacactccctgtcctagtcggtctatctggacttgcccttgtctgttcgtggtcctcggtggttatctgcagcttgttaatcgtgtaaagtcaagagaagaatgtatacacatatgtgtgttgaataattactattggcataggtatgtgtatacacacggtgcaccaatctacagtatatatagcagagaatcagaggctaaaaatattaccccatatgttccagtattagtcatggattgcaaaggcttagtaacttgagcaggagagaaaactccctcaaagtcataaatcctgagtgacaactgctgctggatgacagatcccttcacctgtggacaacctggctgggggtggggggctgttccaccagctcacctgagcatgtagaggtgggtcctgcagtggtctcgtgggtattactgcttgtgtctgattgtcctgtattttgtaacactttagaagaatacagaaaagtgcagtaattctctttctccatagtatttaagcagaaatattgctagtttaatattgtgtcaggtcgtcctattaaccaggagcagatgacagtaaaatttcagtgaatagcaccttgacatctacaacttaaaaatggtgattgaagcaaaatatgtaaacttgtacggggtgatcgtgtgctttggaacagagtattgttgaagtaattagaagatatattaaggtgttcctggtaatgaaggcatgtaagttataataattgtagctttctgaataagtgtcaaactatatctttaagtgtgctgtatgctgagttacaagttaggtcatttatgaatggaatgtaaaataatactaaaaatgcttcaataacttatcttggtattgctaataaaaaaaaaaagctgtgaaacattagtgca

SEQ ID NO: 275665 - DNA, 308 bp, Homo sapiens
tgttgtgtgcaaagcccagggttcaaataagcagtaattatctcctattacttagtgctgatcaacagcacctctacgtctaattgccaacctgccctaatcatgttgactattcttgctttagccagagacagaaggaccaaattttataaataacactttattgtcattattccattaaacgattaggggatgtggccctgcccttgctttcaaatgcctctagccctgatggtttctggattatttaataaatctgcacattttcttgcaggtaagtgacactccctgtcctagtcggtctatct

SEQ ID NO: 275666 - DNA, 892 bp, Homo sapiens
gataaacgcctcttttttttcttatatcaaaatcttgcaggtgagaaaccctacaagtgtccgcactgtgactatgccggcacgcagtcagcatccttaaaataccacttagagcgacaccatcgggagcggcagaacggggctgggccgctgtctgggcaacccccaaatcaagaccacaaggatgagatgtcaagcaaagcttctctgttcatcaggccagacatcctgaggggggccttcaagggtctccctggaatcgacttcagaggaggccctgcatctcagcagtggacatcaggggttctctcctctggagatcactcggggcaggccacgggcatgtcttcggaggtcccctcagatgctctgaaaggcactgaccttccttccaaaagcacccacttctctgagatcggaagagcttatcaaagcattgtgagcaacggtgtgaatttccaagggtccttgcaagctttcatggacagttttgtcctcagttccttgaagaaggagaaggacatgaaggacaaagccctggctgaccccccttccatgaaagtccacggagtggatggtggtgaggagaaacccagtggcaagtcctcccagaggaagtccgagaaatctcagtatgaacccctggacttgtctgtgcggccagatgccgcctccctcccgggctcctcggtaactgtgcaggacagcattgcatggcacggctgcttgttttgtgctttcacaacgtcctccatggagctcatggcccttcatctccaggccaaccacctgggcaaagcgaaacgcaaagataacaccatcggggtcacagtcaactgcaaagaccaagcccgggaggcgagtaagatggccctgctgccctcgttacaat

SEQ ID NO: 275667 - DNA, 4941 bp, Homo sapiens
gtctggagaagagagtttccacgttgtcatcataggatctggactcaagtgaccaaaaccttgcttggatttttacctgatgaagtttgtcttgaaaagtgaaaatggttccatttccattttccctgttctcaagggatggaagaagcgagcctgtgccttggagtgtcttcggcggagccggaagctgagccccacctgagtggccccgtcctcaacggccagtatgccatgagtcagaagctgcaccagatcacctcccagctcagccatgccttccccgagctccatccccggcccaaccccgaggagaagccccccgcatccctggaggagaaggcccacgtgcccatgagcggccagcccatgggcagtcagatggcgctcctggccaaccagctgggccgggaggtggacaccagcctcaacgggagggtggacttgcagcagttcctcaacgggcagaacctgggcatcatgtcccagatgagcgacatcgaggacgacgcccgcaagaaccgcaagtacccgtgcccactctgcggcaagcgcttccgcttcaacagcatcctctccctgcacatgcgcacgcacacgggcgagaagcccttcaagtgcccgtactgcgaccacagggcggcgcagaaggggaacctcaagattcacctgcggacccacaagctgggcaacctgggcaaggggcgtgggcgtgtgcgcgaggagaaccgcctgctgcacgagctggaggagcgcgccatcctgcgggacaagcagctgaaaggcagcctgctgcagccccggccggacctgaagcccccgccgcacgcccagcaggccccgctggccgcctgcaccctggccctgcaggctaaccacagcgttcccgacgtggcccacccggtgccctcgcccaagcctgccagcgtgcaggaggacgcggtggccccggcggcgggcttccgctgtaccttctgcaagggcaagttcaagaagcgcgaggagctggaccgccacatccgcatcttgcacaagccctacaagtgcacgttgtgcgacttcgcggcttcgcaggaggaggagctcatcagccacgtggagaaggcacacatcacggccgagtcggcccagggccagggccccaacggcggtggcgagcagtcggccaacgagttccgctgcgaggtgtgcggtcaggtgttcagccaggcgtggttcctcaagggtcacatgcgcaagcacaaagactcctttgagcactgctgccagatctgcggccggcgcttcaaggagccctggttcctcaagaaccacatgaaggtccacctcaacaagctgtcggtgaagaacaagtcccccagcgaccccgaggtgcctgtgcccatgggcggcatgtcccaggaggcccacgccaacctgtactccaggtacctctcctgcctgcagagtggcttcatgaccccggacaaagccggcctgagcgagcccagccagctctatggcaagggcgagctgcccatgaaggagaaggaagcgctggggaagctgctgtctcccatctccagcatggcccacggcgtcccggagggggacaagcactccctcctgggatgcctcaatctcgtgccgccgctgaaatccagctgcatcgagcggctgcaggcggctgccaaggctgcggagatggaccccgtgaacagctaccaggcttggcagctcatggccaggggcatggccatggaacatggcttcttgtctaaagagcatccgctgcagcgcaaccacgaagacactttggcaaacgccggggttctgtttgataaggagaagcgggagtacgtgttagtgggagcagatggctccaagcagaaaatgcctgctgatttggttcacagcactaaagtgggcagccagagagacctgccaagtaagctcgaccctttagaaagcagtcgggattttttgtcacacgggctgaaccagactctcgagtataacctgcagggtcctgggaacatgaaggagaagcccaccgagtgccccgactgcggccgggtgttccgcacttaccaccaggtggtcgtgcactcccgtgtccacaagcgggaccgcaagggcgaggaggatgggctgcacgtgggcctggatgagcggcgtggctcgggcagtgaccaggagtcccagtcggtgagccgctccaccacgccgggctcctctaacgtcaccgaggagagcggggtcggaggcggcctctcccagaccgggagtgcccaggaggacagcccgcacccctcctcgccatcctcctcagacattggcgaggaggctgggagatctgccggcgtccagcaaccagcgctgcttcgcgacagaagcctgggctcggccatgaaggactgcccgtactgtgggaaaactttccggacatcccatcaccttaaggtgcacctgaggatacacacaggtgagaaaccctacaagtgtccgcactgtgactatgccggcacgcagtcagcatccttaaaataccacttagagcgacaccatcgggagcggcagaacggggctgggccgctgtctgggcaacccccaaatcaagaccacaaggatgagatgtcaagcaaagcttctctgttcatcaggccagacatcctgaggggggccttcaagggtctccctggaatcgacttcagaggaggccctgcatctcagcagtggacatcaggggttctctcctctggagatcactcggggcaggccacgggcatgtcttcggaggtcccctcagatgctctgaaaggcactgaccttccttccaaaagcacccacttctctgagatcggaagagcttatcaaagcattgtgagcaacggtgtgaatttccaagggtccttgcaagctttcatggacagttttgtcctcagttccttgaagaaggagaaggacatgaaggacaaagccctggctgaccccccttccatgaaagtccacggagtggatggtggtgaggagaaacccagtggcaagtcctcccagaggaagtccgagaaatctcagtatgaacccctggacttgtctgtgcggccagatgccgcctccctcccgggctcctcggtaactgtgcaggacagcattgcatggcacggctgcttgttttgtgctttcacaacgtcctccatggagctcatggcccttcatctccaggccaaccacctgggcaaagcgaaacgcaaagataacaccatcggggtcacagtcaactgcaaagaccaagcccgggaggcgagtaagatggccctgctgccctcgttacaatcaaacaaagacctgggcctctccaatatgatcagctctctagactctgcttctgagaagatggcccaaggtcagctcaaggagactctgggagagcagaagagcggtgcatggaccggccacgtggaccctgcattttgtaacttcccatcagacttctacaagcagtttggtgtttacccaggcatggttggctcaggggcctccagttcctgccccaacaaggagcctgatggaaaggcccactctgaagaggatgtccccatcctgatccccgaaaccacgagtaagaacactactgatgacctctctgacattgcctcctcagaggacatggactcctccaagggggagaacaacgatgaagaggatgttgaaaccgaaccggaaatgatgaccaagccactgtctgccctcagcaaagacagcagcagcgatggcggggacagcctgcagcccacaggcacctcccagcccgtccagggactggtctcacctttatcccaagcaccggagaagcagtggcacagccagggtcttctccaagcccaggaccccttggcgggcctgccaaagccggagcgggggccccagagcctggacaagccgatgaacatgctgtcggtcctcagggcctacagttctgatggcttagcagcctttaacggacttgcaagtagcacagcaaattctggatgtatcaagaggccagacttgtgtggtaagtgacactccctgtcctagtcggtctatctggacttgcccttgtctgttcgtggtcctcggtggttatctgcagcttgttaatcgtgtaaagtcaagagaagaatgtatacacatatgtgtgttgaataattactattggcataggtatgtgtatacacacggtgcaccaatctacagtatatatagcagagaatcagaggctaaaaatattaccccatatgttccagtattagtcatggattgcaaaggcttagtaacttgagcaggagagaaaactccctcaaagtcataaatcctgagtgacaactgctgctggatgacagatcccttcacctgtggacaacctggctgggggtggggggctgttccaccagctcacctgagcatgtagaggtgggtcctgcagtggtctcgtgggtattactgcttgtgtctgattgtcctgtattttgtaacactttagaagaatacagaaaagtgcagtaattctctttctccatagtatttaagcagaaatattgctagtttaatattgtgtcaggtcgtcctattaaccaggagcagatgacagtaaaatttcagtgaatagcaccttgacatctacaacttaaaaatggtgattgaagcaaaatatgtaaacttgtacggggtgatcgtgtgctttggaacagagtattgttgaagtaattagaagatatattaaggtgttcctggtaatgaaggcatgtaagttataataattgtagctttctgaataagtgtcaaactatatctttaagtgtgctgtatgctgagttacaagttaggtcatttatgaatggaatgtaaaataatactaaaaatgcttcaataacttatcttggtattgctaataaaaaaaaaaagctgtgaaacattagtgca

SEQ ID NO: 275668 - DNA, 2177 bp, Homo sapiens
aggggtgagagacggagagaggaaaaagaggggggcggccagaagagggaaggagaggcgtggggacagggcccccgcccccgccggggtcgggtttgatggtgaaatagtaaacccacgcacggagggtcgccaggaaagtggacattaccgctttaattaacttcgagatgctccggcggcgggacctggcgtagccgtgacgcgcccccataaatctgcccggcccggggctgctccgagaactcgtacagtagcggcgtcagatccatcccgcgcctcccagtccggagtccatttgcataattggattttttttttttgcctccttctttctccctgaaacttgtttgaaaacccaagtgaaaaccgcgacgatctgcacactcaaaagcaagtgccaagttgtgcaggacagcattgcatggcacggctgcttgttttgtgctttcacaacgtcctccatggagctcatggcccttcatctccaggccaaccacctgggcaaagcgaaacgcaaagataacaccatcggggtcacagtcaactgcaaagaccaagcccgggaggcgagtaagatggccctgctgccctcgttacaatcaaacaaagacctgggcctctccaatatgatcagctctctagactctgcttctgagaagatggcccaaggtcagctcaaggagactctgggagagcagaagagcggtgcatggaccggccacgtggaccctgcattttgtaacttcccatcagacttctacaagcagtttggtgtttacccaggcatggttggctcaggggcctccagttcctgccccaacaaggagcctgatggaaaggcccactctgaagaggatgtccccatcctgatccccgaaaccacgagtaagaacactactgatgacctctctgacattgcctcctcagaggacatggactcctccaagggggagaacaacgatgaagaggatgttgaaaccgaaccggaaatgatgaccaagccactgtctgccctcagcaaagacagcagcagcgatggcggggacagcctgcagcccacaggcacctcccagcccgtccagggactggtctcacctttatcccaagcaccggagaagcagtggcacagccagggtcttctccaagcccaggaccccttggcgggcctgccaaagccggagcgggggccccagagcctggacaagccgatgaacatgctgtcggtcctcagggcctacagttctgatggcttagcagcctttaacggacttgcaagtagcacagcaaattctggatgtatcaagaggccagacttgtgtggtaagtgacactccctgtcctagtcggtctatctggacttgcccttgtctgttcgtggtcctcggtggttatctgcagcttgttaatcgtgtaaagtcaagagaagaatgtatacacatatgtgtgttgaataattactattggcataggtatgtgtatacacacggtgcaccaatctacagtatatatagcagagaatcagaggctaaaaatattaccccatatgttccagtattagtcatggattgcaaaggcttagtaacttgagcaggagagaaaactccctcaaagtcataaatcctgagtgacaactgctgctggatgacagatcccttcacctgtggacaacctggctgggggtggggggctgttccaccagctcacctgagcatgtagaggtgggtaacactttagaagaatacagaaaagtgcagtaattctctttctccatagtatttaagcagaaatattgctagtttaatattgtgtcaggtcgtcctattaaccaggagcagatgacagtaaaatttcagtgaatagcaccttgacatctacaacttaaaaatggtgattgaagcaaaatatgtaaacttgtacggggtgatcgtgtgctttggaacagagtattgttgaagtaattagaagatatattaaggtgttcctggtaatgaaggcatgtaagttataataattgtagctttctgaataagtgtcaaactatatctttaagtgtgctgtatgctgagttacaagttaggtcatttatgaatggaatgtaaaataatactaaaaatgcttcaataacttatcttggtattgctaataaaaaaaaaaagctgtgaaacattagtgca

SEQ ID NO: 275669 - DNA, 419 bp, Homo sapiens
ttaattaactgcatgaatgaatgagtgagtgataaacaaataaatgaaagtgtgaaagtcctccttagcagtctccttgatattctcaggattaatatttttgtcttttaagtatatcctctgcaaaacacactcctgcagtaaaagtaagcctgttacttcaatttgaagaccgcctttttcatcctgccaggccagatatcctatgataaatagtttagtttttcttgctgattccagggcacataaagttctcaactgtgaaggtgccagaagctttctggattcaaagtgtctatccagatggacagactggggagccaggctcttcattgctttctctgctctaaaaattctcagcatttcatttgaacacatcaaagcaggctcagattaaagacaaaatgagcttgacacaa

SEQ ID NO: 275670 - DNA, 392 bp, Homo sapiens
aggccgccgagaggccgttgctgggcctggggaggccaacttgaggacgacttgggcctgcagaggccgccgggaggcaggagctggccctggacaggccgacttgacgacagtctgggcctgcagaggccgccgagaggaagagctgggcctggagaggccgactggaggaagtccagggcctggagaggatgcaaagcagcaaacgctaggcctggaaaggctgccctgaggcacgggcttggccagcagaggccactgggaggcaggagctgggcccacagaggctcccgagagggaggagcattgccccaggaggccacggtgaggaagaggtgggcctggagagcccactgtgaggtagaggccgggcctgtagaggccgccgacag

SEQ ID NO: 275671 - DNA, 365 bp, Homo sapiens
ttgccaggagtttaagggagagggggatgaataagcagagattcacagatcattatgactgtgaaaatactctgtatgatactataatggtggacacatatcattatacatttctcaaaacccatacaacaccaaaagtacaacaccaagagtgaattgtaatgtaacctgtggactttgggtgataatgatgtgtcaatatagtttcatgaattataacacatgtaccactctgctggtgggggatgcagatatgagggaggagggtggtcaggagttatataggaactcttctgtattttctgctcagttttacagggaacccaaaactgctctaaaaaataaactttattaaaagtgaaaag

SEQ ID NO: 275672 - DNA, 576 bp, Homo sapiens
ttgaatagtggaggacaatagtttcagaaagttcgtcaatttaaatatttcttctggcaggacaactatcctaagtgatatgtgcattatatcagaatgcacataattccagtgtatcacattacctgtaatgggtaagtgtggtaggcagaaatgtccacttcaccctacaacaccagagatgtcactgtcctaatccccagaacatgttgacatgtcaccttacatggcaaaaggaactttgcaaatgtgattaagattttgagatggagattatcctagattacctggatgggccccagtcatcacaagcgttcttatgagtgaaagaggcggggggcagaggagtcgggtcagagtgatgtgatgtgcaaaagactcatctggccattgctgcctttgaaaagggaggaaggggaaccacaagccaaggaatgcaggcggttcctcttctcccataggcttccagacaaaaagcagctctgccaacatcttgactttagcccactgagacttacgttgtacttctgaactacagaactgtaagataataaatttgtatggctttaagtccct

SEQ ID NO: 275673 - DNA, 747 bp, Homo sapiens
tctcctcaccaaggcattaagaaatgcatgggtgaggggaacagcggcgtgcatgtaaaggtcctgtggcgcctctcctctacaggctggaggtcatggcgggagatgctgcatggatttgccctccctgctgtcagaacaacagggttctggaagagtagaggacaggccgtgggacttggctgtctagagacaaggcgggagggatttccttgagaggcagggacatgtggtggttactaatcattgtgaggtgtctgggatgtaatggatgggaaatctactaagaagtcaacttatgtaataattagaaaagctctagttctgaggacagagacctgttggagtcaccatagtggaaatttatgacctggtatccagttcagatacctggagcttcttgactggggggagattggatcccttggggaagagtgaagccttcaatgctgccacaagtgtgatccgcccgcctcagcactttgggaggccgaggcggcagatcacgaggtcaggagatcgagaccatcctggctaacacagtgaaaccccgtctctactaaaaatacaaaaaaaaaaaaaagaaaaattagccgggcgtggtggcgggcgcctgtattcccagctacttgggagtctgaggcaggagaatagcgtgaacctgggaggcagagcttgcagtgagcctagatcgcgtcactgcactccagcctgggcgacagagtgagactctgtctcaaaaaaaaa

SEQ ID NO: 275674 - DNA, 1437 bp, Homo sapiens
tctcctcaccaaggcattaagaaatgcatgggtgaggggaacagcggcgtgcatgtaaaggtcctgtggcgcctctcctctacaggctggaggtcatggcgggagatgctgcatggatttgccctccctgctgtcagaacaacagggttctggaagagtagaggacaggccgtgggacttggctgtctagagacaaggcgggagggatttccttgagaggcagggacatgtggtggttactaatcattgtgaggtgtctgggatgtaatggatgggaaatctactaagaagtcaacttatgtaataattagaaaagctctagttctgaggacagagacctgttggagtcaccatagtggaaatttatgacctggtatccagttcagatacctggagcttcttgactggggggagattggatcccttggggaagagtgaagccttcaatgctgccacaagtgtgatccgcccgcctcagcctcccaaagtgctgggattacaggcgtgagccaccatgcccggcctcttttttatatttaaaaaatatcattttatatattaccagggcaaaagagaaaactcgtatgattacgtggtcatacacagtaaaagcatttggcaaaattgaaaacttttttcatgatttataaaaacaaaccccagaaaatgctcagcatgatgagaacagaaggcaacacttccaaccccattaagggcagatttgaagaacccacaggtaacattatattaaatggcataagattgaatgcttttctattaaatcagagaaaaaagtagaatacctgctgttactcttttaattcagcattatactagagctctaagtcaatgcaataaagtaagaaaaattaataaagtattgaaaagaaagaattgaagctgtctttattcacagataatgactgtgtttgttaacaatgctagaaatctacaaaaatctaccagaactaatcagtgagtttggtagtgttgcagaatgtaagctctcaatgtaagtggtcttttgtatttctgtatattagcaatgagcatttggaaaatgaaataagaatacaatttcatttaaagtaacatctaaatacatgttgtgcttataaataaattcaacagactgggcaccatggctcacacttgtaatctcagcactttgggaagccgaggtgggcagatcatgaggtcaggagatggagaccatcatgcctaacacagtgaaaccccatctctactaaaaatacaaaaaaaaaaaaaaaaagaaaaattagccgggcgtggtggcgggcgcctgtattcccagctacttgggagtctgaggcaggagaatagcgtgaacctgggaggcagagcttgcagtgagcctagatcgcgtcactgcactccagcctgggcgacagagtgagactctgtctcaaaaaaaaa

SEQ ID NO: 275675 - DNA, 883 bp, Homo sapiens
agcaaaaaatatgtatgtataaatggactcattcaaaatatataaagaactcctattacaaagaaattgacaaacagcccagtatatcaatgaatataaaaatttgagaagatattttccataagaagatatctaaatgaacattaggcatgagaaaaccaaattttaggatatcactacacacctggcatagtttaaaagactgaaaatattaagtgtgtgggaatgtagagcaactggaaatggcctacatctttcatagaaatgtaaaacaatacaaatactttgcaaaactctgtccaacattttctacccattcaccaagcaactccatccctagctatagatacccaggaaaataagtatgtatcttcacagaaataattgtatgagaatattcatagttacttatgcacagtagttatcaagtaaacctgtctcccatcagaaaaatggatatcaaattgtgtgataatcatacaatcaataggatattacttggccaaaacaaaatgaaacaagggaaaaacacaatcaaacaaattagtggcatatatacccacctgagtaaagagaagtcggccgtgtgcggtggctcacgcctgtaatcccagcactttgggaggccgaggcggcagatcacgaggtcaggagatcgagaccatcctggctaacacagtgaaaccccgtctctactaaaaatacaaaaaaaaaaaaaagaaaaattagccgggcgtggtggcgggcgcctgtattcccagctacttgggagtctgaggcaggagaatagcgtgaacctgggaggcagagcttgcagtgagcctagatcgcgtcactgcactccagcctgggcgacagagtgagactctgtctcaaaaaaaaa

SEQ ID NO: 275676 - DNA, 1045 bp, Homo sapiens
ctttttaattttctcccttccagggttatttacagactaaatgagacagtgtatatctaacattgctttgtggatgctatcaagtgctggcaaatgtgtgggagaatgaatggaaaacttcatcaatttctaggatagtaaattggtgctgctattttggagagcaatttgtcagccttcaggggaaactgaatatgcacatcctctaagacccagcagtttcacttcaaagaaaatttcttatatgcacagagacttgtacaaggatatttatcacagcactgtttgtaataacaaagggctggaaataaaccaaatggccaatgataagaattgataaatgtggtaaatgcctaaaatagaatgtcacacagcagttaaaaaatcatttattcactaattaagcaaaggacaaaaagcctcaacagaaaaaaaaagacaaaagccttgaatagtcactttgccaaatgttcaatacacgtacaaaaacatgggcaagttcattggttgtcaaggaagttcgaattaaagccacattttgcaggtacaacactggcacaagtttaagtctgatgataccaagtcttggagaaggttgaagctacttggaaaacctgccctctgctggtgggagtgcaaattgctccaagctctttggacaataatttggcatcctctagtgaagttgaagatgtgtgtgcttgagactcagcaattcccctttgtgacatcaggatgctcccgcacatatgcttaagaacattcatgccagctttgtttatataacaaaaacgtggaaataacccaaatgtctgaggatggggaatggacaaataatggttcatagttatgaaaatgaatacacaacagctacaagcatctactggaatgaatctcacatgcattgtgttgtagaagaatatgtataattccatttatgtaaagtttaaaagcatgcacaactaaatgatatgttatttatgagtatatgacatatatgataaaggcaaagaataaataaagtaaggaaaggtaagacaataaa

SEQ ID NO: 275677 - DNA, 294 bp, Homo sapiens
attttcccaactttgggggcaaggaaaaccaaaccagttgattggttttatgtggtatatttccccatttattagaatgagaactgattgccaattaaagaagagaaagatatcaaatattcctaggaacactggctcccattttttgaggggggtggaggagaaggcatcaattaaagttgtgtctccctgacattaggacagtgttggaggatttctactcaacacagatttggagaattcaattactctattctgcaaagcttagataaataaaataatgagtaaaattgc

SEQ ID NO: 275678 - DNA, 403 bp, Homo sapiens
ttaatcactataattaatatcttggcataattgccttaaggaaatcattctattgcttttataaaaatgaatcatgcatatcataaagacgttaaatgaggcaaaaatgtacagtgaagaaaatcttttaaaaaaccctaaatctcactaacttaggcaaacataattccagacacctatgtatgctgatagaaagtaacatggatacctggacaaatacttatctttataaaaaatgaccatctctagatgttatttcaaaatataaagtatttaattttacttaatagaagaaaatgtaagtgaagtgaaactgagggaactgtgaacttcaaatacatatttttttatgtaaaatttatttcccagaaaatcccttaaaaacaaaaaagagagattgtga

SEQ ID NO: 275679 - DNA, 238 bp, Homo sapiens
aatgagggtacaattgctatatgctgtagtggtgagttcaggctttgagaccatggagacttatgttcaggttctagctttcctatgtgatttcacttagcctcagttctgttgttaggaaaaatgctacttaccttgggagatctaggaggattagagacaatgtatagagcatgcatatcacaaagctggccctcaattaatagtagtcatgcttaatataaaatatgaagttaca

SEQ ID NO: 275680 - DNA, 382 bp, Homo sapiens
gaccatggatcaagtaaactaaccattaatcatcgatccgaaattgtcaggaaaccaggagatcaaaagaacatccctggggaaggtattaggctcagcttattattatgtgggggctcagtgtctatacccacctgaagctgggctggccatgaggcttcagttcactaatcagatgtgcatgaaacagacacaaaaaggggaagtctttagggccaaaaaatagacctaggtttgtattactatttcagcttaatcgtgtattccttgtgtgtcctcggccaataatggctaattatggtaaatactatttagaattatgtgctatatactaagtgtttgacatgtggtatctcatttaaaccttgtgtaatcctctgaa

SEQ ID NO: 275681 - DNA, 456 bp, Homo sapiens
cctggcagtctgtgcaccggagttggctcctttccctcttaaacttgtgcaagagatcgctgagcgatgaaggtagaattatggtcctccttgcccttgcctttcctttttgtgatctcaaagcatcctccctccgcccccattccatggccccagttccctactcccacagctgtctgctgaaactgccaacattactcaattgtttctggggggaggaacatttttttttgaaacaaaatagatatatgaaacagtacacgggaattaacacgaatatttaaggtaaaacatgaccttgaagattatgaaatccatcttattttggcccagaacgggggcattgggctccttgggccataggggagctggggaggacagggtgaagagttagctctaagccctctgcttggagatgctgtaaatacagaacgcaaaatcaccttcgaagttaaa

SEQ ID NO: 275682 - DNA, 406 bp, Homo sapiens
ttaaactatgtccttcttttctatgtgcagtggcagactggggagaagacactaccagataataagtaggtttgaaatttgcaataagaatgtgagtgatttgaatagagtgagactcaattcaaggctttgcttttgtggtggggatgttaagagagtgttaacttcactactaggttttatgttcattaatcaaattccaattcaaatggcctttaaatttatgtaaaacctggagctgtgtcaacatcaaaatttccgtgaggtcacagaaggcttaaaacacaacaaccaagcataagaacagtaggtatactgaggctggagaaaagtttgagctggggaggcagagccgagatcgcgccactgcactccagcctgggtggcagagtgagactccatctta

SEQ ID NO: 275683 - DNA, 441 bp, Homo sapiens
gcagatgccaacacatgactaaatggttttatctcaaaagattaatccacattaaattaacataggaccaaggcctcagaattgtatagccttttgttgtgagagattccaggctttgtgactctgatagacaggctggcaattgtctcctcataagggatggtagctggttaatcagtcagtcagcctggtagacccagttattgcctacctaacagtcaatgccctcttcttctttattaagaacaccaattttgttcagggagcaatgtgctcagctccagatgatgagatatgatagatctgcttccgttccggtgaactaaattccctgtgattggttcagaggtgaggaagtgacctaattccggccaatgaaatgcaagagaaggatggaaaggagctgaatgggttggaggaggaagggatggtggcttccag

SEQ ID NO: 275684 - DNA, 329 bp, Homo sapiens
tctgatgtatctataccaactagggaaaaatcaagaattgaaaagctaagtgaaacacatagattctctgctatgatcaacatattgatttactccacatttcatttcttttgacttttagtaatcccaagtaaaactaagggagatgtaagatgggggagctgtcttggggttttgcaaaagaactagcactgacattagtgagctcttaccaacaatacaaacaaaattgtcacattataaatcctattatgtgaatcctgacctggcaaattcaatgcacactaggactgcagtttggaactctaacgtaccatgaaatcatgtta

SEQ ID NO: 275685 - DNA, 230 bp, Homo sapiens
agttgattgttttccatggattctaccctgccaggagacacaataaataactttttgaaacttcattcttcagtcctgggagtttttacaaataaaaggacacacatgttgagacaaattacatgcttgaaaatctgtcactaacatcaatttcatgttaaaaagtacgaagcagctgttacagtggcatttcttttgttgttggggaaaataatgtgtgaatagctatg

SEQ ID NO: 275686 - DNA, 137 bp, Homo sapiens
cgtccacctcagcctcccaaagtgctgggattacaggtgtaatcccactgcgagccacaagccaccgcacccggcccaccctggccttctttacattcacaccttaaggtgtgtgtaaagattgccgaggtggagcg

SEQ ID NO: 275687 - DNA, 476 bp, Homo sapiens
ataacatatataccttttattcaaaaacagaactgtggaattgtgttacctttgttagtaagacacatctagcatgaaaaccttagcaaaatcgttcagtgatgtttagtgttgaaatagatttctgttgtgttggaaacataattgtctatttactagacatagattaacttcatttaacaaaagaaaatgtgggccaggtgctatggctcatgcctgtaatcctagcactttggtaggccgaagtgggtagattgcttgagcccaggagtttgagatcagcctgggcaacatggcgaaattttgtcattacaaaaaataccaaaattagccaggtgtggtggtacgcacctgtagtcctagctactcagcaggctgaggtgggaggattggtttcagtgagccaagattgtgctaattcactccagcctgggcacccgagaccctgtctcaaaaaaaaaaaaaaaaagaaaaaa

SEQ ID NO: 275688 - DNA, 409 bp, Homo sapiens
tatgtagatgaagcctccagatagcaggctacagagggaatggatggtgaacttgtcctattgggcgttaacagctgtcagaatctccagaaaggaccttgtacatctctacagaagaaatggctttgcagggccattggggtcaaatactttgatgccttcagggcctgctatctgtcatgtaacgctctaccagagtcaaatcggagtttgggatctcattgcacaaaaagtctggtccatcttaaactctctgttttaaatgttaatgctggtcagtggtgcctaaacttccaagggaggcaggtccaacccccatttcctgtcatggcctgaactagcttctcaggttgctttgagaaccccttggccaacaggggacccattcagtccgttggaaacgtgagaa

SEQ ID NO: 275689 - DNA, 164 bp, Homo sapiens
tctccctcggtaaggaccaatttgaaaggaaaaacagaaactccaaggtggagtctgacagaaggaagatctggcttggaggtaaataagaggatattctaggtcatgagaatgttcccacaaagacactagagggaaggattagcaagcgaatttgtttcgct

SEQ ID NO: 275690 - DNA, 815 bp, Homo sapiens
agaatcgcttgaacccgggaggcggaggttgcagtgagccgagatggggccactgcacttcagcctgggtgacagagcgagactgtcaaaaataaaaataaaaataactactacagtactgggaaaactttacaagacggagcaggagcttgcctttccagatgacaaacatagtatataaaacacaataggccagtgccaaggcactgggaggccaaggcggggggatcacctgaggtcaggagttcgagaccaacctgaccaacacggtgaaacccccgtctctactaaaagtacaaaaattagccgagcgtggtggcagacgcctataatcccagcttctcaggaggctgaggcaggagaattgcttgaacccaggaggcggaggtgtagtgagctgagatcgcaccactgtactccagcctgggcaacagcatgagactccgtctcaaaaacaaaaaaccacaataataaaacaatatgatattgttggtaggaaagacacattagtgcaacagaatccggaaataccacaaatgtagtattttatttcaatcaggaaaagatgatttcgttgataaatggcgtagaatcttaaatttaaacaacaaaacatttagaatataatttaggagactataagggtattctaggggttgagagactgcaaagacaggaacctcaaactgtaaaaagatatacttgattaccccgaaaattaacactgataaaagtcaagagacaatgatagatgaggaaaaaatatttgccatacatgataaagagccaatacctgtaatatacaaatacatctt

SEQ ID NO: 275691 - DNA, 681 bp, Homo sapiens
  misc_feature (15)..(15): n is a, c, g, or t
tgatcacggagcttnatgcattgtcttccttcccgaagtagtatccccattatgcaatacaatttgggtcaatgctctgggccccctttccttgattttagaaaactattataatttccttataaacatccaaatattcgtggcattcataaattgactactaccttatctcaaactgaattttctattatcactataatttattgtgtttataaaacatagagtggaaagagctaaacaaaaaggtttccttttcattcttgagatgggcgcttctcaactgggaaggatttaaataacacaaccggaaacctctcatttctaagtcgaattaatagctgaggatggctgaaaaagattatacatatccagaagataaaaagtaaaatgaggccggggcatggtggcgggcgcctgtaatcctagctacttgggaggctgaggcaggagaatagcttgaacctgggaggcggaggttgcagtgacctgagatcacaccactgctctccagcctgggtgacaagagtgaaattccatctcaaaaaaagaaaattaaataaaaaataaaaacagatttaggattaacactgtaaccttattgagatggtagaatgcaaatataaataaaaacaactcagctctcattgtcagaatagcaaagaacagtacgatgcctgtaac

SEQ ID NO: 275692 - DNA, 388 bp, Homo sapiens
gtgattcttttaaaattagaaatattcttcctaattggtggggctgctgttatcttttccaaatctctttcgaatgcagtttatcttattccactatttttcttattactgtttttagacataggtttccttggaaactggacttctaatggactttagctacagataggctaaaaaattgtctttattcatttatcatttcattgtaattaaatcttctatatgatgtggcctattctcatgtatggtattttgtttctatggtaacagagatttttctactatccatagtttgaaatgacttcacagtatttcttgattaactcgtgagaccaatattgcattttgtaaacttacatgcagtcgaacttataaagcaatggttgca

SEQ ID NO: 275693 - DNA, 488 bp, Homo sapiens
gggtttcctggcacctacatgaaaaaaaagacaagttatatgggtgatgaagaaaactgcacaaaattaaggggttgcagaatcacgggagcataataattcccttccataatctttagcattgttctttcagtcagacatgatatgcgcaacattcagacatgatatgcgcatcattcagacatgatatgcggggtcaagttcttaagggctgtttgccttttggtccttttggtttggtttggctttgactaattctggtactgaaaagttagctatacacacacacacacacacacacacacacacaaacttcaaaaatgcttaaccatctgaccatagtgactagcctatagtgagtcgaggaccaaactttttcaggaaaatgctgcctcgtttttaaaacaagcctcctaagctatgttctttacaatgtctgtaattagtgtttcacttgagaaagccttttgtgggtcgtaaattatttc

SEQ ID NO: 275694 - DNA, 428 bp, Homo sapiens
ggggaggaacataggtcacagagtgctgttgtcttcactggattagtagtgctacaatgcatgctttttgtagtttctattgtttttgttttgttcttaccaaagcacctacaaatactaaatttactttttaaagaatgctatctagaaatacgcttcagtgaaacctttcttttcattatcaaatgcagttgataatggtggtttaggagtttcttacttttccagcagttagtttctaaagaaaccattttttctctcctccctgattctgactttccttgacaaacttgataacccttattatataatactgaatgttaaagttttcagatgtatttatgtgtgtgacacattttaagacttcttgatgaaaacagaacttacaactaaatatataattctattacagaattaatcttcccttt

SEQ ID NO: 275695 - DNA, 150 bp, Homo sapiens
aacattcctctgacagaggtgcctgttggcttttctcccttccttccttcttcctgcctcgaatgtggttctaatggcttgagttccaaaaactactctatgaccatgtggcaaccttgaggttagaagccacatgccaagtatggcact

SEQ ID NO: 275696 - DNA, 305 bp, Homo sapiens
aatcaagatatatattaccagcatcaccccaaaaggttccttgtgctccttttgtcaatctctcccatcatcccctccccaatccgcagctccaggcaaccacagacctgctttctgtctctgagattagttttgccttttctaaaatgtcgtataaattgaatcatataggatgtgctcctgtgtctggctttttttgctcagcatatacttgagaaatatccatgttgctgtatctatgagtagtttcttactttatattgagttatatttcattgtatatatataccgcaatttgattaccc

SEQ ID NO: 275697 - DNA, 176 bp, Homo sapiens
gggattaaaggtgtaagccaccgctcctggccctgaagatttcctcctctcagaagagaccgtggcctggccctggcttgggagctgatatgttacctggaacttctggaaattgctctcctggcaggggagaagttgaattctggtgtgccatgcttgggggaagctggcatgat

SEQ ID NO: 275698 - DNA, 453 bp, Homo sapiens
actgtggaaaatgtataaacagcacattattcttaaaggttacctctggggtgcagaactggggctgcgaggggaagggacagagggctgctggttttaaaactttttaagaagatgatgtagttttggcatttgtccccacccaaatctcatgctgaattgtaatccccaatgctggaggtggggcctggccagaggtgttcaggtcatgggggcagatccctcatgctggttggtcttcctgataggagttctcatgagatctggtcatttaaaagtgtgtgccccccactccactctctcttgctcctgctctggccatatgacctgcccccttcaccttctgtcatgattggaagcttcctgagggctccccagaagccaagcagatgctagcatcatgcttcctgtaaaatgtgaagacttgtgagccaattaaatcattttattttt

SEQ ID NO: 275699 - DNA, 612 bp, Homo sapiens
agcctgctctcactggtggggcagagtgggctggcatggtcaccaagcagaggggggtccatgttaggggggcaacatggtggtacctgatgtgggtttacaaagagaggtaccaaaattgtcccagtgctcatccttacacacatttggggacactttcacactcttcctcatgaaagtaaacatggagtggtggggatgaacaagagatgggagtagctgccatttgcagggcatgtgctctgtgtaagtctttagcctgttcacccactgcagtgtactaagcactttcataacccatgattttattttatcctcactactccataaagtaacattataccctatttatttaaagaggaaacggaagccccaagaaatccagtgtcaaaataccaggacttggtgctcaacaaatgtgtgggaacaaaattagatgttgacctgatccctcctgactttcttaaggtctcagggcagtgtatctgtgatttggtgagatggccacatgagggcaggcacgcacacgttgagaaagttgaactggaattttgtcctgcaaactctttgaggcgttgcatgggttgcacaccgtgctgggtactaagagta

SEQ ID NO: 275700 - DNA, 488 bp, Homo sapiens
ctactaaattcgcggccgcgtcgacgggacactttcacactcttcctcatgaaagtaaacatggagtggtggggatgaacaagagatgggagtagctgccatttgcagggcatgtgctctgtgtaagtctttagcctgttcacccactgcagtgtactaagcactttcataacccatgattttattttatcctcactactccataaagtaacattataccctatttatttaaagaggaaacggaagccccaagaaatccagtgtcaaaataccaggacttggtgctcaacaaatgtgtgggaacaaaattagatgttgacctgatccctcctgactttcttaaggtctcagggcagtgtatctgtgatttggtgagatggccacatgagggcaggcacgcacacgttgagaaagttgaactggaattttgtcctgcaaactctttgaggcgttgcatgggttgcacaccgtgctgggtactaagagta

SEQ ID NO: 275701 - DNA, 427 bp, Homo sapiens
gaggattgcttgagcccaggagttcaagaccagtaagggcaacatagtaagattctgtctctacaaaaaaattgaaaattagccaggcaaggtggtgtgcacctgtggccccagctactcagaagcctgaggtgggaggattgcttgagcccaggctgtagtgagccatgattaggccactgcactccagtctgggcgacaaagcaaaaccctgtctcaaaacaaacaaacaaccaaaaaaaacctcctttcctggcttgttacctcactctcatggctcttcctcttccttactccttctccaactcttgctggttcctcatctcctacctgagccacatagcccagaatgccttggagttcagccctgtcaatcttctccacctcgacatcctcccctagttactttaaaaacctatctgccagt

SEQ ID NO: 275702 - DNA, 373 bp, Homo sapiens
ttcttctgcaagtggatatacagttgtctcagtactatttattgaagagactgcccttccttcattgtgtgttcttggcactttcattgaaaatcaatggaccacaaatgcaaagatctatttctgggctctctgttctgttccactggtctgtgtgtctgtttttatgccagtaccatacttttttttctctctctctttttaaaatcagctgaatttaagattcaagtacaatactgttttgattactgtagctttatagtatagtttgaaatcaggtactgtgatgtctccagctttgttctttttgctcattattgctttggccatttggggtcttttgtggttttggacaaatttggggattattttt

SEQ ID NO: 275703 - DNA, 349 bp, Homo sapiens
gaaaatgggactgctgctcaaaatctaaggtggaagacacagcaatggactgggcatatggtcagcacgaagggagatcaactcaccctcactcagactcattctagacaccagatgttaaaggagggcacagatacgtgctacactttcttctctgctcacatgttgttgatgagccagacaaaactgagcttaaacagaaagggcactagagcccaaagcagagggaagaacaatggcttttcattatcttcagctatgaagtgcttatttccactagatcttacagtttttaaaggcaaacctaacatcactgcatattaaaactttggttgtttcatcattatag

SEQ ID NO: 275704 - DNA, 250 bp, Homo sapiens
gcctctgcatataagtgagatcacgcggtgttgtatctctgataagatttcttgtgtggattggaaagcaggaacccttaggttatctatgattagaagtagttgaaatgcaaaagtggactaaaaaagtaaactgttggccgggcacgatggctcaagcctgtaatcccagcaccatgttagccaggatggtctcgatctcctgacctcatgatccgtccaccttggcctctcaaagtgctggtcgacg

SEQ ID NO: 275705 - DNA, 195 bp, Homo sapiens
actacgcccagctaatttttgtatttttagtagagacagggtttcaccatattggccaggctggtctggaactcctgtcctcaagagatctgcccaccttgctatttctcatattttaaaaagaaaataaatatctatgctgacaataagcaaagataaaaacccagaccacttatttaaattgaattaattttt

SEQ ID NO: 275706 - DNA, 516 bp, Homo sapiens
caggcatgccccaccatgttgcccaggctggtctcaaactcctgggctcaagtgatcctctgccttggcctcccataatgctgggattacaggtgtgagccaccacacagccatatgttcttaagtggataagacttaatatgttcagaggactggagtgatttgggaagaatatatatgaagtagatactaaaacattaggcagggttttagtgaatcaagaaataattctgtggccgcgcgcagtggctcatggctgtaatcccaacactttgggaggccgaggcgggcggatcacctgaagtcaggagttcgagaccagcctcaacatggagaaaccccgtctctactaaaaatacaatattagccgggcgtagtggtgcatgcgtgtaatcccagctactcaggaggctgagggaggagaattgcttgaacctgggaggcagaggttacagtgagccaagatcgtgccattgcactccagcctgggcaacaagagcaaaactctgtctcaaa

SEQ ID NO: 275707 - DNA, 190 bp, Homo sapiens
attaaacacaaaaattaccatatgggatagcaattctaattctatatacatactcaagaaaaatgaacatacacagacacacacacttttgtacaagtatttataacagcactaatcataaccaaaaagttattatgagaacacacacacacacttttgcacaagtatttataatagcactaataataac

SEQ ID NO: 275708 - DNA, 965 bp, Homo sapiens
ctcttttctatctctaaaggtccaacctaattaagtcttaaattgctccaaacataggagatttgaagatgcagactcctgacccactgataatttggtatttacttatattctgtccccctgaatacctctcttctctccagctctgagaagaaaagacaaaactttctcctgtgtcattttcaagtagaaatcctctttctctgaaatcagatcagcatgttcctatgtatttatcaatatgtaaaataatgtagatttcccttctctatggaaataatttgaacaatttgatgaaaagtgtggtaaatgaagattaaatgctgtgtcacacctgattcccctgagctgtgagcactagagtcaatcagctgctctcattgccctctgacatttagatttttccccagagcctacatctgtgggaatgtttctttctatcattatccagaacaaacaccaggaaacactagttcttcaaagtttatcttttaaacagaggccattttacaatggggttgtataggtcttcacgtatgtgagagccaggtaggtgatcctccttgtggtatgcttttggcaagggagtaatgggctgagaaatccgactatccaaaacataaattcccccatataccaagagatgcctaaaatctgctgttatggtattctttcttgggttaagactttgtgctattgaggagcatagaataaggtttacattatttctagtcatttatattttactgtgaacgtctaatagctttagggtatagggtcctgtaaggaaggcgggtaggggaccttgagcttgacaattacatctcccctctccctacagatccaaacaaaaagacagccctctggcatagtggtcattctcttgtggggaatatttgctgctcagatgtttttatcttagggacttgctataggatgaaataaacaaacaaaaaccccacaca

SEQ ID NO: 275709 - DNA, 520 bp, Homo sapiens
gactgacccactgaccctttggctggcctagagagatctgctctgtaggacactaccactgccactgcagggccccttctttgcctctatccaacaggaagtagctagagtggtcatcacccaattcccaacagcagttagggtgtcctgtttagaggggggattgagcgatgaagccagccggacttcctgggttgagtggggtcttggagaacttttctgtcatacaagaggtttgtaaaacacaccaatcagtgttctgtggctagctagaggtttgtaaagtgctccaatcagtgctctgtaaaaacgcaccaatcagcgctctgtggctagctagaggtttgtaaaatagaccaatcagcactctgtaaaatggaccaatcagcaggatgtgggcagggacaaatgagggaataaaagctggccaccccagccagcagtggtaagccactcgggtccccttccacgctgtggaagctttgttcttttgctcttcacaataaatcttgctgctgtt

SEQ ID NO: 275710 - DNA, 393 bp, Homo sapiens
ggcccttatatagcggcccattgcaaaacttcatatgtgtaactctgtgtgaccctcccttgttctcactacttggcctcccagcgttcaattctctcattgagggcaaacagaagcctgcttttttatttttattaaaaagaagcataaacacagcaataatgctaattttctgcagtgggtactttttaagatttcatataacacaccacagagtattctcattagtaactagtatacacgtgtaataaatgacttacctcaaattattttcaaatatatttgaggcaagaactttattactagggtaatgatattaagatgactattttgaaggacatataacaacaattatcagaatcagtgactatcaaactgtgttctgagacaaaa

SEQ ID NO: 275711 - DNA, 336 bp, Homo sapiens
atagcacaggctcagggagctgaatacaacatattcaagggttttgtaaacttgttaatcagtgggagcttgacattggacatgatgtgtctgcactgtagaaattggcaaaccggctggacgaggtggtcatgtctgtaatcccagcactttgggaggctgaggtgggaaaatcacttgaggccaggagttcaagaccagcttgggcaacgtggcaagaccccgtggctacaagaaatttaaaaattagcctggtgtggtggtgcacacctgcagtcccactctagatcatgccactgtactccagcctgggcaacagagcgagatcctgtctca

SEQ ID NO: 275712 - DNA, 343 bp, Homo sapiens
tggatcaattagcatctagtccatcactcaagcaattcagagtatgtaccttcaaaatgataaataagcctctacgtccacctatcctacaaaataagcccttgtaaaagaaatatcaagcaactaaaagagaaggagaacttaaaatatattttcttaaagcctgatattcttgattttcattataatactttccttatattcattatagataaaaaaaagtttttaaagtaaatgttgaaagattaaataaaatccttttcctggagtaaatgagtgctttctaaacggaatccagctccctagagaaatgtgatacagagattttacatgtagcaaaaaa

SEQ ID NO: 275713 - DNA, 403 bp, Homo sapiens
tttttattaactagacagtagtctcagacatcttttggagggtttgttcagacagagactgtgaggccccacccctgagtttccaattcctgagtccctgatctcagaatttgcatttcacacaagttcccacagtgctggggctgctggcccggggccactttttgagaatcgctcaaggaccagggtgtttgcagcttgctgtttggctgactcctaacagtgactgtactgaaaggttttgaatgccacgtgttcaaacaaggcagttcgcaagagtggtaggaagagacgttgaggattcgagttgttctttcgtttcgtaaaagggggtttgagggaaggttgtgtagctcttttaaaaagagttaatggcggccggtgcagtggctgatgcctgtaa

SEQ ID NO: 275714 - DNA, 371 bp, Homo sapiens
aagtagtaatttaaatcagaatcttagaggaatgtttttacttcattccttacctttcatttgttttcatagctttatataccagtctgctaaccttcagtcaacagtaagtcagttgaaaacagtaacaataattaaacctgtttttgtttttagtttagtcacttttctcaaatatttggagtgcctctcaagaggtgttccactcaaatattactattatttatgagatacatccaaaataacttataaaaggaaaatttgtgaataccttttaacaatcatgctttgcttttccacatatgtaagggtttcatttcttttttgcattcaacttataatttatgtctggaaacttgggcatgtcagta

SEQ ID NO: 275715 - DNA, 434 bp, Homo sapiens
aagaaagcaagttaaacactgtaaaagcctaaaacggggcaagttgggattagcttttaaaatgcctgccttgaaaaacacattattctgtgaggttttttttttttctttaaagttgtgcaaatttgattcggaaaaatagcttaataggtttgtatagggcacgggagaaggggttgtgtgcataaatgtatgatgattattttaagtgtgtgcttcagcagcgacaacaaacagatgaagatacgtgatactgactaaacaggcaagagtattttctagtctcagttcttctagtcaatgcctaaagtattagaaaaagtactgaaacaattcccaaagcatcaggaatttccatttctagtcaaaatattgtttgttttcttccaacagttctgttaaataaaaggaaaagttataaagttttagagata

SEQ ID NO: 275716 - DNA, 364 bp, Homo sapiens
gtggctactgtcatgtactaatagctgattcgttgtgctcaagtgacttgcctgtggtcacagttttacggtagccaaagcagggttagaacctggggatgtggccagccactctgggattttattcctattccacactcctatgtataggtagatacttcttcttgtctgcttggagagtacagaaaagcagaaagaagggtaaacatcacagccccaggtctcagaggtctcagtagagttttgggttactcagtctttttttctatgcattacatttgcacaattgagatcaagctgaatatattaaatgttaaatattgtttattctaattataaaataaaacaagggatttattgtagt

SEQ ID NO: 275717 - DNA, 626 bp, Homo sapiens
aggtttgggattagacactcaatttcgaaaaacacataggagtgtctcaagtaagataggtggatacatagagaaagcaaacaacattaattagccgggcgtggtgccacgcgcctgtaatcccagctactcgggaggctgaggttgcagtgagccgagatcacaccactgcactgcctcagcctcccgagtagctgggattacaggcatgcgccaccacacccagctgattttgtatttttagtagagacagcatttctctatgttggtcaggctggtctcgaactccagacctcaggtgattccacccgcttaggcctcccagagtgctggaattataggtgtgagccaccacgcccggccccagctatgctcttgagccacactctagagacgccatgaaggactgtttttgtttattttcgttggaggtggggatgggtaagacatacctacacagagttatttttctacgtaactgagtacatttaaggaatcctgagcagagttgataagggatttgcattgttgttagcattgctgtgatagcaaaagacagggtcttactctgtcacccagtctggagtgcagtggctcagtcatggctcactgcagcctcaatgtcc

SEQ ID NO: 275718 - DNA, 603 bp, Homo sapiens
acgccattctcctgcctcagcctcccgagtagctgggtctacaggcgtctgccaccacacccggctaattttttgtatttttttagtagagatgcggtttcaccgtgttagccaggatggtctcaatctcttgacctcgtgatccgctgtctgcctcagcctcccgagtagctgggattacaggcatgcgccaccacacccagctgattttgtatttttagtagagacagcatttctctatgttggtcaggctggtctcgaactccagacctcaggtgattccacccgcttaggcctcccagagtgctggaattataggtgtgagccaccacgcccggccccagctatgctcttgagccacactctagagacgccatgaaggactgtttttgtttattttcgttggaggtggggatgggtaagacatacctacacagagttatttttctacgtaactgagtacatttaaggaatcctgagcagagttgataagggatttgcattgttgttagcattgctgtgatagcaaaagacagggtcttactctgtcacccagtctggagtgcagtggctcagtcatggctcactgcagcctcaatgtcc

SEQ ID NO: 275719 - DNA, 106 bp, Homo sapiens
tgtaaaatggtgcagccgctttgaaaaagtctgaaagttaaagacagagttaccattggacccagcacttccactcttaggtatatcaagagaagtgaaaaggtat

SEQ ID NO: 275720 - DNA, 661 bp, Homo sapiens
catttgcatccttttatgtgcctctttcttcagtgcctagtcattggctcactcattcattcaagtacaatgctattttcacccatccgattggcagagaccaaaaatttgataacacagtgtcctggcgaggctgggagaatacatacgttgctggcgggattgtaaattgattggtatgactcctttgaagacaatctagcaaagatctgttaaaagacaaatgcacacatgccctgtgacccagcaattcctcttctgggattttatcatcttacaagtacatctgcggtataagacaagacaggcttcaaggtcattcactgcacagccttgtttgtgagagaaaaaaatagggaacattgaaatgaatggctcctttatacagtggaatactatgaagctgttaaaaaggaatggggaaagtgctttatgtactgatatgaaacaatttccaagatatattgttaattgggaaaaaacaaagcatgtctagaacagtgtttgaaagtatgttctcgttcatgttaaaaattatatctggtcagatgtggtggctcacacctgtaattccagcactttggaggctgaggcagaaggatcacttgaggccaggagttcaagaccagcctgggcaacatagtgagatcctgtctctatg

SEQ ID NO: 275721 - DNA, 261 bp, Homo sapiens
gagtaccccatgagacaaaagaattcagacagcaggacttgagtctcagaaatttctgcatgtggaaagtttccttcagcacaggcacaggtgaagtgctgggctcagcagggagagtctgtggctctacgccaatagtcaggcagccctggtcctcatgaagggtcttggagaaggacatttcttttcttcctcatccaccactgcaaaaacacctagagcttatccattggagcttagagtgggtgcacctgtacatag

SEQ ID NO: 275722 - DNA, 730 bp, Homo sapiens
gagcgactcccctaccgctttcgggcgaaggccacacgtgacggcccccctttccccgcagacgtgtgaatgcagcgctgtgtctttaaggggcacgcgcggaggttttccgtccgggacaaaatgtcagcgaggcgcctggagggggatctaccatctcggactcccgacccgccgccggctccggccgcgtttcccgggtaaagggtttttcccagttgtgtttaacaagaaagattctggaactttgtcatctccatggctgctggttcaaaatctgacagtatgagcagcattgatctcactgtgcctgggtctcaccttgcccttgattttctccctaagttctcagaagagctcaagaagtctgtcatgtgttttcttctcattgtttttcaactttcaaagcaaatttatctagaatcacacatttggtcctttgtgaacttatttcctaacgaataaacttcacctttttctgtattcccttttctttaataggttattgcagtagtgaattagtttcctaataaaaaagactgtgcaatgaaaaaaaaattaactgcctttccaaggcaacaatcttcaaacttgcggccggaattcgggcttacttgcccaattggccttatgtgagccgtatacaattaattgccggcgtttacaacggcgggctggcccctggcgttccaactttgcctttgaggacatccctttctgcaggtgcgcc

SEQ ID NO: 275723 - DNA, 2074 bp, Homo sapiens
gagcgactcccctaccgctttcgggcgaaggccacacgtgacggcccccctttccccgcagacgtgtgaatgcagcgctgtgtctttaaggggcacgcgcggaggttttccgtccgggacaaaatgtcagcgaggcgcctggagggggatctaccatctcggactcccgacccgccgccggctccggccgcgtttcccgggtaaagggcactgctgatggttcttcagaactcaggaatcgtgttgcatgcattgtttctacccacctgagatggttggaaaccctgaggcaatgacagggaccccagaatccttgggaaattacccactgtctaatttaaagcgtgcgggcgccgcagaatgaggagtggcgagccggcctgcaccatggaccaggcccgcgggctggacgacgcggcggcgcggggcggtcagtgtccgggactggggccggcgccgacgccgacgcctcccggccgcctgggggcgccatactccgaggcctggggctacttccacctggcgccggggcgccccgggcatccgtcgggccactgggccacctgccgtctgtgcggggagcaggtgggccgcggcccgggcttccacgcggggacctcggcgttgtggaggcacctgaggagcgcgcaccggcgggagctggagagcagcggcgccgggagctccccacctgccgcgccctgcccgccgccgcccggccccgctgcggcccccgagggcgactgggcgcgcctgctggaacagatgggcgcgctggccgtgcgcggcagccggcgggagcgggagctggagcggcgcgagctggccgtggagcagggcgagcgcgccctggagcggaggcggagggcgctgcaggaggaagagcgcgccgcggcccaggcgcgccgggaactgcaggccgagcgggaggcgctgcaggcgcggctgcgggatgtgagccgccgtgagggcgccctgggctgggcccccgctgcgccgccgccgctcaaggacgaccccgagggtgacagggacggctgcgtcatcacaaaggtcctcctgtaggggtgtggccacttccccaccccaggacagcgcttctccgtccaatgccaatgccttcagaccccgctgggaccgaagccgtaaccgaagccaggcccgcagccgctactcactcggaagctccagctaactgtaggatcttccacaccctaaggcttcagcttgagaagcacttcgaagccagagcagaaccaaaactcacttccatggggtcaccgggggtgcctgggcggcctttcgtgggcatgcacgcaaggaattggggtggcacacgggacacccgagagctccaggagccccgtgaacccagaccacccagtgccatggccacttagggctgggaacccgaacctggtgactttgaaaggatagagcttcattccataccaaagacttatcacaccatgtgcctatacacccagcagcccaaggtggagggtgcgtggaaatgagaaagctttttacccaaaaaaaaaaagagttcctaatgcataatctgcccaacaccaagttctgaagggtgggtgagggacgtcccctctagtttccatgactgctgtagacccgcatcatctctagccctcatcggggcagtcccagagcccgcttttttactgcccatattattcaaccaataccaggtgcactctgtctcccctcggccatccttcccttgcttcagacctaatgacaagtgtggcacatatgtccactttcaggcctcacatctgccaccttagcaagacatcacctcatccccttgtcactaggaagagggcttcttccccacatgtcgtcatagtgctcacctctgggctgaaggggaaagcatccctccgcttaaggccacatctacctgtcattttccatcccattcctctcccacgtttactgggtctttcctcctgtagtattccccctttcgctgacttcaaacccctcccctttttccccccaaggcctactttgtttcccttaaagccaaatgttggccaagtcctcgcctttt

SEQ ID NO: 275724 - DNA, 1104 bp, Homo sapiens
actgcatccaacgccgctgactgcatccaacgccgctcaaggacgaccccgagggtgacagggacggctgcgtcatcacaaaggtcctcctgtaggggtgtggccacttccccaccccaggacagcgcttctccgtccaatgccaatgccttcagaccccgctgggaccgaagccgtaaccgaagccaggcccgcagccgctactcactcggaagctccagctaactgtaggatcttccacaccctaaggcttcagcttgagaagcacttcgaagccagagcagaaccaaaactcacttccatggggtcaccgggggtgcctgggcggcctttcgtgggcatgcacgcaaggaattggggtggcacacgggacacccgagagctccaggagccccgtgaacccagaccacccagtgccatggccacttagggctgggaacccgaacctggtgactttgaaaggatagagcttcattccataccaaagacttatcacaccatgtgcctatacacccagcagcccaaggtggagggtgcgtggaaatgagaaagctttttacccaaaaaaaaaaagagttcctaatgcataatctgcccaacaccaagttctgaagggtgggtgagggacgtcccctctagtttccatgactgctgtagacccgcatcatctctagccctcatcggggcagtcccagagcccgcttttttactgcccatattattcaaccaataccaggtgcactctgtctcccctcggccatccttcccttgcttcagacctaatgacaagtgtggcacatatgtccactttcaggcctcacatctgccaccttagcaagacatcacctcatccccttgtcactaggaagagggcttcttccccacatgtcgtcatagtgctcacctctgggctgaaggggaaagcatccctccgcttaaggccacatctacctgtcattttccatcccattcctctcccacgtttactgggtctttcctcctgtagtattccccctttcgctgacttcaaacccctcccctttttccccccaaggcctactttgtttcccttaaagccaaatgttggccaagtcctcgcctttt

SEQ ID NO: 275725 - DNA, 649 bp, Homo sapiens
ttgacggaagccagaagcagagttcaaagcctggcgtggatttccgtctggagctgtctgttcttaaagtttgtaactccgtgttaagaaacagccccagcggaggctttgggatcggtgtgaaagtctagcactaccatctgacagcgagctgcaaaactttgggctgcatattaagcgaggaaagtggattgaagcgagagtcaaggcaattcattatgttaccggctcccatacgggagctgtaaaatacgaactggatgcacacacggagaaaaatggaatgaactcggaatggcattcaacagctcttcgcggtaaaactgtgactgccaaggatctagaatcccaaaggagcaaaccaggaggcctcaaacttggttggcacacaataaatgcttttctagatcttttccccactcatctcaaactcttaagcaatttggggtcatttatatttcagaataaggaacacattttgagaaatgttaatttctgaatgagactttttttccccaaagtagctgtgaaaaaaagagcctcaggcataagtcagccagcttattttgtctcaatataaattaaaaattaccctcaccaccacctccaccaaaactgaaataaaaaataaaataagtaaaagtccagg

SEQ ID NO: 275726 - DNA, 266 bp, Homo sapiens
ccccccccccccccccaaaaaagtttggccaattttccttccaaaaactcttaagcaatttggggtcatttatatttcagaataaggaacacattttgagaaatgttaatttctgaatgagactttttttccccaaagtagctgtgaaaaaaagagcctcaggcataagtcagccagcttattttgtctcaatataaattaaaaattaccctcaccaccacctccaccaaaactgaaataaaaaataaaataagtaaaagtccagg

SEQ ID NO: 275727 - DNA, 225 bp, Homo sapiens
acaaaacaaaaggcaaaaaatattaaaaaccaaagtaaaatggatagaaatgtacaggttgaggccgggcacagtggctcatgcctgtaatcccagcactttgggaggccaaggtgggcagatcatgaggtcaggagattgagaccatcctggctaacatggtgaaaacccgtctctactaaaaatacaaaaaaaaaataagccgggcatggtggcgggtgcctg

SEQ ID NO: 275728 - DNA, 351 bp, Homo sapiens
ccaaaaattcggcacgagggacagggtcttgctatgttgctcaggctggtctcgaacttctgaccttaagcagtactcctgccttggcctcccatagtgctgggattacaggccattctagtgtttattattcacaatttaaattattcttccaattctttgtgaggcctccacggatgaattttttctcctaaaaatcgtcctgtctttaagactctgtgtgtgatggtagagaataaatttctcatctgcagttgatctgagaaaaaatgtttatcctgcctccttgcttggtttatgtgaaaaaagtgtaataaaataatatgggttattttcggaaagattttatgt

SEQ ID NO: 275729 - DNA, 127 bp, Homo sapiens
tctgggaagggaattggatggctaggaatggggtaggaaagaggtttgcttttcagaacattttatactatttaagttttgtaacaagtgcatctattttgacttaaaagataaaaaatgaaaagga

SEQ ID NO: 275730 - DNA, 549 bp, Homo sapiens
agaagtagggttagtgtggaaacgtagctattcctcagtgagcaattgttggctgaatcctgctacatgtcagacgttgtgccaggtgatgaagtggtcacaatgaggaagatggatgtggagagttgctgggtggtgcccagaagatcagtaattgggattttaacacattgtgatgagtttagaagggtggaagctttgaggactatagagacacaaaaaggcagaaactggaaaagagtttgtagaggtttcttaccttctcaaccattcaagttcatagcccatcttcccaactttgcatccatggttcagtagccgagtctgtggtgggcacctcattgatctttgctgctttatggttttatgaactctagcagcttcccctgcagacattgagacaccttgtagaacctaggcaagactgcagtggtacaggcagtggccagatcacacattatataagatgatgccaatacgtatagttatttaaatgtgcagctaaaatcgtcctgaatgttgttgcatcatttcaaatatatgacttac

SEQ ID NO: 275731 - DNA, 305 bp, Homo sapiens
tttttcagactttgcattctggtagaccaactgatgccacccagacccatgacccatgccaaagaactgattcaactggttctgtgactcccacccatgaagtcactcaggacatgaagacagttttgacactcctgtgatttcatccctgaccaaatcgcagttcccattccttagcaccccacacacaccaaatcatcctaaaaaaccctcacctccaaattcatggggaggcagatttgagagatattgcccatcctccccactcagcggccctgcaattattaaaattatttctttgctgc

SEQ ID NO: 275732 - DNA, 499 bp, Homo sapiens
atattttataaagaaaagaagcttaattggcttacggttctgcaggctttacaggaagcatggtgcttctgcttttggggaggcctcaggaagcttacagtcatggtagaaggcaaagggggagcaggcacatcacatggtgaaaaccagagtgaacaagtgagagaagtgccaagtactttgaaaccaccagatctcatgagaactcactattgtgaggacatctaatcacctcccaccagacctcacctccagtactggggattacaattcaacatgatatttgagtggggacagatatacaaactatatcagcaggttaactagagtaaaacttaattttgaatacaaattcaatggtcacagtcattatattcagggcaacagaccttgaaattaaaaaatttttgtcgcacactgatgagttccctctgtcttgatcatgaaatatattgatttccaggaaagtgaaaaataaaacagtaaaagtaaatctaaa

SEQ ID NO: 275733 - DNA, 376 bp, Homo sapiens
gatctgtattttattatattttactaagcaaattttaaaggtatatgcaaacaacatttaaagagctcttcttattaaaaaattttaaattataataagttaaaattataataatctaagtgtttgtattacttccatgctacggataaggaaattgtgtctcacagaggtttcatgcgttggtcaaaattacacaaaaagtaaaaggccgaacctgaaaataagggttcacatcttaggactccaagatggtatacacatttgacttttttgtctttaaacttgctgtgaacatttttccacttttgattcttaagtataaatattaagtgccttctttgtatttcagtattaggcttttaagtcttctacttcc

SEQ ID NO: 275734 - DNA, 267 bp, Homo sapiens
gagtggtggaaaggcacggagaatgcggtaggctgaggctggctcccaaagacatgctgcgtcctaatacctggaacctatgaatgctaccttatttggaaaaagagcctttgcagatataattaagttacaattcttgagatgaggtgattattctgtattttctgggtggacccaaatgcaatcacatatgtcctaatagaaaggtgacagagggagaatagacagaagagaaactgtgatcaagaggcagagattgaattgtgt

SEQ ID NO: 275735 - DNA, 203 bp, Homo sapiens
gcttacagtaaaaaatatgaatccagggtgtatttcatctgaattaatcttttggaagtgatggcacgatatgcagatgagcgagaagatataggcagaggagcctgggttgcagtggtagtgctgccaccatggttgctgattgagagataagggaaacaaacgggtctttcttccactgaactcatggggctgggcggaac

SEQ ID NO: 275736 - DNA, 631 bp, Homo sapiens
gctgggcctgtgcaggcctttgggaggcaggaggcctggccttgtcgaggcctgcagaggccaccgaaagtcaaaagcggggcttgggaaggccgccgggaggcatgagctgggctgggccgaaagaggccactgggaggcaggaggagctgggcctggagaggctgccgaaaggcaggagcttcgcctgaggatgccacagtgagacaccatctgggtctggagggtccactgtgaggcagaggctggcctgtagagtccgacagtagacagaagttgggcaaaaggctgatttgaggaagttttgggcttcaagagtcagccacgaggcaggcactaggcctggaaatggcctcacagtcatgagttgggcctaaatgggccactgtgagggaggagctgtgcctgttgaggctgctggcaggcaggcagaaatttggcctggggcagctgccatgaggcaggagctgggtctggaaaaagcccctgggaggcaagagcagggcctgcagaggctgttctcaagtcaaagctgggcctgttcatgccaccgggaagcagaaggtgggcctggagagtttgacttgaggaagttttgggcctacattggccgccatgagctggacaggaa

SEQ ID NO: 275737 - DNA, 848 bp, Homo sapiens
gtgaggcaaatgctcagttttcggaggatgccgtgaggcagggagaaacttggctttcggtggccgcagtgagggaatagtttgattgctgagcctgccgggaggccaaaggtgggcctggaaagctttaccttaagaattctgtggcctacagaggctgccagcagctcagcaggagttgggccaaaggaggttgttgtgaggcaggagacgggcctgtagacgcactgggaggatgagctcatcctggagatgccgagttaaggacattctgggcctcgacaggctgcaaaaggcaaaagctgtgcctggaaaagtcgccatggggcatgagcttggcctaaagaggccactgcaaggcaggagctgggcctgtagaggctgccgaaaggcaggagcttcgcctgaggatgccacagtgagacaccatctgggtctggagggtccactgtgaggcagaggctggcctgtagagtccgacagtagacagaagttgggcaaaaggctgatttgaggaagttttgggcttcaagagtcagccacgaggcaggcactaggcctggaaatggcctcacagtcatgagttgggcctaaatgggccactgtgagggaggagctgtgcctgttgaggctgctggcaggcaggcagaaatttggcctggggcagctgccatgaggcaggagctgggtctggaaaaagcccctgggaggcaagagcagggcctgcagaggctgttctcaagtcaaagctgggcctgttcatgccaccgggaagcagaaggtgggcctggagagtttgacttgaggaagttttgggcctacattggccgccatgagctggacaggaa

SEQ ID NO: 275738 - DNA, 1116 bp, Homo sapiens
tcaacaaaatccctgggtaatttgtatgtacattaaattttgagatgcatgatcttttaaggttcattctaatccttaaaattctgttttaataatgtgtacaatgaagtgctgcatggcaaactacacagaaactaaaggcatgttccaaaaaggaaaagttccatgtggctaggggaataaaagcttcatcagggaaccaggagttgggctggttcttaaaacctggagaaagaagatggttacatcaagagataaatagagtgaagcagaactagtggtgcggaccagctcgccagcaacagaagggtttgtagtcggcctggcagtggacagggaggttggctagaactattaccttaggtccgtgataatatccctgaatccaacttttcagaaagaaataggtaacatatttttcaccaggaagcttcacccagacactgaacagaatggtctcagtgcactaatggaggctcagttaaagggttgtggtagcacaaggaagagacattctgacttggaaatttggagaaggcttcacaaatgaaggggcatttgaaatgagctttgaaggtgcaagagtattccaagttgagaagacaacctgagtggtgttgggtgaacagtcattctacctggctgtagtgtagtatagtgtagtgtagtgtaggaaacatcagaggagtggagtgggatatgagcctggagagagctggcggccatggatcattgaaagccttgaatgtctgatggggaggttgactttattttgtaggcaatggaaagccaccagtggttttagttgagcagcaatgaaattaagcctgtgctttgcaaagattaatctagcagcaacagattggaagcaacaccaccattcctggtatcagtccaggtaaaatatattacagctctttactggagcaataacagtaatattagaaggagaaataaaaaagaaaaatattgcacaggcagaatggggaggtcccagtgatggagctgatcttggttcattgaggcaggggtggcattaatcatgtaaaacacaggaggaggaactgggttaggagtaatggtagagttcagtttaggtaattgcaaatacacact

SEQ ID NO: 275739 - DNA, 532 bp, Homo sapiens
gtagagtgaagagccaatgtggataagtttgaggggtttaaaatgtcatcaaatccaaaaggcaggattacaggtgtgagccactgtgcccggcctattctgttgcttcatgatgtaagggagcccacgtctctcttcctgccaggtgggccacctgagcacagtaaggtcagaatgggtggaatgatggaattcctgaccatctttgcatcattgtcttgatgatcatgacccagccatcccctggaacttctgcatcacagcctttagctcagtctgctgctgtgagcagtatatgaaacttgtatccgtgataacttggctctgccaggacttggggtacctgatggagaggatttcttggaggaaaaggccaaagggctgccccaactttggcctcatatctaaatcctaagagtatacttgcttctggttgccaaaggcctgaatgctcagaaagagtacagcacagaacctgttgataaggattcctctggctttgctttactctgccatgccaaaaaaacaaaaa

SEQ ID NO: 275740 - DNA, 205 bp, Homo sapiens
gcctcccaacgtgctgggattacaggcgtgagccaccgcacctggctgggaattcagacttttattgctataaatcagcaaaagtttggccaagactggggatgggtcaggcatgaaacatttccttgtaatatcatctccatagatcagtagaactctagtggagtagatcagtgtgctgatttatttggaactgagtaaaagg

SEQ ID NO: 275741 - DNA, 186 bp, Homo sapiens
gtgtgtgccaatgggacttgactcagacaccaacattcaaatttcatctaatttccacatgtcatgaaatattattcttttaattttttcaaccagtaaaaagtgtaaaaaatgttcttagctcactgggcggtagaaaaatagattgcaggctgggtttggcttgagggtagtttgctgaccaag

SEQ ID NO: 275742 - DNA, 614 bp, Homo sapiens
gaagcaaccaaaatgtccttcagtgggcgaatgaaaaaaaaaagaactgtgggatattgaggcaatggaatattattcagtgctaaaaagaaataagccattaagtcatgaaaagacacaggttaactttaaatgcatatgactaagcaaaagaagacaataccaaaagactatatgctgaacgattcctgtatgatactacaattaacacaagccattatttatctgtccaaacccatagaatgtacaacataagagtgaactgtaatgttgggaccaggtgtgacagctcatgcctcagaagtcgagggttcagtgtgctgtgattgcaccaatgcactccagcttaggtgacacagtgagactctgtctcagaaaaaaaaaaaaaaaaagtgtaccgtaatgtaaactatgggctttgggttattatcatgtgtcaatgtaggttcatcaattgtaacaaatgtaccactccggtggaggatgttgataatgagggaggttatgcatgtgtggaagcaagggagatacggaaaatctctgtcaactcctcttaatatttctgtgaacctataacttctttaaaaaaaataaagttcttgaaaaagtcaact

SEQ ID NO: 275743 - DNA, 1398 bp, Homo sapiens
  misc_feature (57)..(57): n is a, c, g, or t
  misc_feature (1178)..(1178): n is a, c, g, or t
agtggcgtcttctcctcctcttcaatggcatgactaatccaagagctacggatagtnttagttcatgtgcttggggttggtctaatccaaaataggaaagtctatggtagctgcttcccagctattttgtactggggacaatctggtcctgtctcactcaggacgtttgatctaagccttccataccctctccacctcatcccaagtcttataggttgcaatgctgatacttgaaccacccgctttcagagatttggggccacctggaggtaaagaggtggggctgagaggtggtgctggtgctactctgtgggaactagtacccacatgagggaactaccctttcctgtaaccccagaaaaatagctccaggcatggaaatgtctagtgcaaacccacatcaagggtgtctgttcgcgtttgaaattcatcggcaccagaaagagctaacatgttggcagtatctagaaaaccatcaacatgagcatgggacagttcgctttgcagctgatcccaccatagtgaggaggacgtcttgctctgttacctatgctgaagtgcagtgttacaatcaaagttcactgtagccttaacacctgggctcaagtgatcctcttgcctcagcttcctgagtggctggaaatgcagacacatgccaccgtgcccagcttctacactttttaagaatcacaaaatccacttccattcttcaaaaatttattatttattattaaaaatctcaaacaaacacagacatatggggataccagcattcccctcctggataccaggcagcttcagccctggcaggcacgatagaagaaaatacttgttacacatcctcatcaactctcagagggatcctgagccgtagatggaggaaacgcagacggagtaagcacaggatgtttgcttcctgctgcaatatccccaggtacctacccagctgaaggggatgggatggtacgcctgtgagaagctacaggccaggttggtcaactggggacaagggagttcatggggacactgtgaacacataaaaaaatgaggtaagacaaaagagccatcaatcacaaaacttaaaaactgagaataatagagtcaaaaggggccagggagaagggaggacaggagcagtgggtaggaagagccaggggaatcattaggtaggaactggntaggaacacaaagtagtggagagtggcttagctttaccatcttacatttcccggccacgcctaagttcagatccgtgtggtgggacaggcagaagtaatactcaccggggcaaagacaaaaccaggtcgagggtccaaaggtgacttctcttttccctgaaatcaaaggaaataaaagaaataaagctgggccaagggtctattttcataattcaatctc

SEQ ID NO: 275744 - DNA, 1300 bp, Homo sapiens
ctaagagcagcgaagggccggggttaatcggccgaggatgaaatagaatgagtcagctctgctcatggaacagtagtatctcttgaggccagagcaggtcttgtattttgtttttttatttccagacttctttcggggaggttttataaaatgacagtggtgttcccagcatatgtgatatgtggttagacttctgatagtatcagcttccaggggctaatctggcttatgttgggaggatatgcttacgaatcagcagcagctttctaaaggagagatttgacttttctctgcactgcacagcctggaggattggcttttgatggggatttgcctccgaagctctttgtacatttcttgtttaggagggttttcctatctacctttctactgaagtagtttctggaactttcctggtggatcagagttacgtaatgcagtctgagccttcagactgctagttagaattgttttaggtgttcagaaagggcaaaataggctgatgtggcctgtcagagtgatgtgttctcaaaaaagttcacttgcacatctgtgggctgcttttgtcctcagacccttagtggacagactccacaaaccctctgatgagacgattgatgtggccagggtccagttagcatcagtagaaggatgtcactaggaaaggcccaggtatctggtaagtgactgtgaggtgtcacagtacctgtgacaggagagtgtcctgatgtgcttgggagaaaggccgtatgggggccagggatggaagagacagtgtgtggccacagaaattcctgtccatccaccaccagtgctgctccctgtgtgggctctagggcgagtggccccgaaccttggcccagtgctttgtcccaggccagagtcttggcaatgccacatgctggcagctttctcactgagaaggtcctagcttacccctgtgtgctggccttggattcagccccgagagaggggagagaccattcctcctgtggagtgggttccttatcaccagaccggccactctcagaactggcgtccactgtaaatccaggtgccttacgtgtggctctgtcccttacgctgcaggggaaagctgcattgccattgttcccacctcctcactggcagaaagatgccagggctgttagcactgtctcctcaccttctgtttctcattgtggctcctcaaatgggatttgcatgttcctgtcaagcgtaacaacaatcccttctctctttgacagaggcccaggtgggacagtttctactatttgatatttgagtattatctgggatg

SEQ ID NO: 275745 - DNA, 756 bp, Homo sapiens
acatttcaaagcccattgaagcctatagtgaaaaatcaaaaatcccgtgagcaaaaatagaaacaacctctgtgggaaaatgctgtgtgatacgttcattcatctcacagggataacctttgtttttattcaacaccttggaaacattctttttgtagagtctatgaaaaaaatttctgagccaattgaagtctgtagtgaaaaagctaatatcccattttaaaatataaaacaaactatgaaaatgagttttgatgtgtggattcatcgagagttagacctttgttctaaatcaacaggttaagaacactctttttgtagaatctatgaaaaaacatttctgagcccgttgaggcctattgcgaagtgaatctcttgcaataaaaagcagaaaccagctctctgtgaaataattttgtgatgtacaaatttatcttgcagagttaaaactttgttttaattcaacaagttgaaaccttctttttgtagaatctgcaaagagacatttctgagcccattgaggccaatagcaaaaaaatgaatatcccacaataaaaactagaaacaaaacagctgtgtaaatgctttgcaatatgtggattcgtctcactgagttaaacctatgttttgattcaacaagttaaaaaacttgtctttgtagtatcttcgaagggacaattctgagcctatggagattatagcaaaaaactgaatatcctgcaataaaaactagaaacaagatatccgtggaaaaaa

SEQ ID NO: 275746 - DNA, 405 bp, Homo sapiens
tttggatgatgaaaatgttctgaaatcacatggtggtgatggttgcatggctgtgaatgtactaaaatccaggaactgtatacttttaaagggtatgtgaattgtatcttttaaaaaaatttaattttaagttctaggatacatgtgcaggacatgcaggtttgttacataagtaaacatgtgccatggtagtttgctgcatctatcaacccatcacctaggtattaagtctcacatgtattagctattgatcctgatcctctcctcctgctgcacccccaacaggccccagtgtgtattgttcctctccctgtgtccatgtgttctcattgttcagctcccacttataagtgagaacacacagtgtttagttttctgttcctgtgttagtttgctgaggataat

SEQ ID NO: 275747 - DNA, 361 bp, Homo sapiens
atcggcatgagtaaaactgcaggggaagtaagaaatttatgaagtatactggatgtgtgtggaggagggtgaaggtggtgatgagcagttttatgttgcttgaacatgaagtttgaagcaggcagtaactaaacatgtaagactagatgggtgggcatggagggctttgtatgcctcaataatgattttatactttagtctgaagatatgtgaggggaaccatataccaatgatgacgcgatgtaacacgagacagcacataccaaggccaccacacaccacctgtccaaaaggccttcgatacgggataatcctatttattacctcagagttttttcttcgcaggatttttctgagcctt

SEQ ID NO: 275748 - DNA, 339 bp, Homo sapiens
atcggcatgagtaaaactgcaggggaagtaagaaatttatgaagtatactggatgtgtgtggaggagggtgaaggtggtgatgagcagttttatgttgcttgaacatgaagtttgaagcaggcagtaactaaacatgtaagactagatgggtgggcatggagggctttgtatgcctcaataatgattttatactttagtctgaagatatgtgaggggaaccatggtagaatagtgtgatatgatttttcttcttcatgaatcatcttcaaaacagcattgctctgggaagaaaaagattacctgagagtgaaggatttgagagactggttgagcctatt

SEQ ID NO: 275749 - DNA, 344 bp, Homo sapiens
tcgtgttcttgcggctgagtggtgctctgctgcgcatccacctcggtgcctccgcccactcctgcaccgacggccgctgcctttgctcgcagatctgggctattgtgaacagcgctgcggtaaacgtggcggcacagacatctctcgggcaaaccgaggatgcgatacggatacttcctccgtcatttccactcccctttctccaggccctgaagctccgtctccacgcccgaactcgtggcctcccattccccaggcagcttctcccgaatgtcccctctcagaaaccggtgccagcgcgtccccgctgtgccacccccaagcccactgccaaccccgcacag

SEQ ID NO: 275750 - DNA, 787 bp, Homo sapiens
aattgtttctttttaaagtaaagattagctcgggatgttctttaaaaaatagttggggttaatcataaattaacctcttatgacggccgtgatatagaaatgtatatgttaggccaggtgtggtgactcatgcctgtaatcccaggactttgggagaccaaggcagatggatcacctgaggtcaggagttcaagatcagcctggccaacatggtgaaaccctatctctactaaaaatacaaaaattagccgggcatggtggtgtgtgcctgtaatcccagctgctccagaggctgaggcaggagaattgcttgaacccgggaggcagaggttgcagtaatctgagatcgtgccactgcactacagcctaggtgacagagcaagactccatctcaaaaaaaaaaaagaaagaaatatatatgttagaaaaagtctaaaaaggaaatttacaaagactacaagaagatagttccctggaaaagacagtgtgatggtgtgccaaaaacacctttcctgatcatacacatataagtaaacacccataccgagttccccctgactctagttaggagctgtctttaaccacattagtccctattcgggatcatcaaatttgggaaatacctgttcctagcttgttatgaacatttaaaaatcttatttttttccccttcaaactgtgcttataatagatagcaaagtggggaataaaagtctaactacaagcttattaatttgaagtaataggacttactgctttcagtaatgtcactgtcatccatcagact

SEQ ID NO: 275751 - DNA, 581 bp, Homo sapiens
ctggccaggggcccttatgggatcttttagtagaagctagccttctgagacaacgcagccaagcacaagccagtaaatgttgcaagagtgaagggagaactatacctaaatggctgttgatctcaaggcactgaaagctaagttaagaggaatgttatttgcttattggttagtgtgttagtctgctagggctgccataacaaagtaccacagaggtcttaacagaaatgaattgtctcacaattctggaagctagaagtctgaaatcaaagttggttttttccttctgagggctttgaagaaagatctgttccagttctctctcctgggcttggagatggtgttgtctgtgtcttcacatgatcttccctctgtatgtgtcagtttttgagtccaagtttcccctttctacaagaacattagtcatgttggattaggtcccatcctaaacacctcatctcaatacgtgtgcaacaatcctatttccaaacaggttaaacttcaactctgcaaatgcagtgaaatattttactaaaacaaacaagtattattaataaaaataattttgcagaaaaatctct

SEQ ID NO: 275752 - DNA, 525 bp, Homo sapiens
caggctgataacatgtggaaggaagagaacagttctaattaatagactaattagtggtacaagtctttaatagctgattatagggaagtcattccccaccccccaagtgattgatttatttattgctgttgtgctgcattattgcaaaatagtcagcttctaattatctattggctggttcaatcaagccttttccttctcttccatcttgttctttcccttgctaagggaaggcacaggcagaatgggagaactcaagccagctgatgaccaattctggacagatataagtgttgggatcctactgccactccatcttgagtgcttagagctggaaggggaatatgaggttcaagggaaaagaaggcaagaaaatcccactcattcttctaggataacgtccccatggtggccattccctcatcatccctctgactctgcacgccataactcacacacattgtcagttgcattaaaaaacagtatagttaggaaacaagcatgagaagacacaaaaagaaaaaa

SEQ ID NO: 275753 - DNA, 492 bp, Homo sapiens
ctgaccattatgtttgagaagtagatttcttcactaaaggggctttgcagcacacttagaatgagtgagccactgtgcctctctagaaactggcttcttgtcatcatttcaacatccactcaaacgctcacccctgaaagtggccttcctgcttgatatggtttggctctgtgtctccacccaaattggtttggctctgtgtccccactgaaatctcatctcgaattgtaatccccataatccccatgtgtcaagggacggacctggtgggaggtaattggatcatggaggcagtttctcccatgctattcttgtgatagtgagttctcatgacactgatggttttgtgtttgatagctccttcacactctttctttcctgttgccatgtaagacatgcctgcttccccttccaccaggattgtaagtttcctgaggcctccccagccatgcggaactgtgagtctattaaatctcttttctttgtaaatta

SEQ ID NO: 275754 - DNA, 455 bp, Homo sapiens
caattaaaactcactgtctgaggcccctttgagtctagttccgaaggaggacaggaggccagcctccacagcagagccagtgcaaggcttggtctgtgcagccttctgcttcttggtctctgctcattttatcctaaatggaagcatcccgcgtggctgcctccccaacactatcatggtagatttgtgtctgtaaagttatctaagatgtggttctggggtctctgaacacagtctgactcttcattcccttccctcagagttaggaacaaaagaataatgcatgcggcatttagatgctgattacggggtatgggagttggtaagagatgagggtggagggaatattcctagcaattggtgtatttggctgattggtaactgtttatagacttgtttctttctagcatgtaccccttgaaatcattttctttgtaaatgttaaaagccatatg

SEQ ID NO: 275755 - DNA, 671 bp, Homo sapiens
tagactgtgacagcaaagctttataacaagtaaatggagtaacaattacaataaagaaaatgtgagccaaagattttgtgctttgtcaagctaatgttcagttataaagatcacagacaaacatcaatgtgtaagtacttggaatattgctctttccggcattgtttcgcgctgccacaatggtgtgtgtgaacatcctacctgttgctctcaagagtatcaccaatgccgaaaagagagggaaacgccggttcttactaggccatgctccaaagtcattgtccaacttctagctgtgatgatgaagcatcgttacattggcaaatttgaaatcattgatgataacagagctgggaaaattgtgaacctcacaggcaggctaaacaagtgtagagccccagctttgatttgcaactcaaagatctagaaaaacggcagaacaatctgcttctatcccaaccatttgacttcgtcatattgacagccttagctggtatcatggaccatgaagaagcaagacgaaaacacacaggagggaaaatccttggattttgtttctagggatgcaatacatatttacaaataaaatgcctcaaaaaaaaaaaaaacaaaaaacttcggaatatcgttcccaagacttttcctgagaactactgaagaacaagcttctg

SEQ ID NO: 275756 - DNA, 201 bp, Homo sapiens
ccagttaccatagctagtagaagaaccagaatttgaggccagatctccttgttttcaatccagtgccctttcagctacaaaagtagttatagttaagtgaagctaatcaagggcagattttctgtaaggagggtgattttgagtgtctatttaagggagtatgagttgattgttacgagaatggaggtggtattcgggcta

SEQ ID NO: 275757 - DNA, 302 bp, Homo sapiens
ggcagaagctctcagttactgccgggcatctatgtatcaagcaggctgcatacaatttgcctcactgaacctttggaacaaagctacaaggtcggtatgagtcatattcccctattacagaggaagaaactgaggctcagagagtaaaacctaaaaccactagctcatgttcaacacagcaagaaagcagtgatgctggggctcgaaaccacattgcagccattgccctgcagaggaggaatgggaggcagcggtggtggggctaggggtgggtttggaataaatcactaatatttatatta

SEQ ID NO: 275758 - DNA, 409 bp, Homo sapiens
atatgtgggaaagccttttactctcccagttcatttcaaaggcatgaaagaagtcacactggagagaaaccctacaaatgcaagcaatgtgggaaagccttcacttgttccacttcgtttcaatatcatgaaaggactcacactggagagaaacccgatgggtgtaagcaatgtgggaaagccttcagatctgccaagtacattcgaatacatggaaggactcacactggtgagaaaccctatgaatgtaagcaatgtgggaaagcatttcattgtgtcagctcctttcatagacatgaaaggactcacgctggagaaaaaccttatgaatgtaagcattgtgggaaagccttcacttgttccatatatattagaatacatgaaagaattcacactggagagaaacctt

SEQ ID NO: 275759 - DNA, 254 bp, Homo sapiens
cttccgaaccatcagggacagtggcacaagcacttgggtttgaatctccgtcctgtgtcttaccagcttcttgacctcgagcaagtttccttaacctgaggcccagttgcataatctgtgagatgggaaaaaatctgcctatgtcattgggttgttttaaggactgagtgagctcatgtgagtggagcatctagaacagcgtttggcagcccatacatgctcaataaatggcaagttttattgttatgattaga

SEQ ID NO: 275760 - DNA, 447 bp, Homo sapiens
agaaatgcaagaaagctagcacccccaggggcatccttcaaccaatggggttgggagttgatggagaaatgcctcagctctcagtgtttcgggcagagattctggggcattcccaggaggtttggtggatcatgatcccataatgcccagaaacaaccccaacagcttactcatacattggcttctcctcctccctgtcttacctccctgctccctcattcctgcttcctggggtcaggtaaatcacctggacccaggtccttgtctcaggctctacgttcagtgtttctcatgctgtattcctcggaaccctagggcaccttaggatgtgtctacccctctctcacctgcatttgatttaatgctctgttgtcatcatcttgaaatgtttaataaattttgaacaaggggccgcatattttcattttgcattgtaccccacaaatg

SEQ ID NO: 275761 - DNA, 302 bp, Homo sapiens
taaaatatataagtctttggttaaaaagagccactgaggccaggcacagtgctcacaccttgaccctcccaccttggccttgtaagtgctggaattgcaggtgaatcactgcacctagccagaagaaacttttaaaatcagaaaaggctactttgcagacacctaggaaaataaatgtgaaatcctagatgaaatggacagtttcctaggaaaatacataggacccaaattgactccatttgatttagaaaggtaaacagactagcttttatagaataaatacagatatttattacaaaact

SEQ ID NO: 275762 - DNA, 558 bp, Homo sapiens
ttatgaagttctctaaacctgtaagtgaagtggaaacaggaaactttggattagaaaacataccctctgaccagggaatatccaggatccagcatgtcttcacattggcagaattttctgaaataggaccgaaggtcatatatcactgtgtaatctatgaaaagagatgctcagaaggtttgatattcatacacactcttacaacttgttacatctccagagctcagactggctggctttacaaatagctggctttacaatttgcacagggataattgaagttcatttcttctagaatcattaaaaattaacagtaaagttgctaaaaaaataatgccttgaaagtacaagattcaatattctgtgctttggtgtatgtatgtatttatctgtatgtgtagtggggattaggaggggacgattactccaaaataggattttgttccatcctgtatgggataactattaagcatttggcttgtggctaaaaatacatgttaaaataatactttttgtatgttatgttaaataaatgttattagaattaaaaaaaaaaaa

SEQ ID NO: 275763 - DNA, 201 bp, Homo sapiens
gaaacattttgctgaagaggatctatattaatagatggcaaataagcatataaaaatgatatttaatatcattggcccttaggaaaatgcaaattaaaatcacagtgataaattagacctatcaaaatgtcaaataaaacacattgacaaccccagatgctggccaggatatggagaaacagaattgctcttctgttaatg

SEQ ID NO: 275764 - DNA, 1624 bp, Homo sapiens
gacggacctgccccgaccttctcctgtccgatgggaaagccagcatctccatgccccgtgagggcggttccacctgcactgcccgatgtcctgaccctggggaacacagcagcacttggggggagtttgaaggctttcgggaatcttcagccaagtctggacaattctcacagtcccttgaactcctcgagggacccacagaaccccagccaccgagaaccacttctgccccaaaagagtgcagttctcaccaaccatgccagggtggaccttgggtgacaggaacttctgccgtcccaccttctgagcccattctcagctatgagaacattttaaagtgtgcttttcaagaaataacagtccagcaggcagctgaagacgtttccaccatagaccatttcctagaaataagcagtgaagaaaaacctggcgttgaacgtgtacataaattgtgtaacgaatccagaaaactctggagagcccttcagagcatacacaccacgtctacttctcagcgcctctggagcgagtcccgttgccaggagaacttctttcttgttctcggaatagatgctgcgcagaagaacctttctggaggccagggccacatcatggaagattgtgacctcaaagagcctgaaggactcctcactgtcagcagcttctgtctccagcattgcaaagccctgatccagaccaagctctcggggccgcctggcagcaaacaggggaggctgatgacatgcagccgcttcctgaagaccccctcatgcggaggtggccagcacatcactattccaaggaaaaggatgttcactccacgcaagctcaaattgacactctttaatagcgacgtttgctaaaatcaggaggactttgtacctttatgaggaatttttcattttcttcctggctgggttgatgtggaaaccagagctgtctgtggagctgttttccagaccccaggcccattcctgggatctctccaacaggacctgtcctgtgttctgggcttgtctcgggtctgaccaggagatggaggatgtgtccttggcagagccaaggggagacagaggtttctggatgccatgacaggctgtcggggtccaggtggcactcatgggccccctgccccatgtgaatgctgctggcacctggtggggggttgcccagggatggaccctgggcatggcttctgggctgcttagtccagggggagcaacttgtggccaaatccatgagttcagaggaaaaggggaaggcactgaaacgtcaccagagagacagctgttgagaccgctcagaaaccctctgtctgtcacactctgccctggctgctgtgtggtcagggcaccatgagggtgtacagatgtgctgtgtcctcagagcctcgcaggtgccctcacttactgcctgggcccctgcccagcagcctcaaggacaggcctttgtccctcacggttgtggacaggaggtcgcaccactggcctgcgagagcctctggtgggcccgtggcttcccccagttatctgctaaggaaaactgtgctcttcgaagggcagagccaagaagtcagccctgacttttgtaaaattttactaaataaaaccacctggataaaact

SEQ ID NO: 275765 - DNA, 398 bp, Homo sapiens
gacggacctgccccgaccttctcctgtccgatgggaaagccagcatctccatgccccgtgagggcggttccacctgcactgcccgatgtcctgaccctggggaacacagcagcacttggggggagtttgaaggctttcgggaatcttcagccaagtctggacaattctcacagtcccttgaactcctcgagggacccacagaaccccagccaccgagaaccacttctgccccaaaagagtgcagttctcaccaaccactggcctgcgagagcctctggtgggcccgtggcttcccccagttatctgctaaggaaaactgtgctcttcgaagggcagagccaagaagtcagccctgacttttgtaaaattttactaaataaaaccacctggataaaact

SEQ ID NO: 275766 - DNA, 2243 bp, Homo sapiens
gacggacctgccccgaccttctcctgtccgatgggaaagccagcatctccatgccccgtgagggcggttccacctgcactgcccgatgtcctgaccctggggaacacagcagcacttggggggagtttgaaggctttcgggaatcttcagccaagtctggacaattctcacagtcccttgaactcctcgagggacccacagaaccccagccaccgagaaccacttctgccccaaaagagtgcagttctcaccaaccatgccagggtggaccttgggtgacaggaacttctgccgtcccaccttctgagcccattctcagctatgagaacattttaaagtgtgcttttcaagaaataacagtccagcaggcagctgaagacgtttccaccatagaccatttcctagaaataagcagtgaagaaaaacctggcgttgaacgtgtacataaattgtggtaatgaactgaagaaatatttcttacagcaactgcttttgtacttttgtttgataaaagtaggtgtgtgaggctttgtttttgcctttatggagagtagcatctctcctgaggtccctgccatctgtgggtcataggggtcctatgagaaggggcagcacgattggcgctccagctgtggccttccactctgagccctattcatcctcctccccagccagctcacctggagcagctggacccaagcccagctccccttgggtctcagtgccagtgctggtggagtgggtgggggcctcgcattcagtgcgagtggctggtgggcctgggcagtgggcacaggggccttctgggggacttggctgagtgggcaccggctgcctcatggttctcagccacagagttctagaaaacgttccacactctggagccccattgtcagccccaggcccagccccaggggtgctcccggtgctgcctgcagggccacaggctcctaggggaaagtgcacccgcagtcactcgcagatggccattttccagggacacactttcaactgagcattgaaagacagacagcgctcgagtggattaggccgcagtggttgagaagctcgagtaacgaatccagaaaactctggagagcccttcagagcatacacaccacgtctacttctcagcgcctctggagcgagtcccgttgccaggagaacttctttcttgttctcggaatagatgctgcgcagaagaacctttctggaggccagggccacatcatggaagattgtgacctcaaagagcctgaaggactcctcactgtcagcagcttctgtctccagcattgcaaagccctgatccagaccaagctctcggggccgcctggcagcaaacaggggaggctgatgacatgcagccgcttcctgaagaccccctcatgcggaggtggccagcacatcactattccaaggaaaaggatgttcactccacgcaagctcaaattgacactctttaatagcgacgtttgctaaaatcaggaggactttgtacctttatgaggaatttttcattttcttcctggctgggttgatgtggaaaccagagctgtctgtggagctgttttccagaccccaggcccattcctgggatctctccaacaggacctgtcctgtgttctgggcttgtctcgggtctgaccaggagatggaggatgtgtccttggcagagccaaggggagacagaggtttctggatgccatgacaggctgtcggggtccaggtggcactcatgggccccctgccccatgtgaatgctgctggcacctggtggggggttgcccagggatggaccctgggcatggcttctgggctgcttagtccagggggagcaacttgtggccaaatccatgagttcagaggaaaaggggaaggcactgaaacgtcaccagagagacagctgttgagaccgctcagaaaccctctgtctgtcacactctgccctggctgctgtgtggtcagggcaccatgagggtgtacagatgtgctgtgtcctcagagcctcgcaggtgccctcacttactgcctgggcccctgcccagcagcctcaaggacaggcctttgtccctcacggttgtggacaggaggtcgcaccactggcctgcgagagcctctggtgggcccgtggcttcccccagttatctgctaaggaaaactgtgctcttcgaagggcagagccaagaagtcagccctgacttttgtaaaattttactaaataaaaccacctggataaaact

SEQ ID NO: 275767 - DNA, 1423 bp, Homo sapiens
cacgcgtcgccacgcgtccgcaccttctgagcccattctcagctatgagaacattttaaagtgtgcttttcaagaaataacagtccagcaggcagctgaagacgtttccaccatagaccatttcctagaaataagcagtgaagaaaaacctggcgttgaacgtgtacataaattgtgggacacactttcaactgagcattgaaagacagacagcgctcgagtggattaggccgcagtggttgagaagctcgagtaacgaatccagaaaactctggagagcccttcagagcatacacaccacgtctacttctcagcgcctctggagcgagtcccgttgccaggagaacttctttcttgttctcggaatagatgctgcgcagaagaacctttctggaggccagggccacatcatggaagattgtgacctcaaagagcctgaaggactcctcactgtcagcagcttctgtctccagcattgcaaagccctgatccagaccaagctctcggggccgcctggcagcaaacaggggaggctgatgacatgcagccgcttcctgaagaccccctcatgcggaggtggccagcacatcactattccaaggaaaaggatgttcactccacgcaagctcaaattgacactctttaatagcgacgtttgctaaaatcaggaggactttgtacctttatgaggaatttttcattttcttcctggctgggttgatgtggaaaccagagctgtctgtggagctgttttccagaccccaggcccattcctgggatctctccaacaggacctgtcctgtgttctgggcttgtctcgggtctgaccaggagatggaggatgtgtccttggcagagccaaggggagacagaggtttctggatgccatgacaggctgtcggggtccaggtggcactcatgggccccctgccccatgtgaatgctgctggcacctggtggggggttgcccagggatggaccctgggcatggcttctgggctgcttagtccagggggagcaacttgtggccaaatccatgagttcagaggaaaaggggaaggcactgaaacgtcaccagagagacagctgttgagaccgctcagaaaccctctgtctgtcacactctgccctggctgctgtgtggtcagggcaccatgagggtgtacagatgtgctgtgtcctcagagcctcgcaggtgccctcacttactgcctgggcccctgcccagcagcctcaaggacaggcctttgtccctcacggttgtggacaggaggtcgcaccactggcctgcgagagcctctggtgggcccgtggcttcccccagttatctgctaaggaaaactgtgctcttcgaagggcagagccaagaagtcagccctgacttttgtaaaattttactaaataaaaccacctggataaaact

SEQ ID NO: 275768 - DNA, 1629 bp, Homo sapiens
gtttgtttgtttgagacagagtctcactctgtcccccaggctggagtgcagtggcgcgatctccgctccctgcaacctccgcctcccgggttcaagcgattctcctgcctcagcctccccagtagctgggatgacaggcgcccatcaccacgcccggctatttttttgtatttttagtagagacggggtttcactatgttggccaggcagatcttgaactcctgacctcctgatctgtcagcctcagcctcccaaagtgctgggattacaggcgtgagccactgtgcccagcccgggaacactgtttttagagttcttaacagccatacgcctcttggcttgtgcgcgtctcggcttgcgggtaaaggccaggcgcccgctgcgtgcctcgggccgtgcctcatgatctcctcagaaggctctcaaggtcaccttttaacaagtgcatctgttttccagtaacgaatccagaaaactctggagagcccttcagagcatacacaccacgtctacttctcagcgcctctggagcgagtcccgttgccaggagaacttctttcttgttctcggaatagatgctgcgcagaagaacctttctggaggccagggccacatcatggaagattgtgacctcaaagagcctgaaggactcctcactgtcagcagcttctgtctccagcattgcaaagccctgatccagaccaagctctcggggccgcctggcagcaaacaggggaggctgatgacatgcagccgcttcctgaagaccccctcatgcggaggtggccagcacatcactattccaaggaaaaggatgttcactccacgcaagctcaaattgacactctttaatagcgacgtttgctaaaatcaggaggactttgtacctttatgaggaatttttcattttcttcctggctgggttgatgtggaaaccagagctgtctgtggagctgttttccagaccccaggcccattcctgggatctctccaacaggacctgtcctgtgttctgggcttgtctcgggtctgaccaggagatggaggatgtgtccttggcagagccaaggggagacagaggtttctggatgccatgacaggctgtcggggtccaggtggcactcatgggccccctgccccatgtgaatgctgctggcacctggtggggggttgcccagggatggaccctgggcatggcttctgggctgcttagtccagggggagcaacttgtggccaaatccatgagttcagaggaaaaggggaaggcactgaaacgtcaccagagagacagctgttgagaccgctcagaaaccctctgtctgtcacactctgccctggctgctgtgtggtcagggcaccatgagggtgtacagatgtgctgtgtcctcagagcctcgcaggtgccctcacttactgcctgggcccctgcccagcagcctcaaggacaggcctttgtccctcacggttgtggacaggaggtcgcaccactggcctgcgagagcctctggtgggcccgtggcttcccccagttatctgctaaggaaaactgtgctcttcgaagggcagagccaagaagtcagccctgacttttgtaaaattttactaaataaaaccacctggataaaact

SEQ ID NO: 275769 - DNA, 1271 bp, Homo sapiens
  misc_feature (142)..(142): n is a, c, g, or t
ccaagagtggctactggagggctgtgagtgtgcagggtagtggcagcctccaccagggagtgccagacacgtagcacaagggccagagaccccgcctaagatgtgggcccactgctgtcttcggggctggctgcaggcagangccacagactgcaccatgaggaagccccagcatgttttccctgggcgcctctctggtgacatcccatgatgagaaggtttctaagaggagaaccaaggagagaacactagggggccgagagcagggggcggccaggggcaaacgcccaagctagcgcttctcattgcccggggtgcgcgcgcctgactgctgtcctctcatctcagctctcggggccgcctggcagcaaacaggggaggctgatgacatgcagccgcttcctgaagaccccctcatgcggaggtggccagcacatcactattccaaggaaaaggatgttcactccacgcaagctcaaattgacactctttaatagcgacgtttgctaaaatcaggaggactttgtacctttatgaggaatttttcattttcttcctggctgggttgatgtggaaaccagagctgtctgtggagctgttttccagaccccaggcccattcctgggatctctccaacaggacctgtcctgtgttctgggcttgtctcgggtctgaccaggagatggaggatgtgtccttggcagagccaaggggagacagaggtttctggatgccatgacaggctgtcggggtccaggtggcactcatgggccccctgccccatgtgaatgctgctggcacctggtggggggttgcccagggatggaccctgggcatggcttctgggctgcttagtccagggggagcaacttgtggccaaatccatgagttcagaggaaaaggggaaggcactgaaacgtcaccagagagacagctgttgagaccgctcagaaaccctctgtctgtcacactctgccctggctgctgtgtggtcagggcaccatgagggtgtacagatgtgctgtgtcctcagagcctcgcaggtgccctcacttactgcctgggcccctgcccagcagcctcaaggacaggcctttgtccctcacggttgtggacaggaggtcgcaccactggcctgcgagagcctctggtgggcccgtggcttcccccagttatctgctaaggaaaactgtgctcttcgaagggcagagccaagaagtcagccctgacttttgtaaaattttactaaataaaaccacctggataaaact

SEQ ID NO: 275770 - DNA, 864 bp, Homo sapiens
aattttttgtatttttagtagagacggggttccaccatgttggtcatgctggtcttgaactcctgacctcgtgatccacccgcctcagcctcccaaagtgctgggattacaggcgtgagccaccgtgcccggcatttttcattttcttcctggctgggttgatgtggaaaccagagctgtctgtggagctgttttccagaccccaggcccattcctgggatctctccaacaggacctgtcctgtgttctgggcttgtctcgggtctgaccaggagatggaggatgtgtccttggcagagccaaggggagacagaggtttctggatgccatgacaggctgtcggggtccaggtggcactcatgggccccctgccccatgtgaatgctgctggcacctggtggggggttgcccagggatggaccctgggcatggcttctgggctgcttagtccagggggagcaacttgtggccaaatccatgagttcagaggaaaaggggaaggcactgaaacgtcaccagagagacagctgttgagaccgctcagaaaccctctgtctgtcacactctgccctggctgctgtgtggtcagggcaccatgagggtgtacagatgtgctgtgtcctcagagcctcgcaggtgccctcacttactgcctgggcccctgcccagcagcctcaaggacaggcctttgtccctcacggttgtggacaggaggtcgcaccactggcctgcgagagcctctggtgggcccgtggcttcccccagttatctgctaaggaaaactgtgctcttcgaagggcagagccaagaagtcagccctgacttttgtaaaattttactaaataaaaccacctggataaaact

SEQ ID NO: 275771 - DNA, 953 bp, Homo sapiens
gacggacctgccccgaccttctcctgtccgatgggaaagccagcatctccatgccccgtgagggcggttccacctgcactgcccgatgtcctgaccctggggaacacagcagcacttggggggagtttgaaggctttcgggaatcttcagccaagtctggacaattctcacagtcccttgaactcctcgagggacccacagaaccccagccaccgagaaccacttctgccccaaaagagtgcagttctcaccaaccatgccagggtggaccttgggtgacaggaacttctgccgtcccaccttctgagcccattctcagctatgagaacattttaaagtgtgcttttcaagaaataacagtccagcaggcagctgaagacgtttccaccatagaccatttcctagaaataagcagtgaagaaaaacctggcgttgaacgtgtacataaattgtgtaacgaatccagaaaactctggagagcccttcagagcatacacaccacgtctacttctcagcgcctctggagcgagtcccgttgccaggagaacttctttcttgttctcggaatagatgctgcgcagaagaacctttctggaggccagggccacatcatggaagattgtgacctcaaagagcctgaaggactcctcactgtcagcagcttctgtctccagcattgcaaagccctgatccagaccaagcaccagtctaacagagcagcgcaggcgtttctcatccagcagcaatgctacttcctcacccagggcaggtgcatgggctgaccctgatgggagcctccaggaacactgccttgagaaggcaccaccgaggggctatgaggtccctgaagaccaactggtgcctgtgatctacaaacagacaaatatttgacctttgtcttcaatgacatttacatataaatagacataaataaaatcctccataatttactc

SEQ ID NO: 275772 - DNA, 1010 bp, Homo sapiens
gacggacctgccccgaccttctcctgtccgatgggaaagccagcatctccatgccccgtgagggcggttccacctgcactgcccgatgtcctgaccctggggaacacagcagcacttggggggagtttgaaggctttcgggaatcttcagccaagtctggacaattctcacagtcccttgaactcctcgagggacccacagaaccccagccaccgagaaccacttctgccccaaaagagtgcagttctcaccaaccatgccagggtggaccttgggtgacaggaacttctgccgtcccaccttctgagcccattctcagctatgagaacattttaaagtgtgcttttcaagaaataacagtccagcaggcagctgaagacgtttccaccatagaccatttcctagaaataagcagtgaagaaaaacctggcgttgaacgtgtacataaattgtgtaacgaatccagaaaactctggagagcccttcagagcatacacaccacgtctacttctcagcgcctctggagcgagtcccgttgccaggagaacttctttcttgttctcggaatagatgctgcgcagaagaacctttctggaggccagggccacatcatggaagattgtgacctcaaagagcctgaaggactcctcactgtcagcagcttctgtctccagcattgcaaagccctgatccagaccaagaggccctgaaggaacgtgaccatcacctgacctgagtgacactgcaaagccctcattctttctagtggacgtggagctctctccaagcagataactgagccgtcagccacatcagaggccagggacatggccttcagaggctttggccatcatgcaaaaaacctggccaccctgaagcctctatgctggagaaatgtctgcagtgatcccacagagatgctgacaagatgcccaaggacccagctgctggagctttccggccagcatgccagccctgggaggagggaagccttcagggtggggtgcatc

SEQ ID NO: 275773 - DNA, 469 bp, Homo sapiens
gacggacctgccccgaccttctcctgtccgatgggaaagccagcatctccatgccccgtgagggcggttccacctgcactgcccgatgtcctgaccctggggaacacagcagcacttggggggagtttgaaggctttcgggaatcttcagccaagtctggacaattctcacagtcccttgaactcctcgagggacccacagaaccccagccaccgagaaccacttctgccccaaaagagtgcagttctcaccaaccatgccagggtggaccttgggtgacaggaacttctgccgtcccaccttctgagcccattctcagctatgagaacattttaaagtgtgcttttcaagaaataacagtccagcaggcagctgagaagtagacgtggtgtgtatgctctgaagggctctccagagttttctggattcgttacacaatttatgtacacgttcaacgccaggtttttct

SEQ ID NO: 275774 - DNA, 2180 bp, Homo sapiens
  misc_feature (1780)..(1782): n is a, c, g, or t
  misc_feature (2154)..(2154): n is a, c, g, or t
gacggacctgccccgaccttctcctgtccgatgggaaagccagcatctccatgccccgtgagggcggttccacctgcactgcccgatgtcctgaccctggggaacacagcagcacttggggggagtttgaaggctttcgggaatcttcagccaagtctggacaattctcacagtcccttgaactcctcgagggacccacagaaccccagccaccgagaaccacttctgccccaaaagagtgcagttctcaccaaccatgccagggtggaccttgggtgacaggaacttctgccgtcccaccttctgagcccattctcagctatgagaacattttaaagtgtgcttttcaagaaataacagtccagcaggcagctgaagacgtttccaccatagaccatttcctagaaataagcagtgaagaaaaacctggcgttgaacgtgtacataaattgtggtaatgaactgaagaaatatttcttacagcaactgcttttgtacttttgtttgataaaagtaggtgtgtgaggctttgtttttgcctttatggagagtagcatctctcctgaggtccctgccatctgtgggtcataggggtcctatgagaaggggcagcacgattggcgctccagctgtggccttccactctgagccctattcatcctcctccccagccagctcacctggagcagctggacccaagcccagctccccttgggtctcagtgccagtgctggtggagtgggtgggggcctcgcattcagtgcgagtggctggtgggcctgggcagtgggcacaggggccttctgggggacttggctgagtgggcaccggctgcctcatggttctcagccacagagttctagaaaacgttccacactctggagccccattgtcagccccaggcccagccccaggggtgctcccggtgctgcctgcagggccacaggctcctaggggaaagtgcacccgcagtcactcgcagatggccattttccagggacacactttcaactgagcattgaaagacagacagcgctcgagtggattaggccgcagtggttgagaagctcgagtaacgaatccagaaaactctggagagcccttcagagcatacacaccacgtctacttctcagcgcctctggagcgagtcccgttgccaggagaacttctttcttgttctcggaatagatgctgcgcagaagaacctttctggaggccagggccacatcatggaagattgtgacctcaaagagcctgaaggactcctcactgtcagcagcttctgtctccagcattgcaaagccctgatccagaccaagctctcggggccgcctggcagcaaacaggggaggctgatgacatgcagccgcttcctgaagaccccctcatgcggaggtggccagcacatcactattccaaggaaaaggatgttcactccacgcaagctcaaattgacactctttaatagcgacgtttgctaaaatcaggaggactttgtacctttatgaggaatttttcattttcttcctggctgggttgatgtggaaaccagagctgtctgtggagctgttttccagaccccaggcccattcctgggatctctccaacaggacctgtcctgtgttctgggcttgtctcgggtctgaccaggagatggaggatgtgtccttggcagagccaaggggagacagaggtttctggatgccatgacaggctgtcggggtccaggtggcactcatgggccccctgccccatgtgaatgctgctggcacctctctnnntcgtgcgccgccgccaacaaaggggccgcccgcaacgcccccccacaccgcccccacgcgcacaacccccgggcgggccaaccgcgcccccgccgcggcccccaccaagaccgcccaagcgccccccaaacgccaggaaccccccagcaccacgcgacacccaacaccccaccaccgcgccgcccacaaccaccccagcagccacccggcccccaaacccaccaccgcgcccgcacccccgcccaccgcgcccccgagccgggcacacggccccacggaccccccaccacccgcccagcacccacacaacacccggccgcaccaccaccccaaacgcacgcgccggccccagcgacccgccgccccgcccgnacgccccacgcaccacccgcaccccg

SEQ ID NO: 275775 - DNA, 357 bp, Homo sapiens
aagcatttcctccagggctagtgggatgcatggggagatgtgcagcccaggtccccttcaaaggaggacttgtggctattcccacatacctgtgggcagccagcctccagcagccaagagtcgcctcccctaaggtcacacccatcccagtgtgcccacatcccatgacctgtcaggcgagggtaaagagacaaggccatcttggcccaatgtgggacaagtctgatgcatccatgtcagcccaggtgctgggttctgccagcctgcatcacagttcgacttctgcttctgtctaatcctgcctgtctccagttattgatcccaatggctccccctaataaacctccttcacactaa

SEQ ID NO: 275776 - DNA, 132 bp, Homo sapiens
cctcccctacagccccttggccattgtgggaaggaaaagcagattctaatacaggacacagcaaacatcatgtttgtcttcatgtctgcaaagcatgctggatttgtccaaggaaaaagcaagtaaaaatag

SEQ ID NO: 275777 - DNA, 422 bp, Homo sapiens
caaaatatacatatatggctaaatagtctgaaactatggattcagtgaagcaaacggtatgtgcccatggaagagttataccaggaaaagaaaataattcattacagttttactggcactctgaaaaggaacaggagctgtgaagctgctgaggactaaggctgctgctatctgtggactcaaatggagaagcgtctatgaaaaatgctggctgcaaggggcacattatataattctatgtgtgatatcctaattttagaatgaatgaactaaactctttctgagtatgtttttgtattagcacaaaaatgcctgggaggtgaggacacctaactacagccattggctgttcttgggcattgccagcagagaggaacagccgcttttacctttcatctgaactggttgactttttttttaaa

SEQ ID NO: 275778 - DNA, 875 bp, Homo sapiens
tggttttagttttagacatggtgaatttgaggggtgtgtgggacacctaggtggagatattgaatagagacacacctgagcaagttacttcagctttctgtgcctcagtttcctcctttgaaaatgataatagtacctacctcaaagactttcatgaagattaaatgaattactacgtaaagtgcttagaacagtgcctgacatacagtgctatagtgtttgctattacatattaatatgaattatagttatgtttctatttatatatatagatacacatacatctaacatatgtgcgtgtgtgtgtgtaaatatataataaagccttgtagaggtttttggggggctttaggggaattaataaaataactcctgaatgaaaataacagaacaattgcaagaatcccactgcgcccctgccccatgacttgactctctcaaaagtcctttctcccctctcccttcaatgccttcaatgccagcaagccttcaatgccacggctgtggtgcggcacatgaggaaactgcagctgggcaccagccaggaggggcaggggcagacggcgagccatggggagctgctgacaccagtggctggggggccggcagctggctgttgctgtcgagactgctgcgtggagccgggcacagaactgtcccccacactgccccaccagctctagggccctggacctcgggtcatgatcctctgcgtgggagggcttgggggcagcctgctccccttccctccctgaaccgggagtttctctgccctgtcccctcctcacctgcttccctaccactcctcactgcattttccatacaaatgtttctattttattgttccttcttgtaataaagggaagataaaacca

SEQ ID NO: 275779 - DNA, 1168 bp, Homo sapiens
ctggcataaaataggcattcaaacattcctttagggctttacagtgcacacctgaggtttagagacagttcccccccacaccctcttgagccttgtccttcctggaatttttggccttcttgagagcttccttgattttcttatgacagccatgaagccacagtggcttttggggatccattatttctcagaaggtgcttggagcggcagaaggttctaccagcctctaaccatctctgattgccccttctcttccctcctgcccttcaagccagagaatctgctgtactacagcctggatgaagactccaaaatcatgatctccgactttggcctctccaagatggaggacccgggcagtgtgctctccaccgcctgtggaactccgggatacgtgggtgcggagggccctgggctggggctgtgatggtggggggaaccaggagttgaagggcagagatttgtcaccaccacgtcctcttccctccacagcccctgaagtcctggcccagaagccctacagcaaggctgtggattgctggtccataggtgtcatcgcctacatcttgtaagtggggcttggccacggtaggctgtggctccagagttgtcctctcgcctactttcctctcttccttcctctgctctccctctgccctcccttccttccctccctcccttccttccaccaatcaattaccagtattacttcattcaatagatactatgtttcaagcactgtgccaagcaagcactggggtaaatttagcacagcacaaaccagacaaagtgcctgccctcagggagctgactttctttctagtagggaagacagacaatcaacaagtaaataaatctacaaactgacgtcaggtgataaaaataaatactgtggagaaaaaccaagcaggaatagggagacggggtgatgccatttcagtagggaggtcagggaagggctcgctgtggaggtgatgaccgagtggtgagggagccagacattggaggtgtggggaaagagtggcataggcagaagcaatggcaagtgcaaaggccctgaggagggcaagatggcggcacatacaaggaacagaaaggataatgtagctagaacaggagtgagcaggcagggctggtagagtttataaagggggaactccttccatgg

SEQ ID NO: 275780 - DNA, 2477 bp, Homo sapiens
aggcgggggagagagccgccgagccgagccgagccccagctccagcaagagcgcgggcgggtggcccaggcacgcagcggtgaggaccgcggccacagctcggcgccaaccaccgcgggcctcccagccagccccgcggcggggcagccgcaggagccctggctgtggtcggggggcagtgggccatgctgggggcagtggaaggccccaggtggaagcaggcggaggacattagagacatctacgacttccgagatgttctgggcacgggggccttctcggaggtgatcctggcagaagataagaggacgcagaagctggtggccatcaaatgcattgccaaggaggccctggagggcaaggaaggcagcatggagaatgagattgctgtcctgcacaagatcaagcaccccaacattgtagccctggatgacatctatgagagtgggggccacctctacctcatcatgcagctggtgtcgggtggggagctctttgaccgtattgtggaaaaaggcttctacacggagcgggacgccagccgcctcatcttccaggtgctggatgctgtgaaatacctgcatgacctgggcattgtacaccgggatctcaagccagagaatctgctgtactacagcctggatgaagactccaaaatcatgatctccgactttggcctctccaagatggaggacccgggcagtgtgctctccaccgcctgtggaactccgggatacgtggcccctgaagtcctggcccagaagccctacagcaaggctgtggattgctggtccataggtgtcatcgcctacatcttgctctgcggttaccctcccttctatgacgagaatgatgccaaactctttgaacagattttgaaggccgagtacgagtttgactctccttactgggacgacatctctgactctgccaaagatttcatccggcacttgatggagaaggacccagagaaaagattcacctgtgagcaggccttgcagcacccatggattgcaggagatacagctctagataagaatatccaccagtcggtgagtgagcagatcaagaagaactttgccaagagcaagtggaagcaagccttcaatgccacggctgtggtgcggcacatgaggaaactgcagctgggcaccagccaggaggggcaggggcagacggcgagccatggggagctgctgacaccagtggctggggggccggcagctggctgttgctgtcgagactgctgcgtggagccgggcacagaactgtcccccacactgccccaccagctctagggccctggacctcgggtcatgatcctctgcgtgggagggcttgggggcagcctgctccccttccctccctgaaccgggagtttctctgccctgtcccctcctcacctgcttccctaccactcctcactgcattttccatacaaatgtttctattttattgttccttcttgtaataaagggaagataaaaccaaaaaaaaaaaaaaaaaaaaaaaaaaaaaaaaaaaaaaaaaaacaagaaaacaacacaaaaaaaaaggaggcggcgcggcgcgagtaataagagagaaccccccgggagggggccaacagttgcagcggcacgaccgcacaggttttggtggtgaccaaagggggcgcccccaatagggagggaggcgcgattattataaggacgagacgacacgggcgcgcgcgggtttaacaacagcggcggaggagccggggagaaccagcggcgacaccccgggggagaccctctggggagagggacgcccctaactacagcgggggggggggggcagcaaatatggggggacaaaacctcccctcacaagagattaaagacgcctacaagggggagcaacttacaaacagtccacgagcggagcgcaacagcggcggggagaacaccaccacgccggcgaattcagccgcccggggcgcgggaagacaaatgcgtccgccgcgcccaccacggagagatatcgacgtatgtagacaggaaaattatattcccccagagaggcgcggataagacaataaacacggccacagacaagcacgcagcacgagaccagcccgcaggcgccagagagaaaagaggagagacaggggcgagacaaagaagaaagcaggcgacagagaacacaagaagaagagaagcacaaaaggcagcagagaggaagagaacaagacacgaacagcaccagacggaaagaaaaaaaacacaaaaagaccggcaagagcagaaaggagaaggacgcagaggagcaggcagaggacgggcacgaggaggaaggaacagcgagcgcaggaggaaagagggacgggagaagagagtacagaggccaaagaaaggaaggacaacaaccagaaaggggaggaagaagaggaaagcgtaaacgcaggagaggagtgagcaagacacagcgacggaggacgcggaggaggagcgcac

SEQ ID NO: 275781 - DNA, 1598 bp, Homo sapiens
aggcgggggagagagccgccgagccgagccgagccccagctccagcaagagcgcgggcgggtggcccaggcacgcagcggtgaggaccgcggccacagctcggcgccaaccaccgcgggcctcccagccagccccgcggcggggcagccgcaggagccctggctgtggtcggggggcagtgggccatgctgggggcagtggaaggccccaggtggaagcaggcggaggacattagagacatctacgacttccgagatgttctgggcacgggggccttctcggaggtgatcctggcagaagataagaggacgcagaagctggtggccatcaaatgcattgccaaggaggccctggagggcaaggaaggcagcatggagaatgagattgctgtcctgcacaagatcaagcaccccaacattgtagccctggatgacatctatgagagtgggggccacctctacctcatcatgcagctggtgtcgggtggggagctctttgaccgtattgtggaaaaaggcttctacacggagcgggacgccagccgcctcatcttccaggtgctggatgctgtgaaatacctgcatgacctgggcattgtacaccgggatctcaagccagagaatctgctgtactacagcctggatgaagactccaaaatcatgatctccgactttggcctctccaagatggaggacccgggcagtgtgctctccaccgcctgtggaactccgggatacgtggcccctgaagtcctggcccagaagccctacagcaaggctgtggattgctggtccataggtgtcatcgcctacatcttgctctgcggttaccctcccttctatgacgagaatgatgccaaactctttgaacagattttgaaggccgagtacgagtttgactctccttactgggacgacatctctgactctgccaaagatttcatccggcacttgatggagaaggacccagagaaaagattcacctgtgagcaggccttgcagcacccatggattgcaggagatacagctctagataagaatatccaccagtcggtgagtgagcagatcaagaagaactttgccaagagcaagtggaagcaagccttcaatgccacggctgtggtgcggcacatgaggaaactgcagctgggcaccagccaggaggggcaggggcagacggcgagccatggggagctgctgacaccagtggctgggggggtgaggagcgggctctgcagaagggcatgggtggtccacaaaggtgcacccgggctggagtggagggcctgccctgcggccacctctgttctgtcttcccatgcagggccggcagctggctgttgctgtcgagactgctgcgtggagccgggcacagaactgtcccccacactgccccaccagctctagggccctggacctcgggtcatgatcctctgcgtgggagggcttgggggcagcctgctccccttccctccctgaaccgggagtttctctgccctgtcccctcctcacctgcttccctaccactcctcactgcattttccatacaaatgtttctattttattgttccttcttgtaataaagggaagataaaacca

SEQ ID NO: 275782 - DNA, 1488 bp, Homo sapiens
catgccacttcatcacctctacaccacggctgcactttgtcttgaacgttgtaaagcagtgtcggccgaatctggatgcggcggtgccagcaccagcgtaggacgggcacagctgggcacacgcggctccagcagccgcgggggcagcgcagagccctggctgtggtcggggggcagtgggccatgctgggggcagtggaaggccccaggtggaagcaggcggaggacattagagacatctacgacttccgagatgttctgggcacgggggccttctcggaggtgatcctggcagaagataagaggacgcagaagctggtggccatcaaatgcattgccaaggaggccctggagggcaaggaaggcagcatggagaatgagattgctgtcctgcacaagatcaagcaccccaacattgtagccctggatgacatctatgagagtgggggccacctctacctcatcatgcagctggtgtcgggtggggagctctttgaccgtattgtggaaaaaggcttctacacggagcgggacgccagccgcctcatcttccaggtgctggatgctgtgaaatacctgcatgacctgggcattgtacaccgggatctcaagccagagaatctgctgtactacagcctggatgaagactccaaaatcatgatctccgactttggcctctccaagatggaggacccgggcagtgtgctctccaccgcctgtggaactccgggatacgtggcccctgaagtcctggcccagaagccctacagcaaggctgtggattgctggtccataggtgtcatcgcctacatcttgctctgcggttaccctcccttctatgacgagaatgatgccaaactctttgaacagattttgaaggccgagtacgagtttgactctccttactgggacgacatctctgactctgccaaagatttcatccggcacttgatggagaaggacccagagaaaagattcacctgtgagcaggccttgcagcacccatggattgcaggagatacagctctagataagaatatccaccagtcggtgagtgagcagatcaagaagaactttgccaagagcaagtggaagcaagccttcaatgccacggctgtggtgcggcacatgaggaaactgcagctgggcaccagccaggaggggcaggggcagacggcgagccatggggagctgctgacaccagtggctggggggccggcagctggctgttgctgtcgagactgctgcgtggagccgggcacagaactgtcccccacactgccccaccagctctagggccctggacctcgggtcatgatcctctgcgtgggagggcttgggggcagcctgctccccttccctccctgaaccgggagtttctctgccctgtcccctcctcacctgcttccctaccactcctcactgcattttccatacaaatgtttctattttattgttccttcttgtaataaagggaagataaaacca

SEQ ID NO: 275783 - DNA, 1528 bp, Homo sapiens
aggcgggggagagagccgccgagccgagccgagccccagctccagcaagagcgcgggcgggtggcccaggcacgcagcggtgaggaccgcggccacagctcggcgccaaccaccgcgggcctcccagccagccccgcggcggggcagccgcaggagccctggctgtggtcggggggcagtgggccatgctgggggcagtggaaggccccaggtggaagcaggcggaggacattagagacatctacgacttccgagatgttctgggcacgggggccttctcggaggtgatcctggcagaagataagaggacgcagaagctggtggccatcaaatgcattgccaaggaggccctggagggcaaggaaggcagcatggagaatgagattgctgtcctgcacaagatcaagcaccccaacattgtagccctggatgacatctatgagagtgggggccacctctacctcatcatgcagctggtgtcgggtggggagctctttgaccgtattgtggaaaaaggcttctacacggagcgggacgccagccgcctcatcttccaggtgctggatgctgtgaaatacctgcatgacctgggcattgtacaccgggatctcaagccagagaatctgctgtactacagcctggatgaagactccaaaatcatgatctccgactttggcctctccaagatggaggacccgggcagtgtgctctccaccgcctgtggaactccgggatacgtggcccctgaagtcctggcccagaagccctacagcaaggctgtggattgctggtccataggtgtcatcgcctacatcttgctctgcggttaccctcccttctatgacgagaatgatgccaaactctttgaacagattttgaaggccgagtacgagtttgactctccttactgggacgacatctctgactctgccaaagatttcatccggcacttgatggagaaggacccagagaaaagattcacctgtgagcaggccttgcagcacccatggattgcaggagatacagctctagataagaatatccaccagtcggtgagtgagcagatcaagaagaactttgccaagagcaagtggaagtcctttctcccctctcccttcaatgccttcaatgccagcaagccttcaatgccacggctgtggtgcggcacatgaggaaactgcagctgggcaccagccaggaggggcaggggcagacggcgagccatggggagctgctgacaccagtggctggggggccggcagctggctgttgctgtcgagactgctgcgtggagccgggcacagaactgtcccccacactgccccaccagctctagggccctggacctcgggtcatgatcctctgcgtgggagggcttgggggcagcctgctccccttccctccctgaaccgggagtttctctgccctgtcccctcctcacctgcttccctaccactcctcactgcattttccatacaaatgtttctattttattgttccttcttgtaataaagggaagataaaacca

SEQ ID NO: 275784 - DNA, 1455 bp, Homo sapiens
gaaaacacagacagataggaccaagacacgcaacaggatgagagaccagaggagcaaagactcagcgccaaccaccgtgagcctcccagaccagaccccgcgagcggggcagtcgcaagagccctggctgtggtcggggggcagtgggccatgctgggggcagtggaaggccccaggtggaagcaggcggaggacattagagacatctacgacttccgagatgttctgggcacgggggccttctcggaggtgatcctggcagaagataagaggacgcagaagctggtggccatcaaatgcattgccaaggaggccctggagggcaaggaaggcagcatggagaatgagattgctgtcctgcacaagatcaagcaccccaacattgtagccctggatgacatctatgagagtgggggccacctctacctcatcatgcagctggtgtcgggtggggagctctttgaccgtattgtggaaaaaggcttctacacggagcgggacgccagccgcctcatcttccaggtgctggatgctgtgaaatacctgcatgacctgggcattgtacaccgggatctcaagccagagaatctgctgtactacagcctggatgaagactccaaaatcatgatctccgactttggcctctccaagatggaggacccgggcagtgtgctctccaccgcctgtggaactccgggatacgtggcccctgaagtcctggcccagaagccctacagcaaggctgtggattgctggtccataggtgtcatcgcctacatcttgctctgcggttaccctcccttctatgacgagaatgatgccaaactctttgaacagattttgaaggccgagtacgagtttgactctccttactgggacgacatctctgactctgccaaagatttcatccggcacttgatggagaaggacccagagaaaagattcacctgtgagcaggccttgcagcacccatggattgcaggagatacagctctagataagaatatccaccagtcggtgagtgagcagatcaagaagaactttgccaagagcaagtggaagcaagccttcaatgccacggctgtggtgcggcacatgaggaaactgcagctgggcaccagccaggaggggcaggggcagacggcgagccatggggagctgctgacaccagtggctggggggccggcagctggctgttgctgtcgagactgctgcgtggagccgggcacagaactgtcccccacactgccccaccagctctagggccctggacctcgggtcatgatcctctgcgtgggagggcttgggggcagcctgctccccttccctccctgaaccgggagtttctctgccctgtcccctcctcacctgcttccctaccactcctcactgcattttccatacaaatgtttctattttattgttccttcttgtaataaagggaagataaaacca

SEQ ID NO: 275785 - DNA, 1358 bp, Homo sapiens
aggcgggggagagagccgccgagccgagccgagccccagctccagcaagagcgcgggcgggtggcccaggcacgcagcggtgaggaccgcggccacagctcggcgccaaccaccgcgggcctcccagccagccccgcggcggggcagccgcaggagccctggctgtggtcggggggcagtgggccatgctgggggcagtggaaggccccaggtggaagcaggcggaggacattagagacatctacgacttccgagatgttctgggcacgatcaagcaccccaacattgtagccctggatgacatctatgagagtgggggccacctctacctcatcatgcagctggtgtcgggtggggagctctttgaccgtattgtggaaaaaggcttctacacggagcgggacgccagccgcctcatcttccaggtgctggatgctgtgaaatacctgcatgacctgggcattgtacaccgggatctcaagccagagaatctgctgtactacagcctggatgaagactccaaaatcatgatctccgactttggcctctccaagatggaggacccgggcagtgtgctctccaccgcctgtggaactccgggatacgtggcccctgaagtcctggcccagaagccctacagcaaggctgtggattgctggtccataggtgtcatcgcctacatcttgctctgcggttaccctcccttctatgacgagaatgatgccaaactctttgaacagattttgaaggccgagtacgagtttgactctccttactgggacgacatctctgactctgccaaagatttcatccggcacttgatggagaaggacccagagaaaagattcacctgtgagcaggccttgcagcacccatggattgcaggagatacagctctagataagaatatccaccagtcggtgagtgagcagatcaagaagaactttgccaagagcaagtggaagcaagccttcaatgccacggctgtggtgcggcacatgaggaaactgcagctgggcaccagccaggaggggcaggggcagacggcgagccatggggagctgctgacaccagtggctggggggccggcagctggctgttgctgtcgagactgctgcgtggagccgggcacagaactgtcccccacactgccccaccagctctagggccctggacctcgggtcatgatcctctgcgtgggagggcttgggggcagcctgctccccttccctccctgaaccgggagtttctctgccctgtcccctcctcacctgcttccctaccactcctcactgcattttccatacaaatgtttctattttattgttccttcttgtaataaagggaagataaaacca

SEQ ID NO: 275786 - DNA, 1513 bp, Homo sapiens
aggcgggggagagagccgccgagccgagccgagccccagctccagcaagagcgcgggcgggtggcccaggcacgcagcggtgaggaccgcggccacagctcggcgccaaccaccgcgggcctcccagccagccccgcggcggggcagccgcaggagccctggctgtggtcggggggcagtgggccatgctgggggcagtggaaggccccaggtggaagcaggcggaggacattagagacatctacgacttccgagatgttctgggcacgggggccttctcggaggtgatcctggcagaagataagaggacgcagaagctggtggccatcaaatgcattgccaaggaggccctggagggcaaggaaggcagcatggagaatgagattgctgtcctgcacaagatcaagcaccccaacattgtagccctggatgacatctatgagagtgggggccacctctacctcatcatgcagctggtgtcgggtggggagctctttgaccgtattgtggaaaaaggcttctacacggagcgggacgccagccgcctcatcttccaggtgctggatgctgtgaaatacctgcatgacctgggcattgtacaccgggatctcaagccagagaatctgctgtactacagcctggatgaagactccaaaatcatgatctccgactttggcctctccaagatggaggacccgggcagtgtgctctccaccgcctgtggaactccgggatacgtggcccctgaagtcctggcccagaagccctacagcaaggctgtggattgctggtccataggtgtcatcgcctacatcttgctctgcggttaccctcccttctatgacgagaatgatgccaaactctttgaacagattttgaaggccgagtacgagtttgactctccttactgggacgacatctctgactctgccaaagatttcatccggcacttgatggagaaggacccagagaaaagattcacctgtgagcaggccttgcagcacccatggtgagaattcacacaacctgtgagctggggcgggatttggggccctcaggtctgcttctgccctcataggcaacccaccacataaccccatcctaggattgcaggagatacagctctagataagaatatccaccagtcggtgagtgagcagatcatgatctccgactttggcctctccaagatggaggacccgggcagtgtgctctccaccgcctgtggaactctggggggccggcagctggctgttgctgtcgagactgctgcgtggagccgggcacagaactgtcccccacactgccccaccagctctagggccctggacctcgggtcatgatcctctgcgtgggagggcttgggggcagcctgctccccttccctccctgaaccgggagtttctctgccctgtcccctcctcacctgcttccctaccactcctcactgcattttccatacaaatgtttctattttattgttccttcttgtaataaagggaagataaaacca

SEQ ID NO: 275787 - DNA, 1241 bp, Homo sapiens
ctggcataaaataggcattcaaacattcctttagggctttacagtgcacacctgaggtttagagacagttcccccccacaccctcttgagccttgtccttcctggaatttttggccttcttgagagcttccttgattttcttatgacagccatgaagccacagtggcttttggggatccattatttctcagaaggtgcttggagcggcagaaggttctaccagcctctaaccatctctgattgccccttctcttccctcctgcccttcaagccagagaatctgctgtactacagcctggatgaagactccaaaatcatgatctccgactttggcctctccaagatggaggacccgggcagtgtgctctccaccgcctgtggaactccgggatacgtgggtgcggagggccctgggctggggctgtgatggtggggggaaccaggagttgaagggcagagatttgtcaccaccacgtcctcttccctccacagcccctgaagtcctggcccagaagccctacagcaaggctgtggattgctggtccataggtgtcatcgcctacatcttgctctgcggttaccctcccttctatgacgagaatgatgccaaactctttgaacagattttgaaggccgagtacgagtttgactctccttactgggacgacatctctgactctgccaaagatttcatccggcacttgatggagaaggacccagagaaaagattcacctgtgagcaggccttgcagcacccatggattgcaggagatacagctctagataagaatatccaccagtcggtgagtgagcagatcaagaagaactttgccaagagcaagtggaagcaagccttcaatgccacggctgtggtgcggcacatgaggaaactgcagctgggcaccagccaggaggggcaggggcagacggcgagccatggggagctgctgacaccagtggctggggggccggcagctggctgttgctgtcgagactgctgcgtggagccgggcacagaactgtcccccacactgccccaccagctctagggccctggacctcgggtcatgatcctctgcgtgggagggcttgggggcagcctgctccccttccctccctgaaccgggagtttctctgccctgtcccctcctcacctgcttccctaccactcctcactgcattttccatacaaatgtttctattttattgttccttcttgtaataaagggaagataaaacca

SEQ ID NO: 275788 - DNA, 1052 bp, Homo sapiens
gagacgcagtctcgctctgttgcccaggctggagtgcagtggcacaatctcggctcactgcaacctctgtctcccgggttcgagcaattctctgcctcagcctcccaagtagctgggattacaggcgcccaccaccatgcccggctaattttttttgtatttttagtagaaacaaggtttcaccatcttggccaggctggtcttgaactcctgacctcgtgatccacctgcattggcctcccaaagtgctgggattacagacatgagccactgtgcccggccatatgtttttcttaagagagaaaggaaagagctggaaggcacggggtgggagggcctgaagaagagcataggttgggtggggtggggcatggactgatttggcctctttgtcttgatgccaggccagacctgagggagtgggtatgctcttggggagtacacaggcagtaccatgctgtcattatctttgcttttgtcttgggggtttagccaaagatttcatccggcacttgatggagaaggacccagagaaaagattcacctgtgagcaggccttgcagcacccatggattgcaggagatacagctctagataagaatatccaccagtcggtgagtgagcagatcaagaagaactttgccaagagcaagtggaagcaagccttcaatgccacggctgtggtgcggcacatgaggaaactgcagctgggcaccagccaggaggggcaggggcagacggcgagccatggggagctgctgacaccagtggctggggggccggcagctggctgttgctgtcgagactgctgcgtggagccgggcacagaactgtcccccacactgccccaccagctctagggccctggacctcgggtcatgatcctctgcgtgggagggcttgggggcagcctgctccccttccctccctgaaccgggagtttctctgccctgtcccctcctcacctgcttccctaccactcctcactgcattttccatacaaatgtttctattttattgttccttcttgtaataaagggaagataaaacca

SEQ ID NO: 275789 - DNA, 1148 bp, Homo sapiens
gagacgcagtctcgctctgttgcccaggctggagtgcagtggcacaatctcggctcactgcaacctctgtctcccgggttcgagcaattctctgcctcagcctcccaagtagctgggattacaggcgcccaccaccatgcccggctaattttttttgtatttttagtagaaacaaggtttcaccatcttggccaggctggtcttgaactcctgacctcgtgatccacctgcattggcctcccaaagtgctgggattacagacatgagccactgtgcccggccatatgtttttcttaagagagaaaggaaagagctggaaggcacggggtgggagggcctgaagaagagcataggttgggtggggtggggcatggactgatttggcctctttgtcttgatgccaggccagacctgagggagtgggtatgctcttggggagtacacaggcagtaccatgctgtcattatctttgcttttgtcttgggggtttagccaaagatttcatccggcacttgatggagaaggacccagagaaaagattcacctgtgagcaggccttgcagcacccatggtgagaattcacacaacctgtgagctggggcgggatttggggccctcaggtctgcttctgccctcataggcaacccaccacataaccccatcctaggattgcaggagatacagctctagataagaatatccaccagtcggtgagtgagcagatcaagaagaactttgccaagagcaagtggaagcaagccttcaatgccacggctgtggtgcggcacatgaggaaactgcagctgggcaccagccaggaggggcaggggcagacggcgagccatggggagctgctgacaccagtggctggggggccggcagctggctgttgctgtcgagactgctgcgtggagccgggcacagaactgtcccccacactgccccaccagctctagggccctggacctcgggtcatgatcctctgcgtgggagggcttgggggcagcctgctccccttccctccctgaaccgggagtttctctgccctgtcccctcctcacctgcttccctaccactcctcactgcattttccatacaaatgtttctattttattgttccttcttgtaataaagggaagataaaacca

SEQ ID NO: 275790 - DNA, 1039 bp, Homo sapiens
catgccacttcatcacctctacaccacggctgcactttgtcttgaacgttgtaaagcagtgtcggccgaatctggatgcggcggtgccagcaccagcgtaggacgggcacagctgggcacacgcggctccagcagccgcgggggcagcgcagagccctggctgtggtcggggggcagtgggccatgctgggggcagtggaaggccccaggtggaagcaggcggaggacattagagacatctacgacttccgagatgttctgggcacgctctccccaggtggtggcaaagatgatcgccattagctccaggcttacatcctaccagctcaacaggagactcattctcaaagtgctagtaagctggcttgcaatcacatgaccaattactgtggccaggggagagactactttgactggccaggcctgggtcatgtgaccatctctggagccaggggatggatgagtgactaggggagggtcatccacgtccttggtccagcagtggtcacagaacccatagggaatggaggagaggctggagggaagctggggttccagttcttcaccttgtgaatcccctctcccgataggggggccttctcggaggtgatcctggcagaagataagaggacgcagaagctggtggccatcaaatgcattgccaaggaggccctggagggcaaggaaggcagcatggagaatgagattgctgtcctgcacaagtgcgtgggccacagcctttccctgccccaagctgaccctgccttggccctcccatcctcctcctttcctgctttggacaaatcatttaaactctctaagccttaaattgcccctttataaaatggggatcacaatttccacttggcagggttgtggggaacatcagaagtcctttatttcaagtgcctggcctaacatgacagatgtgatggaggtgccagtgcttagtcacaggggtttaactgttcaatcaggtgtaaagatccatcctgaacatggcttggacccacatatctcagttggtgttgtctctgga

SEQ ID NO: 275791 - DNA, 272 bp, Homo sapiens
ttgttgaatgattttgtcaaatggatgaatcaaggatgaataaatgcaggttgaatgactgaatggggcctgcagtaaattcccagacagagggctgggctctgctgagtctcctccttccattctccttacaggagccctggctgtggtcggggggcagtgggccatgctgggggcagtggaaggccccaggtggaagcaggcggaggacattagagacatctacgacttccgagatgttctgggcacgtgagtccagggcaggattgggt

SEQ ID NO: 275792 - DNA, 1490 bp, Homo sapiens
aggcgggggagagagccgccgagccgagccgagccccagctccagcaagagcgcgggcgggtggcccaggcacgcagcggtgaggaccgcggccacagctcggcgccaaccaccgcgggcctcccagccagccccgcggcggggcagccgcaggagccctggctgtggtcggggggcagtgggccatgctgggggcagtggaaggccccaggtggaagcaggcggaggacattagagacatctacgacttccgagatgttctgggcacgggggccttctcggaggtgatcctggcagaagataagaggacgcagaagctggtggccatcaaatgcattgccaaggaggccctggagggcaaggaaggcagcatggagaatgagattgctgtcctgcacaagatcaagcaccccaacattgtagccctggatgacatctatgagagtgggggccacctctacctcatcatgcagctggtgtcgggtggggagctctttgaccgtattgtggaaaaaggcttctacacggagcgggacgccagccgcctcatcttccaggtgctggatgctgtgaaatacctgcatgacctgggcattgtacaccgggatctcaagccagagaatctgctgtactacagcctggatgaagactccaaaatcatgatctccgactttggcctctccaagatggaggacccgggcagtgtgctctccaccgcctgtggaactccgggatacgtggcccctgaagtcctggcccagaagccctacagcaaggctgtggattgctggtccataggtgtcatcgcctacatcttgctctgcggttaccctcccttctatgacgagaatgatgccaaactctttgaacagattttgaaggccgagtacgagtttgactctccttactgggacgacatctctgactctgccaaagatttcatccggcacttgatggagaaggacccagagaaaagattcacctgtgagcaggccttgcagcacccatggattgcaggagatacagctctagataagaatatccaccagtcggtgagtgagcagatcaagaagaactttgccaagagcaagtggaagcaagccttcaatgccacggctgtggtgcggcacatgaggaaactgcagctgggcaccagccaggaggggcaggggcagacggcgagccatggggagctgctgacaccagtggctggggggccggcagctggctgttgctgtcgagactgctgcgtggagccgggcacagaactgtcccccacactgccccaccagctctagggccctggacctcgggtcatgatcctctgcgtgggagggcttgggggcagcctgctccccttccctccctgaaccgggagtttctctgccctgtcccctcctcacctgcttccctaccactcctcactgcattttccatacaaatgtttctattttattgttccttcttgtaataaagggaagataaaacca

SEQ ID NO: 275793 - DNA, 1586 bp, Homo sapiens
aggcgggggagagagccgccgagccgagccgagccccagctccagcaagagcgcgggcgggtggcccaggcacgcagcggtgaggaccgcggccacagctcggcgccaaccaccgcgggcctcccagccagccccgcggcggggcagccgcaggagccctggctgtggtcggggggcagtgggccatgctgggggcagtggaaggccccaggtggaagcaggcggaggacattagagacatctacgacttccgagatgttctgggcacgggggccttctcggaggtgatcctggcagaagataagaggacgcagaagctggtggccatcaaatgcattgccaaggaggccctggagggcaaggaaggcagcatggagaatgagattgctgtcctgcacaagatcaagcaccccaacattgtagccctggatgacatctatgagagtgggggccacctctacctcatcatgcagctggtgtcgggtggggagctctttgaccgtattgtggaaaaaggcttctacacggagcgggacgccagccgcctcatcttccaggtgctggatgctgtgaaatacctgcatgacctgggcattgtacaccgggatctcaagccagagaatctgctgtactacagcctggatgaagactccaaaatcatgatctccgactttggcctctccaagatggaggacccgggcagtgtgctctccaccgcctgtggaactccgggatacgtggcccctgaagtcctggcccagaagccctacagcaaggctgtggattgctggtccataggtgtcatcgcctacatcttgctctgcggttaccctcccttctatgacgagaatgatgccaaactctttgaacagattttgaaggccgagtacgagtttgactctccttactgggacgacatctctgactctgccaaagatttcatccggcacttgatggagaaggacccagagaaaagattcacctgtgagcaggccttgcagcacccatggtgagaattcacacaacctgtgagctggggcgggatttggggccctcaggtctgcttctgccctcataggcaacccaccacataaccccatcctaggattgcaggagatacagctctagataagaatatccaccagtcggtgagtgagcagatcaagaagaactttgccaagagcaagtggaagcaagccttcaatgccacggctgtggtgcggcacatgaggaaactgcagctgggcaccagccaggaggggcaggggcagacggcgagccatggggagctgctgacaccagtggctggggggccggcagctggctgttgctgtcgagactgctgcgtggagccgggcacagaactgtcccccacactgccccaccagctctagggccctggacctcgggtcatgatcctctgcgtgggagggcttgggggcagcctgctccccttccctccctgaaccgggagtttctctgccctgtcccctcctcacctgcttccctaccactcctcactgcattttccatacaaatgtttctattttattgttccttcttgtaataaagggaagataaaacca

SEQ ID NO: 275794 - DNA, 1779 bp, Homo sapiens
aggcgggggagagagccgccgagccgagccgagccccagctccagcaagagcgcgggcgggtggcccaggcacgcagcggtgaggaccgcggccacagctcggcgccaaccaccgcgggcctcccagccagccccgcggcggggcagccgcaggagccctggctgtggtcggggggcagtgggccatgctgggggcagtggaaggccccaggtggaagcaggcggaggacattagagacatctacgacttccgagatgttctgggcacgggggccttctcggaggtgatcctggcagaagataagaggacgcagaagctggtggccatcaaatgcattgccaaggaggccctggagggcaaggaaggcagcatggagaatgagattgctgtcctgcacaagatcaagcaccccaacattgtagccctggatgacatctatgagagtgggggccacctctacctcatcatgcagctggtgtcgggtggggagctctttgaccgtattgtggaaaaaggcttctacacggagcgggacgccagccgcctcatcttccaggtgctggatgctgtgaaatacctgcatgacctgggcattgtacaccgggatctcaagccagagaatctgctgtactacagcctggatgaagactccaaaatcatgatctccgactttggcctctccaagatggaggacccgggcagtgtgctctccaccgcctgtggaactccgggatacgtggcccctgaagtcctggcccagaagccctacagcaaggctgtggattgctggtccataggtgtcatcgcctacatcttgctctgcggttaccctcccttctatgacgagaatgatgccaaactctttgaacagattttgaaggccgagtacgagtttgactctccttactgggacgacatctctgactctgccaaagatttcatccggcacttgatggagaaggacccagagaaaagattcacctgtgagcaggccttgcagcacccatggattgcaggagatacagctctagataagaatatccaccagtcggtgagtgagcagatcaagaagaactttgccaagagcaagtggaagcaagccttcaatgccacggctgtggtgcggcacatgaggaaactgcagctgggcaccagccaggaggggcaggggcagacggcgagccatggggagctgctgacaccagtggctggggggccggcagctggctgttgctgtcgagactgctgcgtggagccgggcacagaactgtcccccacactgccccaccagctctagggccctggacctcgggtcatgatcctctgcgtgggagggcttgggggcagcctgctccccttccctccctgaaccgggagtttctctgccctgtcccctcctcacctgcttccctaccactcctcactgcattttccatacaaatgtttctattttattgttccttcttgtaataaagggaagataaaaccatagataaaaatataatattttaaatataggggatttatatgggtaaatatattttaaaattatctcgggggggggccgggcacccaattggccctatggggaggcgttttacatttcattggccgccgtttaacaaccgccggattggaaaaacccgggggttccccaacttaattgcctgggagcacaatcccctttttgccaggtgggggtaaatactgaaagaggccggaccattcgctcttctcaacaattgggcaacctgaatggggaagtggcaaattgtagg

SEQ ID NO: 275795 - DNA, 1579 bp, Homo sapiens
aggcgggggagagagccgccgagccgagccgagccccagctccagcaagagcgcgggcgggtggcccaggcacgcagcggtgaggaccgcggccacagctcggcgccaaccaccgcgggcctcccagccagccccgcggcggggcagccgcaggagccctggctgtggtcggggggcagtgggccatgctgggggcagtggaaggccccaggtggaagcaggcggaggacattagagacatctacgacttccgagatgttctgggcacgctctccccaggtggtggcaaagatgatcgccattagctccaggcttacatcctaccagctcaacaggagactcattctcaaagtgctagggggccttctcggaggtgatcctggcagaagataagaggacgcagaagctggtggccatcaaatgcattgccaaggaggccctggagggcaaggaaggcagcatggagaatgagattgctgtcctgcacaagatcaagcaccccaacattgtagccctggatgacatctatgagagtgggggccacctctacctcatcatgcagctggtgtcgggtggggagctctttgaccgtattgtggaaaaaggcttctacacggagcgggacgccagccgcctcatcttccaggtgctggatgctgtgaaatacctgcatgacctgggcattgtacaccgggatctcaagccagagaatctgctgtactacagcctggatgaagactccaaaatcatgatctccgactttggcctctccaagatggaggacccgggcagtgtgctctccaccgcctgtggaactccgggatacgtggcccctgaagtcctggcccagaagccctacagcaaggctgtggattgctggtccataggtgtcatcgcctacatcttgctctgcggttaccctcccttctatgacgagaatgatgccaaactctttgaacagattttgaaggccgagtacgagtttgactctccttactgggacgacatctctgactctgccaaagatttcatccggcacttgatggagaaggacccagagaaaagattcacctgtgagcaggccttgcagcacccatggattgcaggagatacagctctagataagaatatccaccagtcggtgagtgagcagatcaagaagaactttgccaagagcaagtggaagcaagccttcaatgccacggctgtggtgcggcacatgaggaaactgcagctgggcaccagccaggaggggcaggggcagacggcgagccatggggagctgctgacaccagtggctggggggccggcagctggctgttgctgtcgagactgctgcgtggagccgggcacagaactgtcccccacactgccccaccagctctagggccctggacctcgggtcatgatcctctgcgtgggagggcttgggggcagcctgctccccttccctccctgaaccgggagtttctctgccctgtcccctcctcacctgcttccctaccactcctcactgcattttccatacaaatgtttctattttattgttccttcttgtaataaagggaagataaaacca

SEQ ID NO: 275796 - DNA, 1413 bp, Homo sapiens
aggcgggggagagagccgccgagccgagccgagccccagctccagcaagagcgcgggcgggtggcccaggcacgcagcggtgaggaccgcggccacagctcggcgccaaccaccgcgggcctcccagccagccccgcggcggggcagccgcaggagccctggctgtggtcggggggcagtgggccatgctgggggcagtggaaggccccaggtggaagcaggcggaggacattagagacatctacgacttccgagatgttctgggcacgggggccttctcggaggtgatcctggcagaagataagaggacgcagaagctggtggccatcaaatgcattgccaaggaggccctggagggcaaggaaggcagcatggagaatgagattgctgtcctgcacaagatcaagcaccccaacattgtagccctggatgacatctatgagagtgggggccacctctacctcatcatgcagctggtgtcgggtggggagctctttgaccgtattgtggaaaaaggcttctacacggagcgggacgccagccgcctcatcttccaggtgctggatgctgtgaaatacctgcatgacctgggcattgtacaccgggatctcaagccagagaatctgctgtactacagcctggatgaagactccaaaatcatgatctccgactttggcctctccaagatggaggacccgggcagtgtgctctccaccgcctgtggaactccgggatacgtggcccctgaagtcctggcccagaagccctacagcaaggctgtggattgctggtccataggtgtcatcgcctacatcttgctctgcggttaccctcccttctatgacgagaatgatgccaaactctttgaacagattttgaaggccgagtacgagtttgactctccttactgggacgacatctctgactctgccaaagatttcatccggcacttgatggagaaggacccagagaaaagattcacctgtgagcaggccttgcagcacccatggattgcaggagatacagctctagataagaatatccaccagtcggtgagtgagcagatcaagaagaactttgccaagagcaagtggaagcaagccttcaatgccacggctgtggtgcggcacatgaggaaactgcagctgggcaccagccaggaggggcaggggcagacggcgagccatggggagctgctgacaccagtggctggggctctagggccctggacctcgggtcatgatcctctgcgtgggagggcttgggggcagcctgctccccttccctccctgaaccgggagtttctctgccctgtcccctcctcacctgcttccctaccactcctcactgcattttccatacaaatgtttctattttattgttccttcttgtaataaagggaagataaaacca

SEQ ID NO: 275797 - DNA, 1417 bp, Homo sapiens
aggcgggggagagagccgccgagccgagccgagccccagctccagcaagagcgcgggcgggtggcccaggcacgcagcggtgaggaccgcggccacagctcggcgccaaccaccgcgggcctcccagccagccccgcggcggggcagccgcaggagccctggctgtggtcggggggcagtgggccatgctgggggcagtggaaggccccaggtggaagcaggcggaggacattagagacatctacgacttccgagatgttctgggcacgggggccttctcggaggtgatcctggcagaagataagaggacgcagaagctggtggccatcaaatgcattgccaaggaggccctggagggcaaggaaggcagcatggagaatgagattgctgtcctgcacaagatcaagcaccccaacattgtagccctggatgacatctatgagagtgggggccacctctacctcatcatgcagctggtgtcgggtggggagctctttgaccgtattgtggaaaaaggcttctacacggagcgggacgccagccgcctcatcttccaggtgctggatgctgtgaaatacctgcatgacctgggcattgtacaccgggatctcaagccagagaatctgctgtactacagcctggatgaagactccaaaatcatgatctccgactttggcctctccaagatggaggacccgggcagtgtgctctccaccgcctgtggaactccgggatacgtggcccctgaagtcctggcccagaagccctacagcaaggctgtggattgctggtccataggtgtcatcgcctacatcttgctctgcggttaccctcccttctatgacgagaatgatgccaaactctttgaacagattttgaaggccgagtacgagtttgactctccttactgggacgacatctctgactctgccaaagatttcatccggcacttgatggagaaggacccagagaaaagattcacctgtgagcaggccttgcagcacccatggattgcaggagatacagctctagataagaatatccaccagtcggtgagtgagcagatcatgatctccgactttggcctctccaagatggaggacccgggcagtgtgctctccaccgcctgtggaactctggggggccggcagctggctgttgctgtcgagactgctgcgtggagccgggcacagaactgtcccccacactgccccaccagctctagggccctggacctcgggtcatgatcctctgcgtgggagggcttgggggcagcctgctccccttccctccctgaaccgggagtttctctgccctgtcccctcctcacctgcttccctaccactcctcactgcattttccatacaaatgtttctattttattgttccttcttgtaataaagggaagataaaacca

SEQ ID NO: 275798 - DNA, 760 bp, Homo sapiens
atgatcgagctgcaggacattcatggcttgagaatggccgacgtaggacatggattgctggtccataggtgtcatcgcctacatcttgctctgcggttaccctcccttctatgacgagaatgatgccaaactctttgaacagattttgaaggccgagtacgagtttgactctccttactgggacgacatctctgactctgccaaagatttcatccggcacttgatggagaaggacccagagaaaagattcacctgtgagcaggccttgcagcacccatggattgcaggagatacagctctagataagaatatccaccagtcggtgagtgagcagatcaagaagaactttgccaagagcaagtggaagcaagccttcaatgccacggctgtggtgcggcacatgaggaaactgcagctgggcaccagccaggaggggcaggggcagacggcgagccatggggagctgctgacaccagtggctggggggccggcagctggctgttgctgtcgagactgctgcgtggagccgggcacagaactgtcccccacactgccccaccagctctagggccctggacctcgggtcatgatcctctgcgtgggagggcttgggggcagcctgctccccttccctccctgaaccgggagtttctctgccctgtcccctcctcacctgcttccctaccactcctcactgcattttccatacaaatgtttctattttattgttccttcttgtaataaagggaagataaaacca

SEQ ID NO: 275799 - DNA, 1417 bp, Homo sapiens
aggcgggggagagagccgccgagccgagccgagccccagctccagcaagagcgcgggcgggtggcccaggcacgcagcggtgaggaccgcggccacagctcggcgccaaccaccgcgggcctcccagccagccccgcggcggggcagccgcaggagccctggctgtggtcggggggcagtgggccatgctgggggcagtggaaggccccaggtggaagcaggcggaggacattagagacatctacgacttccgagatgttctgggcacgggggccttctcggaggtgatcctggcagaagataagaggacgcagaagctggtggccatcaaatgcattgccaaggaggccctggagggcaaggaaggcagcatggagaatgagattgctgtcctgcacaagatcaagcaccccaacattgtagccctggatgacatctatgagagtgggggccacctctacctcatcatgcagctggtgtcgggtggggagctctttgaccgtattgtggaaaaaggcttctacacggagcgggacgccagccgcctcatcttccaggtgctggatgctgtgaaatacctgcatgacctgggcattgtacaccgggatctcaagccagagaatctgctgtactacagcctggatgaagactccaaaatcatgatctccgactttggcctctccaagatggaggacccgggcagtgtgctctccaccgcctgtggaactccgggatacgtggcccctgaagtcctggcccagaagccctacagcaaggctgtggattgctggtccataggtgtcatcgcctacatcttgtaagtggggcttggccacggtaggctgtggctccagagttgtcctctcgcctactttcctctcttccttcctctgctctccctctgccctcccttccttccctccctcccttccttccaccaatcaattaccagtattacttcattcaatagatactatgtttcaagcactgtgccaagcaagcactggggtaaatttagcacagcacaaaccagacaaagtgcctgccctcagggagctgactttctttctagtagggaagacagacaatcaacaagtaaataaatctacaaactgacgtcaggtgataaaaataaatactgtggagaaaaaccaagcaggaatagggagacggggtgatgccatttcagtagggaggtcagggaagggctcgctgtggaggtgatgaccgagtggtgagggagccagacattggaggtgtggggaaagagtggcataggcagaagcaatggcaagtgcaaaggccctgaggagggcaagatggcggcacatacaaggaacagaaaggataatgtagctagaacaggagtgagcaggcagggctggtagagtttataaagggggaactccttccatgg
